United States Patent 7,314,974 (EXPRESSION OF MICROBIAL PROTEINS IN PLANTS FOR PRODUCTION OF PLANTS WITH IMPROVED PROPERTIES) - sequence listing, part 3

SEQ ID NO: 6478 - protein, 847 aa, Caenorhabditis elegans
MCAQSCSNASGARAVQNVSFSGSINTTLFLILARYSLDFAHCQVFYVVSLHVLIIHLRNLFFSNNVNFTSSSFQMFFSKAGKAAVEWAKGSKVPYKEFALTLEKIEELSGKKKVDELAQFFTKVLDFSPDDLTACVYMSVNQLGPSYEGLELGVAENSLIKAVAKATGRTEGKIKEDLRAKGDLGTVAQQSRSNQKMLAVPKALTVPTVFNKLTEIAKLSGTSAMNKKVDAISALLIACQGIEARFLVRMLAGKMRIGLGEQSVLSALGHAFTLSKITDQKVRGDKLDSLKDANVKRVKTAYCECPNYNRLIEVALTEGVEALVEKCKLSPGIPLKPMLAHPTKGIDEIMRRFRNQTMTCEWKYDGERGQIHKREDGQIFIYSRNQENNTTKYPDIIEKISSCIGDGVTSFIVDAEVVAIDEAGLILPFQVLSTRKRKNATDDNGVKVVVFLFDLLYFNGEPLVRKPLRKRRELLRTNFKKIDGSFYFATSVDTNDTDEINSFFDEAVQNKCEGLMIKTLDTEATYEISRRSHSWLKMKKDYVDGVGDTLDLVVMGAYSGVGKRTGVYGGYLLGCYNPTTEEYESVCKIGTGFTDEDLAEQYKILQDKKIDKSPSYYQFDHTLKPDDTFSPYLVFEVKCADITISPRHKAASGLTDDGKGISLRFPRFLRIRDDKNSDDATSSEQVLEMYKNQEAFANQKIEKADAVDEDDEFEEKEDEEEELNMTNVSEGSSKENPVKEEIKKETPKSVSPKKFEKKPPVKSSPVNKSPVKSSPIKKEAEKKKGPVASIFSSSTKKNEKDVKVESPSPIRKKKLPSDSDESDEETSTNKKQPAKKRSRVAIDSDSD

SEQ ID NO: 6479 - protein, 336 aa, Caenorhabditis elegans
MSTFCNYCQRSTKEMFHLIDFSDLFNKYFTFSKRTLLENVSKWIQRVDGRQDIEKQYEIGAIIGKGNFSSVHLTRRKEDGTKCALKVRYQSTLQFSFPSKFFQQVEKRAMRGKCFFVDNEVEMLSLIQHDHIISIIDAFSTENQYFIVFEHAQYGDLYETIRKNGRIEEPDAAIITLQVASALNYLHERNVVHRDVKPENLLLVDKFSVKLCDFGLACHILGPLYRICGTPTYCAPEVLRETGYSTRCDIWSLGVVLYVMLVGYAPFRAPDQTRLFKLIMQAKPNLDMPEWKGISLKAKDLVSRLMNKTEERRPLASQIMAHPWIAPYTMENIDDE

SEQ ID NO: 6480 - protein, 557 aa, Caenorhabditis elegans
MIPADAPPPTNIGRTNTYGGGPVIPRRERRQSSSMFNISQNRELQRLPAIKDADPSERETLFIQKLRQCCVVFDFANDALSDLKFKEVKRAALNELVDHVSGAPKGSLSDAVYPEAIGMFSTNLFRPLSPPTNPIGAEFDPDEDEPTLEAAWPHLQLVYEFFLRFLECPDFQSQVAKRYIDQNFILRLLMIMDSEDPRERDFLKTTLHRIYGKFLGHRAYIRKQINNIFYSFIYETERHNGIAELLEILGSIINGFALPLKEEHKTFLLRVLLPLHKVKSLSVYHPQLAYCVVQFIEKDSSLTEPVISGMLRFWPKQHSPKEVMFLNELEEVLDVIEPNEFQKIMTPLFSQIARCVSSPHFQVAERALYYWNNEYVMSLVADNARVIIPIMFPVLFKNSKSHWNKTIHGLIYNALKMFMEMNQKLFDECSQAYQKDRVQEKTLNEEKERIWNNIEKQAMGNPQYVEVKALFARFNPDEIISSRQQNGVDENMKTSTVLSKDEILKNAVGVSSMKNDMDFGPNHKQSDFPPDEQTTRALGEYKRHDPFLKKVTSTDEQ

SEQ ID NO: 6481 - protein, 561 aa, Caenorhabditis elegans
MIPADAPPPTNIGRTNTYGGDLISGPVIPRRERRQSSSMFNISQNRELQRLPAIKDADPSERETLFIQKLRQCCVVFDFANDALSDLKFKEVKRAALNELVDHVSGAPKGSLSDAVYPEAIGMFSTNLFRPLSPPTNPIGAEFDPDEDEPTLEAAWPHLQLVYEFFLRFLECPDFQSQVAKRYIDQNFILRLLMIMDSEDPRERDFLKTTLHRIYGKFLGHRAYIRKQINNIFYSFIYETERHNGIAELLEILGSIINGFALPLKEEHKTFLLRVLLPLHKVKSLSVYHPQLAYCVVQFIEKDSSLTEPVISGMLRFWPKQHSPKEVMFLNELEEVLDVIEPNEFQKIMTPLFSQIARCVSSPHFQVAERALYYWNNEYVMSLVADNARVIIPIMFPVLFKNSKSHWNKTIHGLIYNALKMFMEMNQKLFDECSQAYQKDRVQEKTLNEEKERIWNNIEKQAMGNPQYVEVKALFARFNPDEIISSRQQNGVDENMKTSTVLSKDEILKNAVGVSSMKNDMDFGPNHKQSDFPPDEQTTRALGEYKRHDPFLKKVTSTDEQ

SEQ ID NO: 6482 - protein, 540 aa, Caenorhabditis elegans
MKISINISKQSLTISYAEKKMNRTFSLRRKVKKSEISTPSNFEHRIHAGFDARSGTYTGLPKQWQALLGPPRSISRPKPMVDPSCITPVDVAELKTVIRGPSSRYNSPLPFGMTNSPMPSVARSNSLRISATASPVVNVSSARHSFRPTLPPVSQRGYPFNDPSYAPLPLRNQKPPMSTTFGVEKPHQYQQIITIVAPSRTTTPQLQPKSPSTPQAMRQQPKCTEGVSDEEFRNALKFVVDGTDPRSDLTDYKQIGEGSTGVVEAAYKISTKQIVAVKRMNLRKQQRRELLFNEVSILRQYQHPNIVRFFSSHLVDDELWVVMEFMEGGSLTDIVTATRMTEPQIATISRQVLGALDFLHARKVIHRDIKSDSILLKRDGTVKLTDFGFCGQLSEEVPRRRSLVGTPYWTAAEVIAREPYDTRADIWSFGIMLIEMVEGEPPFFNDQPFQAMKRIRDEHEARFSRHAKVSVELSELLSHCIVKDVNKRWPAKDLLRHPFFAKAQHSSSIAPLLLQLQGNTINGNNPPTHHHSSQITTVIQ

SEQ ID NO: 6483 - protein, 542 aa, Caenorhabditis elegans
MKISINISKQSLTISYAEKKMNRTFSLRRKVKKSEISTPSNFEHRIHAGFDARSGTYTGLPKQWQALLGPPRSISRPKPMVDPSCITPVDVAELKTVIRGPSSSFRYNSPLPFGMTNSPMPSVARSNSLRISATASPVVNVSSARHSFRPTLPPVSQRGYPFNDPSYAPLPLRNQKPPMSTTFGVEKPHQYQQIITIVAPSRTTTPQLQPKSPSTPQAMRQQPKCTEGVSDEEFRNALKFVVDGTDPRSDLTDYKQIGEGSTGVVEAAYKISTKQIVAVKRMNLRKQQRRELLFNEVSILRQYQHPNIVRFFSSHLVDDELWVVMEFMEGGSLTDIVTATRMTEPQIATISRQVLGALDFLHARKVIHRDIKSDSILLKRDGTVKLTDFGFCGQLSEEVPRRRSLVGTPYWTAAEVIAREPYDTRADIWSFGIMLIEMVEGEPPFFNDQPFQAMKRIRDEHEARFSRHAKVSVELSELLSHCIVKDVNKRWPAKDLLRHPFFAKAQHSSSIAPLLLQLQGNTINGNNPPTHHHSSQITTVIQ

SEQ ID NO: 6484 - protein, 496 aa, Caenorhabditis elegans
MRQQTGRRRRQPSETSNGSLASSRRSSFAQNGNSSRKSSEMRGPCEKVVHTAQDSLFSTSSGWTNFRGFFNLSILLLVLSNGRVALENVIKYGILITPLQWISTFVEHHYSIWSWPNLALILCSNIQILSVFGMEKILERGWLGNGFAAVFYTSLVIAHLTIPVVVTLTHKWKNPLWSVVMMGVYVIEALKFISYGHVNYWARDARRKITELKTQVTDLAKKTCDPKQFWDLKDELSMHQMAAQYPANLTLSNIYYFMAAPTLCYEFKFPRLLRIRKHFLIKRTVELIFLSFLIAALVQQWVVPTVRNSMKPLSEMEYSRCLERLLKLAIPNHLIWLLFFYTFFHSFLNLIAELLRFADREFYRDFWNAETIGYFWKSWNIPVHRFAVRHIYSPMMRNNFSKMSAFFVVFFVSAFFHEYLVSVPLKIFRLWSYYGMMGQIPLSIITDKVVRGGRTGNIIVWLSLIVGQPLAILMYGHDWYILNFGVSAVQNQTVGI

SEQ ID NO: 6485 - protein, 496 aa, Caenorhabditis elegans; identical to SEQ ID NO: 6484

SEQ ID NO: 6486 - protein, 360 aa, Caenorhabditis elegans
MSWRTTTAILCLYGAVKEFRPATPFLTPFLASPEKNITLDELYSQVYPYWTYSYMLALIPMFILTDILRYKPIVMIEAIGLVATWALLVFGKGVWQMQIMQVSFGVASAAEIAYYSYIYSIVDRKHYKRATSYIRAAALMGKLVAFGLGQTLISTHTSDYLVLNQISLGAVCLVTIIAIFLPRVKSEKAKVSMRAHEIVEQQTVESVESVQTPKAVKMSYTREYFKKISEELQICSKNQELLKWSLWWALASCGVYQVQNYTQSLWKELQNNPDDVANGVVEFVNTALGAFLSLFIHHLSIDWTLRYVLRANVAKELSSNNHGLIFGCNTFVAVCLQSLLTLVVVDSRFLHLDIRTQVSF

SEQ ID NO: 6487 - protein, 357 aa, Caenorhabditis elegans
MGNCESRELVAQAKQNKIINTELDKAKKTDENIIKLLLLGAGESGKSTVLKQMKIIHNSGFSQEEISNKRNVVCANTVQAMGALLDGMKQLQFDFSTRVCNAHEKLIRETLNDKAEYGPFSDAMFNALTELWADKGVQCAYDKREFFYLHDSAKYFFDAIARVHTPNYVPTENDILHTRVPTMGVIEVNFTIKGKFFRVFDVGGQRSQRKKWIHCFDDAKAMIYVASLSEYDQVLLEDNTTNRMHESIQLFKQVINNKYFVNTSVILFLNKIDLFEEKIVTKKRSLGIAFESFSGPSQDLNAAVAFVEKKYRSMAENKEKNIYCHHTCATDTQQVQYVLDAVLDTILSTKLKGCGLY

SEQ ID NO: 6488 - protein, 506 aa, Caenorhabditis elegans
MLQIFLINISISFPLVIFSFIFQLLSMTLFLPNWCSGFYYHDDVMLSSQMHNRKTPNSFFIFLILLSILQINICEIIIDSDYNVSSDDDPTTTTQKPRNCTRQPAIIDKLLNGTGYNKFRIPNENGVPVQVEFWVQAITSINEITNDFEMDIYINEMWLDPALKFDHLNPCKQNLSVSHQVLEQLWTPNSCFVNSKFAEIHDSPFKNVFLMIYPNGTVWVNYRVNVKGPCDLSLELFPLDIQECHLIYESFNYNNQEVRMRWNEKSAEPVSVTNKIRLPDFELIKIESTRISAPYPAGMWDELHVKLVFERRYIWYFMQAYLPTYLTIFISWISFSLGTKAMPARTMLGVNALLAMIFQFGNIMRNLPRVSYVKAIDVWMLVSMTFIFLSLLELAIVGYKTKNEEGSKKKCPHKKLLDNFEASPAGLCRYEKRFMLPVERRSARWGGIIRFQVFQDFWNWSPEKIDRVSAIMFPACFAIFNIVYWSYYYNKKLEKAAEMKLNEDRL

SEQ ID NO: 6489 - protein, 746 aa, Caenorhabditis elegans
MWFTANESMGRRTVDKMIEMSGGKVTPLLSNSDKKRDILSFVCLSRFSNVLKKSLYLLIFFCLSFESIGFSSLSLFSDALFSSLNVKILYRFQMELWKSCIFLFLNFCIQSEGIVRTSYGNWNIPKIGDRNIPSFLIDESKNQFLLDGLPFRYISGSIHYFRIPRDRWDERLGKVRALGFNAIQYYIPWNMHELEEGNHDFSGLLDFAEFSMMAFHKYGLWTILRVGPYICGELENGGLPWWLLNKNVTKQRSSDRVFTREVENWFEILLPRVKPLLRKNGGPVLMLQIENEYGSYDACDQQYLRFLRDLTRSLVGDDVLLFTTDGSAESLLKCGTVEGVFPTVDFGPTDDAKEIENNFKLQRKFAPNGPLVNSEYYPGWLVLWGQKKQNLPSPQTIINGSQTMYSLGASFNYYMIHGGTNFGFWNGAETEAPCITSYDYDAPISESGDVTTKYLEIRKWIKGLTDWPTPPLDVPGNSPKGRFGKIKMRLVHSVEKLKTLTSLGDPGDCVETDKPISFETLKHPLGLVAYQAKINSCGNLTIPSFGDFVHVYLNGKYIDTLTRRYYNLTRNSVIIEGCLENEENRLFMLVENQGRKTFETINDRKGILSDVFMNGQAIQFWTQCGIKLPLQEDFYFRKAMRNNYRKNVKSNQKQGVFIGILSVDAPTDTWLDTTGWGKGIAIVNGRNFGRYWPTKGPQMTLYIPAEFLKIGENSVMMVELEGAEEACTSTSSCIADFIDHPVFDFQ

SEQ ID NO: 6490 - protein, 524 aa, Caenorhabditis elegans
MGDEFRPSHEERSKMYKSNVRDQNEMRRKRREDEVQIRKNRRDEKFERNRQITVQRSLSHEETSELLKSVADGLQSMQETTIHEALTVLHENLNNTVWTIHVLVKVQILHKLSDVYCNRVISQTTRLLISRTLLKISGIDEVKYERYSSDDRCIQSLVFNISTYGSSEDILCDTFQSIACFIIRSITYRNLALDCAIVSELIDASTINMSIILHRSLMWLVFLFCEKLDRCSPHVDEIAPLLEIISNGIQSTDAMVQTDAASSCASLAEWPPIYHYMSDLKLCSKLVANLRNDKGNARPKVKAGINSIIQATGYFTEEMIDAGLLEVLKGFVNVSYMSQEVCFIISNICVEGEQTIDKLISSGVLREVARVMEASEYRSRREAAFVICHCCASANQKHLEYVVELGMLSAFTDLLTCMDVSLVSYILDAIYLLLQFGEMRLLPDNSNPVAIKLEEIGCREKLEFLCESQSVDIHARAYTIIDRFYVDDDAPLNDDPFAGYQRNNIDDTIEKMIREPIMDQPFSF

SEQ ID NO: 6491 - protein, 632 aa, Caenorhabditis elegans
MCHYNLIHPAHWFFFLQFFRVIMVEATSVAEREQWSSWADFIMSCIGYAIGLGNVWRFPYLCYQNGGGAFLIPYCISLVFCGAPLFILETSWGQLMSVGGLGMFKICPIFKGVGIAAAVMAFWLNIYYIVVLSWAATYLYNSFTMSDVPWKNCDHAWNTPNCRSEYVKIPCDSNRTIAEFFNVKVLTHDHIHEYKKQFFVGEKMNWTVCSAADLSVVSPVKEFWNHRVLGISSGLENPGGIRWDLALFLLLVWIICYLCIFKGVKWTGKVVYITASFPYMMLFCLLIRGLTLEGAGVGLEFYLKPDFSKLLESKVWVDAVTQVFFSYGLGLGALVALGSYNKFNNNVYKQALTVCFVNSGTSVFAGFVIFSFIGFMATQQEKSVAEVAQAGPGLLFLAYPSGILQLPYTQFWSCLFFLMVLFLGVDSQFCTMEGFFTAIIDEFPQIRRKKYGREIFVGVICVISYLIGLTTVTEGGFYVFQLFDFYAASGWALLWLLFFECIAISWSLGIDRWYEHMKSMIGYYPSAWWKFCWVFATPSVCFGVLLFGLIKYQPLRIDAYNYDYPVWGHIFGWFLSLSSMLCIPGYAIWIWFKTPGTVQEKIKLLCRPDIEIKGAMENAENLELVEDFQNAI

SEQ ID NO: 6492 - protein, 376 aa, Caenorhabditis elegans
MNITNSSIGYPPPPLVGASFAKTAIPYSICFVFGTLGNTAVLSYVFFITRSLKSSVTALGNTFIYIVALCAVDLLVTVSIPFSLSYMILNNWVFGELVCKIHFMLELSNKMCSTFILTALAFDRYMAICHPEIKRIHEMRHTIYITTILATLSLFLISPVVLSARVTSFKSGQYFVSAKNERHEVIRQMCIDGMALEWKVWVSAFLIFFAFLLPCTLLTYFYAKIVLRLRRQRRTMLQSRIPLRRITIYTMAATFFYLSCHIPFWLPQIYNIFSTVLGHKMNPKVMTFTYYSHLLPFISAAFNWIFYARLNSQFKKGLVLVTERMIRKRTKSMHEKGYSEAAVELTSKFDDVPLMCPHCEAQLSIRSSSNGKKNSR

SEQ ID NO: 6493 - protein, 763 aa, Caenorhabditis elegans
MLLSVSNGTDQNPQDLNDLQWNAFHAFLLLLIILVVFGNTMVIFAVAVDRKLRSVTTNKFIASLAVSDLLVGLIVMPLSLYYKMHNDHWTLGYTWCQFHLVSGVFSTTASIVHLVAISLDRYFAIMFPTEYQRHSVSTSTVPYVVMIWLMALAVSSTLFMEQRDSFDGICWISNPQYIVLSSFLSFFLPGAIVVYLYMKIFKKLRNHQLYMFGQLTHRGGERERRHSLPRVIIEEVRSRRGSRMSQTGSQSGSPTRRQSGGSKERSPSQPDIHIVAKPQQRWRSPTICAETLAHDRLLAAKKRVSIVPDPPSMDVSVNMASIDQMKDEHHHNLMREEELLGCEAGRRKQSEEEVRKLSDERKRVIYERRRSSTSENPNGIPIMQAFQKAYQEVRAGRRRSTIHDITAYHFPSLTTVNEPATPPPGEDCEEKEKDSDGTSIMHKLSSGSSIAETVIAMLPKTSTLSKTDSHESSVSTEASQKPLLGPPTHHYTKKSQTQKEPRYSPSIPAPTFLMVPAMMAVNTPPATPNTKEAPTNCTSLLQVPRLFDCPSPCSVPSNSSHSSYTSASGSSDTYRRISMNSYGSSLTDGTESTFECDSRRSSAWSTIRAAVFDRQQMRGGKASVDITVDRTGSPQKKMSTISRGKLRRIATQVTRAIRRKRRESMAIRRESRATRVVAAILIAFLICWIPYFCISIFRGVLMGFQININTPIHLTLFVYTSWLGYAHSCFNPLIYMCLNKNFRNTMRKMMQKTNRAKMAEQEG

SEQ ID NO: 6494 - protein, 564 aa, Caenorhabditis elegans
MTLKIRTIIILFCVISVTTTSQSLNATLKTFDPRLLNSTADRDIAMKNVPLVRLTRHLLSPERYDVRVRPILDHKKSLKVHISISLYQIIEVDEPSQNIKLNVWMIQKWRDEYLDWNPNEYGMINSTIIPFHHLWIPDTYLYNSVKMSRDETERYMNIQATSNYWKGEKGAELSFLYPAIYTITCRLNIRFFPYDRQNCTLTISSWTNSKSALDYYADTEVSMQSFIPNEEWQVKSFKIHRHEYKYACCAEPWVILQASLVIQRKPLYYLVNLIIPTSIITLVAITGFFTPASTDDDRTEKINLGITTLLAMSILMLMVSDQMPTTSEFVPLIAWFYLSIIIIISIGTFLTSVVLSVQGRRQYGRNPPQFIRYIFFVLLPQVLLLNVPPPLQTLWGELDDDPLNVRRRKKSHYLSRNVNNGSTKMASPMSTLRVPQSAGSVSEKRQSFQMIDVTSPNSPNTARSRAPSLAPSTAKATMWEGTMSALAGTNTQLRRTSNVFNKEVDEMRRKRQCSLEWEFLATVLDRFLLIVFVGAVVIVTAGLILVGRMAQYSYDHPDDRFFNV

SEQ ID NO: 6495 - protein, 548 aa, Caenorhabditis elegans
MLIIIQSLLLATTASLCIADTPVPTQIRLVHDLLDNYDKKAKPMWDNSKPINVSFSMDLYQILELNEPQQYILLNAWIIERWFDEFLYWNPDDYENITELRLPYDSIWLPDTTLYNSLVMKDDDTRRLLNSKLTTDTHRRAALIELLYPTIYKFSCLLDLRFFPFDVQVCTMTFSSWTYDQKGIDYFPYSDKIGTSNYLENEGWYILQTKIKRQEVKYACCPNNYTLLQLTLYLRRKPLFYLVNLIIPTSIITLIAIVGFFTTSSASGMREEKVSLGITTLLSMSILMLMVSDQMPTTSTFIPLIGWFILAMIIVISLGTVVSSVIIAIQKRGSLGERMSKRALKFAKVLAWFTCTSLPPHVEKEHMMEAFDAPTPLVEVRPLQLASVKESVRNKWVSGARRATQRGNSGLALISDKSTDPLIHLSPTAHQPDESISPSAPPVPSSSPLPPPLTPGPADDVVSVASELSSKFLTSRMRPKSQKDNTFAAMQSSIKANRQLAVAEFEWFATVVERTCFVIFVVAFLIITFGINFIGFIHWHQAGVEYGG

SEQ ID NO: 6496 - protein, 548 aa, Caenorhabditis elegans; identical to SEQ ID NO: 6495

SEQ ID NO: 6497 - protein, 251 aa, Caenorhabditis elegans
MSPKSVVVTGSNRGLGFGLVQQFLKDPNVQHVIATARDVDKATALKGICDPRLHILQLSLGSDESIANFAEKVSEIVGESGLTLLINNAAVMLPYVTKQKPDRKVVLDLFESNTIGPMMLTQSLVPLIIKASKRQEGDTLSVSRGAIINIASEFLGSISENTSGSGEYKAMAYRMTKCAVNQFTKTLSIDLKDDHILTAGICPGMVQTDMSKGKGQLTIEESSSQILAAFNKLGATHNGGYFRRDLSIIPY

SEQ ID NO: 6498 - protein, 805 aa, Caenorhabditis elegans
MSQNKIERISKEVAERLTTAQVVVSLSSAIRQLIDNSIDAGSTIIDIRVKNNGFESIEVQDNGSGIEARNFDALCKPHSTSKLTQFSDFDKLATLGFRGEALNALCTVSSVSIFTRASDTEIGTRLTYDHSGNIICRQSAARELGTTIIVNKLFETLPVRRKELERSQKREFVKLLSTVQSFALLCPHIKILCTNNINGKKTNLICTPGGTTSIQDVVANLFGIARKIENSKIGSGLIPIQQNQPDVEIMTIHSVPMEEMHFFDLFKIRGFVSSCEHGCGRGTSDRQFVYINNRPVEYSRVCSVINDVYKQFNKKQYPIIVLFIDVPPEKIDVNVTPDKKTVMLEKERHLLAVVRASMMKTYLKIVGSHSTVRSSVEDRRIMNLSQQSFSNASFMSSKSSTPDDFNNTTLNSTYPEDSLLNTSDLLKQRKENRSPPAKKSCPMIRRTEPFHSVPSTSNSRTQRLENFSFTMEPKRVEVSKKIPSKSDKKLTDEELRSAVIEENPLKKAGEIDDIEILEQSQESQDVNESQCSQDSQTSQNSRVSYFTLRPQQKIKFSMKLLREAYSPKTDETDDNTEEAEVSAEKDVLNEITTKINKEENDDAERQLSRSLTKDDFSKMKIIGQFNHGFIICRLRGHLFIVDQHASDEKYNFERLQSSAKLTKQPLFMPTALGFGAVQELIIRENLPIFHANGFDFEFSENDGCIKTFLTARPELLNQQLTNSDLEEILAVVSQYPNQMYRPVRIRKIFASKACRKSVMIGKPLNQREMTQIIRHLAKLDQPWNCPHGRPTIRHLASLPDRAEFE

SEQ ID NO: 6499 - protein, 805 aa, Caenorhabditis elegans; identical to SEQ ID NO: 6498

SEQ ID NO: 6500 - protein, 374 aa, Caenorhabditis elegans
MIRKCGFYSDFLFRYILELIPEGGSLQDRAILITGCDTGFGRELAKKCAKNGFLVFAGCLTTEAAKTLESESANPRLRTVPLDVSKDESVEKTVEFVKKSLGNHKLWGVVNNAGIFSCYGPDDWCRMNDYKLALDVNCLGVIRVTQAFKKLVKAAKGRIVTVTSVNGRLSTPAAGPYVVSKFGAAAYMDCIRFVIGVLDILIKFSVFSFVFKNDIQLLPISNFSSLMFGFRIVQEYKQELYNFGVKVSILEPGIFRTPLLDEQAMLKRVDHVWTQIDDETRTEYGETFKNYFAKMWNKTYISMSTTKIHYVVDNYYHALTAKYPRHRYYCGWDAIFVYVPLSLLPTWWADYVIRSLGKQEVVPACLEDSMKKKN

SEQ ID NO: 6501 - protein, 535 aa, Caenorhabditis elegans
MSMKLRDILPAPVAADEAASQIRRDPWFGGRDNEPSAALVSKEPPPYGKRTSFRPRGPEDFGDGGAFPEIHVAQFPLGLGLGDMRGKPENTLALQYGTDGKLQHDAIARIGHVKDKVVYSKLNDMKAKTWNEDDDDIQKPDDDAVIDATEKTRMALEKIVNSKVASALPVRHADKLAPAQYIRYTPSQQNGAAGSQQRIIRMVEEQKDPMEPPKFKINQKIPRAPPSPPAPVMHSPPRKMTAKDQNDWKIPPCISNWKNPKGFTVGLDKRLAADGRGLQQTHINENFAKLADALYIADRKAREEVETRAQLERRVAQNKKSEQEAKMAEAAAKARQERSAMRRKDDEDDEQVKVREEIRRDRLDDIRKERNIARSRPDKADKLRKERERDISEKIVLGLPDTNQKRTGEPQFDQRLFDKTQGLDSGAMDDDTYNPYDAAWRGGDSVQQHVYRPSKNLDNDVYGGDLDKIIEQKNRFVADKGFSGAEGSSRGSGPVQFEKDQDVFGLSSLFEHTKEKKRGGDGGDSRGESKRSRRD

SEQ ID NO: 6502 - protein, 588 aa, Caenorhabditis elegans
MLNPWNFFVFVLFIICGPLGSNQVEVHVCDTTNSNNSFIYCNGPILDAVNYHSLYNDSKEFVDMPLKDDPQIVYNAWRAKYGNQSSANLNKSDVQAFVNQYFSAAGTELVVCTPDDWQEKPPKLATIADPKLPIEQHTSRYSLLYVPNSFIVPGGRFREFYYWDAYWIIKGLIASDMYNTTRSMIRNLASMVDKYGFVPNGGRVYYLQRSQPPFLAAMVYELYEATNDKAFVAELLPTLLKELNFWNEKRMTDVQMNGKSFKVYQYKTASNVPRPESYRVDTQNSAKLANGADQQQFYQDLASAAESGWDFSTRWFSDYKTLTSIETTKVLPVDLNGLLCWNMDIMEYLYEQIGDTKNSQIFRNKRADFRDTVQNVFYNRTDGTWYDYNLRTQSHNPRFYTSTAVPLFTNCYNTLNTGKSQKVFDYMDKMGVFTYPGGIPTSMSQESDQQWDFPNGWSPNNHMIIEGLRKSANPEMQDKGFLIASKWVMGNFRVFYETGHMWEKYNVIGSYPQPGSGGEYDVQDGFGWSNGAILDLLLTYNDRLFVPENFVNTTVTPSVESTTKSAPKYAKLPWVLVFAFMIRQLFNY

SEQ ID NO: 6503 - protein, 103 aa, Caenorhabditis elegans
MSDSIITRSEVNMHCSEDDCWIIVGNYVYDVTKFVDLHPGGPEILLEFAGGDATDAFESVGHSMCARMMLTKFKIGSLPEDERPDFIQAEYITHAKISLPMAH

SEQ ID NO: 6504 - protein, 1175 aa, Caenorhabditis elegans
MRFSRIPPIFANVVRQTHYRNYANGVIKPREFNKVMVANRGEIAIRVFRALTELNKTSVAIYAEQDKNSMHRLKADEAYLVGKGLPPVAAYLTIDQIIETALKHNIDAIHPGYGFLSERSDFAAACQNAGIVFIGPSPDVMARMGDKVAARQAAIEAGVQVVPGTPGPITTADEAVEFAKQYGTPIILKAAYGGGGRGIRRVDKLEEVEEAFRRSYSEAQAAFGDGSLFVEKFVERPRHIEVQLLGDHHGNIVHLYERDCSVQRRHQKVVEIAPAPALPEGVREKILADALRLARHVGYQNAGTVEFLVDQKGNYYFIEVNARLQVEHTVTEEITGVDLVQAQIRIAEGKSLDDLKLSQETIQTTGSAIQCRVTTEDPAKGFQPDSGRIEVFRSGEGMGIRLDSASAFAGSVISPHYDSLMVKVIASARNHPNAAAKMIRALKKFRIRGVKTNIPFLLNVLRQPSFLDASVDTYFIDEHPELFQFKPSQNRAQKLLNYLGEVKVNGPTTPLATDLKPAVVSPPIPYIPAGAKPPTGLRDVLVQRGPTEFAKEVRSRPGCMITDTTFRDAHQSLLATRVRTYDMAAISPFVAQSFNGLFSLENWGGATFDVSMRFLHECPWERLQTLRKLIPNIPFQCLLRGANAMGYSNYPDNVIYKFCELAVKNGMDVFRVFDSLNYLPNLLVGMEAVGKAGGVVEAAIAYTGDVTDKSRDKYDLKYYLNLADQLVKAQAHILSIKDMAGVLKPEAAKLLIGALRDKFPDIPIHVHTHDTSGAGVAAMLECAKAGADVVDAAVDSMSGMTSQPSMGAIVASLQGTKHDTGLSLDDISKYSAYWESTRQLYAPFECATTMKSGNADVYKHEIPGGQYTNLQFQAFSLGLGPQFDEVKRMYREANLVLGDIIKVTPSSKIVGDLAQFMVQNNLTRETLVDRADDLSFPKSVVDFMQGNVGQPPYGFPEPLRTKVLRGKPKVDGRPGENAKPVDLDAVKVELEEKHGRTLSEEDVMSYSMFPTVFDEFETFRQQYGPVDKLPTRLFLTGLEIAEEVDVEIESGKTLAIQLLAEGKLNKRGEREVFFDLNGQMRSIFVVDKEASKEIVTRPRALPGVRGHIGAPMPGDVLELKIKEGDKVTKKQPLFVLSAMKMEMVIDSPIAGTVKAIHAPQGTKCSAGDLVVEVEP

SEQ ID NO: 6505 - protein, 160 aa, Caenorhabditis elegans
MKNFEIVTVTPDHAEQLISMIHELAEFEKMKSSVVNTAEKLRKDIENKAVHGFIAFIGEEPAGMNLFYYAYSTWVGQYLHMEDLYIRPQFRRMGLARTLWKKLAELARDKGIVRLEWAVLDWNKNAIALYDTVDYVNLTKSEGWFTFRMDGAAINKFADE

SEQ ID NO: 6506 - protein, 328 aa, Caenorhabditis elegans
MSLKKIIDVKSVNTLLKKGIINKEGVRIIDCSFAVAPRPDWKEFEQEGYGDFKNLMAEPSPSRNLYLAGHIPEAVHVDLDIATYPSRYQRFQQYRADLFEEYAQMVGLNNKEHFIFYGKGAFGGMLFASKVAWIFKSYGHENISLVDGGFDSWKRNGFEVSTELVKLPAGNFKAEDNFKKYVITFQELEAKKDGEDKQFIEKTSEINFLDSRIRGQFDGTQETGLDPHLVNGTRIAGFKNLPSAELLVKGGNLKSEEEIKSWLTQNGYVENQPTITSCNAGIQAALLAYVIDAVKPSQNPPRVYNGSLKEMELRAPKKISEGPQHLPH

SEQ ID NO: 6507 - protein, 349 aa, Caenorhabditis elegans
MTVELPSTQRALVFDTWNGPLEVRQVPVPSPADDEILVKIEYSGICHSDLHVWLGDLKDMSVCPLVGGHEGAGSVVQIGKNVTGWQLGDKAGVKLMNFNCLNCEFCKKGHEPLCHHIQNYGFDRSGTFQEYLTIRGVDAAKINKDTNLAAAAPILCAGVTVYKALKESNVAPGQIIVLTGAGGGLGSLAIQYACAMGMRVVAMDHGSKEAHCKGLGAEWFVDAFETPDIVSHITKLTEGGPHGVINFAVARKPMEQAVEYVRKRGTVVFVGLPKDSKVTFDTTPFIFNAITIKGSIVGSRLDVDEAMEFVTRGIVKVPLELVKLEDVPAVYQRMLDGKINSRAVVDFSL

SEQ ID NO: 6508 - protein, 351 aa, Caenorhabditis elegans
MSSANIPATQSALIFEKYGGPLEVRQVSVPQPQENELLVKIEYSGICHSDLHTWEGDFEYASICPLIGGHEGAGTVVTIGSKVKGWNIGDRAGIKLINANCLNCEYCKTGHEPLCDHIQNYGIDRHGTFQEYLTIRDIDAIKVSNDTNLAAAAPVLCGGVTAYKSLKATNVKPGQIVVLTGAGGGLGSFGIQYAKAMGMRVVAVDHISKEDHCRNLGAEWFVDAFDTPDIVAHIRKLTNGGAHGVVSFAAAKKPMEYALEYVRKRGTVVFVGLPKDGTIPLDTLSLICNEITVKGSIVGSRMDVDEAIDFITRGIVHVPIELVKLEDVPSVYQRMKDGKVTSRVVVDFSMR

SEQ ID NO: 6509 - protein, 4101 aa, Caenorhabditis elegans
MPKKLIYSISMKSTASSPTPSVRTLPEEQVRVPTSGAPPVRADANGTDQDEFNNETLYFERSRIRTLQDERVHIQKKTFTKWCNSFLNRASLEIVDLFEDVGDGIMLMKLLEIISGDKLGKPNRGRMRVQKVENLNKVLDFLKKKKIQLENIGAEDILDRNERLILGLIWTIILRFQIDTIVIEDEEERGERKHAKDALLLWCQRKTAGYPNVRIENFTTSWRNGLAFNALIHSHRPDLVDFNRLNPNEHVDNLNHAFDVAEKKLEIARLLDAEDVDVTRPDEKSIITYVSLYYHHFAKQKTEMTGARRIANIVGKLMVSETMEDDYEHIASELLNWIRVTIKTLESRRFPNSLNGMREEHAKFNQFRTSEKPPKYKEKGELEALFFTIQTKRKAMSRKQYQPPQGLFMHDIESAWAQLDYAENERQVAIIAELQRQEKLEQLAQRFHKKAKLRDSWLRSVQVVLEEMEHGRSASQVEKTLKKQQAISTDILAREDRFKMLTAMCNELCTEKYHESDKVRGMEREIIDRWTQLLTLLEQRKRALMSLNDLMSLLRDIDTLSNELYSLEPAVRNRDVGKHLIGVEDLLGKHDLLDAQINAHGSLLSKLSQSANNYIRHKEEQFDVLQRKLDEVTAQYNTLVELCRSRRLGLERARSLFQFVQDHEEEMAWLAEKEKLCTTALNSGDISAVPQTTLLYKNVEMEMQTHWARSKGMIAGGERLVQNGQSKEDIQRRLTQMNHRWERLRVAVDALGNWLSEARHAQQYFQDANEAESWIREKMPLVKSDDLGRDEGAAESLLQRHARLEEEIRAYKSDISRLEEMQSQLANSAFHTATTSQSVQETEEVNVPQVEMSYNYEGNGMRVSKGEVLALLEKSTPEWWRALKRDGTEGYVPANYCKIVPGETVTVTQTTQKTTTTLEGNETKSSVVADRQHKISNDYRELKRLADVRRRLLSDNIKLLRFYRECDEFERWAKEIEVSLADEPSPEHVAAFRRKFDKLEADMKTNGGTQLKHINDIANDLISEGHGQSRKIEVRQHKINAMWDNLERLRKQRGVRLEATERVADFDTTCESAREWMLSKFEQLDRNPNDVKSLQNLERDLKPLEDKIAALEKLAAAVKKDHPEEAAAIERKIAELRALHADLLRRAQEKMLLAEQTQGKEMFESALRDMIGWIEKTRKVMMEDVHPVDVAEAEELLKKHYELGEQIKDKKYEVEYCQELGRRLLERNPRMSKVEEQLQNLVSEMASLRDLYRRRDTILKQQLDLQLFNRESERIDAATKGHEAFLEFDNLGDSVESVENLLKRHRDLEAKLDAQEARLEAFSRTADDMIKAQHADSAYIEQRRRDVLARREAVRRAAAQRKKQLEASLEYQEMRREADEVVGWMYEKAKLVMSGDDSALAPSAIPHRLLKHEAFEAEIIANEPRIQQINSEGDGLVSKKHYESPNVEKIVRQVNAQWGDLKKQVWNKGLRLRQAADQKGLDRILEDAHAKLDEMQTALNSKDQGLDLRSVKDLLQKHAVLEQEMGLYGNKLSDIENRGKKMAVDGHYDADRIHSTVGQLLQRYAAMKGPAQRRKGDLDESRLWHQLVFDVDCELQWIAEKKPIASSQDCGRTLTEALNMVKKQEQLEAEVNQHGGQIDKVLLQAGELIKRHHSASSQIKAKSSELETAWSELKKLLRLRRAVVDWGVKEQQYLFDAAEVESWMNEKRNALASEDYGNDEDAARKLLSKHRALCEDMTTYRQWLEKLEVKCVELVESNRPHVERFQKRQDELVREFDALSKLAEDRRNALEDAVCLYEYMRESADLGQSIEENLRVAMSEEFAEDYEHLKELQSKFDEFKQKVKNGSERFTSCETAANAILRRNPPFARDVVKKQEALRTAWNTLCEYIEARDSKLAVAEELHRFHRDVDEFEQWMADKMANMPRDLGRDVKHVHSLWQHHEALDKEIHNSQPRLAKLVEEAERLKKTYPGGNAEQIGGRQQTLEQEWEELKNATDDRKDMLRAAFDLHTFNGKVRDLLAWTDLTISDIQSDLHINDLQQAEWLQTEHSRLSHEMDAREPEFARLVNDGEKMITAQHYASEEIKNKTHLLKSALERLRSEWALRNGFLSQAVQWHAFQREAKQIIASIGSKRTTLRSLAVGGSVADVESQTKRLDTFEKALSTLDERTATLDHTANELMKARHMESKNISMWQSNVHEELKLLRQDIEARHAMLKDAFALASFDSDVAQIEAWIDEKTNGVRKAQDLSSESISIDEKMKRLQTHQALEAEVTANKPVVDQILQRGNQLKNLHRNPKIANRCDELSYKWNQLSGACADQSLALEEARDLLRFKQLVENVLAWINEKEVLVSTADMGKDMEHCRLLLERLDGTRSDSIVDEQTLDEINRLGEKLVKQGRSSRDQVQKEQQHLNEKWRLLLGQLAHYRTELLAAMEVHTFNRDVEDTDERIHEKVAAMKSDDYGKDFASVELLVRKQSALERDMSAIHQKLIAHDKDAQKILEKRPPLRETVLDSLKKLEESWEQLSKAAELRNEKLNRSFKLYKYLDDVKKVEQWANQVRNKMTSHQTPKDSNGARKILEQHHERKAEIDGRSEELRLLHEEGQALNQEQPEHKAEVQRAHKRVQNSEHQLRQTWESEKGTLQKLLEWMLWCDEAVQCEQWLSDKETQVARGELGDTTDAVEMLIKGHSAFEETVRKQSEKIDALTKNADALVSGGNNYRADIVTRSEEVTARHALLLKSMEKRGHMLEDSKKYHEFIRQCGELIIWITAKLQLAYDESFLDHTNLRSKLQKHMAFDSELVENEKRLSTVERQGEQLVTDNHFMSEQVKAQLVELRSGWDELRTKSALKTQRLREAFELHSLQRKVEDIEKWLDKVEGELSSDDHGRDILSTELLIKKLDTLQTEIAGRSDAVVEMMKKARELRVQGSAAADDCLKQAEQVEARYSGLDEPVQIRRENLVDAQAFFQWVKAAEEDLEWLSDRMMLASSGESGDSLQSALSLQKKHATLEKELDTRQSAMNDTEQRGKDMIRQRHFASTHIQKILDRLSSAMLTLKESCGLRRDLLQEAIDAHEYYTEETEAEQWLREQMPLAMSQEMGRDQAGAESHLRRLTVLDKEVELFKNEIDRLKKRADGLLAREHHDAMSIAAKQRKLEALFGDLCRECARRRTQIVDASKYHKFVRQADDLSDWLREKERSASAEDYGQDLEDCQQIIEQFESTVRELAAAGERVAAVQRAQEDLLRSGHPYGASITAKGADVQRLWTHVNEVANERKQALNGARQVHRFDQEADQILNWLQDKEATGVAMEQEDLSRADLASVKAQLQRHDEFMHGMKAVEKQVAELCHEAERLWNSFPDTRHHLEVRRLDMEEQLKDILEAAKKHLEKLRHMQSLQSYFQEYREMMQWMKNMQSTMTSEQLPRDVASCESLVRRHDEYNLEMQGRKPFVDDFARQGRRMIQSSHVLSQEIQEKVDILEKSWAMLCEIWKDRAELYEENMDVQKWKQNAEQLDSWLEERAGLLGDDWRMVDSVEMAETHLRDFDDFLVTLEAQSEKCDMVKRLTLVEQNFSRLRSKEIDRARIAEDDQKRRDTIKIVEKGNILANRRQERERRKTQEISLLRPSPSGEEFSTHTMPRKERKDRAKTTADLAPGAIQIGDILASSSTVAPLQSGVEMTKTPSFNTRRTQSIRKGSRWEDMGAIDMKGFFDRKQCQQSGGKRATIRSWKNYYGILCGQLLCFFKDEQQFLENVAAAPPVYIYGAQCEQYPEYAKRKNSFRLLLQDGSEFIFSCPDERQMLEWVAKIKFHAHLTPSNQLKSYAYNDDLFQSPDQPPMVAPRRNIGGHDVANRMSHASSVFTTSDDLEQHELDYSRRCSSLPRGKHSGQITMRDCATLPRGFGSDVMEQQPTAFFPPSGPLLATPSVLTMSSSSMTANVMPTVVTRKIGVVRRASRRQSVYAESIYGEVEQAIAEANRVSTSRPNGDHAELRHTIQVHPGSSGYTETLMYKEHTSSNYQPMERSVSPRNQQNGEFITWVESNQQNQPMNTPDGRSTSASVVSTPSNYDDSDSIKSSSSKNFSLFFLTKKYFASERKGFGSLFKRGSKHSK

SEQ ID NO: 6510 - protein, 4101 aa, Caenorhabditis elegans; identical to SEQ ID NO: 6509

SEQ ID NO: 6511 - protein, 1143 aa, Caenorhabditis elegans
MGKRNFYIILCLGVFLTVSLYLYNGIETGAEALTKRQANDLRRKIGNLEHVAEENGRTIDRLEQEVQRAKAEKSVDFDEEKEKTEEKEVEKEEKEVAPVPVRGNRGEMAHIHQVKQHIKPTPSMKDVCGIRENVSIAHSDLQMLDLYDTWKFENPDGGVWKQGWKIEYDAEKVKSLPRLEVIVIPHSHCDPGWIMTFEEYYNRQTRNILDGMAKHLAEKDEMRFIYAEISFFETWWRDQADEIKKKVKGYLEAGKFEIVTGGWVMTDEANAHYHSMITELFEGHEWIQNHLGKSAIPQSHWSIDPFGLSPSMPHLLTSANITNAVIQRVHYSVKRELALKKNLEFYWRQLFGSTGHPDLRSHIMPFYSYDIPHTCGPEPSVCCQFDFRRMPEGGKSCDWGIPPQKINDDNVAHRAEMIYDQYRKKSQLFKNNVIFQPLGDDFRYDIDFEWNSQYENYKKLFEYMNSKSEWNVHAQFGTLSDYFKKLDTAISASGEQLPTFSGDFFTYADRDDHYWSGYFTSRPFYKQLDRVLQHYLRSAEIAFTLANIEEEGMVEAKIFEKLVTARRALSLFQHHDGVTGTAKDHVVLDYGQKMIDALNACEDILSEALVVLLGIDSTNKMQMDEHRVNENLLPEKRVYKIGQNVVLFNTLSRNRNEPICIQVDSLDAGVEADPPIKKQQVSPVIAYDEEKKTLVVKNGIFELCFMLSLGPMESVSFRLVKNTTTSKVEIITNNAAEFKETSFKSSSTSGDFTVKNDKVEAEFDGENGMIKRATSLVDDKPIDLNSHFIHYGARKSKRKFANGNEDNPAGAYLFLPDGEARELKKQSSDWILVKGEVVQKVFATPNNDLKILQTYTLYQGLPWIDLDNEVDVRSKENFELALRFSSSVNSGDEFFTDLNGMQMIKRRRQTKLPTQANFYPMSAGVYIEDDTTRMSIHSAQALGVSSLSSGQIEIMLDRRLSSDDNRGLQQGVRDNKRTVAHFRIVIEPMSSSSGNKKEERVGFHSHVGHLATWSLHYPLVKMIGDATPKSISSKNVEQELNCDLHLVTFRTLASPTTYEANERSTAAEKKAAMVMHRVVPDCRSRLTLPDTSCLATGLEIEPLKLISTLKSAKKTSLTNLYEGNKAEQFRLQPNDISSILVSF

SEQ ID NO: 6512 - protein, 340 aa, Caenorhabditis elegans
MESMKKWGNGMNKFLILTALCAVTLAFVPINHQSAVETLTGQALVDYVNSAQSLFKTEHVEITEEEMKFKLMDGKYAAAHSDEIRATEQEVVLASVPATFDSRTQWSECKSIKLIRDQATCGSCWAFGAAEMISDRTCIETKGAQQPIISPDDLLSCCGSSCGNGCEGGYPIQALRWWDSKGVVTGGDYHGAGCKPYPIAPCTSGNCPESKTPSCSMSCQSGYSTAYAKDKHFGVSAYAVPKNAASIQAEIYANGPVEAAFSVYEDFYKYKSGVYKHTAGKYLGGHAIKIIGWGTESGSPYWLVANSWGVNWGESGFFKIYRGDDQCGIESAVVAGKAKV

SEQ ID NO: 6513 - protein, 120 aa, Caenorhabditis elegans
MPMVRVATNLPNEKVPVDFEIRLTDLLARSMGKPRERIAVEIAAGARLVHGATHDPVTVISIKSIGAVSAEDNIRNTAAITEFCGKELGLPKDKVVITFHDLPPATVGFNGTTVAEANKK

SEQ ID NO: 6514 - protein, 435 aa, Caenorhabditis elegans
MPDHLGDDMRKTKKDDTKEEEKNFQALDEGDIAVLKRYGQGPYAEQLKTLDADIENCLKKVNELSGVKESDTGLAPPALWDIAADKQAMQQEQPLQVARCTKIITSDKHDPRYLINVKQFAKFVVDLADSVAPTDIEEGMRVGVDRNKYQIHLPLPAKIDPTVTMMQVEEKPDVTYSDVGGCKDQIEKLREVVETPLLHPERYVNLGIEPPKGVLLYGPPGTGKTLCARAVANRTDACFIRVIGSELVQKYVGEGARMVRELFEMARTKKACLIFFDEIDAVGGARFDDGQGGDNEVQRTMLELINQLDGFDPRGNIKVLMATNRPDTLDPALMRPGRLDRKVEFALPDLAGRAHILKIHAKQMSVERDIRYDLLARLCPNSTGAEIRSVCTEAGMFAIRARRKVATEKDFLEAINKVVKGYAKFSATPRYLTHN

SEQ ID NO: 6515 - protein, 590 aa, Caenorhabditis elegans
MKTVRFNKQALAILAACFIFLLCVVCYFSASSESHNAVVVGERARGHIAVRDVENRHLAEEKHAVIHAKTVGKIERVVSQEKVEILRPARVESKPPGEKTSTEPEETGVGKAPIQTSEGLEKLIGKIHYENKDEENDLRRQKVKEMMIHAWEGYKNYSWGANELRPMSKKPNSQNIFGGSQMPATIVDAADTLFIMDLKDKYKEARDYIENNFSMAKSTSTLSVFETTIRFLGGLLSLYALTQESFYIEKAREVGEALLPAFNTPSGIPKSNLDVASKHASNYGWANGGQSILSEIGSLHLEFLYLSRISNAPIFEKKVKKVRDALEKAEKPNGLYSNYINPDTGKFTGSHMSLGALGDSFYEYLIKSYVQSNYTDTQAKNMYWDVSDAIQKHMIKVSKQSNLTYTVELNNGQAQHKMGHLACFVPGMFALQAINEDTEEEKLRIMTLAEELAKTCHESYIRSETHIGPEMFYFNERDEATSKHSENGYIQRPEVIEGWFYLWRLTGKTMYRDWVWDAVQAIEKYCRVDSGFTGLQNVYNPKAGREDVMQSFFLAEFLKYAYLTFADESLISLDKWVFNTEAHPVPVLTN

SEQ ID NO: 6516 - protein, 480 aa, Caenorhabditis elegans
MASFVEMRKLAEAKVQNMIRTIVKPKEQNGNVEPKKEEDEKFESTYKQNENTQITPSSFGKRPLYSKVDINCDKWLMTLDEESRLKIDNPPSLVDGLSKETESELRYLGCELIQQGAILLKLPQTAAATGQILFQRYYYQKSFVRYHFEHAVQACLLLASKIEEEPRRPREVYNVFHRLERLHRLQQSGHDINKETTRGMKPPAVDMNYINTKQHMINSERRILATLGFVVHVKHPHRLIVAYGHTLGITQSRPDILQRSWNYMNDGLRTDIFMRYKPETIACACIFLAARTVENPIALPSTPFHWFEAFDTSDRDVEAIALQLVGLYARRTFPNWPRIKAELDALRSVKDAEMKAVKAKEIAENLAKMAPDGEKSTSTVTIGKDSRKVSPDRKNGTKDRGEADRGKKEKDRHRRRSNDRDGRGDRRDRDKDRGDRRKDEKKDRRKRTRSRSRDRKDKNRNRDVGKRYRKESSTPPRSRR

SEQ ID NO: 6517 - protein, 400 aa, Caenorhabditis elegans
MPNSYQQYSRKRQTSKVISRLKRKNYKTPGKRLINWSTVEFPNSPANRKMKTAIAALLVGLVAVNAYNVEVKHGDAIPVEAQMLRGQELVDYVNKVQTSFKAELGSYFSSYPDTIKKQLMGAKMVEIPEEYRVFEMTHPEVEDAAVPDSFDSRTAWPNCPSISKIRDQSSCGSCWAVSAAETISDRICIASNAKTILSISADDINACCGMVCGNGCNGGYPIEAWRHYVKKGYVTGGSYQDKTGCKPYPYPPCEHHVNGTHYKPCPSNMYPTDKCERSCQAGYALTYQQDLHFGQSAYAVSKKAAEIQKEIMTHGPVEVAFTVYEDFEHYSGGVYVHTAGASLGGHAVKMLGWGVDNGTPYWLCANSWNEDWGENGYFRIIRGVNECGIEGGVVGGIPKL

SEQ ID NO: 6518 - protein, 547 aa, Caenorhabditis elegans
MRRKIHEVTGHKFMALFLRQPTFCAHCKEFIWGIGKQGYQCQICTVVVHKRCHEDVVWKCPGNKADAVEELGKEIQETGAGRFNINMPHRFSVHSYKRPTFCDHCGSMLYGLINQGLQCSTCKLNVHKRCQRNVANNCGINAKQMAAELAQLGLTGDKMSIRSKKKPSIMTDTSTDISGSSNSENSGYLQQISEDDSGTTSSRSASKVPGGTLSIHDFTFMKVLGKGSFGKVMLAERKGTDEVYAIKILKKDVIVQDDDVECTMCEKRILSLAAKHPFLTALHSSFQTSDRLFFVMEYVNGGDLMFQIQRARKFDESRARFYAAEVTCALQFLHRNDVIYRDLKLDNILLDAEGHCRLADFGMCKEGINKDNLTSTFCGTPDYIAPEILQEMEYGVSVDWWALGVLMYEMMAGQPPFEADNEDDLFEAILNDDVLYPVWLSKEAVNILKAFMTKNAGKRLGCVVSQGGEDAIRAHPFFREIDWDALESRQVKPPFKPKIKSKRDANNFDSDFTKEEPVLTPSDPAVVRAINQDEFRGFSFINPHFTY

SEQ ID NO: 6519 - protein, 1081 aa, Caenorhabditis elegans
MTSKRPGGSSFQPEVKRKRESDEFEQCYVSRFENELPSVPTIDKTGWARPAVDKDLGISKSIACQILEVETYHEDGSATSYDRTNVKLYGVTKSGNSICVIVTDYFPHFYFQAPQGFGVEHIGTAQSAICNMVAAAKRRGGSGQAQLPGKVVDNLVHVEIVHGENLYYFRGADTKVPFVKVSGSTEALHKARMELKNGVNLMGKGPVNVGNLYESNINVIVMFLAKTNIVGCGWIEIPAGKCRILSNSEKSSRCQIEVTVPVKNLIVHESDGEWAGIAPIRTLSLDIECIGRRGVFPEAIKDPIIQIANLVKIEGEAEPFVRNCFVLGTCAPVVGSNIIQCVNEKVLLEKWAEFVREVDPDIITGYNILNFDLPYILDRAKVLSLPQVSHLGRQKEKGSVVRDAAISSKQMGSRVNKSIDIHGRIIFDVLQVVLRDYKLRSYTLNSVSYQFLSEQKEDVEHNIIPDLQRGDEQTRRRLAQYCLKDAYLPLRLLDKLMSIINYIEMARVTGVPMNFLLTKGQQIKILSMMLRRCKQNNFFLPVIEANSGDGEGYEGATVIDPIRGFYNEPIATLDFASLYPSIMIAHNLCYTTLLKSPQGVENEDYIRTPSGQYFATKSKRRGLLPEILEDILAARKRAKNDMKNEKDEFKRMVYNGRQLALKISANSVYGFTGATVGKLPCLEISQSVTAFGRKMIDMTKLEVERIYKKGALDGKCPADAKVIYGDTDSVMVKFGVETVAQAMEIGLDAAKEVSKIFTPPIKLEFEKVYSPYLLINKKRYAGLYFTKPDVHDKMDCKGLETVRRDNCPLVAKVLGVCLEKLLIERDQQSALDFAKRTISDLLCNKIDISLLIISKELTKSGDKYQAKQAHVELAARMKKRDAGSAPRLGDRVPYVFVAAAKNVPAYERAEDPTFVLQNNIPLDTKHYLTNQLAKPLARIFEPILGDRAEKILVEGEHTRVRTVVQSKVGGLAAFTTKSATCLGCKSVLPRAESENAVCKHCEPKLPTIFASRMNTMHELENHFGRLWTECQNCAKTMQDKVNCSARDCPIYYMREKVRNELSEASAVIERFGDPCFQAPTK

SEQ ID NO: 6520 - protein, 781 aa, Caenorhabditis elegans
MITRKAIFFLALASIIQASDDSEAPDNKKSSIRFTPSVIDSYREKVQKMFYHAYNGYLDHAFPLDELKPITCVGQDTWGSFSLSLIDALDTLLVMGNTTEFRRAVSLVLEKARDDANVNVSVFETNIRVVGGLISAHMLAGRHKDLVVDWEGYPCDSPLLKLAVKMADRLMPAFNTETGMPYGTVNLKYGVHKDETPITCTAGVGTFLIEFGTLSRLTGDDKYEKVALKALDALWSTRSPIGLVGNHINVQTGQWTATDSGIGAGVDSYFEYLAKGAYLFRRPSLMKQFHEHATSINKHVRKGEWFMWVSMAKGSVSLPIFQSLEAFWPGTLTMVGDVQDASRIMLTYSEVIRKYGFPPEFYNIHNEEPGEKRAAFPLRPEMVESLMYLYRATKDETWLELGAEMIDAIESSARTKCGYATINNVKEHSIEDRMESFFLAETTKYLYLLFDPTNFIHSKGDQARILTSPKNLTCVIYGGGYIFNTEAHPVDPGMLDCCSVQAKRDQEVGVKQVNNGDEHEKMNRTEKGGEKYFENQYGKNENLIEFEVDEKLKKESEKRKIELEAEKVKENSHKAMLKVREILVRAHQKDEAMQRNGETSDSARKLMDQLYKAYPNHTAELENLNKEAIIEFEELQHLEDIRELVREIPIPEVFCEKCCVPLHEIVDSVVLRVLMADVYEYHFYPTRKTKFLHGPVCWLEETPRIEDDYKNEPPSVNTEKWNSPLFTSDQASLNDFIGDDLETVRKFGFKTLLAPGYKKLDKLIAGQNIALRRKKSWYYEV

SEQ ID NO: 6521 - protein, 479 aa, Caenorhabditis elegans
MNPVKHRFRYIVVFLGLACLTSILSNYIIINFTFICMKDDPTGIETTENGTIYNRYDYSVAEKSAIVWAVAIGTILGTGPINYSYVRFGARIPFFIAGIVSAFATVLTPYGNGWLQKIISKPFLKMGQQLELNFLKNLSTSECLIMMGLAYSADFAAIGIVCVRWAPLAQTGLFISILTSFSPAATVMTNAASGWLCKSSYGWQSAFYVHAAAGFIIFAAWLYFYNDDPQLNQKVSAKELTTIQKDKTKAHIERDSFVPYWEICKNRVILTVWINSFFEMTTLILLLTYSPIYFRKVLDFSVVETGMLISLSAVAHMPAKLLSGWLSDRQFLSERVRMWFFNTSSVGLAGFMCVSLAYIPVSWKYTSVIMFSIVYTLMGTNCGGFYKCGTFASRQYAHFVLAMIQFMKCIALFAAPATVAIFVSDESSHTQWGHVYILNGLLMFIANILFFPMATDKPQSFTFVTRETIEEEKKKHQFA

SEQ ID NO: 6522 - protein, 349 aa, Caenorhabditis elegans
MKLKAQTLAVAKPDAKLALDNYLKSIDPRETYPDDVNSVKPHHIRVIGAMGDSLTIGYCASHFIERINGPNPGNSFFTGIDEEIDGHLSIYNIFRVIAEETGNKLFGGSTGVGYGNNTGLNVAVGGMKSDDILRQAKDLVSRIKANKEINIEKDWKLVSLWIGTNDVGNLVFGSENPIPVKEYKAFIEEGLLYLKKNLPRTIVSIIGMFPPQLLQEAYYILRTGNRPGTPESRKQLDELCDSYRNASYEIQNEGKFDDREFTVVVQPFGTEYTDAFRNEFGNYSSALYAYDVFHLGKLGQAIVAKHYWQNLFEPVGEKTKRAELGNITPEIFGLSSGNSLIKTLGNSKK

SEQ ID NO: 6523 - protein, 348 aa, Caenorhabditis elegans
MNLEAQTLAVAKSEVKMALEKYLNSIDPHEIYPDDVNMIKPHHIRVIGAMGDSLTIGSRAENIVGQRQRYPGNAFFTGMDFEVDRHLTVYNIFRIIAEKTGNKLFGGSTGIDYGENTGLNVAIGGMKSDDILRQAKELVSRIKANKEINIENDWKLVSLWIGTNDVGTLGYRLEDPIPVDEYKSHIEKGLLYLKENLPRTIVSIVGMFPAQLLQEAQSILKNGKRARTVENQKKLDDLSDGYRNVSYDFQNNEHFNSNDFTVVVQPFATEYTDSYRDEHGKYNPTFYASDLFHLSKFGHAVLAKHYWLNLFEPVGEKTKRADLGDTKPKIYELNEKNCLIKTVGNSKM

SEQ ID NO: 6524 - protein, 337 aa, Caenorhabditis elegans
MYADFIAGWAAEQLYFLLSITAKVIASYKNKVFERLRFLYDLKISILKKHLNINARYLFTVIPGGAGLLVGHPLDTVKARLQTMNIYKGIVDCMVKTMKQESVYGLYKGMFVPFISTGALHSLLFAGYGAGLKFLNPGDSNVMARKDLPMSDILIASICGTLVQVGPVIPVELLKTKLQVQRENIGHFSKHSRNLYAGPLECARETVRAEGVRGLFKGGSVVFCRDNIGYLFYIPVYEGLSRYFRSHNLENTWTQLFAGGCAGVSGWISVCPLEVVKNRIQADKSHKTLSPKEMTLKIYREDGLRAFYRGGWAISLRGFVVNAVIFVVYENTYSFFD

SEQ ID NO: 6525 - protein, 451 aa, Caenorhabditis elegans
MRLLLPLLFCVGAFCLDNGLGRTPPMGWMSWTAFYCEIDCVKHPTGCINEQLYKDMADQLVSGGYDKVGYKSVHIDDCWSEMERDSHGILVANKTRFPSGMKALAKYMHDRGLKFGIYEDYGTKTCGGYPGSYKHEKVDAQTFAAWDVDYLKLDGCNIDQAMMPIGYPLFEKELNETGRPIMYSCSWPAYLIDHPELVNYNLIGKYCNTWRNFDDINSSWKSIISIISYYDKMQDKHIPTHGPGKWHDPDMLVIGNKGITLDMSISQFTVWCIWSAPLIMSNDLRIIGDSFKDVLKNKEAIKINQDPLGIMGRLIKNSTDIGVYVKQITPSKGDKKSFAFAYLNRNEKEGYKRIEIQLASIGLTDPAGYYVHDIWSHVDLGLLRSGDSIVVSIAPAGSVFFRADLASLHQPKGKRRYKFDNSNVVYEFEREQSQLGRFDFGDYLRTNRVQF

SEQ ID NO: 6526 - protein, 906 aa, Caenorhabditis elegans
MTKQRSYSITQRQNQHRFYRPGHGVFGHLPDPPKRVFENQGGLTPENAQRVHLINAFRRYGYLEADLDPLGLRKVESVAELDPAIYGLSLDENVKGNFSLHDLAEQLRHIYCGPTAIEFMHINNWEERQWISQNFENCIAEELRKEELLRIGDLMLKCENFDKFLSTKFPTLKRYGAEGAESMFAFFSELFEGAAEKQVEEIIIGIAHRGRLNLLTQLMDFPPVHMFRKIKGRAEFPESADAAGDVLSHLVSSFDYKGSEGNVHVTMLPNPSHLEAVNPVAMGKARARAWSMNKGDYSPDERSARAGDSVLNVLVHGDGAFTGQGVVWESIALSQAPHFRLGGTVHLVTNNQIAFTAESSVGRSSTHCTDIAKAFEYPVIHVNGDHPEEVVKATRLALAYRERFRKDVFINLVCFRRWGHNELDDPTFTSPVMYKEVEARESVPRLFLDRLVEEGFTTEEAVKEQLQKHTEQLNNELKKVDSTVPIDISHRGRWEGFKQAPKAIESWDTGVATDLLRFIGAGSVKVPEDFDTHKHLYKMHIDSRMQKMQTGEGIDWATAEAMAFGSILLEGNDVRISGQDVGRGTFCHRHAMMVDQSTDHIHIPLNELVEEQKNQLEVANNLLSEEAILGFEWGFSSENPRRLCIWEAQFGDFFNGAQIIIDTFLASAESKWLTSSGLTMLLPHGFDGAGPEHSSCRMERFLQLCDSREDQTPVDGENVNMRVANPTTSAQYFHLLRRQVVPNYRKPLIVVGPKILLRHPKAASTINEFGPGTTYQNVISEEHATSSQKIKKVIFVSGKHWINVEKARDERGLKDSVAIVRVEMLCPFPVVDLQAVLKKYPGAQDFVWSQEEPRNAGAWSFVRPRFENALGVRLKFAGRPELAWTATAIGEHHTKEAEEVINQTFA

SEQ ID NO: 6527 - protein, 1992 aa, Caenorhabditis elegans
MSGNPDAFENDPGFPFLGISREARAATAARPFDSKKNCWIPDPEDGFVAAEIQSTTGEQVTVVTVKGNQITVKKDQCQEMNPPKFDKTEDMANLTFLNEASVLGNLKDRYKDLMIYVRKLKLFKKKINTIQKLNRLNFQTYSGLFCVVINPYKRLPIYSESVIKHFMGKRRNEMPPHLFAVSDEAYRNMVQDKENQSMLITGESGAGKTENTKKVISYFAIVGATQAASGKEAKDGKKGGTLEEQIVQTNPVLEAFGNAKTVRNNNSSRFGKFIRTHFSGSGKLAGGDIEHYLLEKSRVVRQAPGERCYHIFYQIMSGNDPSLRGKLKLSNDITYYHFCSQAELTIEGMDDKEEMRLTQEAFDIMGFEDNETMDLYRSTAGIMHMGEMKFKQRPREEQAEPDGEEDALNAAAMLGIQAEEFLKALTKPRVRVGTEWVNKGQNLEQVNWAVSGLAKAIYARMFKWIITRCNKTLDAKEIERKHFIGVLDIAGFEIFDLNSFEQLWINFVNERLQQFFNHHMFVLEQEEYKREGIAWTFIDFGLDLQACIELIEKPLGIISILDEECIVPKATDMTYAQKLLDQHLGKHPNFQKPKPPKGKQGDAHFAIVHYAGTVRYNATNFLEKNKDPLNDTAVALLKHSTDNSLMLDIWQDYQTQEEAAEAAKAGQTAGGKRGKSSSFATVSMIYRESLNNLMNMLYQTHPHFIRCIIPNEKKASGVIDSALVLNQLTCNGVLEGIRICRKGFPNRMLYPDFKHRYAILAADAAKESDPKKASVGILDKISVDGNLTDEEFKVGETKIFFKAGVLAKLEDLRDEILSRIVTMFQSRIRSYLAKAEVRRRYEQQTGLLVVQRNVRAWCTLRTWEWFKLFGKVKPMLKAGKEQEAMGELAVKIQKLEEAVQRGEIARSQLESQVADLVEEKNALFLSLETEKANLADAEERNEKLNQLKATLESKLSDITGQLEDMQERNEDLARQKKKTDQELSDTKKHVQDLELSLRKAEQEKQSRDHNIRSLQDEMANQDEAVAKLNKEKKHQEESNRKLNEDLQSEEDKVNHLEKIRNKLEQQMDELEENIDREKRSRGDIEKAKRKVEGDLKVAQENIDEITKQKHDVETTLKRKEEDLHHTNAKLAENNSIIAKLQRLIKELTARNAELEEELEAERNSRQKSDRSRSEAERELEELTERLEQQGGATAAQLEANKKREAEIAKLRREKEEDSLNHETAISSLRKRHGDSVAELTEQLETLQKLKAKSEAEKSKLQRDLEESQHATDSEVRSRQDLEKALKTIEVQYSELQTKADEQSRQLQDFAALKNRLNNENSDLNRSLEEMDNQLNSLHRLKSTLQSQLDETRRNYDEESRERQALAATAKNLEHENTILREHLDEEAESKADLTRQISKLNAEIQQWKARFDSEGLNKLEEIEAAKKALQLKVQELTDTNEGLFAKIASQEKVRFKLMQDLDDAQSDVEKAAAQVAFYEKHRRQFESIIAEWKKKTDDLSSELDAAQRDNRQLSTDLFKAKTANDELAEYLDSTRRENKSLAQEVKDLTDQLGEGGRSVAELQKIVRKLEVEKEELQKALDEAEAALEAEEAKVLRAQIEVSQIRSEIEKRIQEKEEEFENTRRNHQRALESMQATLEAETKQKEEALRIKKKLESDINDLEIALDHANRAYADAQKTIKKYMETVQELQFQIEEEQRQKDEIREQFLASEKRNAILQSEKDELAQQAEAAERARRNAEAECIELREQNNDLNAHVSALTGQRRKLEGELLAAHAELEEIANELKNAVEQGQKASADAARLAEELRQEQEHSMHIERIRKGLELQIKEMQIRLDDAENAALKGGKKIIAQLEARIRAIEQELDGEQRRHQDTEKNWRKAERRVKEVEFQVVEEKKNEERLTELVDKLQCKLKIFKRQVEEAEEVAASNLNKYKVLTAQFEQAEERADIAENALSKMRNKIRASASMAPPDGFPMVPSASSALIRSSSNARFL

SEQ ID NO: 6528 - protein, 420 aa, Caenorhabditis elegans
MKEIINVQVGQCGNQIGAKFWEYISEEHGLQTDGTYKGDNGSQLERITSYYKEMEGRKYVPRAILVDLDPESINYVRSTQYGKLFDPENAVSGESGAGNNWSRGYYEQGAEIVDKVLSVIRREAEAADSLEGFQLIHSLGGGTGSGLGSLLISKLREEYSDKTLSTCSIIPSAKVSDTVVEPYNAILSMPHLMDNCDENFCIDNEAIFDICQYNLKLENRVTYASLALSGITTFQRFKGNLKTDIRKLNTAGSPRLHFFMTSFAPVYGKGIIDCQAFSISDLTQQVLDAKNIMTCNHNQGKFLSSAIIYRGQQTEKKDAEQIISVENEDPSEMIESLPKSTNTDVCDIPSRGLKTSATFIANSTAIQEPLKRISKQFAGLFRRKAFLHWYTMEESEFTDAENKVNDLISEFQQYEKVHSA

SEQ ID NO: 6529 - protein, 420 aa, Caenorhabditis elegans; identical to SEQ ID NO: 6528

SEQ ID NO: 6530 - protein, 437 aa, Caenorhabditis elegans
MHWLIIFFLLGKCDGLFMQENASIAIIGAGFAGLRAAQRFEELGIVYTIFEGSDRIGGRVYSFPYQNGYLQFGAEYINGEDNDIYEIVERKNLLSTSETDKDEFETMVYGKPVHDTFHNIWNRFEITTMAKLEKDAANKGISMNSVPQRIDFYFEEFKNITGLDPDEAIVFEKMLKIYKNQFQIEWSASAEDLCLKNFNTWDSGVDSEATLNNMGFKTILDELTSKVSKSKMRMLSKVEGLDYTGKFFQSRKMRAIERAGFGSNLKIFLEYEKPWWPLGTTLRISGKIEVNQTTLEDDFMVFEPSSWAKNILVAWVAGNGPMKIAELSDVQLNEIISKHLTTNLKNIYNIPKIQKIYRHNWITDEFARGSYSYISENTCHSNTDDIKILRDPVLRNRKPIICFAGEHTDSKMYQTAVGASRSGLREADRIFNYMRST

SEQ ID NO: 6531 - protein, 894 aa, Caenorhabditis elegans
MVDYYQQPPSYHQPGYDYTQQEEEWDREGLLDPAWEKQQKKTFTAWCNSHLRKAGTSIDTIEEDFRNGLKLMLLLEVISGEPLPKPDRGKMRFHKIANVNKALEYIESKGVKLVSIGAEEIVDGNVKMTLGLIWTIILRFAIQDINVEELSARDGLLLWCQRKTAPYNNVNVQNFHNSWKDGLAFCALIHRHRPDLLDYSQLHKGDPIHNLNLAFDIAEKHLDIPKMLDAEDMANSQPDEKAVMTYVSCYYHYFSGMRKAETAANRICRVLKVNQENEKMMEDYENLASDLLAWINRWMPWLANRSTDDTLQQAQQKLEDYRNYRRREKPPRIEDKGRLETLFNTLQTRLRLSNRPAFLPRDGHLIKDINAAWAGLEDSEKGFEEWLLSEIMRLERLEHLAEKFRRKCALHEEWAHGKEDALRSNDWRSCGLYKIKALRKRHEAFESDLGAHQDRVEQIAAIARELNNLRYPDIGPINARCQAICSQWDRLGQLSSKRRETLEDAERIAERLDSLYLDFAKRAAPFNNWLDGAREDLADLVIVHEMREIEELVNAHDQFKSTLGDADREFSSINQIEHEVEHLVTSHGLDRELLRNPYTDLSASDIRRKWGEVQNSVPRRDSQLQAELKRQQNNERLRTIFAEKANQVGPWLERELEQVLAIGLGGRGRLEDAIQQLRSIQRNVLGYKPNLDELERVHQEMQENFVFENRKSRYSMESLRVGWETLLTSINKTINEFENQVLLRDSKGISEEQIAEFRASFSHFDKERAGLDPEQLRSCLISVGYTIRPGREGDAELHRVLAHVDPNRMGRVPFEAFLDFMTKENSDQDTVEQMIDSFRILASGKTFITADELERELPRDQAAYCMARMAPSREPGAPPRSFDYVTFSRSLYSQ

SEQ ID NO: 6532 - protein, 920 aa, Caenorhabditis elegans
MVDYYQQPPSYHQPGYDYTQQEEEWDREGLLDPAWEKQQKKTFTAWCNSHLRKAGTSIDTIEEDFRNGLKLMLLLEVISGEPLPKPDRGKMRFHKIANVNKALEYIESKGVKLVSIGAEEIVDGNVKMTLGLIWTIILRFAIQDINVEELSARDGLLLWCQRKTAPYNNVNVQNFHNSWKDGLAFCALIHRHRPDLLDYSQLHKGDPIHNLNLAFDIAEKHLDIPKMLDAEDVSRHPDEKSTMTYVSCFYHAFRNMRDPPPPVIRQPPPQRVVVAPPPERDWRKDAETAANRICRVLKVNQENEKMMEDYENLASDLLAWINRWMPWLANRSTDDTLQQAQQKLEDYRNYRRREKPPRIEDKGRLETLFNTLQTRLRLSNRPAFLPRDGHLIKDINAAWAGLEDSEKGFEEWLLSEIMRLERLEHLAEKFRRKCALHEEWAHGKEDALRSNDWRSCGLYKIKALRKRHEAFESDLGAHQDRVEQIAAIARELNNLRYPDIGPINARCQAICSQWDRLGQLSSKRRETLEDAERIAERLDSLYLDFAKRAAPFNNWLDGAREDLADLVIVHEMREIEELVNAHDQFKSTLGDADREFSSINQIEHEVEHLVTSHGLDRELLRNPYTDLSASDIRRKWGEVQNSVPRRDSQLQAELKRQQNNERLRTIFAEKANQVGPWLERELEQVLAIGLGGRGRLEDAIQQLRSIQRNVLGYKPNLDELERVHQEMQENFVFENRKSRYSMESLRVGWETLLTSINKTINEFENQVLLRDSKGISEEQIAEFRASFSHFDKERAGLDPEQLRSCLISVGYTIRPGREGDAELHRVLAHVDPNRMGRVPFEAFLDFMTKENSDQDTVEQMIDSFRILASGKTFITADELERELPRDQAAYCMARMAPSREPGAPPRSFDYVTFSRSLYSQ

SEQ ID NO: 6533 - protein, 462 aa, Caenorhabditis elegans
MRPLALLICIIVLFLVTEARYNPRKGLAAGRQRKHKYQDEGEAFVVLVAGSNGWYNYRHQADVAHAYHTLRNHGIPEENIITMMYDDVANNPLNPYKGKLFNRPHGKDLYKGLKIDYKGASVTPENFLNVLKGNASGIDGGNGRVLETNDNDRVFVYFTDHGAVGMISFPDGILTVKQLNDVLVWMHKNKKYSQLTFYLEACESGSMFEEVLRSDMDIYAISAANSHESSWGTFCENDMNLPCLGDLFSVNWMTDSDGEDLKTETLEFQYELVKKETNLSHVMQFGDKDIAKEAVALFQGDKEDREYVEDFGLSASKSVNWPARDIELNHLISQHRKSNDLLSSNKLEYKINRIKETRRAIKRNVHMIVQKFFDGESEDLISRVLTQTRPVLDLRCHHIAVHLFKKYCINFNEYEYAMKYVKVINNMCIYRRIEEIVLALPDICMDIDIEQEVAIRLEKEFL

SEQ ID NO: 6534 - protein, 462 aa, Caenorhabditis elegans; identical to SEQ ID NO: 6533

SEQ ID NO: 6535 - protein, 218 aa, Caenorhabditis elegans
MRHMFFGVPSQDTQSVAVLSYSFFKFLRIFYHFDLLNIRFKFSTSTVSGCKAIRAERMAIPSNLMQFSEDIIKQLTPEEIDEFREAFMMFDKDGNGTISTKELGIAMRSLGQNPTEQEILEMINEVDIDGNGQIEFPEFCVMMKRMMKETDSEMIREAFRVFDKDGNGVITAQEFRYFMVHMGMQFSEEEVDEMIKEVDVDGDGEIDYEEFVKMMSNQ

SEQ ID NO: 6536 - protein, 189 aa, Caenorhabditis elegans
MTNSVFYSDPLLSQHLLEGYSEEELQEYRQVFNMFDADRSGAIAIDELEAAIKNLGLEQTRDELDKIIDEVDQRGNHQIDFDEFCVVMRRLTMKKSNWNEVVKECFTVFDRVSSNACRFCDSNSFVFQSENGGISKKDFRFILRELGDITDNQIIDEIFNEADVDGNGVIDYDEFTYMVKNYMTDDDIV

SEQ ID NO: 6537 - protein, 334 aa, Caenorhabditis elegans
MNPFSDVMRKALCSSPQSPSSNSTGLVPFGSPKFYVLCGMGGSICCGFTHLVITPLDIVKCRMQVDPLKYTGVVQGFKVAVAEDGVRGLARAWAPTTIGYSAQGFGKFGYYEIFKNVYGSMLSEENAYTYRSWVYLAAASSAEFFADFFLAPFEAVKVRMQTSSTAPKTMRECMPMIYKKEGMYGFFKGLPPLWTRQIPYTTVKFVCFERIMELMYTHVVPKPRAECTKMEQLLVTFSAGYLAGILCAVASHPPDVIVSQLNQDPNATLTSTAKKLGLKGMWAGLGARIIMIGTITAMQWFIYDGWKVVMGIPRPPPAEMPDSIRKKLENVQRK

SEQ ID NO: 6538 - protein, 3871 aa, Caenorhabditis elegans
MFTTLKSRQDTQTSAMRVVLNSAKHYLVALRNMTLEVNILKKWKTDKMARDMRRRGLLVKMTRQIIGINKLIAINACDPNKCSNGGTCIPSFGAKFTCLCPPHFTGTTCEADIDECSVYNGTTAGCQNNGTCINNRGGFECQCQSGYHGSLCQYHMSACSKTFELCGPHGHCIESIVDPTGQSSSDTTTYKCICDWGFKVSSDKNNPTCVDVNECESNPCHPGVDCINLPGSFVCSGCPKGYKTDGNVCIDVNECEGEIRVCSPLSKCHNTLGSYYCDSCPTGYSGDGGNCVKDDSCVKNKCHKLATCKVTDDGYSAVGDYTCYCPDGYVGDGIGEEGCVKSASNVCQNHNCVNAGKCKPTSDTEYKCECEAGFLGKFCEKTSPCQTNPCKNGGTCIAVENSAYCDCPEHFFGRACEEEEEHCGSHFTHSSGNYTFDLQRSNKTELSICDFVFNIPAANSAVVMTFTEFDKFTQEGSGPTDCAKTDANLTLYDGPEDSSSEFATFCGDSHSVHAPLSDTPITMTSTGAMLRFRGTQGSFTIKWETVERKCGYRSSKPEGIISVPQNHQDIVFSMHSKDIEKCDQNSLEIYDGYATYDKHRILETCSSTLESQVVRTTGPFLTVAFISNMLQSDAGLETIRGFVLKYKFTTPDRECGAEIDNDSNDFSFSGVIESPNYGSLYPPNMDCTWKINGTLSNGSYSGDMVLKLTFDEYDVKSGFSANGPGMHYRSFRRLLPRNEVEYGIAPGFSRVFAYRNLFDMGTCTNDFLKIHDGDGTLVQETCNPRRPPNVLTVNNPAAVLTFHSDSAEQGKGFRIQYEMLCEKRVNGNGTIQTWNFPNGGAAGTCTYIIEAPKTHVISVRFLTIGLRVLPMSECFYTPNAVETYENYVEFSGGRTDNALFNRRYVCARYPFVEGAWMSVSAARRLQIKVGSDGNPMFKGLSLEYKTSDVGCGGVFSSMTGTISSPNYPEKYQPHMHCVYNLYVSWSKTVKLTFDVFDLEVTPAKSCEYDRVEIYTSYHNETVHGELLGKFCGAMIPPSIYSTTNTMAVVFVSDRSVAGPGWNAKFEAVSRKTTCDFTLTAPSNNLIFDPQQLKFDKCTYHIAVHENQRILIKMNNMSLPCDKSSLMFRNGPSETSPPFSSLPPESEICTPKVNYMPVIRSFSNRVTIVYKSINSEGSFFNLTYETITSGCGGRVDGLTGIVSAPQYPLGDKKNLKCDWTVAVALGNKVRFALTALDDLNSSDSGGFCPLFAANRIDFFDSALQGNQHLKRYCAKEMASEPITSDDNELIIKYVQSGGFQSKKIFGFSGHFTTLCNGIVHEAISGSIQSPGYPYKVYSNQFCTWTIKVPKGNRIVATVHHFSISQKSYFEGGINCITDMLKVDDTDLAEAEVTFKKTDYNITNSVNKYCDKAIPRVIRSRHNSMKLTYSSQGDPTNQFWLSWNTLGCSRDITAPQQLIITKENIDPEVDEFECQYKIQAPIGKQINLKIDKMDILPIGTNCTYTKDFSGFAIFMSDSNKSGTPFQTYCSSINQQNISSHTNELFLFLSMKKDKLKTNVFFNATVEFVDVPQSSQSDICGQVINLERGKKNYITSPGYPSAYLPGIKCNFLINAPPGYHIEYALEKYYSPYYHDDRKTDKPRFMSPYTANYTCKWYLAYNVGMLSFYEGNSSSSSPVERLCDESDTVQTFELYASQSLVIFEGASNYMSQKSGEGVRDQIGFVLSMIPKCGEGICNVTIKKKDPQDSEINIRLEEYTKLNSSSTHTIDDRIDIYVGGVLKYTEMLKATDNTMQEYASDEEMMISVQNANAPHSAIIVVSTDDKSCGGEVRHSQGTIYAPTRRLDKPFDCGWAISNSNGNTVTLSILDHNLKSTPNCTDSYIEIRANNSSGKLIKRQCDISSIDSTEYESQSLYVFLRYRPSASDGNDDDDDTPDIDQQDSNKRPLFKARYEKVSGGRPKSRYVSSPMIDNTEMMVWTLDIVDEKAGILVKFIDLYLPSPTSYLRFTESGENDDVASSDYEEVTGVMAPAEKFFETNLIRVYGKLEKSDKFSFTWDPVPLNYRNLTLAKDKPAKVYDCGGDLTPTYEWDYFTNPLPAGQSFGYEENLHCRWIIRRPMFTGIELKFDYLELEDVQNCAFDFVSFRLQFDDQPEENDDVDLSSVSKHCALVRSNNTFNFSVNRALHIHFVTDRSRHGIGFKLKYRLTCNSFEHIRPGIFFEHTLTSPNYDGNFHTPSVWKCQYSLIIESNRKVSVEIVDLDIQENSPCSYNNALILGNRFSELVETHSQYSKSSKYCGKLEQGERLNFTSARGRLFIKYNSGPNSRKGFKMIIKEQLTECPSGVLHVDDNSPSRVLNSPEFPQRIPNSVECEYVMAAPNGHRLMLTFDSENFDIDGNQKNCDLLDYIEIRDGPTVHSEVIGIYCGNQAPSTIFSTTNFLYMKLHTSEYGKSRRFVATYGIATCGGTVMVRENVTTHITSPSFPYPFATPVQCQWNVKSPNTHMIEAKVDHVWLFYNPNCTMEQLMIRDGNSTANPLIGPVCVPRHAPDVFTRSASNQITVQFTSNSTTTRGGRQYCSNKKCGFDVAVTMSGEKCGGRITNLIGTLTPPGYPGKLLSHVKCIWDFKMKPGFIYRFKITFPGANAYHKFDNQVFRIAKQHCFPDVAVVEGFPPYDGAQYSTYFCKNETQITSITDTIRIVYDDSHTREMISAIGNDQPLNSTFYAPFTIDYMAIPANSENQGCTLQINKNLTTEFHLRNKVNGKGVGLDSFCHVSIEKPANFESVHIEISDYKADSELQPAGAKCFSWGAHLKIKSDEPVPIETTVCDGKSMKNKQSEMIYVNPQIDLFISQLFRDQEGQQFNLTIEFQKCGGVISSPNTGDITSPNFGSGLKYLPGSKCRWVLEAPEGQIVKVKIVEMQIAYDHECENDHLIIGEGRQADVNTIHKYCHKMDGEQEQKLEDRFKIIKSHGRYLTLIWVTNMKYEEAGWKIQYEFLNENEECGYHTSGMSGTIYTPMFGDKDYENDLECVWDIQVPLGYHINLKFKDFDVETAENCAKDQLLISQEHSTRANSPNGDYYFLFQDEEKETPLCGIEHPKDFESESNRVRLNFTTDSQTTARGFRVNWEAECGAIYRLNHGVITSPYYPNGYPNDITCTYLIAPPDQNSVIAIKFADFDLATMRTSFGRAPCEDDYLQIIDTGTDRVLHTFCASEPMPKDALVFKGAIGLKFVSDKSYYWMEEDNKYGRKGSKGFQLAYSINKCGDNIELREGTGFITTVTSPAFPLPYTKDLDCVWNITTDPNRQLNIRFEEMKLEAFHDCSADYIEFFDSSDIMANKTLGKFCGTMDKIPQYRIVTSGPNLLIHMRTDFNVNSGGFKLAVISSLGQKEGCGGKLTATTSWQTLTSPKDEDGNYPPALLCGWTISGPVDSQLQIRIDGVDTEQLEYPPGDRPSPECIDALAIYDGQEFFSPLLAGDICTSGTPLPKILYTSHRHAFITFETDRDGTGRGFNISYSIVDSDCGGWLKATNEIKTLVYKGITSDDNKEMNKERSHQRCRFMIQGPKTEPVIVNFQQFNIPSKAGDCSDSFVEIIVSADIMPNKNQSRPSLKFEYNILDSCNRTIDTNTIKSGRLTSPNYPQVYSENSTCVTNLQSSNQKMLLVFNDFTLEEPNNVNKNCDYDYLMLKEGDSNGTYYCGSTLPKALMTSGKDLTALLKSDHSLNHAGYDASYYTVVSERDDQIQFADSYELEGVISSIGYPNGYNKSYTQIFTLRPPNSHDCSIIFTDVSISMTQLPEECFQPTEEYLEIEVKFKTQVKKARIRSCTFALKKARELILEADNNDRYIKFAFKSDAKSENDGRGFKIRWKCHSIGKTQAVLPS

SEQ ID NO: 6539 - protein, 3871 aa, Caenorhabditis elegans; identical to SEQ ID NO: 6538

SEQ ID NO: 6540 - protein, 364 aa, Caenorhabditis elegans
MGALCSSETYMLDKEEYKKQVEHNKSIENDLEKDRKIKILKLLILGPGESGKSTTIKQIKIIHDEGYSAEEKMVRKHGIYMNILEGIEEIHLSVGRENKSYKNPLSFDHINEVRMFTENFKKADDSEKLLGPEVINAIQKYIKDETIAMMLRDKTVYNIDDSTIYFLENFSRIIQKDYLPTEEDILKSRVPTSGVIQYKIMLKNFNFRIFDVGGQRAQRRKWLHVFDDVQAVLFITSLSEYDQVLREDATVNRMKESLNLFEKICNGRYFLNTAMILFLNKIDLFKIKIKHTNITVALTSYKGPQECDSALDYIRKRFISLNKNKKRSIYEHVTCATDTEQIQVVIDSVIDVVIQHTMQKVGIQ

SEQ ID NO: 6541 - protein, 390 aa, Caenorhabditis elegans
MFSAESNLRNRWRLSKTLSENIFLKIDENLKIETQILEERKKKALKLLIIGPGESGKSTIVKQVRILHCGGYSVEEKRALKHGIYINILEGIDEIHWAIMWRQLIYENPSSIECLNQIRIFTKQFNKTGETENVLCKDIIKSIQMYIKDETVAMMLRNKTVYNIEDSTIQQVKRWVLFSLIIIISSFIENLARVIGKEYLPTGEDILKTRVPTLGIAQYEANIKHLTFKFIFFDIGGQRAQRRKITHLSGHVLDDSHAILFITSLSEYNQVLREDAFVSRIEESLHLFNEICNGMYFHSTAIILFLNKIDLFEIKITHTNITVAFPDYEGPRERDCALEYIRVQFISLNNNKNRKIYQHVTSATDTARIQVVIDMLFDIIISASLKMVGV

SEQ ID NO: 6542 - protein, 251 aa, Caenorhabditis elegans
MKTSDGVIVNHTSQFITFAGIGKEICLSLAKAGAQVIAFARNEANLLSLVKETTSLRYTIIPIVGDVSANEEVLFKLIVPHFPIHGLVNNAGIATNHAIGQITQQSIDRTFAVNVRGPILIAQLVARNFVDRQIKGSIVNISSQAAIRPLDNHTVYCASKAALDMVTRCLANELGSQNIRVNSVNPTVVMTDMGRDNWSDPDKKKKMLDRMPIKRFAEVDEVVNAVLFLLSDNASMTTGSTLPVDGGFSNN

SEQ ID NO: 6543 - protein, 428 aa, Caenorhabditis elegans
MKTFIALLALLTVVSAEVHQFNIGYRPNMRQRMNAKGKLAEYEKERNELLSKKSLQLASSSSPVIDYEDMAYMVQISLGSPAQNFVLFIDSGSSNLWVPDITCAGGKDATCGSYCKSTPYDACLTFCQEECCTKTVEGVKVLSTTDACQSKHRFNSSLSSSYVTNGQKFDMTYNTGEVKGFFGVDTFCFTNTSVCATGQVFGQATTIGEAFAKQPEDGIIGLGWPALAVNQQTPPLFNLMNQGKLDQPYFVVYLANIGPTSQINGGAFTVGGLDTTHCSSNVDWVPLSTQTFWQFKLGGVSSGSYSQAPNSGWQAAADTAASFIGAPKSVVTSLAKAVGATYVPLTGAFFMDCDAVVPDIVFTINGKTYNMPSTSFVVSAGPGPCMFAFYELTAGGFYPAWMLGPPFMRAYCHVHDMKSGRLGLAKVL

SEQ ID NO: 6544 - protein, 356 aa, Caenorhabditis elegans
MGCNFSSQSKLQVPEIRASRSITPASQKSEDPYSHIRLLLLGSAESGKTTVLEQVRLLYKQHFTESEYFHRRAFIYHNIFKSIKALCRAMRMSDIQFADPINMGRAQSIIADEHGHYGLFSKDLAEKIKHIWNDKSMQKLYARRSQFNLNDSASYFLNNIDKINMVDYKPSERDLIMAYVPTCGVQNVIFTACNQSFQLFDIGGQKIDRRKWALQYEGIDAIFFCIAISEYDQVMSEDMVTNRLDDALNLLQSISEDPAFATTPIYLFLNEIDVFCEKLSVIPLSKYKPDFKGGDQDDAIDFMENLACEALGKRDRSLYRVYRCIAIDTQMMAELLSTCFLKKERRLIRYANNIPV

SEQ ID NO: 6545 - protein, 356 aa, Caenorhabditis elegans; identical to SEQ ID NO: 6544

SEQ ID NO: 6546 - protein, 241 aa, Caenorhabditis elegans
MKFLYRTTCFLIIVFSSTVFANDKSWKEDDGLEITITSSIDESECEIKSAGGDVVDQYYKLTDEKGVEIGSNFGKKPYTFTLGRNQVIPGMDRAMRGMCIGEIRKVVIPPKLGFAKDSTGQPLYYTVQLVNLFRANPGERWVTEEGIQIDQIHKIEADKCKKAEAGDKIYQQYVLRLEDNTLEVIDGMDIAMDGMCEGERRRVVIPSEYGYGSQGSPPEIPGGARLFFEIVLEKLVKRDEL

SEQ ID NO: 6547 - protein, 343 aa, Caenorhabditis elegans
MSSKVPIFTLSNGVLMPSIGLGTWQMTGEEGKTVIRNAVLAGYRHIDTATLYQNEHQIGDALAELFAEGILKREDIFITTKAFCHEVAPDVVEEALRNSLKRLRLDYVDLYLAHIPASTKDDGSFRSDVKVEDIWRGFEKVYGLGLTKAIGVSNFNESQIVRIMNIQKVPIHASQLELHLYLPQKAHRELCKKHNILITAYATLGSPGRMSVVGSNGRPLFESTQNSENEMNDKHVKALAQKYSKTPAQILLRATVEMGIIVIPKTTNPERMKENINIFDFNISNAEVNLLEAHERTKQERLFWWPKYFFLSNKNDTEHYFSALLIILKIHSRHRDNKCPKEI

SEQ ID NO: 6548 - protein, 988 aa, Caenorhabditis elegans
MASAYTYGSFPQMGHPPPKETKKGCQVKSFVLPVFCTLLGVLITAFITWHITKSQYSRNDPHDEIESENVPAAKPEDNISASELRLPTSVSPISYQLTVKTYLPGYGYTADKNNLTFEGQVLIELNITKSIKKVSLNSKDLNYTEEFIKKSSILVNGKSIAFTLDDKQSTHEKIFFNLDETVEPTTSATLKVAFGAPLRTDMSGLYQTTYTNSKGESKMAAVTQMEPVYARRMVPCFDEPAYKATWTVTVIHPNKTVAVSNGIEDKVEDGQPGFIISTFKPTPRMSSYLLAIFISEFEYNEATTKSGVRFRVWSRPEEKNSTMYAVEAGVKCLEYYEKYYNISFPLPKQDMVALPDFSAGAMENWGLITYRESALLYDPRIYSGSQKRRVAVVIAHELAHQWFGNLVTLKWWNDLWLNEGFATLVEYLGTDEISDGNMRMREWFTMDALWSALAADSVASTHPLTFKIDKAMEVLDSFDSVTYDKGGAVLAMVRKTIGEENFNTGINHYLTRHQFDNADAGNLLTALGEKIPDSVMGPKGVKLNISEFMDPWTKQLGYPLLNASRINNTHIIVEQSRFKLLATGKEEEKYSNPVWGFKWDVPVWYQVVGSSELEMKWMKRNEPLIIKSDKNVIINAESNGFYRAGYSSGLWKEISEMLKENHEQFSPQTRVRLIDDSFALARAGLLSYSIPLNLITYLKNEKEYLPWSGAIAKIRELIDMYGSNPEKDIVNKFMIALAENAPARRSIDFVSKNYLDEKKFYEVGAAQQIILNSCGFGDSVCQADMVKMFTEEVLAKCDATRILSECSQIPAPFRAESYCEAVRNGNSDTFEKVFHWYKTERNQVEKLNLMTALTCSKDILTLKKLLLDAMKPEGSSFRLQDCAALFAKISSNDATTDAMLNFLIDRWEDMQKRLATDHSGFSRVLSSIVNTLKTRGGLDQLRKFRKKAPKASEFGLDKMEESAEVTVTWRETNLKFVTKIIEEISKSL

SEQ ID NO: 6549 - protein, 1584 aa, Caenorhabditis elegans
MKHKKMLILLFLYLLIETTTANPAFYPYGQPAGDNRLDYSMEQSAIALKIPLTYMEQSVDELFLSHNGIVGLGKPTPEKIGGLMTISTPAIAVFYVPVTSGVIDYRVSSDDQGLLTKLTQDVKQVFADAVEFHGLQAVIITWTQIENAEKDGPASFQLAIVSDGISTYAIFRYESLPWSSSMGYYAQAGFVRSIGKIQTNVNSGGPDVKELVNLSNNQFGNFFIFRVSGSAIEDPKDEGADDYDYNNYDQEYEGEHPADCPKDKFVDNCPAECRTVRDERGCERCICAERPHAPRAPQEPRPELENTVEDDEDDEQVDGTRYEEPARQAQEQHHQQHHQPDQPQQQPQRSQEGSLPKMSCSQRDDKSCHANSVCQDFEGGFCCNCDTGFYGNGKECLPKGEPQRISGSFEGVINRIPIDKTELHTFATSTDGNVHTAVSKIPSDLGHPLRFLYSIGGVMGWLFADVQSPNVYNGFQLTGGLFNRTVALHIEQNYYVTIKQEFSGRNIHDYFKSHLFVSGTLPDIAPGSEVIFPDYEEEYVRERRGYLTSKAAFDVIVRDGGNVQTYRMSVDQQITFEECPNKEFDRDHSMKLHVKRINVVYNDDEGVVRYGAKNFATRSVGPAVSAPSGGHFDRRQHGQSNMASERPIEIPSQSESISTDSVCAPGRHQCTLPNMKCRVVDPSYRCECEPGYQAAHDASSHIGWICQDLDECQRGDHNCDQHAKCTNRPGSFSCQCLQGYQGDGRSCIREHQASHHEHNQQTPQEMAGVGATTEGFCTAHNQCHQWGECVFTSEHPTGRCKCRGWYVGDGVNHCGPPEENMPKHNANIPQRGGQACGSYVCDVNAECMPEPSGGSECVCKAGFSGNGVTCESLLDDRHAHSSHNRHEQQQQTGSLGKVCRSHDECSEHGSCAYHHSLGYYQCACTEPYVGNGVECTLPGSSASAPELGCDVTRDCSEFADCVYERSSTGATFRCVCQSGYTGDGKYCMQSQLAISAISPSVPQLPSEPAVLSTASCNPNCGPDAQCVYDDHNRQYRCECYAAFMGDGYNCVPLAKPNMVPAQPKTCVESSDCHINGHCVINEHGAGEYICQCLPGFSGDGFINCRGADQCNPSNPSACYQNAHCVYDAILNAHACKCVDGFKGDGTSCVPYAPATNCNLEPRICHANAQCVMHHDTNAYECICKPGSSGDGYTKCDVIETPRCTNCSIHAYCAQNPTSGAYQCKCNAGYNGNGHLCVSMSSCLDDRSLCDENADCVPGEAGHYVCNCHYGYHGDGRSCSPESSTRSDKLLVARGMAIFERSTNPDEYGKQLIVIPHHIPVGIDFDCKEEKIVWSDMSGHSIRTSSLNGTEHKSYFNKELSSPEGIAVDWSSRNVYYADSMNDEIGVASLNGKFKKSLVTEGLVNPRSVVLDLYGRHLYYSDWHRENPYIGRVDMDGKNNRVFLNEDVHLPNGLTILPNRRELCWVDAGNHRLSCIQYNGAGRRTVFSSLQYPFGLTHDEEQKFYWTDWKDNRIHSVGVYGEGYRSFQISLGGSGKVFGILAVPKSCVGPSTPCSEDNGGCQHLCLPGQNGAVCECPDNVKVKGC

SEQ ID NO: 6550 - protein, 260 aa, Caenorhabditis elegans
MPSNCRRFEGKVAIVTAATKGIGLAIAERLLDEGASVVIGSRNQKNVDEAIEYLKNKGLTKVAGIAGHIASTDDQKKLVDFTLQKFGKINILVNNHGINPAFGHILEVSDQVWDKLFEVNVKAGFQMTKLVHPHIAKEGGGAIIFNASYSAYKSPPGIAAYGVTKTTLVGLTRALAMGLAKDNIRVNGIAPGVIKTKMSQVLWDGGEDAEKELTDIQEIALGRLGVPDDCAGTVAYLASDDSSYITGEMIIIAGGVQARL

SEQ ID NO: 6551 - protein, 260 aa, Caenorhabditis elegans; identical to SEQ ID NO: 6550

SEQ ID NO: 6552 - protein, 484 aa, Caenorhabditis elegans
MDSEYRIILNVGGVRHETYKHTLKKIPATRLSRLTTNLANYDPVLNEYFFDRHPGVFAQILNYYRTGKLHYPLDVCGPLFEEELKYWGLDSNECEPCCWMTLSGTRDTQDVLKTLDELDIEVDQTEGPELYKRFGWEDDYHNDSLSAWQKIKPRIWRLFDEPNSSRSAQFIAAISVFFLITAIIVFCLKTHPGLRIPELAPFGNFSRNHRSTSSRIHPAQINIDKANSRPHPTFMYIETICNIWFTIEILARFSSCPSRFEYLRAPVNIIDIVATLTFYIDLLSSMFGATADLEFFSIIRIMRLFKLTHHNSGLKILMHTFRASAKELMLLVFFLVLGVVVFASLVYYAERVESNEDNQFVSIPIGLWWAIVTMTTIGYGDITPHTYLGRLIGSICALAGVLTIALPVPVIVSNFAMFYSHTQARSKMPKKRRGVLSMDQVAQHVSKTCSGSKFQWTNATEEYGKYTTCIQQPYTATYLNLVVS

SEQ ID NO: 6553 - protein, 2610 aa, Caenorhabditis elegans
MMLDRIMFLLFFILSLVIGSFSEYLDDKYYSTNSIDVVCKPCAVPSSNSVIWLPASRPPCLHPGQPIIHWPDLSDNLACPVPGLPDSVHSSQISLLEGEGLLLTKERICFFDGPIDFHYDYVCDGKLYRSKMRIGHSIASKKKLETRRTKRWARRRNPDANAVHFQQEKYVKELPEDTPIETIIASVKASHASSQPLYYSMVAPQDSRSQNLFTLDTMSGEIRLAKSMDREVLDKHILKVTAYERVDPTISASTTVVVHVLDVQDNSPIFEKDSYFGEIREDAPIGTTVLSVFARDLDSGENGEIEYSLGEGNGKNLLAINAKSGVIQTAAPLDRETLSLIRLDVIASDKGTPKRESTAMVEITVVDVNDNAPVFASDSYNVTILENITIPAVIATVKATDEDFGTNGKVHYSMASSSGIGGLTIDYSTGEVTLRERIDAKNSPITAVIRAKDGAQPALSSTVPLTINVIDINDHAPTLIAAQKMITLEENVAIGEEVGRVYAIDEDSGPNGIIKYSMEGSEDFIIDEDSGLIKTTKLLDRETTARYSLKVTARDMGTPSLNTSTTIAVVLKDINDNAPTFDKKEYNVTISEEMPRGSQIITLKAVDNDEDQKITYRIEEADREVFSILDIGDQGAILSVSGELKRQDHKVRVEISATDQGGLQGRCVVNVFIDDVNSAPYFNDHPFSVKIPEHSPIGYPVITLKVSFFSYFGFYGLKHFYVSSNLRKKRIPNSANWHAEDHDRGDNARIVYSIDSSQFFRIDPSSGDISVSSDLDREDRATFSVIVTASDHASPPLNTSTQIEVILDDINDNSPQFTSSSYAATISEDIPVGTSFLQVSAIDADIGPNGIVDYFLNESSSSPSIQLFRLDRTSGTLRVSSKLDREQFAVIVLPIFARDRGTPSLSAASEITLTLSDVNDNAPTFEQLSYDLYIAENSPVGSTVGTIVARDADEGDNADISFRIFGGADAKLFDIEEDAEQNGVVRILTRAEFDYEAKANKFFFELQASSGQLSSTVPVRIHVSDVNDNKPALKDFVILMNRFDNVQMARQIGFIPAFDPDQNATLEYFLEENDLIEAEKYTGKILVKQEWKRNMDVSFKTCVSDGANTECSTCRFIHVLVEPEWLSESFTLSLARMTVDDFWDPLVFQRFRDAMSTLSNWKPSDIHVIGVKQHLDDVIYINIAITDHGRVVRGWRAIELVKESIKKLEKMTLLQVEVIRDESCANEPCSHMAKCRQTQKFVGEMKAHETDNFIARTLNTVNTFVCECPSGFTSSGAHGDCDTRIDECYRGRCSNNSTCVAFENTYQCECKPGWIGRHCEISVHALTCVPGYCMSDSLCELDGNQMKCRHCKYHGEDTDERCRLRSVSFDGEGLLNVNLDLPRTQWTMKFRVSTIAHNGVLVFTGDKRSDFVEVSVVDRVLKVQFSLGGEKIDAKMENDVENRINDGEWHTVALEYSNKQITMSLDDCETNPSLLLNTSPNCAIRAKLNLEKKCEDPTVPCYRYLDISNGLFLGGRPGTSKQIEKAFSGCISDLSVDKEDVDFSTIKEMHKVGQVHEGCKHRKDFCSTSDGQCSATSKCVNRWGGRICSCPQSVHSTGECVGALGTQDLRGHSLFEEESFVLYQPSQVSVPFEVSFEFRTSRADMQVFALEFTQRSVHYNLEVDDGTLKYNIGDSEVELPAPEVTSKHWMNVVIKFEADSVATSINGIYSAEAKASISDMNLESLYFGIAPGTGHPSRFEGCIRNVLVDGRSISVKKKGKTRAGCVVPNRCSVDSICPAESDTCLPVCSVANVCSSGTCVSSNTTAGYECICPAGKTGKNCQLEAPKQMCPSGWWGTFPRCRRCSCAQTKDYEAQCDKKTGACQCKKSHFSTINGCVKCECGFGADSTECSADGHCKCNGDAVGRRCDRCSRFDHQLDSKTLKCRPVSGKCPSEIEYSIQWPASQKGSIVRQSCPVGESGLATRKCLETGRWSDVNAWNCTRPEYSIMVNKFEILEPSKLLTMVANATNTESSIRGRNQQIAAEALSRLVDYEQSMPMKGRAHIKDMKFTEKLIESLGRVMSEQPADEYSTLISKLWNYAETVAEIHENVNFLSPFFVANDHIVFASDKLDFGNILPKFNNFVDLRPTGFPRVRAIVTGTTQVVYSIVPYPRCNRCENPMIAIVANTSDPVIVEFEIEEDDGWKYPECVRFDEKSGTWTARGAALIGLNLTHAACEYNRIGVFTMFVNDQSSSIVRVAQMDNMTSPAIAGVALFLCFLSILLTLSRRSLKTHSVRIGFILFFAINILNLFFVHKTAINQAYCPVRNAMLSFTSSAPFAWLFLYGLYIYRMLADGSSSPSLTTSLLVGIVFPCLISFTTFFVTDQCSLSPHLWLFWCIILPIGLFLLLSFYAAATSVLVSLHKKYDVFVAKYNVKRAVFQHFILTIFTLGMTLTGLFANQLPLPMEIMEISQSIIYLIAALVIFLWCVCDITTKASDSNPSMWLDNQKSVMAESTMADPQCASPLLSPRHQHHEVPMDSEWVPDVNPSNHYHTSINEPDTPRRLLLPQNRDVINILSSPDQILNEGVGHVYRNNMGSLPRLRSAQDEADDAYYTYTASRKYKNTTSTFNRE

SEQ ID NO: 6554 - protein, 2610 aa, Caenorhabditis elegans; identical to SEQ ID NO: 6553

SEQ ID NO: 6555 - protein, 996 aa, Caenorhabditis elegans
MGKKDKKQELHDLKQEVKMDEHIVPIEELVARLGTNLETGLTRQKAQEVLAKNGPNALSPPETTPEWIKFCKNLFGGFAMLLWVGAILCYIAYSVDYFTMEYPSKDNLYLGIVLMTVVVITGVFQYYQESKSSKIMDSFKNMVPTFALVHRDGQKQQVKTEELVVGDIVEVKGGDRVPADLRVVSAFGFKVDNSSLTGESEPQSRSPDCTNENPLETRNIAFFSTNAVEGTAKGIVIYTGDNTVMGRIAHLASGLDTGMTPIAREIEHFIHLITGVAVFLGISFFIIAFILGYHWLTAVVFLIGIIVANVPEGLIATVTVCLTLTAKRMASKNCLVKNLEAVETLGSTSTICSDKTGTLTQNRMTVAHMWYDETIHECDTTETQTSQEKRTGASFEALVRIASLCNRAEFKAGQQDTPILRRDCTGDASEIALLKFTELTQGNVIAVREKNKKIAEIPFNSTNKYQVSIHDNGDHYLLVMKGAPERILDVCSTIFLNGKESELTDKLREDFNTAYLELGGMGERVLGFCDFVLPADKFPKGFKFDVEEVNFPLKNLRFVGLMSMIDPPRAAVPDAVAKCRSAGIKVVMVTGDHPITAKAIAKSVGIISDGTETVEDIAIRRGIPVEEVNPREAKAAVIHGSDLREMSEDQLAEIIKYHSEIVFARTSPQQKLMIVEGFQKQGQIVAVTGDGVNDSPALKKADIGVAMGIAGSDVSKQAADMILLDDNFASIVVGVEEGRLIFDNLKKSIAYTLTSNIPEISPFLTYILFGIPLPLGTVTILCIDLGTDMVPAISLAYEEAESDIMKRQPRDPIRDKLVNERLISLAYGQIGMIQASAGFFTYFWIMADNGFMPWDLYQLRAQWDSRAYNNVLDSYGQEWTYANRKILEYTCQTAYFVSIVVVQWADLIISKTRRNSLVQQGMSNWTLNFGLVFETALAWFMCYCPGLDNGLRMYGLRFSWWFCALPFSILIFVYDEIRRFLIRRYPGGWVERETYY

SEQ ID NO: 6556 - protein, 136 aa, Caenorhabditis elegans
MAFTFAAFCYLLALIAVGFCIFFAIYTVICVDELRTDYKNPIEQCRNLNQLILPEYIIHGTFTVLFIFSWQLISILANLPLAFYHIYTYAKRPVMSGPGIYDPTTILNRSTLSSTLRISWIKLAFYLVSFFYYLYA

SEQ ID NO: 6557 - protein, 356 aa, Caenorhabditis elegans
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVSFIKQKFAELNLNPDKKTIYMHETCATDTNQVQLVISSVIDTIIQKNLQKAGMM

SEQ ID NO: 6558 - protein, 713 aa, Caenorhabditis elegans
MLKHLFLFLFIKSSIAYNFYWYDKTQTLQNRQTMVHLFEWKWADVAKECENFLQYYGYGAVQVSPPMEHLKAFPNNNYPWWVRYQPVSYKLDSRSGNEQEFQDMVNRCNKVGVRIIVDIVMNHMVGIGQKSGNGVGSSGSSSFDGTHGVQSFPGVPYSLGDFNNPKCDGDIQGSDYQNSAEHVKDCRLVGLLDLNQASATVRAKIVAYLNKLVDMGVAGFRHDASKHMWPQDILNILNDVKDLRSDIYGSNQRPFAVHEVIDRGGEAVKCGDYFGNGRYTNFNFGAAVSAAAKQQSDWKYLANLGPGYGYGNNEDHDVLNFIDNHDNQRDSSPYVVTYKDGQKYNLAVGFMLAWPYGYPRVMSSFAFSYSDQSPPNSGASNDYATTSPTFNGDQTCNSNSGWVCEHRWPAIRQMAKFRSAVQGTAAADIVTDTRRIAFARDGKGFFALNQQDGAWTKIFATNLPAGDYCDHFSGGLDNGKCVGTKITVRDDHTSYLSVPSNSIVAISLDSKLTPYTPPAPPSGYSTTVILLKKDTNPGQNIFVRGGTSQAHNGKCSTGPYQQSSDPCAIPMYHATTVPFVFAEYLTWSQQDNYLDFEGAEINQGTHDGAAAFGTPLAYSTNDKTAIEYQPYNKYGPGYWIAVLRMDCSKAEQGWFEVKGYETPDIGWEGDIKQGSCSGSVGGSAPFSSINHVAKCGAVNVFTWGSASCVIDSA

SEQ ID NO: 6559 - protein, 440 aa, Caenorhabditis elegans
MFFFLVEAFKIFIFRIFSLQNNYFLSSISCFVVCGPAGRLSSFMFFHIFLGLLVAVLGEEVHELRSECLNEAQLMEKLLKGSGYSKHKIPRENGITVSVEFWIQEINSISEMTNDFELELFINEMWTDPSLRFPHLGACKANLTLDQQTLTKLWTPNTCFVNSKFAEIYESSFQNVFLTLFDNGTVWVNYRVRVKGACNMDLVDFPMDTQSCRLNYQSLESKFSMQNPTRKIYSFFPLTHVIFHVSPALFRSSIIVFSFTYNNEEVRLQWNSQRSPVFALQEIRIADFWLKDITPAVIKRDYPAGLWDELVVTFVFERRYMWYFLQAYLPTFFSIFISWIAFSLGPQAITPRTMIGVNALLSMIFHFGSIMKNLPRVSYIKAIDVWMLSSMTFVFLSLIELAIVGYKLQIQREKEHVIEKVDKIARFAFPAGFSIFNVRF

SEQ ID NO: 6560 - protein, 356 aa, Caenorhabditis elegans
MLFIFLSFLLPLFICTPLHSSVTYQSSISSEAIKLSGSDLTSYVNKKQKLWKAETSRMTFQEKMARAKSIKFIKSNDEVSEKTGNDNVLVDIPSSFDSRQKWPSCSQIGAVRDQSDCGSAAHLVAVEIASDRTCIASNGTFNWPLSAQDPLSCCVGLMSICGDGWGCDGSWPKDILKWWQTHGLCTGGNYNDQFGCKPYSIYPCDKKYANGTTSVPCPGYHTPTCEEHCTSNITWPIAYKQDKHFGKAHYNVGKKMTDIQIEIMTNGPVIASFIIYDDFWDYKTGIYVHTAGDQEGGMDTKIIGWGVDNGVPYWLCVHQWGTDFGENGFVRFLRGVNEVNIEHQVLAALPDSEKHN

SEQ ID NO: 6561 - protein, 528 aa, Caenorhabditis elegans
MASTATLSFGPNQENEVQLLPPKEEKTLDNFMKLGKYCWLILFFSEFMLLSGAGNTLYMMYAGAYPKLVSCEGPDVFIKDICKSSFDFHNPPNCTITSKYDFYSINVDYGHFCGEGAWVKTSISVQMVGVLIGSVTSGAVADRYGRLKVLSVCFFMVSSLSILNTFAKDLIYFTIIRTILSIFKGGLLSTYGVYKMEHVPRQHRFWIATMISWAPNYMILSFVAYLCHDWITYQYAIFALSMPGAVVFLFVKESPRWLIQAGRIEEARQVLKHIMEVDGNTSDHSWNEIEEMLQTEKKRQEERIKKRKNYDFRHLFWNKYMASVTMILWLGMFSTSFTNYGFVFNIEKLSGSLYINALLMGSLRWVLNIFFGLADLKFAKLGRKHIHLISKLTITICVFSIFVTYYFEYEEDYSLIIRVATLLASATASQVFITKSMVLMEFYPTVIRNSAVSFKSSASRIGTILGPQLFILCPYKSLPYAILTGFCLFDAIAFQLRLPETKGKPLPETMPERHKNGRTALPTTDPQN

SEQ ID NO: 6562 - protein, 297 aa, Caenorhabditis elegans
MSDSFANVPGGSQKLNSGYNIPFVGFGTYKVTGENVPPAIDAALTAGYRMFDTAKYYLNEKELGEALKILLPKHGLSRSDVFLTSKFFPESKNCREACRGFVEESLQSLQTDYIDMYLVHYPKPNDSDNDDVNNAEYRKIAYEVLEEAKAAGKVRSIGVSNYEIVHLEELKTYAKVPPCANQLEYHPHFARIPLQKYCKEKNIFFQAFSSLARHEPKLIEDPVVVELAKKHNTSVPLVLLAWALRQNVGIVPKSVTPSRIVENFKVIDIALTPEDIQSLTALDRGQHYIRCTGWLVK

SEQ ID NO: 6563 - protein, 283 aa, Caenorhabditis elegans
MSIKLNTGYDCPLIGLGTYKIIGDQVLPVLDAALTAGYRLFDTAKVYNNEKEIGDALEILLPKHNLKREDIFITTKMHPNTVENVKKLVDESLSLLKTSYIDMYLIHYPKSFDYGDQDPMNKTLRIATWNDLWECKNAGKIRSVGVSSFEIRHLEELKDLGKNFPPCCNQVEYHPHFTREELKNYCKSEGIFFQAFSSLARHNETLLSSEIITRLAEKYHVPKTTVLLSWATSQKVGIIPKSTNPERLAQNLKTVLLEEEEVKKICNLNLDKHYVRTTGWLVL

SEQ ID NO: 6564 - protein, 1164 aa, Caenorhabditis elegans
MLRRLKEQVSQVANDIDGRLNNSRPSISSQGSQSQSQKSENDQEIEGFLCPMCMVELGGPDELTVHFEKEHSDFQTSANRNHPDYTPPQQAPLAFATKDQEIEELRIRVNEEKRFAERIKEELDNIKSVMAIASEVTEDEIPYMAQQIQVLTADKGMVTRQFLELEKESGQQSRELQQVKQERGDLMAKLKQMSVTMREITDESESGKVEMEDLKRELKVVKSDVVRYEIEVSRLEKMLDQRPSEDDVNVLRTELVNAQKLMDAISQEKDIEIKEHLNSIRNLSMEREKQHIVNENLEKKIGEGEETVKQLQISYDAQSEELKQRNERVVQLEARIEENVFELSENKQNVKRLEDKVQESQDALQMLSNINGSNEEQMISLNSKFERNTAERKRIEAVFEEKVTVQGERLKTLEMANLDLTNELASMGSLLDKERSLLEEKNKEISERDSSINDLKEKLAESEKKATKYKNELKEHADLVENLTLQLNKLQENSKDLMEKISAGEGGAKMAIEQLEQEKVKLTNELQTSSEKTKKASGELEAKISELEKKLRDAEASRTDKEQKWKQEKESFERKLAEAEDEIKRKGERFVEMEKEMEEERQKATDRTLKLKDALVNSEKNLETIKKESEDREKIVREKDAHLEENKKRIEDAVQKLEEAEKRARELEASVSSRDTTVSTKESELSELKGKLTESNSFIEELKVQVEKVSNEISEKQQEVENLMAEMRDKEAHWKTKRDEFEAQMLRNQEDNEEASSTLKSVQEQLMKEKETSGEEKNQLISVKSQLEELKTEVERLIRSEEEKTQEIEKLKSAVTATTQERDELTATSESLRTECENLNSKIQSIEESRRHAEEKGSENLERMITEKSRLEKDIEERESTIQSIQEALETKDNEIESLKTTQRVVEDELVSKISHIESFNSRIEEFEKEMASGKRTIERLEAEKAEETEKLVVFTGTQSQKQEELEKLQKEIQEKETTIARMTSSKTQFEAMFADVQQTLSKEINDKTEEIERLMERIDSLEKVNHSRIEELESRLTQRERVVESLEADLAAVRNIEQEKLDELQKLKEEFDGKFKYFKSRILFNSKKLQIDADRYSSRKWLDDAEAINCTECGKVFSLTVRKHHCRVCGKIYCNPCSSKSVRIASAKNPVRACNTCFTDSQK

SEQ ID NO: 6565 - protein, 478 aa, Caenorhabditis elegans
MSTSFIRRLAFVGLLLGVHAYHSRPKSEEHSPKHAASSSDLFEDDDQSTTLESIARLSAPAHVPIEQPQTSDTEILEHLLTRGYDHRVRPPGEDGTIHGGPVVVSVNMLLRSISKIDNVNMEYSVQLTFRESWVDKRLSFGVKGDAQPDFLILTAGQEIWMPDSFFQNEKQAYKHMIDKPNVLIRVHKDGTILYSVRISLVLSCPMHLQYYPMDVQQCFIDLASYAYTTKDIEYVWKEETPVQLKAGLSSSLPSFQLTNTSTTYCTSKTNTGSYSCLRTIIQLRRQFSYYLLQLYIPSCMLVIVSWVSFWIDRTAVPARVTLGVTTLLTMTTQSSGINAKLPPVAYIKAIDVWIGACMTFIFCALLEFAWVTYIANKQDANKRARTEREKAELPFLQNSHNDVWVPREVAEQEREVMTVRMNRRQTNSVWKWIKTKTEWNDKSKRADLISRVMFPVLFLTFNISYWTHYGQYGVAIST

SEQ ID NO: 6566 - protein, 426 aa, Caenorhabditis elegans
MILEWEGSENSTECLCSDIQRDDYSPFFEWANYLTIILALPVLSVFGVLTNIINVFLYTRKRLQNSANTYLLFLACSDFMVIVTGLFIFWIDSARSYIPELTQAPYTTVYTLPFGYMAQTCSIYFTVAAAVDCFVNVCWAKQAKHYCTVRRAKQICISIVVVSIMYNSLRFPQFNLRKCFNDITKEQVIEICPTSLFVTINSVYNIYMYMVLMTLLPFFFLLCINAIIVKRQSKAKTDESAPKNEGTSDDTITMIMVVILFLACNTLALVVNFIENFTEPSPVLLNFLSDTSNFLVVFNSSVNCIIYFIFNTDYRDVFLIYWKKLKRVLIEEYCCCCVPAGSRNYSAYQPVSTRLVIEKSQNGSSSTKLILPSLDLNRSDQASFAESESAASPIWQPLTTRNLPNVDWPNIDDDIDSGWDDGSQVI

SEQ ID NO: 6567 - protein, 856 aa, Caenorhabditis elegans
MKTKSLVFIFLPFLFQFSIAGPRINCYPEPSASQVLCEARGCIWNPIDNIDGSPSCFFKDGVGYNIDSQNGSTYNLQKNNGPKNPWGDDFQNIQLKTNMVGSVLNVKIGIDGRYEPPIDFSRATLPSSETLSFITESSDDLFCFSVIRNSTNRKIFDTSIGGLVFSDQFLQLATYLPSENMYGWGENTHQSLKHNFSRYLTWGMLARDQPPNSLNLDTMNLYGVHPFYMCLEPDGNAHGVFIFNSNSQEVTTAPGPSLIYRTIGGNLDIYFFPGPTPALVTQQYLEFIGKPFLPAYWALGYQLSRYGYSGLAEMQQRIGAVRDAGIPLDIAVADIDYMNRYKDFSTNDKWSGFEDYVKVMHGWNMKLIPIFDPAVEVDYLPFQRAMQMNAKFIEWENYSQVQQNIQNLYPMVKNSKIMLGVVWPDGPSQISWIQLEILKCGGETNWSCIINAYLSSKTICMGGVQNNGTYRFYDVKNLFGLTEAIQTQQALLDVTGKRGAVVSRSTFPSAGRYAGHWLGDNTARWEDLRTSVIGAQEFNLFGIPYVGSDVCGFLGTSNEELCLRWQQMGAFHSFFRNHNTLGEPAQDPAVWPSVAAATKIANLFRYQYLPHLFSLHFQASKDGLTVVRPVFFEFPTDSATLDLGYQFMWGSGILVAPVVYQGAVSTSLYLPNDVWYSLFNYMYGSRIDPGFITVPSPTTSRIPVFVRGGYVIPRQTPTTTTTMSRLNPFELLIAPCQLGRAAGVLYWDDGQRIVDSFDTHDYHQFDFKFNSTINGASLAITRTRKGTTVLPTLDILEIFNYTTPPNFRSFRLNGQSINVNVQTSTYSGITKILNISTKNFIDLTSSDVITLEWSNM

SEQ ID NO: 6568 - protein, 995 aa, Caenorhabditis elegans
MSSFGNNAGGGGREYHDDRSNRDHRHGNGGSDAGQRRREDHNSSYQSYRRPDGRQDSYGGGHQGNHGNSYGRREDDRSHSRDNHGGSRYGERDDRGNNGRSADNRYSQSNYNYDSNRGGQHYQRDNHGSKDDRGPMNQYNDHGSNHIPIAETTSIVRDLTKAMVTPAIAETMIVVVTTMTRLDHINRIEILTEVYSPRDHHNYNSQSSPRSHQGGQDRYSAPKEDNQRRYDNHQGGHDSYRGQNSGGYSGNNSGEYRNDYRSQQDSRDHRSGGNNSSSGFKNDGGFGGNDNRGFGNNGGGSFGNPNNSYRGNSNNIGGFHRSDGSNSEGVNAPVRAPRDWVPVTRDIDELVRETADRLADCDVGQDRAVEIRNAEKDVRLTSWTNSGLHPTILETLKRIKYNNVRTIQGAMIPQVLDGHDVLGQAETSAGKTAAFGLPIIDKILRMDEETRNKARQDDGPLALILAPTRELAAQIHEALRTYCQNTDIIVLLSYGQSDRARSLNEIRNGCDILIGTCGRIMDFTVKSHISLLHLRFLVFDEADRLLQDMKKDPLGHLGAIIKDAGFMESAATRQTIMTSATFNASVMTVANELMKRLPGQDEMIKIVLANGRLSKRVNLEFFECKGLAEKNAKLREILKQNVNGKTLKTIIFVQKKDQCDACAAKLTSGGMLAQTLHGDRSQDMREKLINDFKSNRVNLLVTTDLLSRGIDVSDLDRVINFDLPDGDPDQGADTFIHRAGRTGRTGRKENGLCVSFVDPQSDRDSLLAPKLVELIISQNLPDLKVPDFLDAMAKSSRGKSGTSGFGQRGGYGGRGGGFGGTGRGRGGGVFGGGGRGGDFGGSGNFGGSGGGGSFGGSGGGGGFGGVKPSGFGGSRNNAEPTSSGGGFGAPKAPTGFPSDNNDASEDAPAAGGFGFSTKAAQDAKKAEESATLGSSTFGTANNADEEPTETGGENIIFYTLLFYMKLSFQPMATTTTSGKIYATSSLLFDLERSFV

SEQ ID NO: 6569 - protein, 927 aa, Caenorhabditis elegans
MALFKHLALCLLLTLAAAEDDLKCYGADCEVPHYMDDTEQCSGLECESKETLLAMISHYQKEKHDEYLAPLTKPIRDESAVRNFLNEVAVTGDLAATVSPQCSICSQPGLCNSGQCVPDARFPWQYFYCVCPDYASGRFCQNEIKCKDNSCGKNADCYVANHQLNCICKPGYTARRNGRDCDMKVQQACMSGDPHYVTYDGLRFDYQGTCPYVFSQPCTTLPAPYLWYSVRAKNELPGKGYHISQVSEVEVDLHNLTIHVDGRSKTALVNGVQVLTPWYFPNKNTWTVRVRFSGSTFTIENDQGVVVTFTTYNSLCVQVPDIPEFNGATTLCGLAGNIDGKKLDDVVNKNGSVLAIKSSRQPENNNHADFMKTEDTWITDKFLILRPGQENCINGQTLDNNTNCVSTSISLAQSCADVATASQTCYPIQQAEMGLGTFGACQGLGNDTLEDFYYNCIYDICRNPAFKCTEFTYFLQYCQLALPQVAMNQNWRAQINCPLACPLNAHPSTCTSSCPSTCAEPFPEYCDQGCVDGCECDPGYVIDNTVTGSIKCIRLDQCGCVDSDGNAHRPGKPWVTQNCTIYHECQNGTMWSDYRPCSDDGSCVLNSIDMQCKCNNGYRGDGYNCTDINECVETPGICGHGQCVNTPGSYHCTCDDFWLGDNCNTYKPRRHCADLYVYWGVRESGVNSINPPFVLPQRAKFAPMNVYCDMTTNGGGYTLMSSDTADLNTNKTFQDYLIGFGNPATQSVWLGLEFIHQLTTYQPQNLRLNLFRCASNGRPSLTTDCTYPTFSVLDSTTQYSVVIREACTGSEADEHYYQDGWARWDLTQNGPKFSTWDIEAQTTIPPTLRAKMEGDAIYYTCSKSNFNTGWWYVEDQLCGAANLNGVRYTCPVIPVENERYLRWAEGTLGQSWMYLRPVGFPKYDTNM

SEQ ID NO: 6570 - protein, 915 aa, Caenorhabditis elegans
MALFKHLALCLLLTLAAAEDDLKCYGADCEVPHYMDDTEQCSGLECESKETLLAMISHYQKEKHDEYLAPLTKPIRDESAVRNFLNEVAVTGDLAATVSPQCSICSQPGLCNSGQCVPDARFPWQYFYCVCPDYASGRFCQNEIKCKDNSCGKNADCYVANHQLNCICKPGYTARRNGRDCDMKVQQACMSGDPHYVTYDGLRFDYQGTCPYVFSQPCTTLPAPYLWYSVRAKNELPGKGYHISQVSEVEVDLHNLTIHVDGRSKTALVNGVQVLTPWYFPNKNTWTVRVRFSGSTFTIENDQGVVVTFTTYNSLCVQVPDIPEFNGATTLCGLAGNIDGKKLDDVVNKNGSVLAIKSSRQPENNNHADFMKTEDTWITDKFLILRPGQENCINGQTLDNNTNCDVATASQTCYPIQQAEMGLGTFGACQGLGNDTLEDFYYNCIYDICRNPAFKCTEFTYFLQYCQLALPQVAMNQNWRAQINCPLACPLNAHPSTCTSSCPSTCAEPFPEYCDQGCVDGCECDPGYVIDNTVTGSIKCIRLDQCGCVDSDGNAHRPGKPWVTQNCTIYHECQNGTMWSDYRPCSDDGSCVLNSIDMQCKCNNGYRGDGYNCTDINECVETPGICGHGQCVNTPGSYHCTCDDFWLGDNCNTYKPRRHCADLYVYWGVRESGVNSINPPFVLPQRAKFAPMNVYCDMTTNGGGYTLMSSDTADLNTNKTFQDYLIGFGNPATQSVWLGLEFIHQLTTYQPQNLRLNLFRCASNGRPSLTTDCTYPTFSVLDSTTQYSVVIREACTGSEADEHYYQDGWARWDLTQNGPKFSTWDIEAQTTIPPTLRAKMEGDAIYYTCSKSNFNTGWWYVEDQLCGAANLNGVRYTCPVIPVENERYLRWAEGTLGQSWMYLRPVGFPKYDTNM

SEQ ID NO: 6571 - protein, 927 aa, Caenorhabditis elegans; identical to SEQ ID NO: 6569

SEQ ID NO: 6572 - protein, 915 aa, Caenorhabditis elegans; identical to SEQ ID NO: 6570

SEQ ID NO: 6573 - protein, 579 aa, Caenorhabditis elegans
MDDGSMTPEDQEPVTDNDMEYNDNGEESSYSNGSSSSYNADKLSSSRPLQHKLDLSASPSRNNDLNPRVEHLIALFKDLSSAEQMDAFTRLLQESNMTNIRQLRAIIEPHFQRDFLSCLPVELGMKILHNLTGYDLLKVAQVSKNWKLISEIDKIWKSLGVEEFKHHPDPTDRVTGAWQGTAIAAGVTIPDHIQPCDLNVHRFLKLQKFGDIFERAADKSRYLRADKIEKNWNANPIMGSAVLRGHEDHVITCMQIHDDVLVTGSDDNTLKVWCIDKGEVMYTLVGHTGGVWTSQISQCGRYIVSGSTDRTVKVWSTVDGSLLHTLQGHTSTVRCMAMAGSILVTGSRDTTLRVWDVESGRHLATLHGHHAAVRCVQFDGTTVVSGGYDFTVKIWNAHTGRCIRTLTGHNNRVYSLLFESERSIVCSGSLDTSIRVWDFTRPEGQECVALLQGHTSLTSGMQLRGNILVSCNADSHVRVWDIHEGTCVHMLSGHRSAITSLQWFGRNMVATSSDDGTVKLWDIERGALIRDLVTLDSGGNGGCIWRLCSTSTMLACAVGSRNNTEETKVILLDFDAVYP

SEQ ID NO: 6574 - protein, 725 aa, Caenorhabditis elegans
MSSNKKKFEWPYPKINHFPGRIERFSYRTYNWFENRLWPIRPIPFLALVTTATGYQLRNFSLPDIQQNIQTIVRPLAISIGSVYTSVFLLRHFLKYFYFSYKGYLKENPKKPSFFTILWGILRKAVLTIAPPQLSSCDRLLPNIPLPALKNTVKQYVDSMQLVLSEEDHTELIKTSNQFLKEEGRKLQRCAWLWHKLNENYITYFWEKYIYNAGRYALPINSSIGQCVMYGEDDLTQVYQVARLLRYESLANLSLDRQKHYKNIYNGCRVPGKEIDHFQWNPPSKHVLLVHKGTWYKVDTFDRNGKLYSVDNLAKIVSEIMHRQDKADGFLSKIGSLTTDRRTEWSINREKFFLNNKNNKKLLEIIETAQFVVAIDGTNHWGVESTKQVSRYMKDMLAGDGTNRWFDKTMNYAVDETGRGGATGEHSPCDGAELDHLCENFLNIDKQILKSPSKEEQLEIATVTEQDLKSLKLAEKLDFEIVDGMESEIERCYEAHTKSFNDLHMHSMVFLDFGKGKLKECGISPDGFVQMAIQLAYYKAGDQGKFTQTYEPGSIRFYANSRTETLRPVTKASCEFVEAMLSDKSDIASRRKLLKEACEVHVNNCKEIMLGNGFDRHLFVLCVLAKGLGYESPFLNFFQSQKWLLSTSNIPNMTNSIDEDSSIDKIMLGGSFGAVAQDGYGICYRFGGNQAILVHITSYHSSEVTDSDRMGNRLREAFHSLVDLF

SEQ ID NO: 6575 - protein, 725 aa, Caenorhabditis elegans; identical to SEQ ID NO: 6574

SEQ ID NO: 6576 - protein, 344 aa, Caenorhabditis elegans
MHQYTIEAIIGPMMVLGIFGNVNVIVAVARKKVLRTKGAMLIFVLAISHLVINIAELKTLIFRLRFQSLNGRECFLYNIPYSLAIMFQSWLFLSMALDLCFCIMIPIKHMLWPKTKYILIMCIMPTCCALIVFFVNFIFVTEEDAPYCAYMLTMDDGVFEIISTSVVACNILTLLITIVSVFVAIRKSQDMRNHRHSSVTRRNSTVEERRKVFRSTFYMMSIYIFCWMTSSICFRVLFYMFENETNIVPYMPYLAIITMPNFCQAYFVTYFRSPRFRKAYREHFHWLTFGCMYPDVFDGPELRGGESGSKQDSATNQQVRADSDKKQKKGSSKKTVRIYEGEVI

SEQ ID NO: 6577 - protein, 527 aa, Caenorhabditis elegans
MGGTQNGKAVANGKAKNGNITEKVIKLDPCPKPAFYVFWLVQLNITMMLVGAMVATLFDKWGIVKTKRSKGDPRMESFQPLGNSFDATYTDHIYRQSTDVVNRPISGVPGAIVRLKDRYTDDHGWTQKLVIERASQLEYIFWSYTGTESEVINLGSYNYLGFSHRSGVCAEAAAAHIDKYGINCGGSRQEIGNHVAHKSVESTIAQYLNVEDAIVFPMGFATNSMNIPSLVDKGSLILSDRLNHASLVTGCRLSGAHTVVFRHNDASDCERKLRDALCGVSPKTGEKYNKVLIIIEGIYSMEGTIVNLPAFIAVKKKYNCYLFLDEAHSIGAVGPSGRGVAEYWGCNPRDIDIMMGTLTKSFASAGGYMGGSKKVIDHIRRYSAGTCYGVTMSPPLIAQVERAVLIMSGKDGTDIGRQKAIQLLENSRYFRKELRKRGFLVYGNNDSPVVPLMTFYITKVVEFSRRMLKHNIGIVAVGYPATPLLEARVRFCLSADHTKEHLDYILEAVEQVGMETGTFYGTKIVDE

SEQ ID NO: 6578 - protein, 349 aa, Caenorhabditis elegans
MNIEWFAIGVGAIVVLYILYHFIKMIWSILGLYVFYQPIDLKKKAGASWAVITGGTDGIGKSFSFELAKRGFNIYIVSRTQSKLEQTKKEIMEKYSNVEVRFATFDFTNPSISDYKKLLSQLNEVSIGMLINNVGMLFEYPENLHKTVGGIDVVANVTILNTLPVTLLSAGILPQMVSRKTGIIVNIGSVAGAAKMAEWSVYSASKKYVEWLTGCLRKEYEHQGIIIQAITPALVATKLSGHTETSLFCPDSATFAKSALNTVGHTSQTTGYINHQIQCEMLALFPECFLDSFVKKSSVETREKALAKKENKHLLQLFEFFWKLVICIGDIVLYVTLFNKIFKKSESSF

SEQ ID NO: 6579 - protein, 314 aa, Caenorhabditis elegans
MDIEWFATGVGAVVVLYILYHFIRITLNILGPYVFCQPIDLKKKAGASWAVVTGATDGIGKSYSFELAKRGFNVYIVSRTQSKLEHTKKEILEVHPDIEVRFATFDFTNPSVSDYEKLLSKLNEVSIGILINNVGMFFDYPEMLHKINGGIDSIANVTIINTLPATLLSAGILPQMVPRKAGIIVNIGSVAGLATMAEWSVYSATKKYVEWITGCLQKEYGHQGIIFQAITPAMVATKMAGNPNTSFFTPDSDTFAKSALNTIGHASQTTGYITHQIECEMLKLLPDFVIDRSIKQTSAQLREALAKNENKPLM

SEQ ID NO: 6580 - protein, 485 aa, Caenorhabditis elegans
MTADKVAPLPQKGVAVAIPDTKSSNDDSKDQPGYVRYLIMISTMLCLTSLMSNVVCFNFTVLCMPGSGETGELVGNRTHFVGYTRQEKTVLLSTVAIGAVCGVFPVIIGISKLGLKKVFMTSGVLTAISTFLIPILAPLHFHLFIMLRFVQGLSYAACFPAVGAITSSWASLAQQGLFIAALTTFGQTSSIFSMPVAGELCTSVFGWKSVFYLHAIISLVVFTIWFALFTDSPEDNKLVRPAELAEIEFGKSEDEIHEHSNTPYLEILTTPSVWGIWIGAFGDLIAVQLIHIYSPVFLHDVGGYSFEKTGFAAAVPVLFQFFVKMFAGHSSDKVHGISETTKLRIYNTIALGASAIFLVSLGFVKQGQGVLGLVLMTLATGMFGFNGGGFSKCAALVSRQYNHFVMAIQQILVCLSMIVCPIIVSTILQHGTTAEWRIVFFVHAAILLICNAIFCWLATAKPAPWTDRTIKHSATKNTPLYQTKV

SEQ ID NO: 6581 - protein, 453 aa, Caenorhabditis elegans
MSAQFVAFLLIAFNLSLPANAFNGANASVGLFGNASSCPKAAKFGKGPPKSCTIPSDPNNKPASQLESWFTREMFEDLFPFANLGWGPSSCWPYSYDAFKIASRYFPEFGTSLNVNNTVYTADENKKRDLAAFFAHAIQETGENNNYLYTALPDQEASNCFYRGGFYNWFEGGPSSNFLNPETPGHSPTDGNSCTSAGRYCSASDQITFFYPCSNSTISNPAAPYKGCYFGRGGIQISYNYNYGQFQDWLKSVNITVDLLKEPNLVMTKMDPPLAIMASLWFYMTPQPPKPAMHDILMGNWNSGAQNSAAGYDGPIFGPTSLIINNECSGEDSKNPGGPGESRRIKAFKWFNGYFGSPVGPEHTLSCGKMPVKLNAIPHYQSYQPDWSSSWKPERCDCAPASYGGLVYYFDPNYYPASFVAQNDLNRKKCIETVYANPSMYFMDKKNSLCLNY

SEQ ID NO: 6582 - protein, 453 aa, Caenorhabditis elegans; identical to SEQ ID NO: 6581

SEQ ID NO: 6583 - protein, 453 aa, Caenorhabditis elegans; identical to SEQ ID NO: 6581

SEQ ID NO: 6584 - protein, 561 aa, Caenorhabditis elegans
MGDRGYGGSRSYGGSSGGGSRGGYGGGGRGGGGGGYSGGRGGGYGGGGGGGYGGGGYGGGGRGGGRGGSNGSAGGRLRDVDWSAENLTPIEKDFYHENAAVSRREQYEIDQWVSANQVTLEGRGVPRPVFEFNEAPLPGQIHELLYGKFQKPTVIQSISWPIAMSGRDIISIAKTGSGKTLAFMLPALVHITKQAHRQRGEGPAVLVLLPTRELAQQVQEVSIDFCHSLGLKMTCLFGGASKGPQARDLERGVDIVVATPGRLLDFLDNGTTNMKKCSYLVLDEADRMLDMGFEPQIKKIIGQIRPDRQTLMFSATWPKEVRALASDFQKDAAFLNVGSLELAANHNITQVVDILEEHAKQAKLMELLNHIMNQKECKTIIFVETKRKADELTRAMRRDGWPTLCIHGDKNQGERDWVLQEFKAGKTPIMLATDVAARGLDVDDIKFVINYDYPNNSEDYVHRIGRTGRSDKKGTAYTFFTHTNASKAKDLLKVLDEAKQTVPQALRDMANRSYGGSNSRGRYGGGGFQKRGYGGNDNFAPKRPRYDNGGYGGGSGGGGRW

SEQ ID NO: 6585 - protein, 1246 aa, Caenorhabditis elegans
MAPTLTSSGKRRTVKVSPDGDHVTHNRKNSSSHARSTGQSGMSSRSAARRNDQDVHVGKYKLLKTIGKGNFAKVKLAKHVITGHEVAIKIIDKTALNPSSLQKLFREVKIMKQLDHPNIVKLYQVMETEQTLYLVLEYASGGEVFDYLVAHGRMKEKEARAKFRQIVSAVQYLHSKNIIHRDLKAENLLLDQDMNIKIADFGFSNTFSLGNKLDTFCGSPPYAAPELFSGKKYDGPEVDVWSLGVILYTLVSGSLPFDGQNLKELRERVLRGKYRIPFYMSTDCENLLKKFLVINPQRRSSLDNIMKDRWMNVGYEDDELKPFIEPPKDQIDEQRIEKLIQIFQLGFNKAAILESVEKEKFEDIHATYLLLGERKSDMDASEITMAQSLLSHSSINVSSSLGQHPAGVITREHVTSSSASGSSASPSRYSRSSATATGASITAGSALASAANAQKHQQSSAAPSSGSSSSRRSSQNDAAATAAGGTVVMSGTRHGGVQMRAQPTSRQATISLLQPPSYKPSSNTTQIAQIPPLFNRNSTATSSAAQPSTGITGTRKIADPKGRIPLNSTAVQGHRTATGAVAANNGGIPSHRDHAQQQQYMNQLTSSTMMSKLINKTPAAGGTAATSSSSSSSATSTAPLQKSGSQISHAPTEPVIREDDDENNSENQNGNVPLIGGVGPQTSPAVQVPTEDATSSSDKEQQQQKASSETPKESNPIVWQNLHLNSLLKSLLDSSAATSYETPRRPGIAGRRSEPSAATPRRRHQTMVVDARHLQTPPDTDRPYHFEDTTLDRQMRALYVSTASSRMTRGVLPTPPTSNSTSSSFIVEPLTHVAAASPDITTTTPTKSTVTTSPYFRRTPSFRMVLIVLLLCDNGLRLWPSMIHQSPSMPPSQMMTAMESLKLSESGQTGGPTVATGGPPQRATSQQMSRSATTNSANMGASSGGAAAAASATNQLSGAPSSTGASSQQYHPKAPSSSSSSSTNPPHQHQLTHNASFSVTPSSYQIPTSTAVNVTSTGMPTSSSSSAFPRNTRNRQTFHGKTEKDKGGDDSSDEIGETPGNVSIGATGPSANNAEATIWSKLSKLTRRDHNRESMTQPVSGRAGTIGASQGQQTAAALAAIREQSGPIAPGAGQVAPSLPIHEGDVKPRSLRFTWSMKTTSSLAPDDMMREIRKVLDANGCDYEQRERYMILCVHGDPNTDSLVQWEMEVCKLPRLSLNGVRFKRISGTSIGFKNIASKIAQELNL

SEQ ID NO: 6586 - protein, 566 aa, Caenorhabditis elegans
MVFVSKAVPLKLSTQPVHERILDSCRIHAAANKDAIVFIDAETTTKKKLYRDVEPTVNSLATALVKLGFKPGDVAAQAFPNCPEFLIAMLAVMKCGGAMSNASAIFTDYELQLQFKDSNTSIVFTDEDRLARVRRSVAKCPGVRKIICLRTFPLRAEFPENVLDFVELTQTPDQPINVVVSPDAIALLPYSSGTTGRPKGCQLTHKNISAMLDIAQSHLETEVAQAMFGKEKPTWNKEHVLLLLPWYHAYGLNTMLETILLGATGLVFKKFDTIVMLNRIKFYKVKLAWLVPPMLIFLAKDPMVPIFNVAPYLKVIMSAGATAGKQLCEEVQKRFPNAWLCQAYGMTEMVQFTTLPIFEHGNCFETVGSLGPTYEMKILDKEGKEVDKTDTVGQLCFRGPTIMKGYLKKEESDIIDKDGFLKTGDLGSVDQKGRVHVTGRIKELIKVNGMQVPPVEIEDVLLLHPKVKDCAVIGIPDEQKGESPRAYIVKKDHTLTEAELSDFVHKMLSSYKWIDTYEFIDAIPKLPSGKIQRKKLKEMAAGGGSTENSEASQSSKEISERVGEKK

SEQ ID NO: 6587 - protein, 656 aa, Caenorhabditis elegans
MIFKFVVLLWFSAQFAISTKVQLSTGIIEGKQLNSTYSPFGNQSAIAFLGIPYVEPPIGDLRFRKPRPQKTWSGVLETKKFKPACMSNSTKTYKNGGIGGPISEDCLYLNVLTNQYCLENKNCSVVIIVHGGGYLFESAATFNHEILVNNFVGQDRNIVVVTINYRLGIFGFGHLNGFEGDKNVGIFDTLEAVKWVRREIKQFGGNKDRITLAGHSAGAGVVAAFTISPLTKGLIHQQIVMSGPMTNMSKKSNFKGMTAMAERVGCHSKKYGFNKLPEHEVEQVYSCLRKKPAQELLDAQLWLLQNSTFYFGAPPVDGEFITDYPDNLYSEKYISNSNYSKFETKETFLKNLCDQIGIEIYKESEDFSSKCQKWYINGSDSKSLSDDMEFYTQAINLADAHARKGKKVYMYSYAYSGAGPAFKKYMKVKSPHHSEDLIYTFGTHRGVFAPKDYVIEYIYSGMFADFINFEDPSPSTDQPWLQYTKENKEYFLVDFDQNLTMPGMKKNYYAKAYEFWSTAGQKSFKEEWSPSLDTFIITNLVAPIITHMDQITFDVDKTVEQMEILKIERENFLKSEKLKRKSELEMSRWIKKGRKRVINKRMGFMPVEIIENEESESDGGFSIGLLLFGGTLLGGIVYVSSYQFFRRSRNGYQLIN

SEQ ID NO: 6588 - protein, 705 aa, Caenorhabditis elegans
MLKPATVLLLIQMYVCKRVQLSSGTIEGKILNISYSPLGNQSATVFLGIPFVEPPIGDLRYRKPRPPKSWEGVLVTNEYKSACMSNATKTYKNKFGGPISEDCLYLNVLTNEYCLENKNCSVMMIVHGGGYLTESASTFNPEILINNFVGQGRNIVVVTFNYRLGLFSFGQFNGDRGDKNFGLYDMIESVNWVRREIENFGGNKNRITLAGHSAGASMIVAFTSSPLTKGLVHQQIIMSAPMTNMSKKSNFKGMTVMAQMVGCLSEEIGFNKLSEEQVENTYSCLRKKSAQQILDAQLWLLQNSTYFLGAPPIDEHFLTDYPENLYASKSIYPINTLIGTTTLEVEESSYIIDPAFADKKVELLENLCDHIGYVLYEEPETFSKKCQKQYMNGNSSMNLSNEMEFYTPAIDFADSHTSGNTKVFLYSYDYRGAGPAYDRYLEVRSPHHSEDLIYVFGTHRGIFAPKDYIIEKIYSGMFADFVNFENPLPSGDQKWNQYTKENREHFLINFDKNFITPGMRDNYYTEAYEFWSTVGKKSFKEEWSPSLDTFTCALVISPLVSHMKQTTTAFDKTFEQTELLYKEEVNFLKREKLERTQELKMETKRRDKALRIQNRKNGLANKEITEGDEEDESSKLVVSYFFWRKTFLTIRFRKNKFFGFILLSVSITDILLIISAGTLFGGILYVTLPNVILQKRARDGYELLS

SEQ ID NO: 6589 - protein, 673 aa, Caenorhabditis elegans
MVLLFLFLLSTLLHISISTRVQLSTGTIEGKILTSTYSPLGNHTGIGFLGIPFVEPPAGNLRFRKPRPPIPWDGILETKEYKPACMSDAKKTYKNGVGGPISEDCLYANVFTNQYCMKRKNCSVMIVVHGGRILTESASAFNPEILVNNFVGQGRNIVVVTFNYRLGTFGFGVLNGEKGDSNVGMFDMLEAVKWTRKEVHNFGGNKDKLTMVGHSAGGSLVGAFTSSPLSKGMLNQQIIMSGALYQMGKLANFKGMTAMAQKAGCLPEVFGFRKLSQVRIDKTYSCLRNISAQEVLDAQLWVLQNTTYYISVPHIDGEFLLNYSDEILASGTIHPINSMIGTTTAELRDPIYINDLKNADKKEELLKNLCEHIGYELYTEPEEFSRKCQKFYGNGDDAQFLADDMEFYDGSIKVANAHASKNTKVFIYDYKDAGPAFKKYAQAPPPHHSEDLIYVFGTSRGNFTEKDYVIEQIYSGMFADFVNFGNPSPSKEQKWKEYSPEKREYFLIDFDKNFTMPGTRDGYYSRALEFWSTAGTKSFSEHYSPSLDSFTTGILIDPIVSHMKGVATGPDKTFEQFEKMLLEREMFLKTLKSERKLELLKEKWRKIRNGGGRIVERAGNAPMEMRDGKKGSRGGVSLLLIIFGGTLLGGILYVTISHFCLHHKSREGYQLLK

SEQ ID NO: 6590 - protein, 673 aa, Caenorhabditis elegans; identical to SEQ ID NO: 6589

SEQ ID NO: 6591 - protein, 687 aa, Caenorhabditis elegans
MFFRFFILWAILQNVRSTKVKLSTGTIEGRTLTASYSPLGNQTGIVFFGVPYVEPPVGNLRFRKPRPPKPWDGVLEAKEYKAACMSDQKKTYKNGVGGPVSEDCLYANVFTNQYCLEHKNCSVMLTIHGGRFVIESASAYDPEIIINNFVGQGRNIVVVTFNYRLGLFGLGMLNGDNQDTNFGLYGLKNLEIFSLLPDILEVVRWTRKEIKNFGGDKDRITMQGHSAGAVFTAAFSTSPLSKGLIHQQIIMSASMSNLSKKSNVKELTVVARIVGCLPDEHGFPKLSNVEVEKVLEKKAYTCLRSKSAQQILDAQLYMLRNTTYYIGQGHIDGIYQVDYPDNLYATNSIYPINTMIGTTTAELMDSRYIVDPKNTGKKEILLQNLCEHIGYELYKEPEEFSQKCRNFYKNGEDAKSLGDDMEFYYGAIQLANVHSSKDTNVFVYSFDYKEAGNAYKKYDKSLSPKHGEDFAYAFGTNRGNFSTKDYVIEYIYSGMFADFVNFGDPSPLEDQEWAQYTPEKREYFLIDFDKNFTMPGMKDHYYPKALEFWSTCGSKSFKEHFSPSVDIFIIGNLLNPIMSHLNHNETGPDKTFEQFDKLYNEREEFLKLLKAVRKLEIQKKMWRGRSSKDLMLKELVDLEKINEEEQETGANFLLIIFGGTLLGGILYVSISHFCLHHRSRDGYQLLK

SEQ ID NO: 6592 - protein, 606 aa, Caenorhabditis elegans
MILQYLYFAVLIHLSISTRIQLSTGTIEGKILNATYSPFGNQTATVFLGIPYVEPPIGELRFRKPRLLKSWEGVLETKDYKPACMSYWRKTFKNGFVGEISEDCLYANVFTNQYCLQNKNCSVMIVVHGGRLVCESGSAFKPEIFINNFVGQDRNIVVVTFNYRLGVFGFGVFNGETGDTNVAMYDMLEAVKWVRKEIDQFGGNKDRITMAGHSAGAGLIVDTYLCLQNKSAQDLLHAQLSMQQNSTFYFGSPRVDGDFITDYPDNLFNFNTIYPINTFIGTTTGELRDSLYITDPKNDRIKEQLLKNMCEHVGYELFEKPEEFTKKCGNYYKNGTDAQFLSDDMEFYSGAIKVANAHKRANSKVFMYSYDYKGAGTAFHKYLEAPSPHHSEDLIYTFGTSRGPFVAKDYVIERIYSGMLANFINFEDPSPSKTQQWRQYTQEKREYFLIDFDKNFTMPGMKDHYYTRALDFWSTAGKKSFSERFSPSLDNFVMSILTDPIVSHLKGVASGPDKSIEQFEKVFNERESFLEELKLRRKLKLEKKIGVQMRNSVVEFEKDADQGTSGGVLNTLPIILGVTVFGSIIYASISHFCIPNKSRTGYQLLE

SEQ ID NO: 6593 - protein, 769 aa, Caenorhabditis elegans
MKPENGAATWHPAKRSCLGRLTTLETLLLVFLGLLITALLSVLFLWLWVLDGYKTFTDGRPIYPLPFENSSVAVDRSAKNHNDVVCTSRECVRLAGFLAENLNSKINPCEDFYEFACGNYGLNKNLPANKPLRHTISDVQSRLNKQVKSMLQSPISANEKPWDKVAKGYYQKCLDEEELESTGVEAMRDIAKRIGGWPTLEGDKWQEWSHSWEEQIALVLNLTGVNAVILEMAVTHDPSNSSRSVIELDQPKWGAGSRYPYLSGANDPMLRNYTTLMKMTAVALGADPAIAEKEMNEAMEFELKLVNFSADDMVRRDPERGNNRFELWQLKSVFPFINFEKYLKTVFKELVALSPNHTVIVREIDYFVGIQHVLQSTPKRVLANYISWRLVQGFSPFLPPSAREPFYQFKANQTGMFNSPPPDRWEDCVTLSVIMMDMPVGRLFVENFFEKERAMKKMTELTSYLKNEFIKQLHVLDWMDEITRRRAISKANMIEYKSGFPMVLFNDTWMEKNWGMIIKPREYLLHLTIRVKLVRFTEELLRLDQPLDRSMWFQSPAQVDAYYAPNNNEMIFPAGIMQFPFLTLGVPNYITYGMVGAVIGHEVSHAFDDQGGQYDEMGNLNDWWDAETEEKFIEKTRCFVRQYENVHVVEADIHLNGQLSLGENIADNGGVKTAFNAYKAWKSNTTGISEPALPGFQNFTSQQMFFLAYANNWCSLVRPKHYIQIILTDVHAPSKYRAMIPLQNRPEFAKAFQCPIGSPMNPERKCQVW

SEQ ID NO: 6594 - protein, 333 aa, Caenorhabditis elegans
MDGADAEEHGGFLFFVLASSVVFIVLFFTRRYFKGGQFNERVSAKGLVAVVTGSNCGIGFETVRELNLRKADVYMLCRSEEKANEAKRMLVRQGCDATRLHFIECDLTDFESVRRAAKETLESTDTIDILINNAGIMFQSKHEQTKDGHEKTWQSNHLGPFLLTELFLPAVKKSSYARIINVSSRIHLKSEKINLATVDDKKSFGMMKSYRQSKLANVMHARALTKELRKDGAEHVTVNSLHPGVVNTELARNTILNTPGIKQITAVFRWFLMKTSRDGAQTSIFLALGKKIGGISGKYFADCKLTQENPLALDDQACQDLYNYSLECTGLAK

SEQ ID NO: 6595 - protein, 246 aa, Caenorhabditis elegans
MSRGSSAGFDRHITIFSPEGRVYQVEYAFKAINSTNLTAVAVKGADAAVIAVQKRVPDSLIVADTVTSVYQISQSVGCCAIGMIPDAKFQIKRAQGEAASWKYKNGYDMPCELLAKKMADLNQYYTQNAEMRSLGCALLFISYDDEKGPEVYRVDPAGYYRGMKGVSVGVKQLPATSFLEKKIKKKSELTSTEAIELAIEALQTSLGIDVRSKDLEVVVVTKDNSKFTKLTSDQVEHHLNQIANRD

SEQ ID NO: 6596 - protein, 119 aa, Caenorhabditis elegans
MALNFLSYDDDFCGYCGAILELPAQAPATVSCKVCSTRWAVKERVDQVVSRVEKIYERTVADTDGIENDESADAVVDHICTKCGHSKASYSTMQTRSADEGQTVFYTCLKCKKKDIEYS

SEQ ID NO: 6597 - protein, 401 aa, Caenorhabditis elegans
MEIDLRVFFSNSKFFGDVFHVDLFIFRTPLSLNQNSIYSSVSILSKSSMPEYFESSAISIRRNAAGNDVQKNKVQNWLHSVIERLKWWSPGRCQQLFVENELIELCYRAREQFWKNKVKLDIEAPVKICGDIHGQFEDLMALFELNGWPEEHKYLFLGDYVDRGPFSIEVITLLFTFQILMPDKVFLLRGNHESRPVNMQYGFYLECKKRYSVALYDAFQLAFNCMPLCAVVSKKIICMHGGISEDLIDLTQLEKIDRPFDIPDIGVISDLTWADPDEKVFGYADSPRGAGRSFGPNAVKKFLQMHNLDLVVRAHQVVMDGYEFFADRQLVTVFSAPSYCGQFDNAAAVMNVDDKLLCTFTIFRPDLKVGDFKKKDKLGSNHARLLLDLKNASRYTRRRAR

SEQ ID NO: 6598 - protein, 507 aa, Caenorhabditis elegans
MSKFPVPLRTIGGLRPSTTAAISAANIGFTQSSRALSTGAAAKSSGLVGQVARQYPNAAAFSIKQVRLYSSGNLPKHNRVALPALSPTMELGTVVSWQKKEGDQLSEGDLLCEIETDKATMGFETPEEGYLAKILIQEGSKDVPIGKLLCIIVDNEADVAAFKDFKDDGASSGGSAPAAEKAPEPAKPAASSQPSPPAQMYQAPSVPKSAPIPHSSSGRVSASPFAKKLAAENGLDLSGVSGSGPGGRILASDLSQAPAKGATSTTTQAVSGQDYTDIPLSNMRKTIAKRLTESKSTIPHYYLTSEIQLDTLLQVREKLNGLLAKGTSGQATKISINDFIIKASALACQRVPEANSYWMDSFIRENHHVDVSVAVSTPAGLITPIIFNAHAKGLATIASEIVELAQRAREGKLQPHEFQGGTFTVSNLGMFGSVSDFTAIINPPQSCILAIGGASDKLVPDEAEGYKKIKTMKVTLSCDHRTVDGAVGAVWLRHFKEFLEKPHTMLL

SEQ ID NO: 6599 - protein, 401 aa, Caenorhabditis elegans
MTSSIPFRSFNEKYECNDDDNFTYSSTEQKRIETMLFENYNSLVLEPFKTTSDEDLAELTIFRQKHASYLLRYLKNCPSSYATLDASRSWMCYWGVNALKILDAEIPNDVIENIIVFLKSCEHPEGGYGGGPGQLAHLAPTYAAVMCLVSLQKEEALRSINRVTLFNFLKKCKHESGGFYMHEGGEIDMRSAYCALATCEIVGLPMDEISNGVAEWIISCQSFEGGFGGEPYTEAHGGYTFCAVASLVLLNRFRLADMEGLLRWATRRQMRFEGGFQGRTNKLVDGCYSFWQGAIFPLLDGEMEREGRSLEKGLFEARMLEEYILVGCQSVHGGFKDKPDKPVDLYHTCYVLSGLSVAQKYSLARDGKILGGDVNMLAEINPVFNVTIASEQFAKEFFTSH

SEQ ID NO: 6600 - protein, 958 aa, Caenorhabditis elegans
MASRKKHSEPTSNLRVAVRIRPMNGTERSEKCTNVVKVDKGKQAIELKGKSFGPFFRTYDPDTTQEEIYSDLVSSQIKKVIAGFNCTVFAYGQTGTGKTFTMEGGRTDAKSSTDDPTTGIIPRAVEDIFEQLERCGCEEYSLRVSYIELYNEELFDLLASTDNEDRERLRIFDDPNKKGVIVSGVEEVPVRNRSDVFKLLQLGAEKRRTAATLMNMHSSRSHSLFMVNVVIRENTTTGEELVKQGKLNLVDLAGSENIGRSGAQGNRAKEAGSINQSLLTLGRVIRLLTTNGQHIPYRESKLTRLLQDSLGGSTITSLIATLSPSSSNFEESQSTLEYAMRAANIKNKPVCNTKLSKKTILKEYSDEIEKLRRDLRAAREKNGVIISQESHDEFQKNSEKVQELEQHLDNAVDRLRIFTEDQMHMDEQYRQLYERKGELEDRLRDRIREMAVKEKELADTNDVLNKHIEVIGLMHTSALKAFDQLTTSQGAADEMQTDLRAFWRKVDEMERADDRNKIVIDHFSKKMSDFIDTTSKLTNSLKADGDLLSKKLSENICPHVKSMESAHRDIESTAMDMETHAICIMKKSSEAEKKVIDNMTAISMENRIRLETVMKTCDDFYKSYSAKSQEFTQMVVDKLDEVKKQVSDFTEDMKPLVSTLHQTTCDSYEARTNESKKNVEHVRAACSSMADSMKALMLQVEQLSTKVAENHEKQVIADQNNQETILDTLNTAETVVQSLEDNIVETCDVKQEMDDTKKTLKQTDAKQENHIQVEKERAEEKENEVKVALKSFSDEAEATRGEAREFSNTLKSRFSATSEKCKVTGELVSDCTKKATDELSSLLDEFTKSTIVVTKESAAVVNSVVLVHVDPSVNVPQRILPSFPLVSELNQPVEPEVLLGFGEGNDDFDTDELATKKRRVTSFVRRDSLLETTNNFLSPSSIIKRREQAIEEEEDFEN

SEQ ID NO: 6601 - protein, 958 aa, Caenorhabditis elegans; identical to SEQ ID NO: 6600

SEQ ID NO: 6602 - protein, 461 aa, Caenorhabditis elegans
MNSNGPLMEHGKRRVAYYYDSNIGNYYYGQGHVMKPHRIRMTHHLVLNYGLYRNLEIFRPFPASFEDMTRFHSDEYMTFLKSANPDNLKSFNKQMLKFNVGEDCPLFDGLYEFCQLSSGGSLAAATKLNKQKVDIAINWMGGLHHAKKSEASGFCYTNDIVLGILELLKYHKRVLYVDIDVHHGDGVEEAFYTTDRVMTVSFHKYGDFFPGTGDLKDIGAGKGKLYSVNVPLRDGITDVSYQSIFKPIMTKVMERFDPCAVVLQCGADSLNGDRLGPFNLTLKGHGECARFFRSYNVPLMMVGGGGYTPRNVARCWTYETSIAVDKEVPNELPYNDYFEYFGPNYRLHIESSNAANENSSDMLAKLQTDVIANLEQLTFVPSVQMRPIPEDALSALNDDSLIADQANPDKRLPPQITDGMIQDDGDFYDGEREGDDRRNESDAKRAAQFESEGGEKRQKTE

SEQ ID NO: 6603 - protein, 346 aa, Caenorhabditis elegans
MPDDVCDETLKIGVVVGKKYRVIQQLGQGGCGSVYKVEDIEDKTKQYAMKVEFNSNANAGNVLKMEVQILTHLVSKNHVAKCMASGKKDRYSYVVMTLLGESLESLMKKHGPFFNVSTQMRIGICLLFGIKQIHDIGFIHRDLKPANVALGNKGSPDERYFIVLDFGLARQYITDKEDGKKMRRPREKALFRGTSRYCSVAMHDRFEQGRVDDLWALIYMLAELRCQLAWSDLDDKVEIGEMKRHVADQNLFAKSPIQMLEFVKIVRATQFYHRPDYEKLFNLLNDAMKSAKYKWSDPYHWEPEKRKKKPSVPAVGNVPRKGVTPPSNEEVDFFTVDDFNTNPLGF

SEQ ID NO: 6604 - protein, 258 aa, Caenorhabditis elegans
MSDWIWPLEALKARTPNSTTPSIRAGLTKEQELLWRREGIKLLSEVGNALNCKPRPTIGVAAVYFHRFYMIHSFQSFSREVTALSCLFLAGKVEDFPKKCKDVCQAAVTHYPEIYSKYQNLVDDVMGLERVLLHSLKFDLHVALPYDALLDYKMMFPDMNREKITDAVQIAWTFINDSIYTTLCITTEPQMIAIALLHLAFTVKGYQPVQKNMDPCWWSADVSNWPQESVDKACHLVLDFYAATKEKPVLEKKKLTTF

SEQ ID NO: 6605 - protein, 839 aa, Caenorhabditis elegans
MSTKRKIVVSSDSDDDMPFTQEKQKKAATPAKKRTKPVVLTDDDEEEENAPQKKTAPKRSRKQEKEESDITSDEDELVRGTDEKKKRKGGKKELPVGQKTLDYMFKPSSSSSKRDDPKKKVEKTLVNPADFFKNSPAPSASKLPKVAPKTVEKPKTPAKKPVEISPSTKENTKTKKVSDDEFVDSDDSFDTFTPITVKKKTPEKRKETPKKKELPSVKKEFPKKQSIPVKKEKETPQKKALSVKKDPPKVTSESSSSSQVSTSSVVFQPKPSGPPPALSWVDKYKPKRMGELVGQNGDKSPINKLLEWIKDWAKHNLGEGAKIKKPKPAPWMSSQDGTSFKAALLSGSPGVGKTTCAYMACQQLGLQLVEMNASDVRSKKHLEAKIGELSGSHQIEQFFGAKKCAPQDNQKVHHILIMDEVDGMSGNEDRAGISELIQIIKESKIPIICICNDRQHPKIRTLANYCYDLRFPKPRVETIRSRMMTICSQEKMKIGKEELDEIIELSGHDVRQTIYNLQMRSKGVGAKINQKDMAVDAFSAARRLLDSRTTLMEKQEMFFTDYGIMPLFVQDNYLNMKNEKHSPIQAIRGIRKAADFISLGDLIDRQIRGGGSWKLLNEQSMISAALPAIATGGHLKAMIQFPSWLGKNSTAGKRKRLLQQLVQHTHLKVSAGTHSFATDYAPMLRQKITKPLLEHEADGIPDVISTMTEYDLIKDDTEALTEIVAWPGKIDPASKILSKVKASLTRTLNKTGRMLPYSMDSVSKGKKRGVNSIGIEMDEEGNLVEKFEDEDGESDNEDNEEKTTDVVIKVRTGGGAGASKSARGGRGGGRARGGRGSKK

SEQ ID NO: 6606 - protein, 310 aa, Caenorhabditis elegans
MSALLDLFAGSLGGAAGVLAGHPLDTVKVRLQTQSGPTPQYRGTFHCFKLIVQKEGFRGLYKGMSSPLLSLSAINAIVFGVHGGTCRQMEDPDSITSHFVGGCAAGMAQSVIAAPTERIKLLLQIQDDKAHTKFNGPIDATKQLLRTHGLKSLTRGFLATVARDAPAFGVYFASYEWMARSMCKDGETSTLSSGQLLFAGGTAGMLSWLFNYQTDIIKSRFQADNSYKSYMHCIKQTYLERGYRGFFVGLNSALIRAFPSNAATFFTVEWTYRILLDFNVIDNVTKEAEKICAESQLLPFEELTLSYLIL

SEQ ID NO: 6607 - protein, 702 aa, Caenorhabditis elegans
MSENAETFAFQAEIAQLMSLIINTFYSNKEIYLRELISNASDALDKIRYQALTEPSELDTGKELFIKITPNKEEKTLTIMDTGIGMTKADLVNNLGTIAKSGTKAFMEALQAGADISMIGQFGVGFYSAFLVADKVVVTSKNNDDDSYQWESSAGGSFVVRPFNDPEVTRGTKIVMHIKEDQIDFLEERKIKEIVKKHSQFIGYPIKLVVEKEREKEVEDEEAVEAKDEEKKEGEVENVADDADKKKTKKIKEKYFEDEELNKTKPIWTRNPDDISNEEYAEFYKSLSNDWEDHLAVKHFSVEGQLEFRALLFVPQRAPFDLFENKKSKNSIKLYVRRVFIMENCEELMPEYLNFIKGVVDSEDLPLNISREMLQQSKILKVIRKNLVKKCMELIDEVAEDKDNFKKFYEQFGKNLKLGIHEDSTNRKKLSDFLRYSTSAGDEPTSLKEYVSRMKENQTQIYYITGESKDVVAASAFVERVKSRGFEVLYMCDPIDEYCVQQLKEYDGKKLVSVTKEGLELPETEEEKKKFEEDKVAYENLCKVIKDILEKKVEKVGVSNRLVSSPCCIVTSEYGWSANMERIMKAQALRDSSTMGYMAAKKHLEINPDHAIMKTLRDRVEVDKNDKTVKDLVVLLFETALLASGFSLEEPQSHASRIYRMIKLGLDIGDDEIEDSAVPSSCTAEAKIEGAEEDASRMEEVD

SEQ ID NO: 6608 - protein, 539 aa, Caenorhabditis elegans
MGDAESHHCIDVNAILQQFNDWTVLFEVRLGYSVLYFLILIIGLVGNGLLITSILMRKKLSVANIFLINLAVSDLLLCITAVPITPVLAFMKRWIFGIIMCKLVPTCQAFSVLISSWSLCYIAIDRYRSIVTPLREPWSDRHARWLLMFTWVVAFLASYPLYYSQNLKTMVIENVTLCGDFCGEFNWQSDEISKLTYTTSLLIIQLIIPAIIMSFCYLMILQKVQTDWLVDEGSMLTAAQQAQTAVRKRRVMYVLILMVIVFMACWFPLSAVNLFRDLGMRFEFCQTVYKVLMMDQMYFKLLNVHVIAMTSIVWNPVLYFWMSKRHRRALKDDMTWLTNARRHTNVGVLSRFTPSPSVSVVYRRTLERHLGVNHFRRGTLADPTCTSRERSLPRELQSNCFLLVPLMPLCQSVTRKNSHLAINRDGWKFLVDFPKKQAEHLKQDCAGTFSNLWLFTDRHSTSQWLKSSAEQREYQFNSRLVTPPTSFSSFSHFLIIFIHFSSHFHFISLIVLRSSYLHSLRVRALSSFCHFCVCFETKQ

SEQ ID NO: 6609 - protein, 324 aa, Caenorhabditis elegans
MIIFWSLCIFLVAISSGSLGFTSANSIVTPQWLMQNFDNVRIIDASYVETAALNNAKFNTNHPEIIISDIKSPDLYTDEHIPGAVHFDLDIGSYSSEYIKHDLYPPEHFQKYLRLLGVNNGDQLVIYSNGPASGMKFASRAYWTFKMYGFTTVSLLNGGMDVWKAAGGPTDNAVVTPKLGNVNVKSLDNTILAKFEEIPFNNFAETNTVYLDTRIRAQFDGEDPLATNFPGTKAKGSHVTGAINFPMAKVIGPDGFISQQDVDEQISSLGLTSASQVFVGCNTGMQASVIFVALERSGFKAKLYNGSMFELSYRAPELVNATGI

SEQ ID NO: 6610 - protein, 323 aa, Caenorhabditis elegans
MKFLNSLAQQYPNDVKLQNIGNSYEGRSITAVRIADDGSSKPIVWIDAGIHAREWISYNVALYLIYTIVSQPAYRNLLDSVQLVVVPNTNPDGYEYSRTNDRMWRKTRSRFTNSRCAGADANRNYPFYWGTQGVSHSQCSEIFCGSRPQSEPEVLALTNAIIRDEERIKGYIALHSYGQEILYPWGHTQRTYPTDVQDLIQVGRAMASAIRAVNNTDYTVVNSGDGLYPAAGASDDWAKSRGIKYSYTIELSPIDDFTGFSLPEDRINQVCREAFQAIQVLMIEVKSKFGFKQMTSSTASSAQSTLLLNRLRTIGNRGFGRGR

SEQ ID NO: 6611 - protein, 323 aa, Caenorhabditis elegans; identical to SEQ ID NO: 6610

SEQ ID NO: 6612 - protein, 812 aa, Caenorhabditis elegans
MDGQADGMFIDRAEDARKQEITEQYLNFLDNQADTFHYRQKIVKMMNDGESRLVMNLDEIREILPERAEGLLTQSVLEMNCLQSALQMAINRSDVQAVVKTGFHVGFEGTFGERHVNPRTLKSSYLGNLVCCEGIVTKCSTVRQKLLTSVHYCPATNKVLEKKFADFTMLDTAVTNNNYPTEDENKNPLETEFGHSVYKDHQTFTIQELPESAPAGQLPRAVDCVADLDLADRVKPGDRVRIIGVFRVLPNKQNGVSSGSFRSIIIINHIQMLSKEVIPNFEPQDVKDVRKISKSRNPFELLARSLAPSICGHEETKKALLCLLLGGMEKILNNGSRLRGDINVLLIGDPSVAKSQLLRYVLRMAPRAITTTGRGSSGVGLTAAVTTDPDSGERRLEAGAMVLADRGVVCIDEFDKMSDIDRTAIHEVMEQGRVTISKAGIHAKLNARCSVLAAANPVYGRYNPFKSPMENIGMQDSLLSRFDLIFVLLDEHDADKDANVAEHVLKLHTYRTQGEADGTVLPMGGGVETISTINMETKKASSSIYEENTQWAGIQDTKILTMDFMRKYIHLARSVQPKLTDEATEYISEVYADIRSFDITKTDQERTMPVTARQLETLIRLSTAIAKARFSKKVEREDTEKAYNLLHFACFKEKPKARQEYEKKKRAPRIDGDDDEDQSDNEDMATSEEPQSSSVPTAATPRRGVRRRAEDDDSQDSMMDTTIGESQPTAKKARTGPAAIGVDRYKELRKYVRKAFDDIGSTDDMVELQIITDSVQTQAGSHKFTEDELKAGYEQLENDNAAMIAEDKITLI

SEQ ID NO: 6613 - protein, 212 aa, Caenorhabditis elegans
MREFKVVVLGSGGVGKSALTVQFVSSTFIEKYDPTIEDFYRKEIEVDGQPSVLEILDTAGTEQFSSMRDLYIKNGQGFVVVYSITSQQTFHDIRNMKEQIVRVKGSENVPILLVGNKCDLSHQRQVRSEEGLALENSKHKVFNILSNFVWEKIIFWKNRFFFKIETESWSCPFTECSAKNNQNVNVTFAEIVREMNYVQNKSRQSKSCCSLM

SEQ ID NO: 6614 - protein, 600 aa, Caenorhabditis elegans
MSEFSQTAVFPSLPRAARGVPVILGSSPAGDKILYCNGNSVFTIPIDSLNSADIYTEHAHQTTVAKISPTGFYCASGDTQGNIRIWDTTQSTHILKHTIPVFSGPVKDIAWDSESKRIAAVGEGKERFGHVFLLDTTTSNGSLTGQSRTMNSVDFKPTRPFRIISGSDDNTVAIFEGPPFKFKHTFDHHKKFVQSTRYNNDGSLFASTGSDGTVVLYNGVDGEKVGVLEDAKGVAHTGSIFALAWSPDQSRIATASADKSVKIWDVSARKLERTIVMGSKIEDQQLGIVWTKSALITVSVSGFLNFLNPDDGSVEKIRQGHNKAITALSKSSDGKFLFSADAEGHITTWEISSGTSSRKSPHTTMITGAQTSSNGDLFTVGWDDQLKITDGSGDTKSFKLPSQPCGLEVSDDLAIVACYKHVVVLSRGTPTENPIEFHSTCVAFCAEKSLVAVGGKDAKVHVYKLNGDGRLEELKKIEHSAEITAVSFSDDGEYLAVTDLARKVIPYSVSTDFSVTSPNSWTFHTSKVLTVAWSPDNQRLATGSIDTSVIIWDMKKPGEHPVIIKGAHPMSSVNVVRWLDETTVVSAGQDSNIKFWNVPL

SEQ ID NO: 6615 - protein, 406 aa, Caenorhabditis elegans
MGETPSFRMLIVAVITSMAGSFHYGYNLVLTNPSQDAFLSFMNQTFAKRFDGGLSDHTLQNIWSFVVAVLFLGALAGSFSIPFIAEGVGRKNGLYISISVGVLAGGMSIASKFIPLFELYIISRVVMGWSVSVSLGLSGIFLSEASPKQNRGAIGMMTGTAIQLGTVVGSVVAMPQIFGTDDLWWVIYATEIGIMLVFGAALPFFPESPGYLIQKGSLESATISISFYYKCEKEEADKHVKEIQKEQMNSTKKFTMLDVIQQKSLRDKAFVGAVVTFVMSFSGVAVISAFAFEILVNTGPGPLSYFINAELVGQDARSAAQSWASVVQMISQFSIITAFLPMKNQLGEAWSYLILFVAPVAVSLVFLYFSLPETKNKSPIEVEEAIEELPKLPLCRSTRSNSIKPI

SEQ ID NO: 6616 - protein, 160 aa, Caenorhabditis elegans
MGIITYLIFVLAIFIFPIASISCPSGFTLLVSTSRCAKFISGELNYDGATLSCNSSGGKLISIHNAIDNRVMMQFANSSITNDNYNYWLGLKCSETGNPNACAWADSTKFSYSGFAKAYPNTGYGNCVFVETAGNSAGQWFSATCNAIRTNAICEIAVNS

SEQ ID NO: 6617 - protein, 896 aa, Caenorhabditis elegans
MATKPTDILRDGKLIFFKYEENWTSRNAVRLHVDPTPYILYWRYKDPKVFNTKELAYEKNYIYLERIYDVRAGKPTDFELVPSERSYEPNFLTIVSGTSITNLKFTHFVCMEKNEKRLHEFAATLFTVVQRVKREEHGLLYHFRKKLAPKMYAAFTRRCIEEDIMKVFDKHRKNSTKIEWTEVGKLLPVNRKSVEIDDQKLIKIIMILTKFEGSRLEAIFRKISEDEPVATKLEFGDWLRKNQHDHRLNDARFNQVSDRKINSILENWQYSSDSAISPQMFTHWMVSDECGVAISAQRMKMDVTSMREPINKYFINSSHNTYCSGNQLVYAIGHCSADVEMYRQALLSGSRCVELDMWDNKDKDGEPVITHGPTAVMGMNEIGLKEVCEAIKECAFKTSPYPVILSIENHLGRKQQEKMVQIFRQVFGELLLTGPLPDYPLYAKEGAGDVVYPPPELLKHKILIKAKKKRFEKQESRSRDSSSIDLQGSSIDLTEDEEMENERFNELTEEQKAAQLSELPEETTCSELSAITNYMQAYETSRGVSTVVNLENATKDIVPCIVSADENTVYNCLRANSIDKVQNLNKSKITRIYPKASRIYSTNYNPMIHWLTGSQMVSLNIQTNCSNMQLNYAMFERNGGCGYVRKPDWLRARNVQLRPFLSIPFTIAYTVEVEIIAAYFLSSMDSGKFRRRSSVSIRLFDVPDQISKDDAASPSVSTAAKFESSCRRRTREEASFVTNYERHVYSFDKIMLNDMSFIQFNVHNESGSVFAQRILHIDTMNNGYRFVTLRTPSNQCAGPACLLVRFDLFMHSDRKNLHDLKQMYNPHAFEKESDKWERRFSNPFADLDKFDDNEFLLVEGTRRGSVEHAPTTPTTPTKPMSFGKEILEKISFWKKK

SEQ ID NO: 6618 - protein, 316 aa, Caenorhabditis elegans
MELLLVILLFLYSTIFIVGFTGNLLMVLVTLHSNKLRSICNILICVCCFCDLLLFTDVIAFVVSMFTPSTQEFCFYISIPADFGAFASNACVLAIGIDRLIAVAAPTRIIFSSRYSYNNCFRYKLLENERYKYLFLQMTFPVIYSSTLLIMGFGQRDPRRNVVCLLPESLGHAYDMFALSSFGINLFVPPLYAYVYFKVKNMSDNNSIKTVFKSLSVTVCLVVCGWMTTDLIGALTVILPMDRSVARMVQLYCGTFIFTSSAFNAVVYYKFSRDYRSAVRTMLGLSDEVSIANINIYQQASDPPKSSNQRPFTNTS

SEQ ID NO: 6619 - protein, 324 aa, Caenorhabditis elegans
MDVKFAEPLEKDSDVASELFVRGEIVPEPLPDTFDAREKWPDCNTIKLIRNQATCGSCWAFGAAEVISDRVCIQSNGTQQPVISVEDILSCCGTTCGYGCKGGYSIEALRFWASSGAVTGGDYGGHGCMPYSFAPCTKNCPESTTPSCKTTCQSSYKTEEYKKDKHYGELVWHSFNRFQRFLNRASAYKVTTTKSVTEIQTEIYHYGPVEASYKVYEDFYHYKSGVYHYTSGKLVGGHAVKIIGWGVENGVDYWLIANSWGTSFGEKGFFKIRRGTNECQIEGNVVAGIAKLGTHSETYEDDGGAATSCSFIMCTLMVLTYYFV

SEQ ID NO: 6620 - protein, 277 aa, Caenorhabditis elegans
MARFSGKSIIITGSSSGIGRSAAVIFAKEGAQVTITGRSADRLEETRLQILKAGVPAEKINAVVADVCEASGQDEVIRTTLAKFGKIDILVNNAGALLTDGTSNTDQAVELYQKTFKLNFQAVVEMTQKTKEYLIKTKGEIVNVSSIVAGPQAQPASPYYACAKAALDQYTRCTAIDLIQHGVRVNSVSPGVIATGFLGAMGLPETASDKFYNFMGSQKECIPVGHCGKPEEIANIIVFLADRRLSSYIIGQSIVADGGSTLVMGMQTHDLMSILNQ

SEQ ID NO: 6621 - protein, 384 aa, Caenorhabditis elegans
MLRSQAKNVDLTSQADSRHQQKRKQAEQLDALKNPSEPAAKKQHSKGLTELRAHISGFKIDSAKRDPLGKSRTSRRDVENLPPQKSRYVDPCPHYDYDLEEAGNPDSISDYAQGIFDYYRHREVHFRVRKYLHKHPEVDVKTRAILIDWMVEIQETFELNHETLYNAVKLTDMYLCKTKNVDKNTIQKLACVAIFIAAKYDERSPPLVDDLIYLSGDRFSRDELLAMERELFATVGYDLGSPLSYRYLRRFGRVCRVDMKTLTMGRFILETSLMVYEYAMVSQSRLAAAAFVLAMRMLDKNNEYEWNPVLEKYSGFTGEEVMPLVEHMNHILHFSKDKWAQLTSVRQKYSHEVFFHVASIPMLPDTLKVVDSHTYAPVPMLSYP

SEQ ID NO: 6622 - protein, 799 aa, Caenorhabditis elegans
MTAEADLLEGYDEELGGNESQKRDCKGITTAIVVVLLILVMIFAALVFFTPLFAAKSFGSWRLNVSDLRSLRYPYAEFAFTDNNAVVMQSWEGVEIVEDGVSRLIFGRENGAEITPSADRKYFAMMDHAPNPGMNPQNETFHLKIVNNNERLNPLLPFEVEELFRELSDSRITYDIGLRKEESVIQAFKWNGKFNDFVFVESNKIYYQSSPEEEGLTRVSNGGEHTVDGLFDWIYEEEIFGRKDAMWWSTKGDQLAYASYDNHLTKNVSLKTYHRLEPYPIDTNFHYPKTFAKVLPTYTLSIWNKKTEQSRQLDVQLKDSLSYHYLLAVKWLEINGTEQLVSVWTNRYQNEVALTICDWDTAICRLEFEYKYASKRWVTHDDFHSITSFEDTLFFLLPHDKRDNAFQQVASLRLSHGQLRTPKFLNLGEYDVTSINGINKETRTIFFHAAAPKPSHRSLFSYSLADESRNSAYCISCSIKNCTWAQAQMDDQMKTAIVSCKGPAAPHTAIVNLTRMDSDKKTEHANLLYDKTYQNRVEEAGLPVIIKETIKISDDFDALIKLSIPKDIYNRDKHQAIPLIVHVYGGPNDQNTKEATQIGIEEVVASASQAAILRIDGRGSGGRGWKYRSAIYGQLGTVEVEDQIKAIKVVLRLYRHLLDARRVAVFGWSYGGFMTLSMVNEAPEQFFKCAVSVAPVTNFAYYDATYTERYMGDAPLESYSDVTKKLDNFKSTRLLLMHGLLDDNVHFQNSAILIDELQNRGVDFDLMVYPNQAHSLSSRTSHVVGKMTHFLRQCFYTDK

SEQ ID NO: 6623 - protein, 779 aa, Caenorhabditis elegans
MTAEADLLEGYDEELGGNESQKRDCKGITTAIVVVLLILVMIFAALVFFTPLFAAKSFGSWRLNVSDLRSLRYPYAEFAFTDNNAVVMQSWEGVEIVEDGVSRLIFGRENGAEITPSADRKYFAMMDHAPNPGMNPQNETFHLKIVNNNERITYDIGLRKEESVIQAFKWNGKFNDFVFVESNKIYYQSSPEEEGLTRVSNGGEHTVDGLFDWIYEEEIFGRKDAMWWSTKGDQLAYASYDNHLTKNVSLKTYHRLEPYPIDTNFHYPKTFAKVLPTYTLSIWNKKTEQSRQLDVQLKDSLSYHYLLAVKWLEINGTEQLVSVWTNRYQNEVALTICDWDTAICRLEFEYKYASKRWVTHDDFHSITSFEDTLFFLLPHDKRDNAFQQVASLRLSHGQLRTPKFLNLGEYDVTSINGINKETRTIFFHAAAPKPSHRSLFSYSLADESRNSAYCISCSIKNCTWAQAQMDDQMKTAIVSCKGPAAPHTAIVNLTRMDSDKKTEHANLLYDKTYQNRVEEAGLPVIIKETIKISDDFDALIKLSIPKDIYNRDKHQAIPLIVHVYGGPNDQNTKEATQIGIEEVVASASQAAILRIDGRGSGGRGWKYRSAIYGQLGTVEVEDQIKAIKVVLRLYRHLLDARRVAVFGWSYGGFMTLSMVNEAPEQFFKCAVSVAPVTNFAYYDATYTERYMGDAPLESYSDVTKKLDNFKSTRLLLMHGLLDDNVHFQNSAILIDELQNRGVDFDLMVYPNQAHSLSSRTSHVVGKMTHFLRQCFYTDK

SEQ ID NO: 6624 - protein, 541 aa, Caenorhabditis elegans
MSHLRKRYCLIFFNSLYNFQARTPMRNLYEHLFLDYVKEIRPVRNESESLKVEIKFWLKQILKVDERDQIVNIYCWLELYWIDETLTWDPKKFGNLSRIHVPAHKIWKPDVLVYNNANMNVEENEMETNAIVDNTGRVMLFRSMITDISCNLNLQQFPFDQQICFVTFASWSMDGSKLDLSATPKTDNLELYIRNTEWGLTDFRVKIYQKIYDCCPHPFPDVTYFMVLRRSPSYYIFSLVIPSAFITVVTIVGFFTPHSTTGENTEKVSLGVTALLSMAIISKFSVFFSLCPSAPSHSLTLFLESSNLYNSLEAYLFVMMVSDEVPATSEVIPLIGKYYIGLIFLIFMAAFTTTLTLSYQMRGNSGQEVDPRVRDFFFYQIAANPCISWAFSFQLPKKLLRSDHRKQSFFFTNGAAHVNGYSKGALHPNTPPAHIVKMEEITGGGSVKSFVMSQESAATSTLLTSSLMKIKVVLDDMKASIHAERELKRIKFEWQQVTRLIDRCIMFSYILITIAFAMVMLASRDPPIVLNDLIMDSVKST

SEQ ID NO: 6625 - protein, 618 aa, Caenorhabditis elegans
MRSILVSRRFAHVLTSTHAAPSTSNIPTTDSHHLTHPSVHRQHTNSYIHGTSNIPLRNETLGQTLRNTTERVPDKEFCVFSKYPIRKTYEEFYHDVRQMAASLYTLGLEKGDRVGVWGPNYYEWVVLQYACAFAGVIQVNVNPHYLHEELRFVMRKTGMKVLFAPKRHKHSNYVHTMLEAMPEMRRGQPGVGHIKSHDIPELRHIVLYGDDVPVHGAWVYSDLIHAAGSAERAKLEDMDRKLRPDEPVNMQFTSGTTGHPKGATLTHFGLNNNAYFAGIRLGWDREDHRICIPNPLYHCFGCAVGVINAVNHGQTVVFPSKSYHVPDIFEAIQNEKCTTMFGTPTMFIDVLKSPLMKQFDISSLRGGVIGGAPCPMALCEKMVKEMRMTDFSVIYGSTETSPLVTMSELHVDPFERIKSVGSVMPHQELAIVDEFGVPVPTGAKGELWSRGYSTMLGYWADHDKTNLAITRDRWYKSGDTATMNEDGTINIVGRTRDMIVKGGENVYPTEIEQFLHKLDYVADAHVVGVPDDRYGENICAWVRLRVEDEGKITAEHIKKACKRGMAHYKVPKYVLIKKESEFPLTISGKVKKFEIQKISKELLGLGTVKSHFTEAVDN

SEQ ID NO: 6626 - protein, 733 aa, Caenorhabditis elegans
MRQQNWKCASSPSGASLDFLAFLMNFQKNSTFLIRFYRKIYHIFDLICGKYKFQISFSLIQLKSSFHMSLLSHLSRLCCSKCSSIPSSSTRLFCFAPQVGRSTGFLKSTLIKSKQAFRNVSVVETKRESYKLKNASWKDLKAILSLAGPYKWRIMLGISFLGISSSIFLFTPRVLGKLIDEWDETKQDKMDPNDKALLLARFFKENPIALAGVFMLGAIAIAARIYCMHTAGQLVINDLRKSVFNSVLRQDMAFFDKNKVGEIVSRLSTDALIVGYSVSMNLSDGARALITCFGSGGLMVYTSLAMCKVIFVVVPVIVGTFAVFGKLQRKYTLMMQEAVAGANQVATERLSSVRTVRMLVAERKELAAYSDKINEIWQISKKEGLAKGFMFGSFQFTGYLALSSILFYGSNLISQGLLTYGELSSFCLYAVLSAGSLSAMSGFYLELMKGLGASSRLFELKNREPRIPLEGGVQIGNVKDTIRFEHVAFGYADRDPLFHNISFDVPAGKITAVVGSSGSGKSTIASLLLRLYDPTSGRILVDGTDLKDIDPSYWRRHIGTVGQEPVLFSTTIKENIIYGSLEPENVTDAEIVSAADQSNADEFISRFPIKYDTKVGEHGSTLSGGQKQRIAIARALVNKPNILIMDEATSALDASSEYLVRIALNKLLANSKQTVMIIAHRLSTIKHADQIVVVDRGSVAESGSYDELIAIPDGIFRKLVEKQTFGFKNPESY

SEQ ID NO: 6627 - protein, 320 aa, Caenorhabditis elegans
MLYQLLHTVLSVVGVSLNAFMMYLALTKSPKIMLPCSAIITIKTFTDILTSAMSFFVMQRIVTDGSSIHVIPTGPCTHLGPTACYIGHMFMLCFLECNLIWMISSYIFRYYILYVRDPSIKSLVFVAICLSIPSFIHMATWISNYDPAVAIAIPENVGIEARDMVLGGKIVTWSALTLIIQLFITSILVLIAYAWIRNTLLSFAVKMGSDKNDVKKLNTRLVKVINFQVFLPSFIFLGVFVFVGMFTQLIDPKISQYLVSVFFMFSPICSPFSYILFVPHYLNVILGNKKVSEAKSTTEGCTFRHVNMAASTSNTPECSA

SEQ ID NO: 6628 - protein, 326 aa, Caenorhabditis elegans
MELLLVILLFLYSTIFIVGFTGNLFMVLVTLHSNKLRSICNILICVCCFCDLLLFTDVIAFVVSMLTPLTQELCFYISIPADFGAFASNACVLAIGIDRLIAVAAPTRYNLPAFFWKIEKQEIFVFRFSKGLYKLLENERYKYLFLQMTFPVIYSSTLLIMGFGQRDPRRNVVCLLPESLGHAYDMFALSSFGINLFVPPIYAYVYFKVKNMSDNNSIKTVFKSLSVTVWFVVCGWMTTDLIGALTVILPMDRSVARMVQLYCGTFIFTSSAFNAVVYYKFSRDYRSAMRTMLGLSNEVSIADINIYQQASDPPKSSNQRPFTNTS

SEQ ID NO: 6629 - protein, 392 aa, Caenorhabditis elegans
MATFPHFGTDAVHVGQEPEQWDINQVVPPISMSTTYKQDNPGEPKRYDYARGGNPTRDVLQKNLAALEGAKHCQAFSSGLAASSAVINLLNHGDHIVCSDDVYGGTIRYIRQIAVKKYGMEVDSVDLTDVQNLEKAIKPNTKMVWFESPSNPLLKVVDIAAVVQTAKRANPEIVVVVDNTFMTPYFQRPLSLGADIAVHSITKYINGHSDIIMGAAITNNDEFQQHLHFMQRAIGGVPSPFDCFLVNRGLKTLHVRMKAHFENALAIAKFLEAHDCIESVLYPALPSHPQHTVHVKQTKGMSGMISFYLKGELCQSRAFLSALKVFTLAESLGGCESLAELPSIMTHASVPSATRAELGITDNLIRISVGIEDLDDLIADLDQALKIAIPNV

SEQ ID NO: 6630 - protein, 372 aa, Caenorhabditis elegans
MSSQIRGSKQHEDVDPVTIKKIEEAYVMLNGPDGAKCSSLLKKNLTKDVIEKLKTKSTKLGANLYDCIRSGVYCLDALVGVYAPDAEAYTLFAPLFDKIIEDYHGLGPDQKQPPVDLGEGKTKEFPPLDPKGKYIKSTRIRCGRSLNGYQFNPCLTEDNYLEMEEKVKKAFSEFSDEELKGTYYPLDGMSKDTQNQLIADHFLFKEGDRHLQYANACNFWPKGRGIFHNNKKTFLIWVNEEDHLRIISMQEGSDVGAVLERLIKGVRGIEKQVQFSRDDRLGWLTFCPTNLGSTVRASVHIALPKLSAREDFKQICDKLDLQLRGIHGEHSESEGGVYDISNRARLGLSEYEAVKKMYDGVKNLIEMEEKET

SEQ ID NO: 6631 - protein, 167 aa, Caenorhabditis elegans
MSDADSQKQIKLTSSDDKTFTVSRKVISQSKTITDIIQNLGIEESGSTSEDTIPLQKVTSTILEKIITWCEHHADDEPKKVDENKKTVDISEWDAEFMKVDQGTLFEIILAANYLDIRGLLDVTTQNVANMMKGKTPSQIRTLFNIENDFSEEEREAMKKENAWCED

SEQ ID NO: 6632 - protein, 201 aa, Caenorhabditis elegans
MYPDHMFKYVIIGDGGVGKSNLLLRFTDELFDPIHTTTLGVEFGYKDLQIDKYKVRLRVWDTCGQENFRSIIRAYYRNALGALLVYDITCRKSFVHLEQWLSDLRQHGHPEMVIMLIGNKSDLKAVRDVTTEEGEAFAKKNGLTFMETSAKANKHVEKAFVNTAHEIYKKLKLGVIEDDDVKKKKIGIILRSRSGKEKKCC

SEQ ID NO: 6633 - protein, 203 aa, Caenorhabditis elegans
MSSDHVFKYVIIGDRGVGKSNLLLRFIGKPFDSIHPSTLGIEFGFRNLEIDRKKVKLHVWDTCGQERFRSLVGSYYRHAIGALLVYDITSRESFYHLEHWLTDLQRLGDPDIVIVLIGNKSDLEADREVRKEEGEAFAREFGLIFMEISAKTNEYVEEAFVNSAHEIYRKLNFGIIKEICVKKKKKKMNIIIRSISGKEKACC

SEQ ID NO: 6634 - protein, 537 aa, Caenorhabditis elegans
MVGFSVSRKLSQAQQVPDQDLNFHHKTRFIILVICTLCLSIAQSDTLTLNFTIICMSGDGAPVSNRSALTNLENMEMTLVNASGSLTDNVENMEHKIADGRYNYSPSEKSLLFSLVAVGAMVAVYPVMLLIQKFGSRSIVFWVGMLSTVSTALIPWMAYIGFWPLLVMRFFQGAGLSTSFTLIGIVTRQWSMQVQSAFYIAVLTTFFQIGPIFTMPVAGALCTSSLGWPAVYYIHAVVTFGLFVLFYFFYRFRTHILLGHFIKFQKNSRENPVRHALVSTKELEKIQRGKGDGKREAVPIKAILTDPVIWSIWISAIGNFMGIQLTMQFSPTYLNKVMGFAVEQTGTFSAIPQIVTFFLKVIAGYAADKARCCTPQTSVKIYNNLALGGMSLSFLGLAVIPVSEPVLGLCMLIFSCSIIGFNCGAFFRSSAIYAAQHNHFIMGVNSFLNCLAALLAPVIVNIFVANDTWDEWWWVWMVHFVTLFVFNIVFQIYGKGVPAEWSKPGFGRSNVIGDVVVSVPKTTEVPVRDGVVPEDKI

SEQ ID NO: 6635 - protein, 495 aa, Caenorhabditis elegans
MATWIVGKLIIASLILGIQAQQARTKSQDIFEDDNDNGTTTLESLARLTSPIHIPIEQPQTSDSKILAHLFTSGYDFRVRPPTDNGGPVVVSVNMLLRTISKIDVVNMEYSAQLTLRESWIDKRLSYGVKGDGQPDFVILTVGHQIWMPDTFFPNEKQAYKHTIDKPNVLIRIHNDGTVLYSVRISLVLSCPMYLQYYPMDVQQCSIDLASYAYTTKDIEYLWKEHSPLQLKVGLSSSLPSFQLTNTSTTYCTSVTNTGIYSCLRTTIQLKREFSFYLLQLYIPSCMLVIVSWVSFWFDRTAIPARVTLGVTTLLTMTAQSAGINSQLPPVSYIKAIDVWIGACMTFIFCALLEFALVNHIANKQGVERSKLVQTKTFVVRHLPGSHYVYLTVVLLGMNPALVEARTEREKAEIPLLQNLHNDVPTKVFNQEEKVRTVPLNRRQMNSFLNLLETKTEWNDISKRVDLISRALFPVLFFVFNILYWSRFGQQNVLF

SEQ ID NO: 6636 - protein, 315 aa, Caenorhabditis elegans
MDIQWFATGVGAAVVLYIFYHFIRIILNILVPYAFCQPIDLKKKAGASWAVVTGATDGIGKSYSFELARRGFNVYIVSRTQSKLEQTKKDILEKQPDIEVRFATYDFTNPSVTDYEKLLSKLNEVSVGILINNVGMFFDYPEMLHKINGGIDSIANVIIINTLPATLLSAGILPQMVSRKAGIIVNIGSFAGVVKLAEWSIYSATKKYVEWLTGCLRKEYSHHGIIFQAITPAMVATKMAGNPNTSFFCPDSDTFARSALNTIGHASETTGYIAHQIQCEILKLLPDFVIDRSIKKGNAEFREKALAKSENKPLA

SEQ ID NO: 6637 - protein, 218 aa, Caenorhabditis elegans
MPSYKLTYFDACGFGESARMLFHLGGVPYEDVRLPTINAVPGFQSDEFSALKDKTPFGRFTVLSIDGFDLAQSSAIHRYLARKFGYAGKTPEDEAFADSIVDQFNEYYASLHPYRDAVKTGKTMEEVKQIHDKVYIPAKNLMFKILTRILKENKSGFLVGDGLTWADLVVADHLYTLTNLKELDPEDPIHLTLRKFQEKIFNLTELKDYIETRPVTLV

SEQ ID NO: 6638 - protein, 547 aa, Caenorhabditis elegans
MHGSGHSLTGAPHQIPPPRTQGAATGGQQLSATANQFVDKIDPFHNKRGTSRRLRINNSSRYNVDSAQELVQLALIKDTAANEQPALVIEKLVQCQHVFDFYDPVAQLKCKEIKRAALNELIDHITSTKGAIVETIYPAVIKMVAKNIFRVLPPSENCEFDPEEDEPTLEVSWPHLQLVYELFLRFLESPDFQASIGKKYIDQRFVLKLLDLFDSEDPRERDFLKTVLHRIYGKFLGLRAFIRKHINNMFLRFVYETDSFNGVGELLEILGSIINGFALPLKQEHKVFLVKVLLPLHKPKCLSLYHAQLAYCVVQFIEKDSSLTPQVFEALLKFWPRTCSSKVTIAQFSTEKEVMFLGEVEEILDIIEPEQFKKIIDPLFRQLAKCVSSPHFQVAERALYFWNNEYILSLIEDTSSLVMPIMFPALYRISKEHWNQTIVALVYNVLKTFMEMNGKLFDELTSTYKGERLREKQREKDRDAFWKKMEALELNPPAEGKEVTPSLFPEKLTDYLKKVRVDFWRNLRKMAFEIAKNFTSGKWKNSKIFVK

SEQ ID NO: 6639 - protein, 195 aa, Caenorhabditis elegans
MSAEAAAVDVPEAPVAATAPIMYKLVSEDKQEFTISAKAAKKSIVLNDVISRRAPEDSAPMAPIPVEKVTGDILNMVIKWCEQRKEDELPVDDGSIPKKIDKIDVPQWDADFLKISSDVLFDLIVACNELDVPGLMNYGCKMVADMAAGKSPEDMRTIYGIPTDKQDADAAEKAAKEEAEKNATAQRDEAGPSAS

SEQ ID NO: 6640 - protein, 279 aa, Caenorhabditis elegans
MARFSGKVALITGSSNGIGRAAAILFAQQGAKVTITGRNAERLKETRHEIKKSGIPAENILAIVADVITDEGQMRLINDTVRKFGHLDILVNNAGGALMDAQGRVGMDQDISVFDNTMQINMRSVVTLVQKAKEHLIKSKGEIINVSAMAAGHHGDPIATFYGMSKAALDQFTRSSAISLIQHGVRVNSVSPGFTKTGFGEAMGFPPIAMKKVISFYESHKECAPSGAIAQPGDIAQVILFLADRTMSSYIIGQSIIADGGSSLVMGMHAHDMLDILKA

SEQ ID NO: 6641 - protein, 279 aa, Caenorhabditis elegans; identical to SEQ ID NO: 6640

SEQ ID NO: 6642 - protein, 362 aa, Caenorhabditis elegans
MSDLFAALDESSKNFWMTVELFMRPIFDYLNFAHFIVAVIGVFSTLFHILVLTRPSMRALTINNFLLGIGICDLIGMISMIFRGCTMLYTNYESSVLLNCNPPSSYIFMIAMKYIQCITKVTERLAIWYAVAMAVLRCLFIKLPINKKVMPKNFRIYGLVHSKNGIRLLISVTAAILPSGVTTYFEVTLKETNNIWTPPPNCHNFPSNFSQIEYAIETTNFYNTLQLVEGIFFKIIPSIILQTATIFLVMKLKKTKILVNQKVRSTTDRDRSTKLVNFMSISFLIAILPHGILYIIDAYLNHILGFSILIVRFATIFQFINTINATVHLLLCYFMSSQYRRTVRSIIRKNNTSVCTIEHLLK

SEQ ID NO: 6643 - protein, 345 aa, Caenorhabditis elegans
MVSFSFNQRVKLFEHDILQNLILLSSLFVITFAFAPIRPIPEELTGQDLVDHINSAASTFQTENYAVTHEKMHTRSMHEKFNAPFPDEFRATEREFVLDATPLNFDARTRWPQCKSMKLIREQSNCGSCWAFSTAEVISDRTCIASNGTQQPIISPTDLLTCCGMSCGEGCDGGFPYRAFQWWARRGVVTGGDYLGTGCKPYPIRPCNSDNCVNLQTPPCRLSCQPGYRTTYTNDKNYGSNSAYPVPRTVAAIQADIYYNGPVVAAFIVYEDFEKYKSGIYRHIAGRSKGGHAVKLIGWGTERGTPYWLAVNSWGSQWGESGTFRILRGVDECGIESRIVAGLPR

SEQ ID NO: 6644 - protein, 372 aa, Caenorhabditis elegans
MAKLSEYYEYEYDFFSSYSENFENFTYPIYFEDYEEEEKWLKLVNEVARVLHNLNFIFCVVGLNINLLNCLVISHRKMWTSSINVLMIGISFCDVLIIGNTFGMRIYDILQQNECWQNSTYLKCLTTFTINLIAEVINRIYPFLGLSMAIIRVLVVSFPLSKKMSSLSQKEVGCEIVLIMVFLSAVISVWYNARYSILKNGLWVPRKRCNYPPGYTELQYAIRVGRKIIFTEMMSQTIFAYLNGSLNIIPAVLYPVVAIVLVIRLLKMRKDRKNVISRRQNVKREHTTTLVILLSITFFISQLPSGIFLWLGNLYKFNTVVRSIVFEGKNVTSILFTVNATSHCIIFAVLSSQYSQVARERFRCCRKKVICC

SEQ ID NO: 6645 - protein, 337 aa, Caenorhabditis elegans
MNRFILLALVAAVVAVNSAKLSRQIESAIEKWDDYKEDFDKEYSESEEQTYMEAFVKNMIHIENHNRDHRLGRKTFEMGLNHIADLPFSQYRKLNGYRRLFGDSRIKNSSSFLAPFNVQVPDEVDWRDTHLVTDVKNQGMCGSCWAFSATGALEGQHARKLGQLVSLSEQNLVDCSTKYGNHGCNGGLMDQAFEYIRDNHGVDTEESYPYKGRDMKCHFNKKTVGADDKGYVDTPEGDEEQLKIAVATQGPISIAIDAGHRSFQLYKKGVYYDEECSSEELDHGVLLVGYGTDPEHGDYWIVKNSWGAGWGEKGYIRIARNRNNHCGVATKASYPLV

SEQ ID NO: 6646 - protein, 382 aa, Caenorhabditis elegans
MAIFYDDPLERLNQPIKTKSYRKKQVVQRVHVFIFDNWKLILLGILNLIFLIIAIVFAILFFVGSADCAQLPDYTTSPASQLTTSAISSRTSEVQTNAITTTQGTPSNKTSTTTPSTSKVICASGFTLVGTKCGKLVSSNQPRTEADSICKGYGGSTLFSVRNEQETRDMLDFVKDSNIDFLWTGLVCNQTARTSCIWDVKSGTTADYNNFADGFPNVVYGYCIYFIVTGNSAGQWGSEQCSQLMNFVCELPTTIRDPDCKYNYNKNCYIRFDITLTIPQAQRFCNEKGADLVSIHSANENRFILTIYDIHGQILLGGLAPAVDFIVWLDGSPTTYSNLLYFYDTRSCVLMTVARGGPYDGDWYTMNCNFQEFFLCKRAIDF

SEQ ID NO: 6647 - protein, 363 aa, Caenorhabditis elegans
MPGCLPSVFEKWSQFLKFHRRIILIGGASEIIIITVAVIVTYCLTKQPACEIYTGTSSPAFQTSTVSSFTESLSNSDTSPASTTTEPLPTSSTPGKIPPNNITCAVGFTYINHKCWRLFTDLQTRENADGACMRYGGSTLFSIRNEQENNAMLGFMLNAGVDNLWTGLICVGKTTFSCTWDMESGTTSVYNSFASESPDNTYGNCVYFIITGTQAGQWKSGLCNMTMSFVCELPPTVHDKNCINNYNNHCYLRYDDSDTVVEAQRFCNTKCANLVSIHSANENRFIQTIYYVDGYIALGAVAPIIDYIVWMDGSPQLYNNIQDNSNGTCVFMRILWGGAGYWYTIDCVKRSWFLCKRPAGIVC

SEQ ID NO: 6648 - protein, 317 aa, Caenorhabditis elegans
MTTSDSLSSHTKPDTTIISTRTLPISSTMPTHGSLLFMLLKPMQKHSCFLASDNVTCAVGFTYVNKKCWKLITGPQRRADADEACMNLGGSTLFSIRSDIENRALVDFVKDKRIENLWTGLICVGKNSFSCTWDVNSGTAAVYNNFAEGYPNNVYGDCIHYMTTGTQAGQWASGSCNETMSFVCELPATIYDDTCDYNYDRYCYTPHYFIKHSSEAQQFCAGLCSNSVSIHSGNENRFVLTLYLYTNSSILIGGIAPSYDFVLWYDGTQTTYNNIDSIANGNCLYLNDLNTRGNWFGLNCLTSRSWFICKRRIGENC

SEQ ID NO: 6649 - protein, 289 aa, Caenorhabditis elegans
MGAVLNTFLAGETPPLKSSAPSDFSCQHGFTLVNNKCWKLVTSNQARPDADKICNGYGGATLFSIKSEQDNRAMIHFVKGQDIDFLWSGLLCSAGEPISCIWDIENGSTANYSNFADGFPNIVYGNCVYFITSGDEAGQWGNEQCGQVMNFVCELPATFQGKDGCKNNYEKSCYLRFDLNLTVPQAQNFCLEKCANLVSIHSANEVRFIMTIYDFIGEILIGALAPAQDFIYWLDGTPANYNNLKFFYNSTCVHMTVAPGMQNVGKWFTRFCTETGKFLCKRSIKNSCT

SEQ ID NO: 6650 - protein, 1101 aa, Caenorhabditis elegans
MDANDYPRLYYTSMPSSSTSMVTTTRFSTSFSPSIPCHRQENFRRHSTSALAKRNGSESEKSAEIRENPDEIEVSRVSGRDSSLAFYTTAHETSSMLSRDSRDETLTPNEHIHQASSRRVSANDSVFEDGYVDFVDEPREHGSRRKSFEKFTDRNGEEKEGRVFELSTPQPTREAAPGAHQFQLPTLLVTSTPTTVFDHSDDEVWTPYRPPPNREYSSSSEPMMGDLTFRLQSGIHKKSIAVEGTEIALRDLRNEALQFIKEIYPEKGCSSLEDYILLYKHDLRSINILQLITTSSDVTDGTLVEVVIGSCPQNERIVVHPHTLFVHSYKVPTFCDFCGELLFGLVKQGLKCFGCGLNYHKRCASKIPNNCNGSKQRRPSAIPLSPSNSNILNLNERRHSRRESCLEALDAARPSSTLGGAATPNIFITSDDCGDAVGGNYLQMPRKDRSCSWSGRPLWMEIAEATRVKLQVPHTFQVHSYKLPTVCQHCKKLLKGLIRQGMQCRDCKYNCHKKCSEHVAKDCSGNTKASQFFLGSQADDGASEDRDDDLSLRSGSGAHKKAQNTPSAPLQGSEGSGSPGPVVSFAANALSNMPDDDVISSESANIPLMRVVMSKKQTKRKNNKLLKEGWIVHYTDQQNMRKKHYWRLDTKGITMYQDENTTRYYKEIPLNEILNVSMSPPDKTADYLFEIRTGVCVYFISGSPSDEKGSSLDAQSWTTAIQSALMPVTPQSSVVGGKRIDKLKVPTEGETGHLGAKIQTEHEFSQLYQIFAEEVLGSGQFGTVYGGIHRRNGQHVAVKLIDKLKFPPNKEDLLRAEVQILEKVDHPGVVHFMQMLETTDRIFVVMEKLKGDMLEMILSSEKGRLSERTTQFLVAQILEALRYLHHLNIVHCDLKPENILLNSNSDFPQVKLCDFGFARIIGEKSFRRSVVGTPAYLAPEVLRNKGFNRSLDMWSVGVIVYVSLSGTFPFNEDEDINDQIQNAEFMYPPTPWKEISENAIEFINGLLQVKMSKRYTVTKAQSQIWMQNYTLWSDLRVLEKAVGQRFVTHESDDQQDPQRNFSYFLHLLVTYPFKFYFVFSCFIIFFPNFLTHIPCVPTPIS

SEQ ID NO: 6651 - protein, 1101 aa, Caenorhabditis elegans; identical to SEQ ID NO: 6650

SEQ ID NO: 6652 - protein, 1101 aa, Caenorhabditis elegans; identical to SEQ ID NO: 6650

SEQ ID NO: 6653 - protein, 1101 aa, Caenorhabditis elegans; identical to SEQ ID NO: 6650

SEQ ID NO: 6654 - protein, 608 aa, Caenorhabditis elegans
MSTFSRQDQLPSLPVPSLVETLEKYIDSASAILTPAEKARVEKEAHEFQHSELGAQLQSALENRAKNHKNWLEDWWYNAYTEIREPLAPYVSFGAMNTAYNCVDGGQVSRAADVLHHWLSVWDKVRHGKWPVTSSRGVTWDMQQFHHLFSSNRTPQRTRDTMDRYFKTKEEGDTPTHVIICCDGCFWKLNILNEDDDTIKSPDEIYNMLKFVRDNSSDESSCCVSKLTTTNRDVWSLNRDELLRVSSANIEYVRAVETSILFLSMVPKKGGDDQQKLMSNALQDESWFVWQDKSVNITIYEDAQVMVQGDHSNIDAIVLLQVGDYVASRVRKQLWHPAKTGSDLHFEFPERLIFEFNEPLRHAISFADVEFYKSKQLYRARGVHHHGYGNELCRTAKVYTDTVVQLALQLAFLKTHGSFAPIYETASTRKFFHGRTETVRGCTSQFVRFAKALLGDQTNEKEDLKKLFDSAINAHNQLMADCMDGRGFDRHLMGLKLTLSIMNKGCGPKRQAPEFLRDDTWKRTGGDGNFLLSTSFIGYMDGNQPGTFGYVAAMRPDGYGCFYRIGKSRISVAVSDWVSSRSNIDAFCANILWALDALAPFLTPAQKL

SEQ ID NO: 6655 - protein, 324 aa, Caenorhabditis elegans
MSSSHLFEELECDQPESQTFFKKLQLVDDWRNILKKGVFLTIIVIFAVLLTYFLARKSICETGLENIAGNYSCATGFTYISHKCWKLITGPQNRTDADHACFNHKGSTLFSIRNEQEFVKDQLVENLWTGLVCRRYEPKWCTWDVKSGTTADYDNFAEGSSNNEYGDCIYYITTGTQAGKWASASCNQALSFVCELPATIYDRTCEYNYNNHCYIPNLEWKLSSEAQSYCTSLDSNLASIQSANENRFAMSLFSPRTAIAIGGVAVSDNFVLWYDGTKTTFINIIEFRRGSCLFIRGDYGGHWIGYDCLYDKAVFLCKRNISEK

SEQ ID NO: 6656 - protein, 302 aa, Caenorhabditis elegans
MSKSYVFGELEIEEPSNNQTRLEKLQLVASDHWKNILIAPENYSCAAGFPYINHKCWKLVTGPQNRADADQACNNLGGSTLFSIRNDQDNQAVLEFVKDQQVKNLWTGLICDNNDPSLCTWDVQSGTTAAYNNFAKGYPSGVNEECIYYMTTGTQAGQWASGLCNETMSFVCELPTTIYDETCKYNYNTYCYTPYSLGKTASDAQSYCTSLGSNLVSIHSGNENRYVMTINFGRNKNILIGGVAFSNDVMLWYDGTESNFNNIYQIKDGNCLNMNNTNGGWYGGDCMASNNYFICKRRILEK

SEQ ID NO: 6657 - protein, 345 aa, Caenorhabditis elegans; identical to SEQ ID NO: 5270

SEQ ID NO: 6658 - protein, 379 aa, Caenorhabditis elegans
MKLSVQHDWKLGPSSLIDESTSLVSKNPQPLSTRPPLSKKWSQFLKHHWLAVLIGVISEILILSGAVLLTYYLANNSTSVTGNTASSDIDSSTALSFTGTRSAPANISSCTFGFTYINGKCWRLFTDPQTRENADSACMSYGGSTLVSIKNEQENNAILNFVPNSAVENLWTGLHCKANTTCNWDLESRSTDTNLVYTNFASGLSSNECVYFITAGSEAGKWKSDSCNQTMSFICELPSTIHDDNCDNIYNNHCYLRYDLSYTVAEAQTFCKTKCANLVSINSANENRYVQSIYNDTNGYIQLGAMLLSSDDIYWLDGSLPVYNNIKRTLNGNCLFMSVSKHRRGFWYTVECTQRSWFLCKRPAGITNCGNYYYILFSS

SEQ ID NO: 6659 - protein, 228 aa, Caenorhabditis elegans
MLKHFFISQFEFQQNENQAALEFVKDQKVDNLWTGLMYYADDPFSCTWDVNSGTTEAYHNFAEDHPNNEYGDCIYYMTTGTQAGNWANGSCTETMSFVCELPATVYDKNCKYNYENYCYTPYNQLETSRDAKNFCASSGSNLTSIHSANENRFLVSILPSYSIIVLGGFAFSKNVVLWLDGTPTIFINAILINRGNCLFLSSQNGHWFGYDCLTEKAHFVCKQRISGQ

SEQ ID NO: 6660 - protein, 308 aa, Caenorhabditis elegans
MLGKLNRFLQLHWMVILLGIIFEILFTIGVVRLTYFLTKQASVESTSGNRTCTDGFTHINNKCWKLVTGPKSRADADKTCYDLGGSTLFSIRNDQENQALMEFVKDQKVENLWAGLICDRHGPAWCTWDLQSGTTAVYNNFADGWPSNEDKICNYFMTNGTQAGKWASASCTETMSFVCELPATIYDNTCEYNYDNYCYTPYFELKLSSEAQTFCASSGSNLVSIHSANENRFVYNIIPPGTETSIGGVAYSDDSLLWYDGTPPLFTNMIQLENGNCLFLYNDYVHWFGNNCLTTKCHFVCKRRISEK

SEQ ID NO: 6661 - protein, 347 aa, Caenorhabditis elegans
MSDIDEIQELQEPSQPKTQPYSEKFKLFMTNHWKNILIGGLAEIIIIVFAFMLTFILAKQPACETDTTSISATFATMPTPVSGNLTCASGFTYVGNKCWKLVTVQKNRADADQACFSLGTEHSQEFPFFKYFEQDNQAVLEFLKDQHVENLWTGLNCVGINPFTCTWDVKSGTTSAYNNFADGYPNNMAGGCIYYKTTGTQAGQWSSGSCNEIMSFVCELPATIYDSTCKYNYNNYCYTPYDQLQISSDAQSICASSGSNLATIHSANENRFFMGIFPSFSMIALGGVALSGDKVIWYDGTPSTYTNIRTLTRGNCILLSNDVGRWDGYKCMIDRAKFICKRRIIGK

SEQ ID NO: 6662 - protein, 468 aa, Caenorhabditis elegans
MLFVQPMNFVYELPVTLQRKSCYLRFDLNLTVPQAQNFCLEKCANLVSIHSANEVRFIMTIYDFIEKVIINTHWIIVLSELISLSIVPIVSVSSKTFRSMSASHLVPEKWIQFLRLHWLIILIGVITEIVIITGVVLLTYFTTHHAACAADKITSSDFQRSNVFSLTSDSTNSEISSTTRTVSRSIKPATEHSFTCIIIEYSISETSTASTTIRPLTTTTTPGKTRDNADFDCMREGGSTLFSIRNEQENNATLDFVSNSGVAYIWTGLICNANTSSSCTWDLKSGSAANYDNFAKGFPNKTIGDCVYFIANGTEAGHWKSSACNQTMSYVCELPPTIHDDNCDNNYNNNCYVRYDKSSTIADAQEFCKTKHGGNLVSINSANENRYVQTLYYVSGYIPLGAVVPNYNVIYWMDGSPATYNNILYYTNGTCLFLNFSWGGSGDFWETVECTDKSWFLCKWPIGIDYAQ

SEQ ID NO: 6663 - protein, 372 aa, Caenorhabditis elegans
MAVTPVTRCTYLLRDELDFALKLLHQQDLTKSFVFSPMSISMAMALAHAGAKDETREEIRNVLLKLRETEHGAEVNVANRLFIKNGYPKKSYLKEVQKLYNASASNLNFDDTKRSAKVINKFASDNTKGKINKIISPEALKGIKVVICNAIYFKAKWLKIFEDSWEVSFFSAKKTSRQVEFLHMCEMTKFNENAHFKVISMPYKDENFALAIFLPKKRFALKKALKSLDSASILQLLTSFSECFVKIAIPKWSIETDMDIGAALQDLGIKDAFDNCAANFEDMYTSAGGDPLYISKALHKAIIEVCGRYDSEGSKFFDFKVDKMGTTAAAVTSLMYTDGVPQLPEHVEFWADHPFMFVLTHNNHPMFMGIYN

SEQ ID NO: 6664 - protein, 346 aa, Caenorhabditis elegans
MAVTPVTRCTYLLRDELDFALKLLHQQDLTKSFVFSPMSISMAMALAHAGANDETREEIRNVLLSGSTDSQLQKYISDLCEELRETEHGAEKRISKKILLKEVQKLYNASASNLNFDDTKRSAEVINKFASDNTKGKINKIISPEALEGIKVVICNAIYFKAKWLKIFEDSWEVPFFSSKNSSRRIEFLHKSEMTKFNENAHFKVISMPYKDDNFALAIFLPKKRFALKKALKSLDSASILRLLTSFSECFVKDLGIKDAFDNCTANFEDLYTSAGGAPLYINKALHKAVIEVDKMGTTAAAVTSHNYVTLCGAPQLPDHVEFWADHPFMFVLTHNNHPMFMGIHM

SEQ ID NO: 6665 - protein, 145 aa, Caenorhabditis elegans
MSSEEQDVKIVTSDDVEFIVSPKIANQSKLLADFVVLNQREPIPLKNVTSEIFKKVIEWCEYHAEDIPKPPDNVEEKRTDDIGEWDVEFLKVDKGTLFELVLAATYLDIKGLFNVTCKSIANSIKGKSPEEIRAVFNLGNETNME

SEQ ID NO: 6666 - protein, 421 aa, Caenorhabditis elegans
MNSVAYSFTVICMDDLVEEHHARNLTGHHWMESSTEKSLIFSATAIGAVMGLVPSVPLIDSLGIRGVLSISGAFSALGTLFFPFSVDSNIYAVIFCRVLQGLGVSVIMTVVGVIPGTWAPTSETGTFMAILSCVFQLSMIICMPVSGFLCESRFGWRSIYYIFGGSTIIFYAIFYIFYTDSPRFHRNVSEKELKKIEDGKMEIVKEGVPYWAICTDGTVLVGWLSVFGGNFGFTILTLYGPTYLKDVLNFDVKKTGFATALPFILSALSKFAAGRISDRMDFLTEKMRFSVCTIVSQGSVVIGLLLMAMTENWRIAQFAYTFAITASGLSIVGNIKCIQLRCRQHTHFALTVSSLGIYANYFGAPIVVGILTSAAGNTAENWSHLFIIVAVVTVITNAPFPFLTSDEPGPYVKVGQKPNEA

SEQ ID NO: 6667 - protein, 1294 aa, Caenorhabditis elegans
MGLFKKKKDDSSSEGSSEKKEEAPPPPKISIFQLYRYTSTVDRLMLAVGIIVSCATGVGLPLMSIIMGNVSQNFVTLGTIFLDPNSTASEKAAARAEFSHEVIQNCLKYVYLGCGIFAAGFLQASCFMVICEKLSNRFRRQFFHSVMRQEIAWYDKNTSGTLSNKLFDNLERVREGTGDKVGLAFQMMAQFIGGFAVAFTYDWLLTLIMMSLSPFMMICGLFLAKLLATAATKEAKQYAVAGGIAEEVLTSIRTVIAFNGQEYECKRYEDALEHGKKTGIKKSFLIGAGLASFFVIIYASYCLAFWVGTNFVYSGRLESGTVLTVFFSVMMGSMALGQAGQQFATIGTALGAAASLYEVIDRIPEIDAYSTEGQTPSKISGRISVNKVEFTYPTRADVKILKGVSLDAQPGQTVALVGSSGCGKSTIIQLLQRFYNPDAGQILIDDIPIEDFNIKYLRQLVGVVSQEPNLFNTSIEQNIRYGRSDVSDEDIARALKEANAADFIKTFPEGLNTLVGDRGVQMSGGQKQRIAIARALVRNPKILLLDEATSALDAESESIVQSALENASRGRTTIVIAHRLSTVRNADKIIVMKAGQVMEVGTHETLIEQKGLYHELVHAQVFADVDDKPKKKEAERRMSRQTSQRKGSVNFKTQESQVDEKPGAPPAPEAAEKEIKRLKKELEEEGAVKANLFKILRYARPEWIYIFFAIIAALIQGAVMPAFSLFFSQIINVFSNPDRDQMKKDGHFWALMFLVLAAVQGTSMLFQCSLFGVAAERLTMRIRSKVYRNVLRQDATYFDMPKHSPGRITTRLATDAPNIKSAIDYRLGSIFNAIASVGGGLGIAFYYGWQMAFLVMAIFPFMAVGQALMMKYHGGSATSDAKEMENAGKTAMEAIENIRTVQALTLQTKLYNIFCSHLDAPHGGNISKAIIRGLTYGFANSIQFFTYAAAFRFGLFLIFDKNVLMEPENVLRVLFAISFSFGTIGFAASYFPEYIKATFAAGLIFNMLEEEPRIDGMTSSGTYPQLSGEVKLNKVFFRYPERPAVPILQGLNVHVKPGQTLALVGPSGCGKSTVISLLERLYDPLEGAVTVDNNDLRQMNPKHLRKHIALVSQEPILFDTSIRENIVYGLQPGEYTHEQIETACSKANIHKFIDELPDGYETRVGEKGTQLSGGQKQRIAIARALIRNPKILLLDEATSALDTESEKQVQVALDAAAKDRTCIVVAHRLSTIVNAGCIMVVKNGQVVEQGTHNELIAKRGAYFALTQKQSSNQSGGAFDTSEALDDDDDDHVKF

SEQ ID NO: 6668 - protein, 333 aa, Caenorhabditis elegans
MTQIKVDAIISKQFLAADLNEIRQMQEESKKQVIKMEIVWKNVALFVALHIGALVGLYQLVFQAKWATVGWVFLLHTLGSMGVTGGAHRLWAHRAYKATLSWRVFLMLINSIAFQNDIIDWARDHRCHHKWTDTDADPHSTNRGMFFAHMGWLLVKKHDQLKIQGGKLDLSDLYEDPVLMFQRKNYLPLVGIFCFALPTFIPVVLWGESAFIAFYTAALFRYCFTLHATWCINSVSHWVGWQPYDHQASSVDNLWTSIAAVGEGGHNYHHTFPQDYRTSEHAEFLNWTRVLIDFGASIGMVYDRKTTPEEVIQRQCKKFGCETEREKMLHKLG

SEQ ID NO: 6669 - protein, 1294 aa, Caenorhabditis elegans; identical to SEQ ID NO: 6667

SEQ ID NO: 6670 - protein, 419 aa, Caenorhabditis elegans
MPGTGESPELTGNKTQYIGYSRQEKTWLFSTVAVGAMFGLFPVIIGISTYGLRKVFFAAAKRKLADLPICQKKYLPLTPVLYTFQGMSYAGCMPAVGAITSSWASLTQQGLFIAALTTFGQLSSIFSMPIAGELCVSPLGWKSVYFLHAAISMVVFLAWFAVFTDSPSTNKLVKSSELLEIQRGKSDAANGKREATPYLEILTTPSVWGIWIGALGDLIAVQLIHIYSPVYLHDIGGYSVEKTGFAAAVPVLFQFFMKLFAGHSSDRISGVSETTKLRIYNTIALGASAVFLAALGFVKEGQGLTGLILMTVATAMFGFNGGGFIKCAALVSRQHNHFVMANVQFLLCLSMLLCPILVSFLLRHGTIAEWRLVFFVHAGILAVCNLIFCLLATAKPAPWTDRTLKPSASRNTPLYTIKY

SEQ ID NO: 6671 - protein, 321 aa, Caenorhabditis elegans
MIRLTLLLFGLLGAATAQNCNTGGIYNSQFNRCYQYFTAPAQFSFAEQQCNLLGGHLASVQNGQENALLQSNAANSFKKSNYSDYWIGANDLETSGTWKWTDPSVTFDYSNWQLGEPQSGSDCAIQDKGDGTWSAIGCTSYRPYLCVTPVIMTATCPPITTPIPTTCPTPAPCPIKQCVPSCDQGWTYFSPTDFCYRVYHGEKFNDAEASCVLLGGHLASIHSLAENTFVNNIASCGIKEGKYEHLAWIGMHKVGQDWVWTDGTPSDYFNWAPKQPDNPKKEFCVQTAPDLSHDKWYENWNNLECNEVMRAYICKKASIHN

SEQ ID NO: 6672 - protein, 382 aa, Caenorhabditis elegans
MLFLQFFLNFQAFLGIFALESSSEPEFFEINIDRDHPEKVYQEFVEFKKKFSRTYKSEAENQLRLQNFVKSRNNVVRLNKNAQKAGRNSNFAVNQFSDLTTSELHQRLSRFPPNLTENSVFHKNFKKLLGKTRTKRQNSEFARNFDLRSQKVNGRYIVGPIKNQGQCACCWGFAVTAMLETIYAVNVGRFKLMSHIPALAPNFSDFDFFFFEFLAKLNMFLSFSDQEMCDCATDGTKAGCAGGGLMWGVEYAINNGLASEFDYPEFDQNRATRPGTCEAMDDDKTFPPVNFAAGTAFLQYKSGVLVTEDCDLAGTVWHAGAIVGYGEENDLRGRSQRFWIMKNSWGVSGWGTGGYVKLIRGKNWCGIERGAIGANMEEHYHG

SEQ ID NO: 6673 - protein, 606 aa, Caenorhabditis elegans
MVAVAAFSSSGQDKPAHTPKLGLFVYILAAASVIGGFLFGYDTSVVSAAMLYMPDAPGLKPMDTVWQEVLVSISPGMAAVGSLMSGTSSDYIGRRKVILGASAIFTIGALVCAASVNKIMLLVGRVLLGIAIGFASMIVPVYLGETAPTHVRGMLVAAFALMISFGQVVANITGGAFSYIDPYNVGWRLMFAFAAVPSIIQFVCFMFLPETPRWLYENGFETETREVLEKVYNGDKEWVEYEMAEIIAFNEDQAKENEKAHASGPVIWRILKTPHVLKACFIGSMLQAFQQLAGINTILYYTADIIRSSGISNNHTTIWISVLLSLCNFIGPFVPMSLIEKVGRRIIFLFSCGLVVLSLVFIGVAFLLVNHDSAATLPANQYGSNFNSSYPDAKGCMAYSNCDYCVTTDACGFCHDANTKQGYCLPAGFDNPEVYSSTGSCTNSNGSIANNFKWEKYYCDTKYTLLPIIACGVYLLTFSSGFTSLPWVLNSEFYPMWARSTCVAISTTSNWVFNLIIALTYLSLTQVIGKYGAFWLYAGLTVIAFIFILFLVPETKGYSIEEVEMLFMNKKQRREAESRRRETVTEVRSRMNSTVSFGQHNEVHKY

SEQ ID NO: 6674 - protein, 613 aa, Caenorhabditis elegans
MVAVEFKVSESGRPRPEKNPKLGFFVYLLGSAAIIGGFLFGYDTSVVSAAMLYVPEAPGLKPMGTVWKEVIVSITPGMAAVGAWFSGAGSDRYGRKPIIIGSTLIFVCGAVICAVAWTKIVMLIGRIFLGVGIGFASMVVPVYLGEASPTHVRGTLVSAFAMMISFGQVVANIMGGVFSYWEPYTIGWRLMFAFAGIPALIQFVCFIFLPETPRWLYENGHTEQAEQVLEKIYGGNTEWIEYELAEIKTYAEERQKQMEEEKKSGPVIWRILKTPHVLKACFIGSMLQAFQQLAGINTILYYTADIIRSAGIENYHTIIWISVILSICNLIGPFAPMFFIEKLGRRKLFLFSCAGVVVSLVLIGVSFLLVGNDSAPNFDRSAYLLAGNYQSNGEAESCLMLSNCDSCVTSEHCGFCEDSETRTGFCLPVDHNDVTLYSSTGLCTNGLDKSNSSFPNATSYVWQKHHCTTSYTILPIVMMGVYLLTFSCGFTSLPWVLNSEFYPMWARSTCVSISTLSNWVFNLIIALTYLSLTHAITKYGAFWLYAIFTIIAFIFIYFLVPETTGYSIDEVEMLFMNKRQRNIAMQARQAKLDAASDKDKNSSTSLSTETITM

SEQ ID NO: 6675 - protein, 386 aa, Caenorhabditis elegans
MQVFVIFLVVLPISGVVSINITEPEFFEINIDRDHPEKLYKAFEDFKKKYNRKYKDESENQQRFNNFVKSYNNVDKLNAKSKAAGYDTQFGINKFSDLSTAEFHGRLSNVVPSNNTGLPMLNFDKKKPDFRAADMNKTRHKRRSTRYPDYFDLRNEKINGRYIVGPIKDQGQCACCWGFAVTALVETVYAAHSGKFKSLSDQEVCDCGTEGTPGCKGGSLTLGVQYVKKYGLSGDEDYPYDQNRANQGRRCRLRETDRIVPARAFNFAVINPRRAEEQIIQVLTEWKVPVAVYFKVGDQFKEYKEGVIIEDDCRRATQWHAGAIVGYDTVEDSRGRSHDYWIIKNSWGGDWAESGYVRVVRGRDWCSIEDQPMTGDIKDHKDNYYY

SEQ ID NO: 6676 - protein, 1166 aa, Caenorhabditis elegans
MKETDEVGGGGGSIEDVDSDDMESSTTSSSNGEIAIKQQDQSFLMSRSTSPTSELRHQTLQIANLQHEMRQMRTQAENRDEECQKLELDNEEKAQKIKILENERLKLVDFKKKWKSVNDDLQEANCKIEKLQNLVGIEKKYREARDGKELYKSKYDIVVKKNLEMEETITTLEKNLKTLQMEMKEKFGVEDNLQRMRNTIDDLEAEISKKNLEIEDFLDEKHRMDREIKELKEIVHQMEVPSTTTTPRIMDSLADQLENAKQDEFEMMKAEIRKLRAQTEGATPETTIIQCNQDLDTLRSQLSTEQHQTAQLHLEIQKMQVEKEQIDGNMERIGIELEEMSAQVENLNLERDEAVKQLLEARRKFGEFQMGQSRDLEEKWSKEVEKSNKISKKCEILEEKLQESDFLLAKSRDEAKKLQFELDEALEETSHVTRSLSSEKNTLKAKLLELQDQVEAQTLELLNQKNCGKRLEDRDQMISNLHNLKNELENDLKTCQTQLELESKKLQRLREDLVLEKSRRADLIGRIHSLCTTLSLNGANFEKINNDDELIDNIDDIMMNALVAVKRERDDLRIQGNQQIQELHDLKRDIEKLRRSESESLNESDDRVRELTRENMHTKEQVFMLQEKLRELNLELSTKNDEIDMVKASIEELNRNSTASCTSNAEIARLQVSIRNSQIQEDLVKQENTKLRDELQEMQKMSKKRSQNLDELENMHKTLLVDHSRLQQLHNLLTRDYDEAKKESMELRQKVQNIPRQQAVFMNANIRELEAKLSEEISRREQLEKEHKMCRIHCENLRRDITELVQTRDELSLELRRAHDTCHNKNNQIDELKKQLNQKISEVNKLSSKIEALSQLNRTYNEENRNLSRQLEILLTQNKELLQRALHDKDQYHLEMKDFQDQLSALRRHKEKLEDKIMDQYRTMENKKSTPERKQPLVKRAAKALINRRRATSNGGSTTEDSSVYSADERSSPPLAVLHLFIITNFTKTGTNEDVDHLPPTCSSSDDHDVISPDFSAKNPLLRSRNDFMGGSVRSPRRYGNDHDGHIYTSPFLPPRVPIRNSPMTSSLRSRPPPPPYNRSPAHKIEQNSSFFEPIAHSTPNSSILEERRVVGEGEKRELVRDKEERIDKTLSYYENVNLPQNPPDLPENSDLKPNESTIWHEYGCV

SEQ ID NO: 6677 - protein, 907 aa, Caenorhabditis elegans
MVVLRKIAIVWMGLLMARSHVILKHENSLLKNYQKKKIFSNFLNLTQKIRFQNDFCSWCIDAVPIVDQCGNDPCGTPDKFNCTSKIESYDCTCQAGFTGEKCDSEIGSACATSQCREGSTCEASDNSTTGYTCRCTDKQYGTYCENDNLCADWPCQNGGTCSMVLSNSNWICNCTEGWQGRRCETKNSVLSSPVMGKCYKYDYVKIGTHQTKYKDDKMTSDKCNEYAQEKSTDDKTLKYLTLCGEWCMVSEDMLVKDDVSMKDDCKKSCGGDSSEYCGKVNSRCIVYEAGEMETDPNACEDNSTLCGAELGHGMCINWQSDVTDGFACICEPLWTGPDCENPVASACTPNPCVNGTCVLNEQYNKYKCDCDDGFSGDNCEYSKTCTAATCLYGGTCTETNNGGFKCDCLNLYSGNRCEEINRCNYGDPCVNGKCETTVDGITTNYTCTCDDGWTGANCETMIDFCTPDPCKYNSTCTPKFKGYDCTCLTGLTGANCSEIIDLCVPYWDNEAWKWIKSPCNSKDDMANCTKKINGFTCSCGEKWTDTLCDLNVLIKDVLMAIYGHVDLTMITLLNDLMQNPSQIKDMVPFITGLLTDSERSDLSWDAGDLFNWIAFEDQRLDLNRDIHKWNDVVLGNCFTFNHRDRNFTYLMRRPGRHGGIQAFMKTRQDEYAPWYDTAAINVFIHNRDDYVFSESVRYNAQPNAQSTINIFMTRYTRLGGNYGKCIKKPSEVKNYYYPGAYTTDGCLRTCYQDRMKEECNCMDPRYPQAPNSTSCQLSERSCVTEASEAAGDPSTWSSCVCPLPCSNQEYSVTWSKANFVNLPITCEKSSDVATCQKQYKDQLMVSIILPQLDFKIYAETPAMDFNKFLSQLGGQLGVLMGINVVTFIEVVFLFFGMFMVLCQKYEK

SEQ ID NO: 6678 - protein, 520 aa, Caenorhabditis elegans
MLLLLIFSSIFLYFFYHFHWKRRNLPPGPRPLPFLGNLLSLKTLKPGYEAFSNWKKEYGPIFTFWMANKPFVIIASYEKMKETFVKDGDTYVDKQLTHTEKERLGENYGVLDTNGHMWKEHRRFTLTQLRDLGLGKDLMQEKADLGRNRLKKAKKLHVLTSTVYSENILMEVEELFKELDAHGGEEIDLPKLIDRSVGNVINLTLFNKRFDMDKRDEFAHLKSLIDGMRNVTSQFRYLIQYLVPWTSTVLPGPTLSEKVRAKREELDDFFYSQIDEHRNEIDFDNTENLDFVEAYLKEQKKREEDGDFKTFCNKQLCAMLFDLWIAGLMTTTMTMTWGLSYYLYNPEVQRKIREELDKVIGNDRLISTADKNDLPYLQAFVTETQRTANIIPLNLIHMTTRDTVIDGFPIQKGTGVIAQISTVMYDEKVFPEPYKFKPERFIENGKFKKVDEVIPFSIGKRQCLGEGLARIELFLFFANIFNRYDVMPDFSGSLPDLDKSKDNFVIPRKFKAVLKRRYMD

SEQ ID NO: 6679 - protein, 520 aa, Caenorhabditis elegans; identical to SEQ ID NO: 6678

SEQ ID NO: 6680 - protein, 638 aa, Caenorhabditis elegans
MNLLLLLVTTCSAAVFQVPTTTSGSFRAKLIREGKYSSFLASRLQQLNTGSQPLLGFSDDPCIGNITIGSPPQSAFVFMDTTSANLWVMGSACTSVNCNDPLLGIIKHKFNTTKSTSFVKSNRKFNIQYGSGECSGYLGTDTVEIGGLKIQKQEFGVANIVDYDFGTRPIDGIFGLAWPALSVDQVTPPMQNLVSQNQLDAPIFTIFFDKRDPDYYYPSNGLITYGGLDTKNCNANISYVPVSSKTYWQFKVDGFQVGTYNRTVNRDQAIMDTGSSWFGLPYSVIAGIATQTNATWDLYASVYTVPCSTMNSLPDLVFTIGAEKFPISAPEYVEDVGLDDGTCALAMYGIDASGFGPSVTLGNIFIRRYCSVFDVGNARIGFADAIHPNTLTYYQNMLSKLICIKANDGASFQLDMKLLLFLVTTCSAALFQASINCKRFNQQANRYFNFDDSCIGNITIGTPPQSASVFMDTTSANWWVIGSKCTSANCNGYSGIRKHKFNTTKSTSFVEGNRTFSTEYGLCTGYLGTDTVQMGGLTITKQELGIATIVGLGFGLKPYVGIFELAWPALSVDQVTPPMQKLISQNQLDAPMFTIWLDQKDQGVYVGYTGLITYGGFDNKNCDANVTYVALSSKTFWQ

SEQ ID NO: 6681 - protein, 638 aa, Caenorhabditis elegans; identical to SEQ ID NO: 6680

SEQ ID NO: 6682 - protein, 727 aa, Caenorhabditis elegans
MIHSNEPLPYAIEYAKSGRSTCKTCKKNIALDQLRMSMNRPSTFFDGNMDSWFHYNCFWNKMIRGRDDINISSIRGVDWLRWEDQEKLRQEIQHFKTASPPTLTPLFSTTTVILSTIKTEKSLSNRGKCGKCGQNFERGEIKAHNKGKANHFECFLQEFDKISGTVEDIPGWADYEANFKIKATGEYVEALAAKGGSTEPATPASASPTPPEAETPVLSAEGSPESSNKRPASAEIIEIDGEGNPDENDFAKKRRMKKEARLMEVQKKRMKKQSDLLWEYRQIFERMPYTDNISILRENEQDIPEGHDRTAQDVFHEKTKNDWIYRKHFRKMPGMFSYVETDYSEFVGTNNGHKKKITPGSKITPGSKTLLPKSVKEVVMSIFDVENMKSALKSFEIDVNKMPLGRLSHNQINLAFEVLNDISDLLVKLPIDASKILDFSNKFYTIIPHNFGMRVPEPIDSFHKIKEKNNMLNALLDIKFAYDQISGGDVPASTSLSIDPVDINYRKLKCIMEPLQQGCDDWNMIHQYLKNTHGATHDLKVELIDILKVNRDNESSKFKRHIGNRRLLWHGSGKMNFAGILGQGLRIAPPEAPVSGYMFGKGVYFADMFSKSFFYCRANAKEEAYLLLCDVALGNVQQLMASKNVSRQTLPAGFQSVQGVGRQCPREIGSYKNPDGYTVPLGLTYMQLQGKQNVDYHLLYNEFIVYDVDQIQLKYLVRVKMHHARHL

SEQ ID NO: 6683 - protein, 321 aa, Caenorhabditis elegans
MTRLTLLLFGLLGAATAQTCNTGGIYNEQFNRCYQYFTAPAQFSFAEQQCNLLGGHLASVQNGQENALLQSNAANSFKRSNYSDYWIGATDLETSGTWKWTDPSVTFDYSNWQLGEPQSGSDCAIQDKGDGTWSAIGCTSYRPYVCVTPVIMTATCPPITTPIPTTCPTPAPCPIKQCVPSCDQGWTYFSPTDFCYRVYHGEKFNDAEASCVLLGGHLASIHSLTENTFVNNIASCGIKEGKYEHLAWIGMRKVGQDWVWTDGTPSDYFNWAPKQPDNPKKELCVQTAPDLSHDKWYENWNNLECNEVMRAYICKKASIHN

SEQ ID NO: 6684 - protein, 321 aa, Caenorhabditis elegans
MARLLLLTLALFGATAAQTCNTGGIYNAHFNRCYQYFTAPAQFEFAEEQCNLLGGHLASVQNGQENALLQSNAANSFKRSNYSDYWIGANDLETSGTWKWTDPSVTFDYSNWQLGEPQSGSDCAIQDKGDGTWSAIGCTSYRPYVCVTPVIMTATCPPITTPIPTTCPTPAPCPVKTCVPSCDQGWTYFAPTDFCYRVYHNAKWEDAEAACVLLGAHLTSVHSETENTFVANLASCGIKEGNPKDLAWIGMHKVGQDWVWTDGTPSNYINWAPKQPDNPGKENCVETAPDLSHDKWYENWNNEACSTEMRAYICKKGSIHA

SEQ ID NO: 6685 - protein, 443 aa, Caenorhabditis elegans
MTCLSFMMSNVICFNFTVLCMPGTGESSELTGNKTQYIGYNRQEKTWLFSTVAVGAMFGLFPVIIGISTYGLRKVFFAAGMLTSLTTFLIPIVAPMDFNLFLLMRFLQGMSYAGCMPAVGAITSSWASLTQQGLFIAALTTFGQLSSIFSMPIAGELCVSPFGWKSVYFLHAAISMVIFLAWFAVFTDSPSTNKLVKSTELLEIQKGKSDAAANGKQEATPYLEILTTPSVWGIWIGALGDLIAVQLIHIYSPVYLHDIGGYSVEKTGFAAAVPVLFQFFMKLFAGHSSDRISGISETTKLRIYNTIALGASAVFLAALGFVKEGQGLTGLTLMTVATAMFGFNGGGFIKCAALVSRQHNHFVMANVQFLLCLSMLLCPILVSFLLRHGTITEWRLVFFVHAGILAACNLIFCLLATAKPAPWTDRTLKPSASRNTPLYTIKY

SEQ ID NO: 6686 - protein, 283 aa, Caenorhabditis elegans
MLLIAVLTTLISILFAITICYLNFLLLISIFWRKRIPVNLHMMLTYCRFGVDLVYTIVLLILKIYYMLTRISNDFIIKNLYFLLVFPAASIGNIRSVLTFLIALERVIAIYFPIFFHIYRQKLPNFVFLLIILSSELFNQYMLFGYCGNVLETPLECVNYFCAVNSCYYRYWFSHQQIVCFLNGAFSVVLFLRLTFWSYFSGTETNKDISRATRIALLDFFIMLFFNIIPLYISSHITGVNLEILGLFIVLIKTFGFLVEGLITYRFLFNLKIDSVNEATVVS

SEQ ID NO: 6687 - protein, 158 aa, Caenorhabditis elegans
MLRLFIIVCLVCSVAPDCVPGDVGFGDSCYSFNRVHGKFKDANDLCVKMFGGSLVKITNIIDNNWMQKLAVNHLDADYNSFWIGASDAAHYTNWTWIDGSPMRFSNWGPGQPLEDRHCGTMLISTGKWFSQVCDERIQFLCQYPNGAYSPTCPPCLEI

SEQ ID NO: 6688 - protein, 354 aa, Caenorhabditis elegans
MKIAVLLCLLFAGASARSAPVDYVVDSCSKLACRPGFYCVSGKCVEGNAQLVGRHTYLCNLRKCPLGYHCSVKDGVASCAPDLDTPNSCQWIKCNPGSHCVMSNGKGVCVPDEKPVDLCHLLVCESKSTCVMSNGNAKCVPVDETQCNIKQCPKGQNCKLVNGSPKCVPELDQCSHIKCSIGSHCENGECVPDAVTENPCTWIKCSLGYHCAVVNGGGGCVPELRALENLPDLDQCIHIKCSLGSHCENGQCVPGTKFFICSVKCPIPDLGPIDACDSITCETGFTCVVENGASVCIPDGTPINPCIIMQCPTGEKCIFTNGPPICVPGRLSQSPLSYPIGCLIVSDTPLAGSA

SEQ ID NO: 6689 - protein, 1023 aa, Caenorhabditis elegans
MVTAIAGSSGSREGSADSRHSGSSSDGAIVAGPNKRLVVLKRKSEDDDAPDGAAKTKKHCEDTDSIASESSCNDAEDTKGSIRFLSSLTNVIIKPLVKPSPVYNGADEWVPKDMDEIAEFPMESVDKYKKVHPNVEAPKKFKLVNGEFSVVASLETLTKEMNARVAEQSSPDHHKREDSREERLTKNELTDNEDPKKKKEKDLRAKEEEELKNKPLYHLAITLYNENNEKYVMSLFRSHKLADVVALCERCRENPELFRVFPKNVNIKDYLHTIFHELRDNMTWKSVHISSKIGLLEYFENMKEHKLKKYLNLIVQPEGLSPLMIAVQNTQIETVSWMLDHGADINILSSEGQNVLHVAATASSGDLIKILWETKKCETMINQTDSNGYTPAYVALINACLSNCQTLRGFGGGIQSSDSTQMANPIIGAMKRGKLDEVSLRKMLELKQDGLTETEPTTGNTVIHCAINKKCLILLMEKFRDQTDPEARNALQQTPLHTFVIKDELGLVMTLSAYGVDMDAQDINGNTPLHCAVTRGNTEIARMLLCLGAKPDIKNRYKESPRHIAARLTEKEAKMDIVRALIICGAGACDDGFIGCAFGCMHKTGLTSCKTQLGSSSSDEQSMEDRVKDIHVSDNAASAPYEFVLDPDTQLVEEAYAERNETRAFPHEEALKRVKNKLKELVEKKKTSNVINVLGLDGGGIRGLVTVQMLICLEAFLDRPLIDYFDWIGATSTGCYIMSTMMTGGSLRKAQRYYLMFKDQLFDSWTRPYDTKTLETFIQRAFGADRLMGDIKYPRFFCTTVRADTFPVQLELLRNYRLPISEKENNDLGFTDPNELTIWKATRRSSAAPTYFSASEGKFIDGGMISNNPVLDLMSDIGFYNTTCQKMRIPEKMVDMGCVLSVGTGITPICPVDPSVFEMNDLFGMLRGMKNLSLVVIDQATATEGAPITRSRTWCHSLGVPYYRLNAPIFKDVILDTNDDYDLAKIMWDSVVYSHTHKKDFQELAELLKTVGTVDERKELLKI

SEQ ID NO: 6690 - protein, 1023 aa, Caenorhabditis elegans; identical to SEQ ID NO: 6689

SEQ ID NO: 6691 - protein, 483 aa, Caenorhabditis elegans
MQTRSVEPSNSWRYAIGKHLFSLRNCLTNFCIFKVKVCIIGAGLAGLRSAIHFEQVGIDYTIFEGSNRIGGRVYPFEYQDGYLHFGAEYVNGVDNEVYNLVEKYDLFDKTKPRTDDLWMLDQDNSITLVNGHLVPKKILDKFNDYIRYLNVALYEKSIKINQLSVENEINNQFIEFLRDVPENDHEIYESLINVYKNYFQTEWSSPVGELSLSNLSIWDDGTEEEDSAVLNKQGFYEILKDFRSKIPAGNIRLNCEVINVKEEENIMVTLKNGEVLHFDACIVTCSLGYLKKHHKTLFTPQLTSVKQDAINRMGFGNNLKVFLEYSDSWWNSLNTILILTHGENEDFMVFQPSSWAENILLCWIAGSGPKKICDKTDFELKILLDTHLHDQLKNYLDVKASVKIYRKNWINDEFTLGSYSYLTPGQIVGEDICILAQPVLKDNNPVICFAGEHTDSTMYQTTVGAVRSGLREASRISEHTFEK

SEQ ID NO: 6692 - protein, 550 aa, Caenorhabditis elegans
MIIKSKLPNLDIPDKTFHDFLFHEWEKFREDVALIDNDTFAQFTFQDVMQKADFIAKSLVYLKVEKSEVVLLVMDWSPAAIYIALGASMAGAAIQVVSPKLQAWEMQFPVKESESRFVFSDPLGLHEIDKLMKTLNREYRIICTGSRDFANGYPIIEDLAFAAKQNLPLPKIEPDTDIVYLPYSSGIHGKRKGIVTTHKVMVAKTMVMWNTSKHHEFRRGDTTLTMIPLHKQCGLDAILCALLNGLTVVTEKNFCVHTFMTCIQRYKIRAVHLTPYLMNLMMFEAENHTYNIESLEWVVTGADAVTEELYEEFTEIFPSVKTVTQTYGMTEVGLICRTYNKNYSPSCGQLTANLEMKVLDILTGKELGPREKGQICVKGIAAESPYLNNPKATEEHFLDGWRRTGDIGFFDEEGNVHLVDKLKEMIKVFGYQVIPKEIETLLLTHQAVEEAAVVAINNELSGERPVAFVVLKKGFVATEDDLKDYVNKRVIRYKHLVRVNITQFLPKSACGTLLRRLLAEAAVMSVASIAEVEKEFVPELPADMKSILTH

SEQ ID NO: 6693 - protein, 601 aa, Caenorhabditis elegans
MNRYICEGDNPDITEERKKASFNVDKLTEYYYGGEKRLKARREVEKCVEDHKELQDLKPTPFMSRDELIDNSVRKLAGMAKNYKMIDLTNIEKTTYFLQLVHVRDSMAFSLHYLMFLPVLQSQASPEQLAEWMPRALSGTIIGTYAQTEMGHGTNLSKLETTATYGQKTSEFVLHTPTISGAKWWPGSLGKFCNFAIIVANLWTNGVCVGPHPFLVQIRDLKTHKTLPNIKLGDIGPKLGSNGSDNGYLVFTNYRISRGNMLMRHSKVHPDGTYQKPPHSKLAYGGMVFVRSMMVRDIANYLANAVTIATRYSTVRRQGEPLPGAGEVKILDYQTQQYRILPYIAKTIAFRMAGEELQQAFLNISKDLRQGNASLLPDLHSLSSGLKAVVTFEVQQGIEQCRLACGGHGYSHASGIPELSAFSCGSCTYEGDNIVLLLQVANECELYPEHEAWNRCSIELCKAARWHVRLYIVRNFLQKVCTAPKDLQPVLRALSNLYIFDLQVSNKGHFMENGYMTSQQIDQLKMGINESLSTIRPDAVSIVDGFAIHEFELKSVLGRRDGNVYPGLFEWTKHSQLNNKEVHPAFDKYLTPIMDKIRAKM

SEQ ID NO: 6694 - protein, 228 aa, Caenorhabditis elegans [sequence omitted]

SEQ ID NO: 6695 - protein, 941 aa, Caenorhabditis elegans
MFPASLSRTAPSSLQVMDVFECVCVMWRLVVAWLLIGALDAVDRQNFKTCEQSGFCKRHRAVTSPTGYEVVGDSVKTNETGLHALIKNKDTTLRLSIVALKDSTVRVVIDENDGALRKRYQPLEALVDREPAQQKVKKIKEEATATKVLTTDGNRIVLQHKPFRIDFYVKDKIVSSINAKETLHFEAFKKKVLLSDREKGFWEETFKEIKDTKPHGSSSVGVDIAFVGAKHVFGIPEHAESYSLRDTRTYEPYRLYNLDVFEYETNSPMALYGSIPYLVGVHQKRSVGALWLNAAETWVDIEPTTADKGGLSKEVLDADTKPRQVPQHNARFYSESGLIDVFITLGPQPNDIFRQLAALTGVTPLPPAFALGYHQSRWNYKDQKDVKEVHDGFVKHDIPLDVLWLDIEHTDNKAYFTFDKDAFGKPEDMIKDLADKNRKLVTIVDPHIKKDSKYYIYKEAKKNKYLVKDAKDTIYEGNCWPGDSTYIDFINPKARKWWSEQFAFDKYKGTTKDVHIWNDMNEPSVFNGPEITMHKDAKHHGEFEHRDVHNVYGFHQHSSTFEGLKARSNNEVRPFVLSRSFFAGSQRTAAVWTGDNKADWAHLKVSFKILFNFFKIEQSIPMLLSLSTAGLPFVGADVGGFFGNPDEELLVRWYQAGAFQPFFRGHSHQDTKRREPWLFADNTTEAIRNAIKTRYAFLPYWYTLFYEHAKTGKPVMRPFWMEFIEDEPSWDEDRQWMVGNGLLVKPVLEEKVKELSIYLPGKRQVWYDWETHKARPSPGAVQIPAELNTIGLYHRGGTIIPKLSEVKLTTKENHEQPIILYIAVNQKGDFANGTIYLDDGESYAYEKGDFAYWGFTFKREHDYLHTITNKNLDKKGKFDSDVYIDKIVIRGAKFYPRNAHIFLDDFSPEDLEFEFNRDNFLMEIANPGAFVTREFRIDIHS

SEQ ID NO: 6696 - protein, 392 aa, Caenorhabditis elegans
MTECPESSTNMTNGENGENHAPAATIEDFEILKHIGSGAYGEVAAVRKLNGCDTETIYAMKVMEKRRMSKHKDMVEHEWKILTTIHNPFFMKMSYSFQTKRHLVFVMPFAGGGDMLTMMENECLIEESAHFYLCELVEGIGYLHEKHIVHRDVKLENLLIGNDGHLMITDYGLSATGCDAEDAIQGVIGTRHTMAPEVHLEKKYGTSCDWWAVGITYCDMRSDKAVFDGADSKEYSDSTAKKRPRLPKVLSPRERGFVNKLIVRDPTQRLGNGPDGTATVKAHDMFKGVVWEDVLAKKSKSDNYSVFATHNFGNRPTKFFLNAFLYYTLSHFTGLILTSRTHPCATTSHPTRMDFNIIFYCHAKYSLDFLTNRFPFCHFSRLLNPIFPIPTF

SEQ ID NO: 6697 - protein, 1494 aa, Caenorhabditis elegans
MFPLVRELVCGDKTENCKLTHGNKNDRWFQQILGCLLVVDLIATVIYDLYLYVSQSPNFEVVHFYGDLVQFGGICLALILTVACKNKGIITSGVITLYWLLVVVCGIPEFRFYLSGFIYNEYALEGIRATLYIIAFTFSALELFLCCFADVPSDMYKSESSCPEYTASFINRLTFQWFTGLAYLGNKKSLENEDLWDLNEIDKAENLIPSFMQNLKPRIDEYHQNIKKDPSAALPKNHPSFVIPIFKTYKYTLLAGFFYKLCFDMLQFLAPQLLKQLIGFIEDKNQPVWIGCSIVGIMFFSSFLQSMFLHQYYHSMFRLGMHVRSVLTSAVYSKALNLSNEARKGKTIGAIVNLMSVDIQKIQDMAPTIMLFWSAPLQIFLSIYFLWKFLGVAALAGLVVLILALPVNGLIAIQMRKCQTEQMKLKDERIKMMSEILNGMKVLKLYSWERSMENMVLKIRERELHILKKLSYFMAAIVFSWICAPFLASVISFVVYVYLDPENNVLTPEITFVALSLFDILRMPLAMVAMVYGEAVQCSVSNTRLKEFFAAEEMSPQTSISHGETDSAIEVENGLFSWSSDEDPTLREISFKIQKGQLVAIVGKVGSGKSSLLHALLGEMNKLSGSVQINGNIAYVPQQAWIQNMSLRNNILFNKPYDLENYEDVVKNCALKEDLANLPAGDRTEIGEKGINLSGGQKQRVSLARAVYQNPDIILLDDPLSAVDSHVGKHIFENVISSSTGCLASKTRVLVTHGLTYLKHCDQLIVLKEGTISELGTYQELLNNSGAFAEFLEEFLIEESKTRGRVASIGDGSGEVDEILRDLGQVKPGILKRLESHLSQESDKEDTSARAIEYSRDSSRRSVLLHSPRSQHEENEALLGAISEDVPAQENTQLIEKETVETGKVKFEVYIAYFQAISIPITLLFFFLYVGSSGLGILSNFYLAKLSDHAKSGNRTSSDAKMELGIYAVLGMGQSFVVLIASIILTIGVLRASRILHAGLLGNIMRSPMAFFDVTPIGRILNRIGKDIEAIDRTLPDVIRHMSMTIFNVVATLVVIMWATPWAGIAFAILSVIYFIVLRFYISTSRQLKRLESASRSPIYSHFQESIQGASSIRAFGVVDNFIKQSQQRVDDHLIAYYPSIVANRWLAVRLEMVGNLIVLSAAGAAVYFRDSPGLSAGLVGLSVSYALNITQTLNWAVRMTSELETNIVSVERIKEYTVTPTEGNNSRRLAAKSWPEKGEISIKNFSVRYRPGLDLVLHGISAHIAPSEKVGIVGRTGAGKSSLTLALFRIIEADGGSIEIDGINIANLQLEQLRSCLTIVPQDPVLFSGTMKMNLDPFSAYSDSQVWEALENAHLKPFVKSLQDGLEHKISEGGENLRFAGSKSQKFQLNFSVGQRQLICLARALLRKTKVLVLDEAAAAVDVETDSLIQKTIREQFKECTVLTIAHRLNTVMDSDRLLVLDKGRVAEFDSPKNLLANPDGIFYSMAKDANVV

SEQ ID NO: 6698 - protein, 514 aa, Caenorhabditis elegans
MSSASTPPSKSVQFSFRETDNLITKASENGRRRKTTVAMSPSVTDIFTAQRMLDIEEPLVKNKKYPFFKTPRLGGSRRIRNRLVQKQGLCNISLKNVPKQRRKYFSDIFTTVIEMKWRWCLLYFSLSFMISWSFFATVYFLIAKQHGDIEQIANATWTPCIVNVHNELNAFLFSFTTQTTIGYGFRYPTDACPLTIVTMCFQFMWGVMTQTLMAGIIFSKLARPIKRAATLIFSKNAVICLRDGKLCLLFRVGDMRKSSLAEAHVRLQMIKRCVTYEGELLPFHQFDMDVGYDQGLDRVFVIWPITICHEIDERSPLWEIGADDLKSAKFEIIAILEGVVESVGSTTQARTSYLPSEILWGHRFEKLVHYKKENGQYNIDFGKFHNVYSVNTPTCSAAEIERLRSEGIFNESEYQMYPPSDNKLNLLDNDEMSPVRDSIDLNQVPQIQILRRDSDEDPDAGEESMELVDLGIHHKCSIRSQSPIINSTSHLLQPMHKNSCSVRRGMLAPPASHS

SEQ ID NO: 6699 - protein, 414 aa, Caenorhabditis elegans
MQTDDSWKHNVSFYTLQALFTSANRRDDFIAVSIWTIMLLYALISNMLILAGIARSSTMRSATSYWFIISIAICDILMTFISLGHLVPATAFHEEYVQFKSIRNIVMIFFYDLFWYTGVVQLGLMAGNRFVSIVYPMEYKHIFSRTRSLYLILFGYFLGFLVSLPTLFDCCHTLWDSNYYITVYEKPDTLYKYVDMAVNSISLCMMIISYAVIILKVRASGRAMAKYQLTIRTRQQNALVNGVSLSCQMSECGRTSSVRPPRSQVSKKEMRLFIQFFVVSLVFLLTWTTWQWLPYMSESKWAYFVMTSLFFINNSVNPTVYIIFNTQLRRELHYLICRHHVITTAQNKRKQTLFGRGIAAANKIETDFQNNTRDDATKSLVDQAGSLSSQSHGTIDEHVRHQLLIKVRHASKNF

SEQ ID NO: 6700 - protein, 604 aa, Caenorhabditis elegans
MRLISSESFNAPMAVEYLNSIQDKPSLTFLGKRLFDLPEKDLDFYLPQLMYLYVTKVDAASVSHAYIEERNKKDAQFTVLCIWLLNCFTKNVPNKYENHALMLKSLLSRSNVPGTSQSADNMITLSLDRLEETNWTVGSSYGKSAGALARAAIQKESTLTAEHDSYEKSRCGPISTKLLTNQQNFIGRLVYIGVKLTEHHLLSSKQEKTIALQSELSMLNSMLPNSVWIPFDFENTMFNICVNESAVLNSKDKVPYVFFAEVIRSSPNYNSNIKTLSSVEPRIKKSQSESVLLKNKSYHDSTDPSIAVFAESWAEKKARIRGSSRYENHQKWDLIPVIVKTGDDLSQEAFAQQLLFTFKDLWHEEGVPLYLRPYKIVCIGSDAGLIEPVLDTLSLHQIKRHLTNVFRMNGNVTTPSLKHHFENVFGPVNSETYVNAQKNFIQSTAAYSLVSYYLQLKDRHNGNILLDMDGHLIHIDYGFLLSSSPRNLGFETAPFKLTTEIIDVMGGIDSDMFLYFKSLLLRGLMAARKHHRRIVSLAEIMSAGSKMQCFRAGAETVRALEARFHVSSTDEQLQQLVDTLVEGSRDSYTTRFYDSFQYYTNGIH

SEQ ID NO: 6701 - protein, 569 aa, Caenorhabditis elegans
MVTSRYLITVTTVVLGGSAQFYSYGVVNPAQVVITDWINQTYIDRYKAPLSLTVSNVIWSFVVSSIAIGAILGASFTRIIGEKYGRRNGMFFNGILNVFAALFELVAKRFSSPELLIFGRFVYGINMGLSSGLVPMYLMEITPYKYRGPAGTLHQIAVAFSDWFSLLIGLPEVLGDQNNWPLAFALPGLPALALVCILPFCPESPKYTLGTKHDRDKALKDVELLIGKEQAPHMFESIVREVALDEVSFFCVYLYTRISLLGLYLNFANHLATTKFWKKNVIHTALKLKLLSSKLRGNAKLHGYFQGDGTFRELFTRPDLRIPLAVSIIVMIAQQFTGCTAVFAFSTDMFLNAGLTPVIARFSTLAIGIVYFLFACTSPFLIHKVGRRWLSLFQLASCMVALMLLSLFTFLQNYENIEWARYGTIFSLVFYMCVYGVGSPIPWIIASELFTQQFRATAVTVSVFVAWTFAFIVSTSYLPFQQLVGITFSYFPFIIGLAVFGIFIYVLLPETRDRPMVEIVTEVHHRTASLSAGRPWDASRPPSRQEVQRLLDTMDPRSYSSYDNSTLED

SEQ ID NO: 6702 - protein, 454 aa, Caenorhabditis elegans
MVDEDKKSGTRVFKKTSPNGKITTYLGKRDFIDRGDYVDLIGENKGTEPQNVGFILTGLSHGMVLIDEEYIKDNRKVTAHLLAAFRYGREDLDVLGLTFRKDLISETFQVYPQTDKSISRPLSRLQERLKRKLGANAFPFWFEVAPKSASSVTLQPAPGDTGKPCGVDYELKTFVAVTDGSSGEKPKKSALSNTVRLAIRKLTYAPFESRPQPMVDVSKYFMMSSGLLHMEVSLDKEMYYHGESISVNVHIQNNSNKTVKKLKIYIIQVADICLFTTASYSCEVARIESNEGFPVGPGGTLSKVFAVCPLLSNNKDKRGLALDGQLKHEDTNLASSTILDSKTSKESLGIVVQYRVKVRAVLGPLNGELFAELPFTLTHSKPPESPERTDRGLPSIEATNGSEPVDIDLIQLHEELEPRYDDDLIFEDFARMRLHGNDSEDQPSPSANLPPSLL

SEQ ID NO: 6703 - protein, 254 aa, Caenorhabditis elegans
MGKGNSKLKSSQIRDLAEQTYFTEKEIKQWYKGFVRDCPNGMLTEAVIKNFESRSKIIILQLLFFKYIELYIPTVKCFVPEKSDISEPVKCMDPFFDVLVLFSIETSHNGFQKIYKQFFPQGDPSDFASFVFKVFDENKDGAIEFHEFIRALSITSRGNLDEKLHWAFKLYDLDQDGFITRNEMLSIVDSIYKMVGSSVQLPEEENTPEKRVDRIFRMMDKNNDAQLTLEEFKEGAKADPSIVHALSLYEGLSS

SEQ ID NO: 6704 - protein, 952 aa, Caenorhabditis elegans
MAAEGHNVDANLVDMRPNHGHYFVKKTFGKPAYCHHCCDKIWGMLTTGYSCEMCNFVCHEKCLRTVVSYCSSVALQLIKNPVAHTWSAPCLIKRKYCCVCRKRTDDALSVECEVCEYYVHVDCSDLAVSDCKEAATYVANMESANTVQYHHMREGNLPKESKCIVCRKTCFSTECLAGMRCEWCGQTAHAVCYRQMDKECDFGVLRKIMLPPMCLTIPRTELPMEQLLNISSHDQPQSRKVSSPSKIQADDVSTSGEDVKEREDFEIIRVFDGNNSYRSQISRNIVVAKHVSVQQVRDAALRRFHINDTPERYYITQVVGEVEEEILEDPVPLRNVKRPEGKRAQIFIRYYDDPDKDEVKVYGGWLRKVPVTFCAISVSKDTVVQDLVTDALYHFGLDGSCWNRYNLIEVSLDRGVAERTCNPQENVLQLVRNLRKDSLRRYHVVRFYVQEKEDPHDHAVFVGNLPVSLAQRQYERILLKLLGAKEKPFTAIGPIYFEYGSLIITFNTPKAATAAVQKLQSAIYEEKKLIVLCLPNVQPQMIPKDVEPLLVLVNVKSGGCQGTELIQSFRKLLNPFQVFDVLNGGPLVGLYVFRNIPKYKILACGGDGTIGWVLQCLDIAKQDAACFSPPCGIVPLGTGNDLARVLRWGGGYTGEENPMDILKDVIEADTVKLDRWAVVFHEEERNQPTSSGNQTEMNEQTMNNPEDQTSMIIMNNYFGIGIDADVCLKFHNKRDANPEKFQSRLFNKTQYAKIGLQKMFFERTCKDLWKRIELEVDGRIIELPNIEGIVVLNLLSWGSGANPWGTSKEEGNFSKPTHYDGLLEVVGISDVSRLGLIQSKLAAGIRIAQGGSIRITTHEEWPVQVDGEPHIQPPGTITILKSALKAQMLKKAKKSRRGGATNATSLTHPHPETSESMSGPLGVPSTLGDPNHGKTTPDNTAADSDEEGDAFL

SEQ ID NO: 6705 - protein, 950 aa, Caenorhabditis elegans
MAAEGHNVDANLVDMRPNHGHYFVKKTFGKPAYCHHCCDKIWGMLTTGYSCEMCNFVCHEKCLRTVVSYCSSVALQLIKNPVAHTWSAPCLIKRKYCCVCRKRTDDALSVECEVCEYYVHVDCSDLAVSDCKEAATYVANMESANTVQYHHMREGNLPKESKCIVCRKTCFSTECLAGMRCEWCGQTAHAVCYRQMDKECDFGVLRKIMLPPMCLTIPRTELPMEQLLNISSHDQPQSLSSPSKIQADDVSTSGEDVKEREDFEIIRVFDGNNSYRSQISRNIVVAKHVSVQQVRDAALRRFHINDTPERYYITQVVGEVEEEILEDPVPLRNVKRPEGKRAQIFIRYYDDPDKDEVKVYGGWLRKVPVTFCAISVSKDTVVQDLVTDALYHFGLDGSCWNRYNLIEVSLDRGVAERTCNPQENVLQLVRNLRKDSLRRYHVVRFYVQEKEDPHDHAVFVGNLPVSLAQRQYERILLKLLGAKEKPFTAIGPIYFEYGSLIITFNTPKAATAAVQKLQSAIYEEKKLIVLCLPNVQPQMIPKDVEPLLVLVNVKSGGCQGTELIQSFRKLLNPFQVFDVLNGGPLVGLYVFRNIPKYKILACGGDGTIGWVLQCLDIAKQDAACFSPPCGIVPLGTGNDLARVLRWGGGYTGEENPMDILKDVIEADTVKLDRWAVVFHEEERNQPTSSGNQTEMNEQTMNNPEDQTSMIIMNNYFGIGIDADVCLKFHNKRDANPEKFQSRLFNKTQYAKIGLQKMFFERTCKDLWKRIELEVDGRIIELPNIEGIVVLNLLSWGSGANPWGTSKEEGNFSKPTHYDGLLEVVGISDVSRLGLIQSKLAAGIRIAQGGSIRITTHEEWPVQVDGEPHIQPPGTITILKSALKAQMLKKAKKSRRGGATNATSLTHPHPETSESMSGPLGVPSTLGDPNHGKTTPDNTAADSDEEGDAFL

SEQ ID NO: 6706 - protein, 220 aa, Caenorhabditis elegans
MGKSQSKVQTKKKANKKLTTEEVQTLEQVTYFTKKELKKWYKDFVRDCPSGELKMEEFQGIYKQFFPNGDPSKFAAFVFNVFDDNHDGHISFSEFIAALSITSRGTLDEKLDCKSKKKMQKETLLKMYESHFAGAFSLYDVDKDGFITKDEMADIVDAIYSMIGNMLELPKDEDTPQKRVEKIFTNMDRNLDGQLTREEFKEGSKADPWIVQALTMDISS

SEQ ID NO: 6707 - protein, 126 aa, Caenorhabditis elegans
MSWSDIINNNLIGSGNVSKAAILGFDGAVWAKSDNFNISVEEAVAAGKAFTSLDALLGTGLRLEGQKFLVLNADNDRIIGKQGGSGFFIYKTIQAVIISIYEKGLQPEMCSKTTGALADYFRSIKY

SEQ ID NO: 6708 - protein, 212 aa, Caenorhabditis elegans
MEAETSTQEVVKQVKNLPILMEDAPVGSDDHQLQYSYTFSYFMRPTGKFDPEDYASYVQPVGIMKSVEQFWSIMVHFKRPTEMCDKADIHFFKTGVKPVWEDPANCKGGKWIIRLKKGLSTRIWENLLMAIIGEQFLVGDELCGAVCSIRNQEDIISLWNRNADDTPVTNRIRETLRSVLQLPQNTVLEYKRHDDCLRDQSSYRHTTKNICK

SEQ ID NO: 6709 - protein, 372 aa, Caenorhabditis elegans
MKSRIFFITLLTIVAAQESADQLCSSFDAQQSCGQCIKAHAECAWCIDPHSSLTNRCQLKSKFTNETCTPHLVYSPQTAQVKIQQNLPLETKQHDGKTIVRQQPQAVSVRLMPSHSATVSFKYLHQTDPSRRSTEPETMEIQTSDVKDTPLQLKFFIVCDGELKETKSCRVQNNQIVEFKIEEINSRLCHQNGHLVCGQCVCDQSRGGDKCECPLASHGVSKASELEDKCRFNSSSPVCSASGKCKCGQCQCNKPTAVFFFWDTLHIQNSITQELCSNNGRCECNRCVCNMGKTGAFCGSDEKTPAPEEKDKPESVPEEPEATEKPDDMPSDSDLEKELDESSSAKEEQTSSSGVVSRVCVLLTFFLLVLNF

SEQ ID NO: 6710 - protein, 455 aa, Caenorhabditis elegans
MGSVNESCDNYVEIFNKINYFFRDDQVINGTEYSPKEFGYFITFAYMLIILFGAIGNFLTIIVVILNPAMRTTRNFFILNLALSDFFVCIVTAPTTLYTVLYMFWPFSRTLCKIAGSLQGFNIFLSTFSIASIAVDRYVLIIFPTKRERQQNLSFCFFIMIWVISLILAVPLLQASDLTPVFVEPSCDLALYICHEQNEIWEKMIISKGTYTLAVLITQYAFPLFSLVFAYSRIAHRMKLRFANRNQNVTTNTNTSQRRRSVVERQRRTHLLLVCVVAVFAVAWLPLNVFHIFNTFELVNSFSVTTFSICHCLAMCSACLNPLIYAFFNHNFRIEFMHLFDRVGLRSLRVVIFGEQESLKKSMRTEFRSRGGCKTVTTAEPATFQRMNESMILSAMEQDEQLSSGGKLFVLKKYILKMFQKGGHKQSTPASPRLGFGYNSIMTSELFSIVEGVLS

SEQ ID NO: 6711 - protein, 238 aa, Caenorhabditis elegans
MSQNTESQMLVALPADYIPEASRRCKIIVVGAKNAGKSTFIERVEFGKFHEEKQTEKLYRVIAKKVFEQTLTVELIEKDLGGLTNEDNGFKKTEMRDVDAVLLFYAADDLESFKQLKENLVHVQRKIPPNANITVVGTKADVKEMQVQWQEVDSFAENQGFSCFETSSKTGVNVEIILHDILETIFERRFASDDDEVLSNQPVYASTVLTSRQEEPPRVNGYCWMPNIPIFSFFRSNE

SEQ ID NO: 6712 - protein, 692 aa, Caenorhabditis elegans
MRQPPDFCAAQTMHVVLFSLFETGKREDLKTEEIVGDGSHPPSLLPRPFTKTFCCLVCSMGWKPQLAYIKMLAYGSDPNAEDLYITMTPSVSTENDTTVWATEEPAAIVWRHPLLAIALFSICLLTVAGNCLVVIAVCTKKYLRNPTGLCALLKNTVTFSLRNSQCLFRTFIGGKGIIYWKFAVPRPNFKTKITTFRIWVTRLYLIISLAIADLIVGVIVMPMNSLFEIANHTWLFGLMMCDVFHAMDILASTASIWNLCVISLDRYMAGQDPIGYRDKVSKRRILMAILSVWVLSAILSFPGIIWWRTSSPHLYEDQSQCLFTDSKMYVSFSSLVSFYIPLFLILFAYGKVYIIATRHSKGMRMGIKTVSIKKRNGKKSNTETESILSSENEPTLRIHFGRGKQSSSSLRNSRFHARESTRLLLKQVSCKSLNDRGEHNNNNTVRQPLLRGTEGCHSDSISRSSQRNFRGRNVTIGSNCSSTLLQVDQPDRMSLSSNSQMVMTSPLSTRRKLNVREKSRQMMRYVHEQRAARTLSIVVGAFILCWTPFFVFTPLTAFCESCFSNKETIFTFVTWAGHLNSMLNPLIYSRFSRDFRRAFKQILTCQRQQKVKTAFKTPLSLVFTQLISVTQMAPRFSSLAEISFRRRRFAKKLANEKFYRILFAQLVFVKKFYISIFFGILLLYIVYQSDSE

SEQ ID NO: 6713 - protein, 312 aa, Caenorhabditis elegans
MSKCFQILVVFGSFYKKNILSTDTDNIFCLILKNIPLAKTVFRCREVATDAMFAVKVLQKSYLNRHQKMDAIIREKNILTYLSQECGGHPFVTQLYTHFHDQARIYFVIGLVENGDLGESLCHFGSFDMLTSKFFASEILTGLQFLHDNKIVHRDMKPDNVLIQKDEENTARRTTFVGTALYVSPEMLADGDVGPQTDIWGLGCILFQCLAGQPPFRAVNQYHLLKRIQELDFSFPEGFPEEASEIIAKILVRDPSTRITSQELMAHKFFENVDWVNIANIKPPVLHAYIPATFGEPEYYSNIGPVEPGLDD

SEQ ID NO: 6714 - protein, 453 aa, Caenorhabditis elegans
MSNDQLKSKLREFFDRQPDQSEKAHQDSKIFEVLYSQFLENQHLIKLNGGLGTTMGCSKAKSLVEVREGYTFMDLAVLEHQPTFWQIDNFFWKNLNFEGNQEQCRNPRKMCEAHNVDTPLYLMNSFYTDEDTKKYLAEKGYSNVKTFVQSKCPRLDAETKLPIEDENEDWGDDAWCPPGHGNIFQSLQNSGVLDQLLADGREIIFVSNIDNTGANTDLQIVQLMLDKNVDYIMECTPKTQVDVKGGTLIDIGGRMMHLEMPQVPAENLPDFCSTKVFKIFNTNNIYVNLKAVKKLLPDIKSEIIVNKKTIRSREVLQLEFSIGGCIKNFDNALCVHVERKRFRPVKNLGDLLSLRSTLCDLDHSTFKVHHNHELGAPPVISLDPSIYNSVEVVDLKFPHPLVMDNCSEFAVVGDVTFGKNVKLSGKVTVNGKTESPGVVPDGTVLKDQEYIAE

SEQ ID NO: 6715 - protein, 255 aa, Caenorhabditis elegans
MNVKVTHNVKRAKTKKSQFSGGASGIGKAISQTLAKHGARVVVADLDSGNAAATAKALPASQSHSSFACDVSNADSVKGLSEHVKSLGTPSILVNCAGITKDSTLLKMKQEQWDSVIKVNLTGVFHVSQAFVKASVDNNNHPLSIINVSSIVGKMGNFGQTNYAATKAGVIGFTKSAAKELAKKNVRVNAVLPGFIKTPMTEAMPPTVLAEICKGIPMGRMGEAEEIANSVLYLASDLSSYVTGATLEVTGGFSM

SEQ ID NO: 6716 - protein, 452 aa, Caenorhabditis elegans
MVIQFAEKNKFSGTLCIASIASNMTVINFTMICMAKPSELVPTTDQEGTINFSYSNEQKSVIMWAAAVGTLAAAWPFHWFYEKFGARRVFFAAGAFSTISTALMPLAAHIHFNFLVVARFFQGVSFGADFAAIGLIVVNWASLKQHGLFISLLSSFSQISVMFTMPVAGELCESKYGWESVYYGHAAVSGALFVLWAWFYRDNPSKHPQMTETELEKIRRGKGEVKEHEKAPIAKILTNPVMQSVWLSAFGELMMSQFIVMYEPTFLKEVLGFTVNHTGYFVAIPRALHLTFKIISGIASDRISFWTEKSKMRIFNTIALMGSGTFFCVLGYIPKEHAHLSLVALIIIECSTGFICGGFYKCATLVARQHSHFVLSQIQFIKCLSLFIEPLLVFLICTSNTLEEWRIVFLTHGILLIAGNIIFCYFATDRPADFTHTLVEEELPEFLLERER

SEQ ID NO: 6717 - protein, 364 aa, Caenorhabditis elegans
MIQIHIRNEVIMANSYGEMLDVLRALLEDYVQRLERLDQVLIQVMELNPGEFRDRQRLMQDIRDLIQETTFQAREVRVARRMVRTLHERESHHLICKKAGFTTVAEYTFWNYEEKCVDIEKLLSDLEFAPAKSVIILPACAYNPTGMDLSENQWKQIARVIKRKRLFPFFDISYQGCASGDPAADSWAIRHFVSDGIELFVAQSFAKNLFFTNPRLGNLTVVVNNAAVIPGIKSQMSLAIRINAFYPTAFGATIVHKVLSTSARREFWIQSIQQISSRIKQMRTALFDVLSALKTPGSWDHIIRQTGMFSYTGLTSTQVDHLVRNHKVFLLSDGRINISGLNMKNVEYVAKAIDETVRAVKSNV

SEQ ID NO: 6718 - protein, 342 aa, Caenorhabditis elegans
MGSAWEEPTCVLITGGCGFIGSNYINFTFNKWKNTKFINYDKLAFGASPLHVEKEIRESPRYKFVEAALEDQPTLIKTLQENEVDMVIHFAAITHVDESYSDRIGTIQDNIISTTTLLESIVNSPYKGVKKLVHISTDEVYGDSFEDTTPKSESASLPNPTNPYAASKAACEMVIRSYWHSYKLPYVMVRMNNVYGPRQIHTKLIPKFTKLALDGKPYPLMGDGLHTRSWMYVEDCSEAITRVALEGTLGEIYNIGTDFEMTNIELTKMIHFTVSKLLNREPTAPTFAPIPDRPYHDRRYYIDFSKIRNAMGWQCTTPFSEGLMKTIDYYVKLHVATARLQG

SEQ ID NO: 6719 - protein, 385 aa, Caenorhabditis elegans
MGLVTCKQEREAELQNRQIDTQIRIENQANKRKIKMLLLGVTDSGKSTIVKQMRVNYLDGFNETEVVNAIFVIRNNIIDAFKNICNIILHSDITVTQEEKVLVKLFAYESGKIELMQEVDELNVINAVSGYECIKQFFERFAFHPMVPDHIHYFYPNLDRIASSNYVPTAEDLIHMRQTTLGVHEISFDYTKHIIRLIDVGGQKTERRKWIHFFEGVTAVMFVCSLASFNQTTEEEPKAFVWESSLNKVQNKVLVRSAGKAKVEKPGLINRLDESVDLFKSIRENSFLKMSNFMLFLNKKDLLTKKLTKVVFSDYFPDYKKWITNDNSDVSVAEFIENMFREGLEPEKRMYAHLTQATVTANIEGTFALCCDVIFGKNYEDTNLE

SEQ ID NO: 6720 - protein, 555 aa, Caenorhabditis elegans
MRLLIPILIFALITTAVTWFYGRDDPDRWSVGGVWPLPKKIVYGSKNRTITYDKIGIDLGDKKDCDILLSMADNYMNKWLFPFPVEMKTGGTEDFIITVTVKDECPSGPPVHGASEEYLLRVSLTEAVINAQTVWGALRAMESLSHLVFYDHKSQEYQIRTVEIFDKPRFPVRGIMIDSSRHFLSVNVIKRQLEIMSMNKLNVLHWHLVDSESFPYTSVKFPELHGVGAYSPRHVYSREDIADVIAFARLRGIRVIPEFDLPGHTSSWRGRKGFLTECFDEKGVETFLPNLVDPMNEANFDFISEFLEEVTETFPDQFLHLGGDEVSDYIVECWERNKKIRKFMEEKGFGNDTVLLENYFFEKLYKIVENLKLKRKPIFWQEVFDNNIPDPNAVIHIWKGNTHEEIYEQVKNITSQNFPVIVSACWYLNYIKYGADWRDEIRGTAPSNSRYYYCDPTNFNGTVAQKELVWGGIAAIWGELVDNTNIEARLWPRASAAAERLWSPAEKTQRAEDAWPRMHELRCRLVSRGYRIQPNNNPDYCPFEFDEPPATKTEL

SEQ ID NO: 6721 - protein, 470 aa, Caenorhabditis elegans
MAEVPHHNIPAVDMLNATSRLQLEAQELRNNKPNWGSYFRSQMIQEDDYNFITSFENAKSKEERDQVLAANNANGQAAKTMANLITQVAKDQNVRYVLTLFDDMLQEDKSRVELFHSAAARQKRTVWSQYLGILQRQDNFIVNQMSSIIAKLACFGTTRMEGQDLQYYFSFLKEQLKNSTTNDYMNTTARCLQMMLRHDEYRHEFVDSDGVQTLVTALNGKTNFQLQYQLIFAVWCLTFNADIARKAPSLGLIQALGDILSESTKEKVIRIILASFVNILSKVDEREVKREAALQMVQCKTLKTLELMDAKKYDDPDLEDDVKFLTEELTLSVHDLSSYDEYYSEVRSGRLQWSPVHKSEKFWRENASKFNDKQFEVVKILIKLLESSHDPLILCVASHDIGEYVRHYPRGKTVVEQYQGKAAVMRLLTAEDPNVRYHALLAVQKLMVHNWEYLGKQLDSDVQTDTVAVK

SEQ ID NO: 6722 - protein, 361 aa, Caenorhabditis elegans
MNHVDYVAHVIVMPIVLSIGMINQCLNVCTLLHIRTSIFLYLKASAIADILSIVAFIPFLFRHAKLIDPSWELGMFYHAHLELPLINALISASALNIVAMTVDRYVSVCHPIKFFQNNETKPSRRRTMLIIVMIYFIALMIYFPSVFQKKLGVVTDALTNKTIYTIVRNEDVEALQVFKFYLIVRECICRWGPVLLLVILNMCVVRGLRKIDKRNWFWRQPSQNSRTETLAQRQLRSPRDDRSRISVLLFVTSATFIICNIPASVISFFVRRVSGSLFWQIFRAIANLLQVTSYLYNFYLYALCSSEYRHAFLRLFGCRSSLSPTSTGDSPTVRVSVHGKRCHQAVVLLGNENHENPVDEV

SEQ ID NO: 6723 - protein, 345 aa, Caenorhabditis elegans
MDYHLDVYFQEEWYDHRLAHNASAPILVRDLTVFKMMWHPDVYFANARSAAFQDITDDNFLVWVYPNGRVWYDARISIVSSCNMDLWKYPLDSQECALRILSYAYPMTVLRLLWSEKEDVPAIDRNPDITMPDMSLKHIRTGYCNGTYATGEWSCMTAIFYVEREMMHHVMQTYVPTALIVVISWFNFWLEIDSAPARVSLSITTLLTISTQANAVKLALPEVSYMKAIDVWMGSCMAFVFGVMIEFTICHYAKNLEMLRGDGQPSLIVDTALSTLFGAARDIDDLVRKVATLATPTIGLPRRRHSRPPAPHHAPHSRHPHTIALLKFCFAITKHHRSAHYTHKL

SEQ ID NO: 6724 - protein, 114 aa, Caenorhabditis elegans
MSVAWNVQNGEIDAVKQSVNEKNVHEIYNGRTAIQIAADYGQTSIIAYLISIGANIQDKDKYGITPLLSAVWEGHRDAVKLLLQNGADRSIHAPDGTALIDCTEEEDIRELLKN

SEQ ID NO: 6725 - protein, 276 aa, Caenorhabditis elegans
MNGKSIGKCFWVRYTTQALTFHHWLTYMCMPNARTQVFIVVVGDHNCGKSCILLRFAENSFRMDHISTLGVDFKLKTIKLGRDKVSETLKTLSFVSYYIFTFPVYLGFSLLYIRLELWDTAGMERYRTIYNSYYHSAHGVMCVYDMTNEKSFENLEKYWLKEIKQHAPPNAVLMLVGNKADMDQERKVDFDRAEKLASRLGVSLYEVSAKTGINCEEAFHTLTAAMRERITAGSMHSDESDDNEEFSSAFHVDGVIKSDKGKFTSCCASAPEPAFV

SEQ ID NO: 6726 - protein, 662 aa, Caenorhabditis elegans
MVRWQTWPLLLLFQLVTCQQLQQRIVEAPKDTLAAVGETAILTCRVEHQQGPVQWMKDDFGLGTDRDKPLPGNKRYRMVGSAANGEYNLEISNVTLFDDDDFACQISESDHAKAVVSSKAKLTVLVRPTPPKIVKSHHSLKAIAGDPITQSCLSRKGKPPPTIGWAIASDEHGKHIVSWLANRAQNSEEFMIEVDSVKLSLRYAPQINLTVASKLPLRENGSALLACNVNAKPLDNVKISWYKGNQKLRETGDVRGISVARITLTFETLKMEDHNRDIFCEATNEIGTTRGSIKLNVAFGARIMSTSQDKEVNEGDNAFFHCATLANPAPAIFWTRGDSDEIIGHGENLTLENVRTWQQGNYNCTATVEGFRKQILSHYLHIRGPPTVSMKDEVSASLDEATEIICEISGRPKTNNVRWTVNGKEINFNNGRITVHQYPKPYGKESILKIKDLKEEDFGVYNCSANNGLGFDNRGTLLKKRNILDWIVITAKFDRMVALAIISAGVLLVSLLCCLCMCRSNCRSRKSKFIDDQSDVTVKCEALDGQYFPEMYSSSPVDNVHLSTKVGQKLDNMKKNSDYISIPQNNPDLDFLGATGSFGPPGGLYPKCFNNSANEYIYNRSFRYVRRGDERQIAGYGDATGSGDSQNVQLQLPLVAGSGPTN

SEQ ID NO: 6727 - protein, 525 aa, Caenorhabditis elegans
MNLVDEKDEKPTRWEKCVEFIMFHFRWVFVVPFLLPLSFLFNTVFDFRNRIVHAVNSAPNAHVRKVKHIQEQLKEWNDNGRKSKLVNARPGWLTMSFRFPLYKENATKIATDKLFDILDLDVEKMTVKAEPGVTMGQLSQYLISRGYTLPVLPELDDLTVGGLINGCGVESGSFKYGMFQHICTGYEVVMSDGELKNVYPDSAAKTEQAKQDNSLFFAIPWSQGTICFLVAATIKIIPCKKYVKLTYKKTETLSEMCEQLTEDSDRNSENVDFVEALMFNKEKGCIMLGEFSDGPDTHDEVVNPIGRWYKKWFYTHVEDLINKKHESIEYIPLRDYYHRHSKSIFWELRDIVPFGNNVLFRYLMAWMCPPKIAFLKATTPNVLRKLYDRSHVLQDMLVPLDKLEECIDLFHKEVEIYPMWLCPFYLKSQPGLMKLRNATHKMYVDVGAYGVTSKDGYHHERTTRRLESFVRSVNGFQMTYADIYMTRAEYAEMFDRTLYDWKRASCKCIDAFPDIYDKICRSGRR

SEQ ID NO: 6728 - protein, 1529 aa, Caenorhabditis elegans
MAPLLQIGLLVLFAIIIFAIIGLEFYSGAFHSACYNERGEIENVSERPMPCTNKTSPMGVYNCDVKGTTCLQKWIGPNYGITSFDNIGFAMITVFQCITMEGWTTVMYYTNDSLGSTYNWAYFIPLIVLGSFFMLNLVLGVLSGEFAKERERVENRREFLKLRRQQQIERELNGYLEWILTAEEVILKEDRTTEEEKAAIMEARRRAANKKLKQASKQQSTETEEDFEEDEDEMEEEYVDEAERKKRGCCHSVGKFIKQLRIQIRIMVKTQIFYWSVITLVFLNTCCVASEHYGQPQWFTDFLKYAEFVFLGIFVVEMLLKLFAMGSRTYFASKFNRFDCVVIVGSAAEVIWAEVYGGSFGISVMRALRLLRIFKLTSYWVSLRNLVRSLMNSMRSIISLLFLLFLFILIFALLGMQLFGGRFNFPTMHPYTHFDTFPVALITVFQVSKNVINCKCINVLKILTGEDWNEVMYLAIESQGGIYSGGWPYSIYFIVLVLFGNYTLLNVFLAIAVDNLANAQELTAAEEADEKANEIEEESEELDEQYQEGDHCTIDMEGKTAGDMCAVARAMDDLDEECEEEESPFGGPKPMVPYSSMFFLSPTNPFRVLIHSIVCTKYFEMMVMTVICLSSVSLAAEDPVDEENPRNKVLQYMDYCFTGVFACEMLLKLIDQGILLHPGSYCRDFWNILDGIVVTCALFAFGFAGTEGSAGKNLNTIKSLRVLRVLRPLKTIKRIPKLKAVFDCVVNSLKNVFNILIVYFLFQFIFAVIAVQLFNGKFFFCTDKNRKFANTCHGQFFVYDNQNDPPRVEQREWRLRPFNYDNTINAMLTLFVVTTGEGWPGIRQNSMDTTFEDQGPSPFFRVEVALFYVMFFIVFPFFFVNIFVALIIITFQEQGEAELSEGDLDKNQKQCIDFALNARPRSLFMPEDKNSTKYRIWRLVTSPPFEYFIMTMICCNTLILMMKYYNNPLFYEEILRLFNTALTAVFTVESILKILAFGVRNYFRDGWNRFDFVTVVGSITDALVTEFGGHFVSLGFLRLFRAARLIRLLQQGYTIRILLWTFVQSFKALPYVCLLIGMLFFIYAIVGMQVFGNIWLNAATEINRHNNFQSFFNAVILLFRCATGEGWQDIMMAAVQGKDCARAGSAEINFEKGQTCGSNVSYAYFTSFVFLSSFLMLNLFVAVIMDNFDYLTRDSSILGPHHLDEFIRVWADYDPAATGRIHYSEMYEMLRIMAPPVGFGKKCPYRLAYKHLIRMNMPVAEDGTVHFTTTLFALIRESLSIKMRPVEEMDEADEELRLTLKKIWPLKAKKNMVDLVVPPNHELCFQKLTVGKIYAGLLILENYRARKSGTEIFLYKCKIRQCILCLKSLTVFVGGQGLFGGGLRSLVAAAKAAESQHSSHTPQPPEETTPIIPQHAQQFSAAPTMSAQGSLQQMQGTSSGGGQRPYSLFNSFVDTIKSGKQDGDVTDVQYQSVDQQQYVSISYSENKCAVGLLWEAGAVSGSGACLQPASLVNLSPHFCTTAKSRRIGV

SEQ ID NO: 6729 - protein, 1956 aa, Caenorhabditis elegans
MGDLQYLQVQRAAVADPATLAAWAQRKLCWVPDQNEGFLIGSIKRETNDEVLVELVDTSRQVTISRDDVQKANPPKFDKIEDMSELTYLNEASVLHNLKDRYYSSLIYTYSGLFCVVINPYKKLPIYSEDLIEEFKGKKRHEMPPHIFAIADTAYRSMLQEREDQSILCTGESGAGKTENTKKVIQYLAHVAGATRNKSLNAAAQQNIVQKGELEHQLLQANPILEAFGNSKTVKNDNSSRFGKFIRINFDMSGYISGANIEFYLLEKSRVLRQAQDERSFHIFYQILRGCSAKEKSEYLLEGVDNYRFLVNRGITLPNVDDVQEFHSTINSMRIMGFADDEISSIMRVVSAVLLLGNLEFTQEKKSDQAMLQDDRVIQKVCHLLGLPVIELQKAFLRPRIKVGREFVNKAQNQEQAEFAVEAIAKASYERLFKWLVTRINKSLDRTHRQGASFIGILDIAGFEIFDINSFEQICINYTNEKLQQLFNNTMFILEQEEYQREGIEWDFIDFGLDLQPTIDLIEKPMGVLALLDEECLFPKANDKSFVEKLQKTHNKHPKFIVPDMRSKSHFAVVHYAGRVDYSADQWLMKNMDPLNENVVGLMQNSTDPFVAGIWKDAEFAGICAAEMNETAFGMRSRKGMFRTVSQLHKEQLTKLMTTLRNTSPHFVRCIIPNHEKKSGKINSNLVLEQLRCNGVLEGIRICRQGFPNRVPFQEFRHRYEILTPDVIPKNFIDGKESVRKMITALDIDTNLYRIGQSKVFFRTGVLAHLEEERDLKLTALIMNFQAQCRGFLSRRLYTRRQQQSSAIRIIQRNGLAYLKLRNWQWWRLFTKVKPLLQVTRTDDEIRAKDDELRATKERLLKMEHDFRENEKKLDQVIVERAVIQEQLQQESENSAELDDIRGRLQTRNQELEYIVNDMRDRLSEEEQQNEKNNDERRKQMETVRDLEEQLEQEEQARQKLLLDKTNVDQRLRNLEERLVELQDAYDKLLKEKRLLEEKVEGLTTQLLDHEERAKHGVKAKGRLENQLHELEQDLNRERQYKSELEQHKRKLLAELEDSKDHLAEKMGKVEELNNQLMKRDEELQHQLTRYDEESANVTLMQKQMRDMQTTIDELREDMETERNARNKAEMTRREVVAQLEKVKGDVLDKVDEATMLQDLMSRKDEEVNATKRAIEQIQHTMEGKIEEQKAKFSRQVEELHDQIEQHKKQRSQLEKQQNQADQERADMAQEIALLQASRADIDKKRKIHEAHLMEIQANLAESDEHKRTLIDQLERSRDELDHLNRVREEEEHAFANMQRRLATAEGQIQELNEQIQEETRLKIANINRARQLEDEKNALLDEKEEAEGLRAHLEKEIHAARQGAGEARRKAEESVNQQLEELRKKNLRDVEHLQKQLEESEVAKERILQSKKKIQQELEDSSMELENVRASHRDSEKRQKKFESQMAEERVAVQKALLDRDAMSQELRDRETRVLSLLNEVDIMKEHLEESDRVRRSLQQELQDSISNKDDFGKNVHELEKAKRSLEAELNDMRVQMEELEDNLQIAEDARLRLEVTNQALKSESDRAISNKDVEAEEKRRGLLKQIRDLENELENEKRGKSGAVSHRKKIENQIGELEQQLEVANRLKEEYNKQLKKNQQIIKEYQIECEEARQAKEDIAALLREADRKFRAVEAEREQLREANEGLMQARKQLELENDELEELRAKGGGISSEEKRRLEAKIAQLEEELEEEQSNCELAIDKQRKAQVQLEQITTDLSMERTLNQKTEAEKQSLERSNRDYKAKITELESGAQSRARAQMAALEAKVQYLEDQLNVEGQEKTAANRAARRLEKRLNDTTQQFEDEKRANEQAKELLEKSNLKNRNLRRQLDEAEDEMSRERTKHRNVQREADDLLDANEQLTRELMNLRGNNRRRADMRLRRGFDVPGSSDNLAREEENESNVSGSEHGMSVN

SEQ ID NO: 6730 - protein, 828 aa, Caenorhabditis elegans
MDADASTITPEELDFIRQRALRRFDSIVPTAGREGTEIASDIFKGRTLAIYTSGGDSQGMNSAVRSITRMAIYCGCKVYLIYEGYEGMIEGGDFIKEATWNTVSDIIQQGGTIIGSARSSEFRTREGRLKAATNLINRGIGRLVCIGGDGSLTGANTFRLEWTDLVQELVKNQRVTAAAAKKIPYIQIVGLVGSIDNDFCGTDMTIGTDSALQRIISSIDAVVATAQSHQRAFVIEVMGRHCGYLALVAALASEADFCFIPEWPAPENWRDVLCDKLSQMRSEGQRLNIIIVAEGAIDRDGKAITAEDVKTAVKEKLKYDTRVTILGHVQRGGAPSAFDRLLGCRMGAEAVFALMEMTEVSGIFCEFFINGLNESEPCVISIDGNVMVRVPLLKCVERTQMVQKAMADKDWTTAVMLRGRSFQRNLETYKLLTKMRTVEKDNLSEGHKFNVAVINVGAPAGGMNAAVRSYVRMALYHQCTVYGIEDSFEGLANGSFKQFKWSDVTNWAMNGGSFLGTQKSLPTEKTMPQLAAQLKKHNIQALLLVGGFEAYHSTIILAENREKYPEFCIPMCVIPCTISNNVPGTMVSLGSDTAINEICQMIDKIKQSATGTKRRVFIVETMGGYCGYLATLSALSSGADNAYIFEEPFTVQDLSDDVDVILSKMEVGAKRYLVVRNEWADKNLTTDFVQNLFDSEGKKNFTTRVNVLGHVQQGGSPTPFDRNMGTKLAARALEFLLIQLKENLTADNKVIAKSAHTATLLGLKGRKVVFTPVQDLKKETDFEHRLPSEQWWMALRPLLRVLARHRSTVESSAILESVEEESADSHMF

SEQ ID NO: 6731 - protein, 191 aa, Caenorhabditis elegans
MCGDAAVGKSSFVMRVIRRQFTNQLPSTLGVDFHVKTVNVDGRNVALQLWDTAGQERFRSLCKSYFRRADGAILVYDVCAEQSFLRVRDWIETIKESTERSIPIILVGNKVDMRISTPGSVAKTDGASMAAAMGVLFMETSALDGSNIDNAMLALTRELMAVEDVEIRSTGVVLNPAVAKKGGCFSKCRGS

SEQ ID NO: 6732 - protein, 341 aa, Caenorhabditis elegans
MTKPSVGINGFGRIGRLVLRAAVEKDSVNVVAVNDPFISIDYMVYLFQYDSTHGRFKGTVAHEGDYLLVAKEGKSQHKIKVYNSRDPAEIQWGASGADYVVESTGVFTTIEKANAHLKGGAKKVIISAPSADAPMFVVGVNHEKYDHANDHIISNASCTTNCLAPLAKVINDNFGIIEGLMTTVHAVTATQKTVDGPSGKLWRDGRGAGQNIIPASTGAAKAVGKVIPELNGKLTGMAFRVPTPDVSVVDLTARLEKPASLDDIKKVIKAAADGPMKGILAYTEDQVVSTDFVSDTNSSIFDAGASISLNPHFVKLVSWYDNEFGYSNRVVDLISYIATKA

SEQ ID NO: 6733 - protein, 341 aa, Caenorhabditis elegans
MPKPSVGINGFGRIGRLVLRAAVEKDSVNVVAVNDPFISIDYMVYLFQYDSTHGRFKGTVAHEGDYLLVAKEGKSQHKIKVYNSRDPAEIQWGASGADYVVESTGVFTTIEKANAHLKGGAKKVIISAPSADAPMFVVGVNHEKYDHANDHIISNASCTTNCLAPLAKVINDNFGIIEGLMTTVHAVTATQKTVDGPSGKLWRDGRGAGQNIIPASTGAAKAVGKVIPELNGKLTGMAFRVPTPDVSVVDLTARLEKPASLDDIKKVIKAAADGPMKGILAYTEDQVVSTDFVSDTNSSIFDAGASISLNPHFVKLVSWYDNEFGYSNRVVDLISYIATKA

SEQ ID NO: 6734 - protein, 2427 aa, Caenorhabditis elegans
MADSNDTHAPPEPVLEVPPPQEIRILETADDIHQRRQEVLGHYSIFKDHSQTKRDRLEEARQFQYFKRDADELNVWILEKLQTAQEENFRDPSNLQAKIQKHEAFEAEVQAHAKTIANLDKTGNAMIQHNHFASEHIKKRLEELHALWDKLFFKLKDKGIKLQQALKLLHFIRQCDEILYWIREKETYVTAEDMGMDLEHVEILQRKFDDFLKELGNHQYRINEINQAADKLVEEGHSEHDQIYKKRDDVNDAWHRLNTLAATRKEGLFGAHQVQRFNRDADETLAWIGEKDLALSSDDYGRDLNNVQALQRKHEGTERDLAALEGKMLQLEKEAHKLAETHPDRAEAIHQKNDDTKAAWNALKEKAQHRKDGLERSFQLHRFLADYRDLISWIGDMKAVIGADELAKDVAGAEALLESHQEHKGEIDARADSFNQTASAGQKLVEMGIPESPEVQEKLEKLDHEKSSLLGLWEERRILYEQCMDLQLFYRDTEQAETWMNKQEAFLANTDLGDSLDSVEHLIKKHEDFEKSLAAQEEKINALDEFATKLIQGQHYAADDVAERRQALLDRRRRLLDRARQRGNALKESYKRQTFDRDCDEMVSWITEKLSTARDDSYLDPTNIRGKLQKHINFEQELKANENRLDDIRSTGEQIIDSGHFAADHIGDRLRQVNNLWNELVDATNKKGAKLREAGNEQQFNRNIEDVEAWLSELEGQVASEDYGKDLVSVQNLQKKIGLIESDFNAHNDRVDGIKQLAQQFQEEEHFNAPVIVRKQENLQQRYNALRDPLEKRKRKLGESHQGNQLFRDIEDELAWIREKEQVAGSTNRGRDLIGVQNLIKKQQALIAEIANHDSQIESVSSAANDMIQQGHFLAPEIRDKLAQLRDNWRILKSKAEKRRTDLDDSLQAHQYLSDANEADAWMSEKEPIVGSTDYGKDEDSAEALLKKHRALLSDLEAFKGTIEDLRKQASQCKYQEQPMGQLGRDCVLALYDYQEKSPREVSMKKGDVLTLLNASNRDWWKVEVNDRQGFVPAAYVKRIEPGTAQQHAQQQVNSIGGKQSEIEDKYQRLMMLGETRKRKLEEACKGYQLLREANDLAEWIKSREAVAAQQEIGTDLEQVEVLQKKFDDFKGDLKANEVRLQEMNQIATALTSVGQTETAVRIRQQIEDLNARWRALEEQTEQREQQLGSAHEVQRFHRDVDETRDWIQEKDDALDSEDFGRDLRSVQALQRKHEGVERDLAALGDKIKSLDEKANRLRQSHPEAAEQIYDLQRELNEQWNRLTSKANNRKEKLLDSYDYQRFLSDYRDLMQWIASMNQLVSSQELANDVTGAEALLERHQEYRTEIDSRAATFQAFDQFGNQLLNSHHYAAGDIENRLQGVNEARKGLEDAWVARRNILDQCLELQLFYRDCEQADTWMSAREAFLAQEDPSGDNVESLIKKHEDFDKAINTQEEKIKGLKLFAESLIKNNHYDSPAVTRKRDQILDRWNGLKEALIQKRFKLGESQTLQQFSRDADEIENWMTEKFQIAQEENYRDPTNIQQKHQKQQAFEAELHANSDRIAAIIQAGNNLIENAKCGGGEAAVSARLKALNDQWDLLVKTTTEKSYRLKEANKQKSFMAAVKDLEFWLGEVEILLQSEDYGKDLASVENLLKKHSLLEADIVAHQDRVGEMNEQADSLLENDQFQGQQIAERRKLIADRYDGVKKMATDRRDKLSKALNVHQFFRDIDDEESWIKEKKLLVSSDDYGRDLPGVQNLRRKHRRIDTELASHEPQVSLVKLKGEELLRSAAEAGVGEDQIKKRMEDLEQSWGQIRDLTGNRHQRLDESEAFQAFLGDVEEEEAWMNEKQQILGSDNFGENMAGVQGLLKKHDTFQVDLELHKQRVADLINKGDTLIHNGNHHAPHIKQRCDQLRARLIEIESMAEGRLAKLRDNSAYLQFMWKCDVVESWIAEKEQQVRSEDFGRDLSSVQILLTKQEAFDAGLNAFEHEGIQRITELKDQLVSSEHQQSPAIEKRHTNVIQRWQNLLAHSEARRQKLLKMQQQFKQIEELYLAFAKKASTFNSWFENAEEDLTDPVRCNSLEEIRALRDAHGEFQRSLSSAEEDFRQLQDLDRRIKSFNVGPNPYTWFTMDALEDTWRNLQRIIKEREQELAREHQRQEENDKLRREFAKLANAFHAWLTNTRQEMMEAGGTLEEQLDAVERKAKEIKANKGQLRQIEEKGAMLERNLILDNRYTEHSTVGIAQAWDQLDQLAMRMQHNLEQQIQARNQSGVSEEALREFSMMFKHFDKEKTGRLDHQQFKSCLRALGYDLPMVDEGQPEPEFQRILDIVDPNRDGYVTLQEYMAFMISKETENIQSSEEIEMAFRALSKEFRPYVTAEELYANLTPEQAEFCIRRMKPYMDAISGRSIQGGLDYEQFVHALFQS

SEQ ID NO: 6735 - protein, 351 aa, Caenorhabditis elegans
MFNAGVISPHIAAALAMSFNQQRMNASVSPPLDHTTISVNSFPSMGSVKTDSPPTASSPTLCCAVCGDVSSGKHYGILACNGCSGFFKRSVRRRLIYRCQAGTGNCVVDKAHRNQCQACRLKKCLNKGMNKDAVQNERQPRNTATIRPALDMDPQNFFREYAGAVSAIMGHSNMMKREDSPSSASDGKTEDEKKDSLQETTMSQLESVLQWAQQFRLFTVLTNSEKRQIILTQWPRLLCISLCEQAEDVSFDDHLTSLMLKFRRLDVSPAEFNCLKAITIFMKPTEDSQYQFEEQLDQCICLLQQCCLKLDSSPSRFGKLLLLLAEIQFYPTSYLESLLDTKISQLVSRFL

SEQ ID NO: 6736 - protein, 2229 aa, Caenorhabditis elegans
MRSWVLIAALAVICLGAEPELSHKERIRKVLKSWNPANSNQLFHPVSEQKIQFDEQSDLFVDTHHISKRSIAEPHVFAGMATRGCNKPGYTGATCQYPLCSARNPYIPDNKDSDDISIDATNLANCSQTYVVVVDETMRNIKIEVETESPLNPTFYLQSESGDLIFPDTDRKTVTSYVATYETLAPGQYLLGPRADSGDEFCTMMMTAHTNIQVTGGFTSGDQPERSDYPTLKFAYFDTESAVVLHAQGLHFPGQIQAIGFTGAENHISRYIPMATRFNCTYPYILERYTCRKIGNNDIGHNLLQVEGMSDNGYVFRRILPYQCILPPVSTTTVPAPTTTAAPLTTCQNGGQVLKDSSGSPYCYCFGLYTGRDCSQMLCANGGFLPTPTSEHCECPEGFTGFHCQNIVCPGASGIDFNAENPTVTLVIRSRSQLSDVIQQATNSVSRIVDELSAEPGYLTNFIVVLFDNAKLLVNQRYDSWDAAMVDLLKAINSAPSDGGCDDVVFSAVASALSLYPTNKSPIYVITDANPNDSTEKQTIVHLESYWRAPVYFIYVQPAIGSGCNTSPDSAGYRDMVDMAAMSSGNTFYFNNRTTISNFFYVHMYNTLFRSQLALSGDYSHCANQNIYKSVAVDVTADQVVVVATGSNLKLQVTTPTGAHPDFFVAFNDGVNYIWTSNQIFAGQWFFNLVSDSPNSACTFKVYQKKYNLGGMSQYNPDYDIFWSFATTLTSAAGVLRQPVAGFDASPVFHVSNYPEFISMDRVHANLQIYAIRDGVQTEVYGSSGMYRDACEFHFYFPPFICNVPDEVLYFNFFARDNNDMALQRAGTMLCSAVHPTPPPQHQCQNGGVMNPTNTTCFCTPQFTGTYCQNIVCYNGGTVSGGQCVCPPGYAGESCEVPRCIETGPNPEFIRYGVDMVFAVEITQQSLASIVMLDNNFQEILRDVQMQDRGWIRNFVLVGFNSTWGGPIAQSPSNNLTAIIAALHNLATNVPSDNGCSVKLWDALNHAIFARDLVPGSFIEIFQTTPEYELDQRSLGLFYDMSRAMDISLYGFLTAKPTLLPAGFVCNATQVNYYVLFGMVTSSTGQTYILQALEISNAIRLIPIQFSNGQVTINGNNDCRHEDGLTTYFPVDAYTQTIQLTVFGYGTTIQVYNGNGVLAEALELFYDDYTGQSVYEIRQACDNGWESFGQYCVKFLTVNDDILSMPQARNFCASAGGYLADDLGDDKNNFYSSIAANTQFWIGLFKNSDGQFYWDRGQGINPDLLNQPITYWANGEPSNDPTRQCVYFDGRSGDKSKVWTTDTCATPRPFICQKHRYDSDHKPNTIGDADLPAGDWYVKIKTNPTNSNPPYCSLSVRVQSSLQIVSGFATKIGDDNPQIDPIQDFSSNRLITYVHSVDNENRVPIMTDAILWDFYNGTFYNGLKYQARFGCQYGWVSQDFPCPNSDNQNNEFGVLHVGEDEFGNTFQRLTFGHCSPATIVCGNGGIRQNGQCICTDYWTGSRCTVPICVNGGTKNSDEATCTCPDGYAGLNCQFEVCQPKVPQIFTDDTKTLLFVVETTRQNSDTVNQLIANLKNIVTSATNFAPFWFSYFGLVTFDTTGRTFEKYNYTTIDALITDLTAQSTAISTDGACSMPYLGVLAHLLEHDNVISIPNSEIFLVTAAGPSDLNKYGEAMNSLFNTEAHLHYIVSKSANCPTFEGVNNVQDMTWLGYGSSGNILFTDSSNIVSLMNSYLPSLYGASILQDPTGPANYSCTDGSLPWFVPVDSNTTFIYVTTSSEFGSLSVKDPLGQAHNVAPAYNVNSQKFYKIEVDRLGGIWTLQLVQPPGLCLAHIYSTGGARVYTKFSLPNPVGGKEDPLGAHQDGRFVQPVSGFDNVAVFHIAGKPMQRGQLQYVEIFDIGQVTVTNVLRSELYRREGCSYEYYSDLFTCSGDMIAVFIHGVDEYNQKFRRQQIVVCNGRNPTTGQPMTGTMVPVTGSMAPVTQATQQTQGPVTQQTQGPITQATQPPQTVQTQAPVTPTQNPQTGLQFDIVFLIDGSQAAQQNFDSFTKFIQTMMVSFDVGIAGAHVGLVVVAADLNDQAPPVANLNAITSQQMLISYLNGLKDGYTDFDDAGQVLTYNLQVVSSTDYMAATAGYRAGISNHVIVYITSTTSFFTDPTPSAKTIIAQKKYGIITVGYGGAVDTGKLQTISGGSACSFTATDFTTLNNQIKPIQQLITAASTNGGNYCKST

SEQ ID NO: 6737 - protein, 2214 aa, Caenorhabditis elegans
MRNWVLIAALAVICLATEQELSHKDRIRAVLRSWSPASQKQFFEPVREQKYRTMEERLDTHHISKRSIAEPHVLAGMATRGCNKPGYTGETCQYPLCSARNPYIPNNDGFDDIAIDAYNLANCSESYIVVVDETMRNIKIEVETASALNPTFYLQAENGDLIFPDESIQLPTMFTANYLHLPPGQYMLGPRADTSEQFCTMMMSSRSSIHVSGGFTSGDQAERSDYPNLKFTYFDTESVVAIHAQGLDFPGQIQAIGFTGAENHISRYIPMTTRFNCTYPYILERYTCRKTSNNDAGHNLIQVEGVTNSGYKFRRIVPYQCVLPPVTTTTPAVPTTPAAPITSCQNGGQLLTDSNGVAYCYCFGLYSGSTCSQMLCANGGFLPTPTSDRCQCPEGFSGFHCQNILCTDMSGFDFNAENPTLTLVIRSRSQLSAVIEQATESVQSIVDLLASEPGYLSKFIVVLFDNGKLLVNRQYDSWDAAMVDLTKAIHSAPSEGGCDDVVMSAVASALSLYPTNKSPIYVITDATPNDSAEKETVFHLESYWRAPIYFIYVQPSPADGCNSSPDNSAYRDMVDMAARSSGNTFYFSDRSTISTFFYRHMLNTLFRSQLVLSGDYSHCSSQNLYKSAAFDLSVDYVTIVATGTNLTLVVTSPTGQYPTFNTAFSDGVNYVWTYNSPVAGQWFFSIRSLEPEAACTFKVYQKKFNFGGQTQYSPDYDIFWSFASTLTSAAGVLRQPVLGFDSSPVFHVTNYPQFLSMDRVHANLQIYAIRDGVQTEVYGSSGMYRDACEFNFYFPPFTCRVPEEVLYFNFFARDNNDMALQRAGTMFCAAVHPTPPPDHQCQNGGVMNPSNTTCFCTPEFTGTYCQNIICYNGGTASGDHCVCPPGYAGESCEMARCIETGPNPEFIRYGVDMVFAVEITQNSIASLSMLNINFQEILRDVLMQNRGWIRNFVLVGFNSTWGGPIAESPADNLTAITTALRTLASSVPADTGCTVKLWDALNYAIFSRQMAPGSFVEIFQTTPEDDTDTRSLGLFYDMSRTMELVLYGFLTSNPRLQPEGFVCNATVENYYTLLGIVSGSTGTTYSLQANEISNAVRLIPLQFSNGQVTFNALDDCRHDDGLITYFPVDAYTQTIQIQTFGYGTTIQVYTGAGVMAEALELFYDDFTGQSVYEIRKACDEGWEPIGQYCIKFMATVENILPMPQAKAFCASAGGFLVDDLTDDKNGFLKSVAANTQFWTGLFKNNDGQFYWDRGTGINPDLLNQPITYWADGEPSDDPTRQCVYFNGRSGDANKVWTTDTCAEPRAFACQKHRYDADHRPNVIGDDDLPAGWWYAKVKSNPPSGYPNMCTMSVRVQSSLQIVTGFSTKIGNDFPLPDPIQDSTENRLISYVHSVDNENRVPILTDAILWDAYNGTFYNGLKYQVRFGCQFAWVTQDFPCPNGDSQANEFGVLHVGEDEFGNTFQRLTFGHCSRAQITCGNGGIRQNGQCVCTDYWTGSRCTVPICVNGGTRNPDEATCSCPDGYEGPNCQFEVCQPNVPQLFSNDRKSLLMVVETTRQNSDTVNQLIANLKNIVSAVTNNMPLWFTNFGLVTFDTTGRTFEKFDYTSIDDLITDLTTQSNAISTDGVCSMPYLGVLAHLLEHDDVIAMPNSEIFLVTPAGPSDLGNYVETMEVLFNTQAHLHYVVSKTANCATFDGVNNVRDMTWLGYGSSGNILFTDPANIVNLFNFYLPTLYGASVLQDPTGITNYTCSDGSLPWFVPVDINTTFIYVTTSAEFGSLSVKDPLGAAHSATPVYNVNDQKIYAIEVDRLGGIWTLQLVQPPGLCLAHVYSTGGAKVYTKFSMPNPIGGKPDPLGSHQDGRFVQPTAGFDNVAVFHLAGNPFHRGQLQYVEIFDIGANSITNILRSELYVRAGCSYEYYSDLFTCNGDMIAVYVHGVDEANQKFRRQEIVICNGRSPTTNQPATGTIGPITMPTQQTALTQGPVTQQTQVPGTQPTQGPVATTQNPYTSAQFDVVFMIDGSQSAQSSFDSLTKFVQTFMVSFNVGQSGARVGLIVVGGDITNPIPPAANLNSLSSQAMLNSNLAQLSGGYTDFEDAGQILNYTLQIVSSPDFMAANNGYRSGISNHVLIYLTTTTAFDTDPTPAAQTILAQKQYGIITIGYGGATDNNKLQTISGGSACSFTAPDFASLNNQIKTIQQLILNANANGGVYCINN

SEQ ID NO: 6738 - protein, 460 aa, Caenorhabditis elegans
MVNNRSVSYFIENVVKHVEFQREVISIHVGQAGVQMGNACWELYCLEHGIQPDGMINEEDSLGVDDDSFNTFFSETMAGKHVPRAIMVDLEPTPIDCIIILTILSTLSFIDEIRTGTYKTLFHPEQLLTGKEDAANNYARGHYTIGKEIIDVVMDRVRRLVENCRGLQGFLVFHSFGGGTGSGFTALLMERLSVDYGKKSKLEFCIYPAPQVSTSMVEPYNSILTTHTTLEHSDCSFMVDNEAIYDICRRNLDLARPTYTNLNRLIAQVISSVTASLRFDGALNVDLTEFQTNLVPYPRIHFPLTTYAPIISAEKAYHEQMTACCLLYRGDVVPKDVNAAIASVKTKRSIQFVDWCPTGFKVGINYQPPTVVPGADLSKLQRAVCMLSNTTAIAEAWARLDHKFDLMYAKRAFVHWYVGEGMEEGEFSEAREDLAALEKDYEEVGLDAGEPDEEDDYSHY

SEQ ID NO: 6739 - protein, 560 aa, Caenorhabditis elegans
MLFNAPPNIIYMLLCFLLMDISNTVLMLLFPTLADIINEMNNHTLSAHFGIEPTIANVNVMNSMITGASTVGLFVSLFVLVPFAETKGRKYTVVYFRFIISVVSSLCIIMSALFQASEFFILGSAVNGLQLPMRMFVTMLFITECAPDKYRGFASTALIFSDVIGQVIMYVVFYLFKQTCIHIYLYCLCIFLAFRLAENNDNRLTITNGYDVLQFSIATPNVLGRANTWVIFPLAVLMSSTVIFFMTLRLPESPKWLVRQNKIEEASRAIEFYHGENCCLNEVVSSYIKEKNLTQEDQISLRQALKVLCSVSLFLVLDSGVIQGVYTVLLHKTAGFTVQEALNVNLVLVIIFLPTRFVGTYIIDHLGRRPVMLIAGIIVYSKTWLMLSTQFIIYFVGPSVLTKWLYIGVECLSESSLATGVTSLGILFISELFPPSARTCVAQALILVTMTINLPIISIFPIVYSFFGPGFFIIHVFSQFFFGAYLYRHMPETRGRAVYDIIESLDQEVASRTASFLEETTPLVRKRSSTLAYKRNSILNTSRTRALTFDHNLIPSGEWN

SEQ ID NO: 6740 - protein, 310 aa, Caenorhabditis elegans
MNTQYAIGIDLGTTYCCVRVFMHGKVEIIANDQGNRTTPSYVAFTGTELLIGDAAKNQVTMNPHNTVFEVTRLIGRNFEDPTVQSDIKHWPFKVISAEGAKPKVQVEYRAENTIFTPEKISALVLLKMKETAEAFLGTTVKDAVVTVSAYLNDSQREATKDAGAIAGLNVLRIINEPTAAAIAYGFDKEVHDIVLVGGSTCIPKAQKLLSDLFSGKELNKSINPDEAVAYGAAVQAAILSGDKSEDAKDLLLDTSPLFTSPSEHKFHSQPLISVVLCRQAQLPRRCRLHTRPPCALFSPPWSSHQSCQCH

SEQ ID NO: 6741 - protein, 520 aa, Caenorhabditis elegans
MKFTVPRNILFMIFTFVLLDIVMQMQVLTFSALAELVNQMNNYTLSAHFGITPTETSVGVLNSIFAVTHETGNALAIIFLLPVADSRGRKFMAVYLRFALLFLTGFFHLLATSFQAAEAYTLGQLFLGIQSPLHLLITPMYILECAPDNCRGFASTALIFSFSIGKLLMFSAASPTFLGTIDSWFIIPLFEMVCSVMILCLMIHLPDSPKWLIQQNKVKKAEDSIKFYYGKHFLDEVVTSLIKEKNLTKDNRISLRQIWENDTLRESLKILFAVTVFLQFDTTTAQSVYTIDFHKTAGFTVQEALNINLILTTVLFPTKFIGTLFLDALGRRPAMGVAGVMKYSKSMLLLAFEILVFISGSSLITKIMYVAVELLTILVPVTGANSIRVLFVTELFPPSARTAVGQAMLFGSMAVNSPIVALYPIVNSIFPPIFFVPFVISQMIFGIYLYRHMPETRGRAVYDIIESLDRNVASRTASVTDENTPLFKDQTENRDGKWNSLLNTPRTRALTFEENSHSPN

SEQ ID NO: 6742 - protein, 791 aa, Caenorhabditis elegans
MFQENAVTNWECQIERFVMSKSRRLRVSTCKALDLNMLGKWFGNYSFEIRTTAHQESGSGAWCPKNQINSLSKEWLQISFSVDTVITSVETQGRFDDGRGMEYATAFKIQYWRPSLNAWASYKDDFELETIPANNDTEHAIRRHLDRAIIARRIRIVPVSNSTRTVCMRVEVFGCPFDDSLVFYNVDQGDLQSGISYHDFSYDGNLANSPHLTGGIGKLYDGEVGKNNVFVNHHKWVGWRRKRNGNVKLAFEFSELRNISGILIHTSNEFKKSAKAFSSATVLFSINGKDFSDTIVHFNNPEDTESEVPRWIRIPVNNRIAKVAKIRLNFGTDSDWLFISEVNFESNHTNIELLNDDVVIPDSVSYFSVTEHDDGTSMFAFIIFFFMFLIVAVIILTVLYRKREYRVKASSPSPNAKREILLTIDGNTIKHHVSPSTYQMARDNLQNALIEKMPMSPIISDYAEPDISVCSDVTANTPLLYGIDGPYDTQKRSNPLSSMVKYSDYGEVYCTTLPEIARDKLICVSRIGQGEFGEVDLCQLENRKVAVKKLHGISQADEFSFHREIRVLGSLKHPNVVEVVGVCTIQKPILCIMEYMENGDLKSYILKNPTIQTSQCISICTQLAAGLAYLESCNFVHRDIAARNCLVDGEGNVKIADFGMARSLYSQEYYKVEGKFVLPIRWMAWEALLLGKFSTASDVWGFGVTMWEIFSLCSEKPYSDMTDDDVVENLQSMSSTGSLKQVLSRPRMCPSKLYNEQILPCWNYESSRRPSFENVHLHLQSLVHTSPHIHF

SEQ ID NO: 6743 - protein, 617 aa, Caenorhabditis elegans
MLLGKFLLVASFILPIAYTWTGATIRNHPADVVAARNKITSRSVARSEPTNSYIRPCYFTNWAQYRQGRAKFVPEDYTPGLCTHILFAFGWMNADYTVRAYDPADLPNDWAGEGMYRRVNKLKVTDTQLKTLLSFGGWSFGTALFQGMAASSASRKVFIDSAITFVRTWGFDGIDIDWEYPSGATDMANYVALVKELKAACESEAGSTGKDRLLVTAAVAAGPATIDAGYDIPNLAPNFDFILLMSYDFFGAWASLVGFNSPLYATTELPAEWNGWNVDSSARYWNQKGMPKEKIIVGMPTYGRGWTLNNASAINPGTSGSPAKITQYVQEAGVGAYFEFCEMLANGATRYWDSQSQVPYLVQGNQWWSYDDEESFANKMAYVKREGYGGAFVWTLDFDDFNAGCSNSNGQLYPLISVIAKELGGVIIPKKGGVTTAPTTVATTVTTGRPPMTSAVTTTTAATTTTTRAATTTTASNTNVCSGKSDGFYPNSNNCGLFVLCLSSKSYSMSCPSGLQYSASLKYCTTSTASGCSVTTTRAPTTTTKSAPTVTTTTRAPTTTTPAFKCTKDGFFGVPSDCLKFIRCVNGISYNFECPNGLSFHADTMMCDRPDPSKCAK

SEQ ID NO: 6744 - protein, 1603 aa, Caenorhabditis elegans
MKSIIIASLVALAIAASPALDRTFSPKSEYVYKFDGLLLSGLPTASSDASQTLISCRTRLQAVDDRYIHLQLTDIQYSASHIPQSEQWPKIESLEQRELSDEFKELLELPFRAQIRNGLISEIQFSSEDAEWSKNAKRSILNLFSLRKSAPVDEMNQDQKDMESDKDSLFFNVHEKTMEGDCEVAYTIVQEGEKTIYTKSVNFDKCITRPETAYGLRFGSECKECEKEGQFVKPQTVYTYTFKNEKLQESEVHSVYTLNVNGQEVVKSETRAKVTFVEESKINREIKKVSGPKEEIVYSMENEKLIEQFYQQGDKAEVNPFKAIEMEQKVEQLQEIFRQIQEHEQNTPETVHLIARAVRMFRMCTIEELKKVHTTIYTKAEKKVQLVIETTLAVAGTKNTIQHLIHHFEKKSITPLRAAELLKSVQETLYPSEHIADLLIQLAQSPLSEKYEPLRQSAWLAAGSVVRGFASKTQDLPLIRPASRQTKEKYVRVFMQHFRNADSTYEKVLALKTLGNAGIDLSVYELVQIIQDPRQPLSIRTEAVDALRLLKDVMPRKIQKVLLPVYKNRQNKPELRMAALWRMMHTIPEEPVLAHIVSQMENESNQHVAAFTYNVLRQFYKSTNPCYQQLAVRCSKILLFTRYQPQEQMLSTYSQLPLFNSEWLSGVQFDFATIFEKNAFLPKEVQASFETVFGGNWNKYFAQVGFSQQNFEQVILKTLEKLSLYGKQSDELRSRRVQSGIQMLQEIVKKMNIRPRVQQTDSQNAHAVFYLRYKEMDYIVLPIDMETIDTLVEKYVRNGEFDIKSLLTFLTNDSKFELHRALFFYEAERRIPTTIGMPLTISGKMPTILSINGKVSIELEKLGARLVLDIVPTVATTHVTEMRFWYPVIEQGVKSLQSARLHTPLRFESTVELKKNTLEITHKFVVPENKKTTVSVHTRPVAFIRVPKNQDSEYVEAEEKTISHSQYQMSTEEIDRQYETFGLRINAQGNVLSQWTLPMVLMTEQDFEYTLENKNRPVEFTARVTIGNLEKTDLSEIKFDKIFEKEFDLENNESENRRQYFHKMIREIQSEQGFKNLITLKLEAPQQMYWNTELRTVCDKWIRMCKVEMDARRSPMEHENKEWTLRTELLAARPQMPSSLRQLREQPHREVQLAFNAKWGSSKKSEITVNAQLEQSTEQKKFIRNIEREYKGIPEYELLIKAARLNQVNVVSEYKLTPQSEYTFSRIFDLIKAYNFWTVSEKRVQNENRRVVLQLSVEPLSRQYMNMTIQTPEQEVELKNVRIPRVVLPTIARSAMFQQTWEKTGATCKVDQSEVSTFDNVIYRAPLTTCYSLVAKDCSEQPRFAVLAKKINKNSEELLVKVVRREEEIVVKKSDDKFLVKVDGKKVNPTELEQYNIEILGDNLIVIRLPQGEVRFDGYTVKTNMPSVASQNQLCGLCGNNDGERDNEFMTADNYETEDVEEFHRSYLLKNEECEVENDRISEKKNYRNKWNREEKKSDYESSSDYESNYDEKETEKELVKKTLIKEFSNRVCFSIEPVSECRRGLESEKTSNKKIRFTCMPRHSKNARRFLKEAREQTVAELVDFPVSFVESVKIPTACVAY

SEQ ID NO: 6745 - protein, 611 aa, Caenorhabditis elegans
MSEFSQTALFPSLPRTARGTAVVLGNTPAGDKIQYCNGTSVYTVPVGSLTDTEIYTEHSHQTTVAKTSPSGYYCASGDVHGNVRIWDTTQTTHILKTTIPVFSGPVKDISWDSESKRIAAVGEGRERFGHVFLFDTGTSNGNLTGQARAMNSVDFKPSRPFRIISGSDDNTVAIFEGPPFKFKSTFGEHTKFVHSVRYNPDGSLFASTGGDGTIVLYNGVDGTKTGVFEDDSLKNVAHSGSVFGLTWSPDGTKIASASADKTIKIWNVATLKVEKTIPVGTRIEDQQLGIIWTKQALVSISANGFINFVNPELGSIDQVRYGHNKAITALSSSADGKTLFSADAEGHINSWDISTGISNRVFPDVHATMITGIKTTSKGDLFTVSWDDHLKVVPAGGSGVDSSKAVANKLSSQPLGLAVSADGDIAVAACYKHIAIYSHGKLTEVPISYNSSCVALSNDKQFVAVGGQDSKVHVYKLSGASVSEVKTIVHPAEITSVAFSNNGAFLVATDQSRKVIPYSVANNFELAHTNSWTFHTAKVACVSWSPDNVRLATGSLDNSVIVWNMNKPSDHPIIIKGAHAMSSVNSVIWLNETTIVSAGQDSNIKFWNVPF

SEQ ID NO: 6746 - protein, 423 aa, Caenorhabditis elegans
MYYLGFYHTHTHTHTYINFDKIPNASNLAPVIIEHPIDVVVSRGSPATLNCGAKPSTAKITWYKDGQPVITNKEQVNSHRIVLDTGSLFLLKVNSGKNGKDSDAGAYYCVASNEHGEVKSNEGSLKLAMLREDFRVRPRTVQALGGEMAVLECSPPRGFPEPVVSWRKDDKELRIQDMPRYTLHSDGNLIIDPVDRSDSGTYQCVANNMVGERVSNPARLSVFEKPKFEQEPKDMTVDVGAAVLFDCRVTGDPQPQITWKRKNEPMPVTRAYIAKDNRGLRIERVQPSDEGEYVCYARNPAGTLEASAHLRVQAPPSFQTKPADQSVPAGGTATFECTLVGQPSPAYFWSKEGQQDLLFPSYVSADGRTKVSPTGTLTIEEVRQVDEGAYVCAGMNSAGSSLSKAALKATFETKGRVQKKKSK

SEQ ID NO: 6747 - protein, 518 aa, Caenorhabditis elegans
MPPDTRINKEIVRKKRPKTAASCVFINSLVHSSFQFPPPYSFIVLHMVSWIRKNLLLVLTVSSVVLGALCGFLLRGLQLSPQNIMYISFPGELLMHMLKMMILPLIMSSLISGLAQLDARQSGKLGSLAVTYYMFTTAVAVVTGIFLVLVIHPGDPTIKKEIGTGTEGKTVSTVDTLLDLLRNMFPENVVQATFQQVQTKYIKVRPKVVKNNDSATLAALNNGSLDYVKASVEYTSGMNVLGVIVFCIAIGISLSQLGQEAHVMVQFFVIMDKVIMKLVMTVMWYSPFGIFCLIMGKILEIHDLADTARMLAMYMVTVLSGLAIHSLISLPLIFFVTTKKNPYVFMRGLFQAWITALGTASSSATLPITFNCLEENLGVDRRVTRFVLPVGATINMDGTALYEAVAAIFIAQINGVHLSFGQVVTVSLTATLASIGAASVPSAGLVTMLLVLTAVGLPVKDVSLIVAVDWLLDRIRTSINVLGDAMGAGIVYHYSKADLDAHDRLAATTRSHSIGFVF

SEQ ID NO: 6748 - protein, 328 aa, Caenorhabditis elegans
MFILKVVYQKYLRSITNVYMIGLCLADFIYLADLILVAATSLNGKSWPFGPTICHLFHGTEATGKYASVLFVVLLAADRYIAMCKSDLCGRYRTYRTAIFLSGLAWIAAFICSLPLYVYADEIKVRMRPKNGTDSIENNHTLCIAHWPSPPHAQWYISVCSVMIFILPGLVIFYCYYHVFCKLREAAKGSRRLHRNKRSRSSYQRVTRSVQRVVLFHLLCWSPFWLFNLFSAIFRVRITTQLMRIIVNIIHLFPYVNCALNPVLYAYRAENFRTAFKSLLFWSRRLDCLKSSLPIKSTMEPASVYQPEEESPVDSTENLEMERYLKIN

SEQ ID NO: 6749 - protein, 342 aa, Caenorhabditis elegans
MSSAQFQTFDADLSLTSQTDCENSAREILTKLRPEWKSPEITFEYFSVGITNKIFSAGFGTEHVIFRVFGHNTNKVIDRENEVIAWKQLAEYGFAAPLYGKFNNGLICGFLEGKSLAIEQMRDSKFNMNIAKRIAQLHSSVPTNGKTPVFEKMRTFLQQLNPSFEKESQQNFFHENFPTDLGAEISKIEKMIVMLKEPIVFCHNDLLVHNIVYDSEKKSIEFIDYEYAFPNYALYDIANHFCEYAGVEGSPDYSKCLTKDEKWAFINDYLRFSNGKEHSDTRIATMFKNLLLFEAAAHLFWAVWALVQAQNSTIDFDYLTYAHARYQQYQKRLHKYISKIEH

SEQ ID NO: 6750 - protein, 203 aa, Caenorhabditis elegans
MEYKLQYFNMMGRAEPARLIFAYAGVQYTDERVEKSAWPEIKATTPHGKLPVLYVDGAKLAQSRVIERYLGKVFGLAGETDWETAKMDELVACVEDFLIEIQPWFKEQDNAKKVEIFKKLIESTIIPFISAFENILVTNGTGYFVGDKISYADLAIFHIFWFMNSKILPGALRKYPKLQEFIEKITAIDSIKSWINSRPKTEA

SEQ ID NO: 6751 - protein, 1130 aa, Caenorhabditis elegans
MSRSPRPHGTHEPAVGVTRPFVRQSHPEIAAWPAPPPAHQLGCLSGNVRTPVGGPAPPSPVLRRAPSGPISPSPISPVSQHSRASSRHDIDNTSLLSILKLSHVARESSRNTSRNNSPQPAGRETELKRKIQTLEETVAEYERQKYNVMGTFSEYRERVAERERKLEAEYSGKIIALSEEVLGAKKDFEARMKSFQALQDKFEREKEQALEKLRKEHQKEIQVLEQRFSDTQLLNLEQKYIIEIQRLEEERKSLRTEKERLGETFEMKLRRAQSLYETELTAAKMLYTKELEALRDHEEALKEELLARQDEFHDRLQELQLQSKRSREDLVSCKNDVTALEKKLHNKEKEVQTLTKELDQVKTETNDKIRRLTEVTSEFAEYRKKFQQQEEELRRKARLLTVVEAAKEKLESVISDLQVEVKALKNKVEFLEKERENLQSQSESQTQLQSSQVDALEAVLHSVTKEKETTKEHYEGLLLKERQQAESREHAMKKEFSCKLNELEEQYTSLKEELEESARLDKDELREASEIEIQALRTEKSILAAEIRVLTQKIEDEEQDDITEQLAKIVEDTSQLTRTLEEYRERITGKDAEILNLRKQLEKEISHTEDRNRLLHENTQKELEAHKETHTETVRVLEAEIDQFKSAFENEQEYGKEKSAKIRELEAQNKTLLSEMEKVKHVAENLEAFTSDKDNLLEELESKNKNIEHLKQEIAQLNEKISTKETEKDSELEKTIAQLEIDNSSKSDQIEKLHLRVNDMLDQMGTIKDELVKKNEEIKTISAKTAQLLESNTVESETKLASVTEEREKEIQSFQTQISEKDNEVLTKAERINELETCLKEREVELTGMRTKLDDMTQQLNEETTVVLFDNSIQEKIDEKEATINEMNERLKSRENEIAKLHEEMYMQKTQNEKRNEEQSKLFQELMFEKEQLEAEKAEQSHIEAEVEQVFQADKESKWKEQIEDLENALQRKNELIQQLQDRQTDESTSEPHTKKRMSITSHGVFQNFVSQMKDKREEASEKRTRKEAEKKAEKEKEKAEKAAKEAAKELAREKSPARAKSPSILTRLRDRSPAKSKSDNLESTPSSSSRNLLSPFDAEKRMERSSPSQQLFSRTKKDSSSEKRPAWKF

SEQ ID NO: 6752 - protein, 366 aa, Caenorhabditis elegans
MDFNFKKIASDAGGFFSRAKQLTEETFLKAERTELDSHFENLLQRADKTEDHTRRLLSAIEGYLQPNPTVRMEEVFYEKLELKKDGAIRQNNLEQLSTAMTEAGEQFGETTPYGSALLKVAQTENRLGQAERELCGQAATNTLLPIRRFLEGDMKTIQKERKVLNSKRLDLDACKSRLKKAKTVDLQTVTNSKTSGGFTIEQAEADVRVAQAEFDKQSEITKLLLEGIQTAHNNQLKCLRDFVEAQMSFYAQSHQLMADLQRELSGTMSFRGSSAILVNNSGDPPNGRTMAAAIAAAKPSGLLPDDLGTKQAKVIMDYDAVLPQEISVTQNDILIVYRLPGMDAEYVMAEKGGKRGKLPVSYIELL

SEQ ID NO: 6753 - protein, 371 aa, Caenorhabditis elegans
MSSSTSSVESVEDESCSNECSASFTFDTNNNSRGNNQVNELAEETHMKLSITPTRESFSLSQLERIITIGKGTFGRVELARDKITGAHYALKVLNIRRVVDMRQTQHVHNEKRVLLQLKHPFIVKMYASEKDSNHLYMIMEFVPGGEMFSYLRASRSFSNSMARFYASEIVCALEYIHSLGIVYRDLKPENLMLSKEGHIKMADFGFAKELRDRTYTICGTPDYLAPESLARTGHNKGVDWWALGILIYEMMVGKPPFRGKTTSEIYDAIIEHKLKFPRSFNLAAKDLVKKLLEVDRTQRIGCMKNGTQDVKDHKWFEKVNWDDTLHLRVEPPIVPTLYHPGDTGNFDDYEEDTTGGPLCSQRDRDLFAEW

SEQ ID NO: 6754 - protein, 548 aa, Caenorhabditis elegans
MFISKEEMNRTFGVKAELNYIEMGNVSSYSTKFHYRVMANIDYLSFTWNAVGIGIHFAKHFSNDNLLFLTDFTVEYRCAGHRSGQFAVSLYFTFKYGNKEPLKVKLRQEKICASRDGRRGLNGGYEGHEVDDTDSIDKAFFVIICIAAAFLLIVAATLICYFKRSKKEDMIPTRLPTSFRNSLKSTKSAQPFLLSTPRDGPPTLSAISSAPCSSSSASGNSIIPSKPRNIDVRRALLQLYQDRDAFQSLPLDMEGTFGEVRYAIWRQVDDVLNGDVDDEEDTFCNQEAVYTKTLKNNASPIQLDRFLSDALLFYNITPHQNLSQVACVASFGRFDRPETVTDFPLVCYRHQGFGNLKKFLTICRHGDKTKGAQTLRTHQLVSLATQVSSAVAHIHKYRIVHNDIAARNCLIAEVNGRLQVQLCDSALSRDLFPADYHCLGDNENRPLKWMSPEAIANELYSSAADVWSLGVLLWELMSLGGSPHAEIDPEEVYTMILKGKRLQQPNNCPDQLYEVMLCCWRVLSEDRPSSEQVVHGLRDFNIQLSQYI

SEQ ID NO: 6755 - protein, 336 aa, Caenorhabditis elegans
MKVFLQQILNLDGQNQIIEVNAWLKYVWMDYRLQWDPLQYDNITSIRFAGGENQIWRPDILLYNSASEDFDSSFKSNEVVYNTGEVNWIPPGIFRASCKMDITYFPFDDQVCYLKFGSWTYHGLALDLSIIAEEDDSELSIDLSTYTPSGEWHLTKAPAVKDVKYNSCCKEPYSTVTFYMFLRRRTLFYLFNIILPSLLISIMTLMGFCLPAHDMSEKIGYQTTILLSICFFVTIVSEMTPPTSESVPLLGMFFSSLTLISSVSTAFTITVLNFRYRQVQNIHMHPIFYKVFLIWIPWLLLMKRPGVFYKKRRATVQAREEISFFDNGDDDVCILK

SEQ ID NO: 6756 - protein, 491 aa, Caenorhabditis elegans
MAAVDVNQPITGHKSAIIRNYNTNPRLIYQTVCGVNGPLVILNDVKFPQFSEIVKITLPDGSKRSGQVLEISKNKAVVQVFEGTSGIDAKNTICEFTGDILRTPVSEDMLGRIFNGSGKPIDKGPPVLAEDFLDINGQPINPWSRIYPEEMIQTGISAIDVMNSIARGQKIPIFSASGLPHNEIAAQIVRQGGLVQLPDRPHEQTNFAIVFAAMGVNMETARFFKQDFEENGSMENVCLFLNLANDPTIERIITPRIALTSAEFLAYQCKKHVLVVLTDMSSYAEALREVSAAREEVPGRRGFPGYMYTDLATIYERAGRVEGRDGSITQIPILTMPNDDITHPIPDLTGYITEGQIYVDRQLHNRLIYPPINVLPSLSRLMKSAIGEGMTREDHSDVSNQLYACYAIGKDVQAMKAVVGEEALSSDDLLYLEFLTKFEKNFITQGHYENRSVFESLDIGWQLLRIFPREMLKRIPESTLEKYYPRGGAKE

SEQ ID NO: 6757 - protein, 196 aa, Caenorhabditis elegans
MFLKVMLLGDSCTGKTCLLIRYKDGAFLNNNFISTVGIDYRNKLITMGDKKVKLQIWDTAGQERFRSVTTSYYRDADALLLVYDIANRASFENCRNWLSQIKEYGKEAVQVTLVGNKCDLPRAVPTDEGKRLAEAYQIPFMETSAKTGFNVDRAFLGLAERMLKLKYGFVPGGEMADTISVADTKKPEIARCCTFN

SEQ ID NO: 6758 - protein, 638 aa, Caenorhabditis elegans
MEIQNPFQISWDKTAAQSFHDYFFSKISAHGSNLAIVDVDSGKQWRYSEIRNWCEMCATRLKELQVTSGSRVAVITGTTGQAIFVHLACSIIGCSAVAVNGWNAVDEIWTLVDLSEATHLIVENQFMQKADDVRRKAQMRGGGRIKHVRQIEDVLTAERINVDSARKRSIDVKQKPPLVKEMSLAKINLTPVLPEDIADLTSPVSEVSGQSKELNGDVESSVVDSEEVQTPIQQVSGQNPLLILFTSGTTGLAKAAELSHRSLIINIQQISLPLYGPVQTKERFLLPLSIAHIYGIVSAYYALINGASLYLISKQSNRLFMETLVNNQINVMHITPAIVHWMATDAIVDDYKTPNLRSVLCAGAPIDSNSAAAMKSRLNIKDFRQSFGMTELGGICTMSPYLDEKIESVGNPLPGMLFKVVNWETKQLCLPRQPGQIIVLGPQVSPCYYKNPKATSELFDATGFVKTGDAGFYDEVGRIYVLDRIKDIIKCKGTMICPSEVELVLRAHAGIDDCAVVGRQDHVTGEVPAAFVVKNAQHPLLASAEVRQYVSGKIATFKELRGGVFFISEIPRSVCGKILRRNLRQFWDRERTNSKVDSLTNKDGAKTAGAAKGAPAKKVNGSTTPSRRPPSAGRPVKK

SEQ ID NO: 6759 - protein, 376 aa, Caenorhabditis elegans
MQLIFFRGMKELLSTMDLDTDANTIPELKERAHMLCARFLGGAWKTVPLEHLRISRIKGGMSNMLFLCRLSEVYPPIRNEPNKVLLRVYFNPETESHLVAESVIFTLLSERHLGPKLYGIFSGGRLEEYIPSRPLSCHEISLAHMSTKIAKRVAKVHQLEVPIWKEPDYLCEALQRWLKQLTGTVDAEHRFDLPEECGVSSVNCLDLARELEFLRAHISLSKSPVTFCHNDLQEGNILLPKASSGNIRMPSLSDETQALGNSLSAFNPADPRLVLIDFEYASYNYRAFDFANHFIEWTIDYDIDEAPFYKIQTENFPENDQMLEFFLNYLREQGNTRENELYKKSEDLVQETLPFVPVSHFFWGLRERSSVAVLQT

SEQ ID NO: 6760 - protein, 476 aa, Caenorhabditis elegans
MSPRIRKGKKKERRMEIFGNFSSVQSEGRREEFLFTLNSLLLYFCKNFFRNVLNNFIRESQTNFSYFYSLYTMGSYISSPQVLTRQVSGQFQVGCKDLMIDGTVLGDRGLFMRLYFPTDSQAADISSYPLWLPKPQYAHGLGEYLGQSSQKMNVITSTVVGEKREDCIENAQMSTKCDKWPIVVFSHGLGGSRTFYSTYCTSLASHGYVVAAVEHKWGKSGGRCDHVAFSCRDHSACWTYQLTEKNGELVEQPIKIKLIEKNEKNEFKIRNQQVGKRVTECVKALNVLEQLNLGTVPEKVLIGNDYNWAQFKNKLVMSSASVIGHSFGGATSLASSAYTTDFQKAIVFDGWMYPLDSTQQEQAKQPTLFLNVGDWQWNENLDVMKKIISHNDGNLALTLNGAVHQCFSDFPFIFPSWLAKKFGVQGRTEPSLCMQAAIELSLAFLENGKDGAQKLKDEKFSSFISNEIYGREKYKL

SEQ ID NO: 6761 - protein, 1257 aa, Caenorhabditis elegans
MKIDDDIIRKEALHYRDQDMKNREMYLKENLHTFPEERQTKAKIEYLGLSLLDFQTELRKKVLATTVLVPPNDFLINPWSIRRTKYEYLQELKRHPDRAILEKRRKVTNFHFLQSLTKHAREFKEFHKRNMLNHTKVRKSMQQYITNENKRIAREEMKNEKNRIQKLIQEDEEGYRAMLDEKKDQRLVYLLEQTDDYIKSLCDLLKQQQNATAGSLATKSYIRKEYDGVAEEDKVKSILDKARNDDDEYENKTKMNIEDYYTTAHGVREEIKEQHFMMGGGNPSLKLKPYQIKGLEWMVSLFNNNLNGILADEMGLGKTIQTIAFITYLMEIKKTSGPFLVIVPLSTVPNWQNEFDKWAANVHLIAYKGPKETRKVFEPIIKSGKFNVLLTTFEYVIREKALLGKLRWKYMIIDEGHRLKNQHCKLTEMLNTRFQCQRRLLITGTPLQNKLPELWALLNFLLPSIFSSCSTFEQWFNAPFATTGEKVELTQEETMLIIRRLHKVLRPFLLRRLKKEVESELPDKMEFVVRCDMSALQKVLYKHMQKGLLLDGKTNTGSKSLRNTMIHLRKLCNHPFLFENVEESCRNFWDARFISAVDLYRVSGKLELLSRILPKLQATGHRVLMFFQMTSMMTIVEDFLAGGTIQYLRLDGSTKPDERGALLDKFNAPNSEYFLFMLSTRAGGLGLNLQTADTVIIFDSDWNPHQDMQAQDRAHRIGQKAEVRVFRLITANSVEEKILAAARYKLNVDEKVIQAGKFDNRSTGAERREILENIIKTENESEEDEEVPNDEDINDILSRSEEEFELFQKMDQERFENEQAQKAKPRLVGEDEIPRDILRAADETDYIEKAKEEGRVPYLEVMPGSRRTRREVDYSADTMSDDKFLEKLFDEDDTTSARTEEEPNPAQPGPSSVSISLESSCDTQKDIKVDDVPAPPLTFKVPRLTIKLGGDEKKRKHNRSESDSDDNSLKKEKKHRKEDHPKEKEKEKKKEKEQEKSTDSEKDLKRKIEAPIEKIRIKFSGEPSEKYRKINEEPPKKEHRDKGRKEEKSHKHRSDDDDSSPKKKKHRDSDESSEKKKKKHKHDSDSALKLREGSPLSVDKEKSPMKIRIGQGQPSISLAANEDKNHPPIKLKLNVKFNMPSQETDGSKKDKKEPHKEKEKDKEKEKEEDKGKEKEKHKDKDKDKEHKKKSREDETEEERRARKEAKRLKRQKEEQEDDAKLQEKLARKAAKKEQKRLEKEKSESSTGTVNLSAAGSA

SEQ ID NO: 6762 - protein, 419 aa, Caenorhabditis elegans
MNESEIAAAVAAMELEDELLQPEWAYLVSLAMADLIVGAFVMPFSIYLSVNRLHWHLPLFVCYFYCVLDVAASTSSIIHLVLISIDRLVAATKPAEYKTVKHRKRVYLAIAITWIFSIALSLPLGTGFNTRTSYFLVIEHHCGIYNPIYMLGSSIFAFYLPCLIMIFTYGYIFYTLRKRLRAIQLQEMAGGQFLGFGADVSNITTSAIQSVIGIAPKNRNMITWEKPLLKKIEETAAEHASSLNDSEREQDWALDLLAKLKSKQGMAIRRETRATKLVATVMVVFLVCWLPFFTLNMIKIYKLIFNVWSADLEIWFHWFTALGYLNSSLNFFIYSTINPVSIFISNLISKKIIFLIFQVQFALYKTLIHGIETRNSVIHSAAYLASVDLLDVREKNRGCYRHEIAAEVLQNVDAVSIKS

SEQ ID NO: 6763 - protein, 420 aa, Caenorhabditis elegans
MYHDDGMLLNSMNDLQWPLLGLFSVLIILALFGNLLVCAAILWDRSLRKQPENLFLVSLAVSDLLVSVLVMLFAAVNDILGYWPFGQFYCQFWISFDITTCTASILNLCAISLDRYWHISRPMVYIRYCNRRRINYVIVLVWLISAGIGAAPLGFGFGSKVTINNLTGLPVCEMRLPLPYAIGSSMVSFFLPAMVMVILYTKLYLYARKHVRSIKTQLQQATSFLIMQLASEKIREVIIYFHFLDAPSRIVFQQFSMFAFYIFLPRSESTVRQTRIVSKSKASFFSLTLGVIMGTFLVCWLPFFTVNILRAWLPEIFSSKTIMAVTWLGYANSSANPLIYSIFNRDFRRAFKKIIVRVFGCCWEEPDLNKSISSRYAAPDNIERRRSCTRSSESAHDNNNDANATRLNLLSNNNEETIPE

SEQ ID NO: 6764 - protein, 425 aa, Caenorhabditis elegans
MTHDNEYQSALVFDRIRRLILNNSNTPITTKELIKHCFHPDVQFLAHMTLKSLDHPGEQFNNSSNQLLLDRAFLNPILTLIFVFVGLVGLIGNLLTVIVIFKTNSLHSHTNYFLANLATSDFCLIVVGVSFDLVNIWNDEEPLDIFGYCSLTSTFISLFTFASILTIVLLTAERFTAICYPFSHRTIFDEKRVKRFILLIWFVALLPSIFIGSMFKRVSQDFCGFNRQMTYIGRCDLVTSPDSFFRYPFESAITITFVLPLFFIIYCYFRILVTLNEMSNSTHVHTPVGTARSDSGAFPFPHTSNNSNTQSFPLTVHTKNVQPPRSQQAQKMVIKMLVTVTAVFFVCYLPYHAQRLIVKYNSKDCSNSDFCKLLYPIAGILQYISASLNPIFYNLMSVRFRNGFKKLIKDVWAHRARSYSNLARV

SEQ ID NO: 6765 - protein, 191 aa, Caenorhabditis elegans
MSDHENTGENTSEYQYKQPPQKSIDELLNADKEDESLKVYKAKLLGQGTVIVDEKNPLRVIVRSVELLINGKTAQSFDLSDPAKLVNSDLSVSIKEGSNYRLSFAFHVQREITSGLHYKHKVKRSGITVENEKYMMGSYAPKLEIQEYKSPNEEAPSGMMHRGKYKVYSKITDDDNNVYLDWQWTLHITKE

SEQ ID NO: 6766 - protein, 730 aa, Caenorhabditis elegans
MFTGTIFNSLFTLPLVISQFVPPPTRPVDLWDPFKTTTTPFPHGGVNQGLNRDEVVVRLPLGDIVGKEVHLHNLPWTIHKDPTEELPKDGTHFDPNPLKPKNNITVFTFLGVPYAEPPTSQRRFKPPQQLTVFPGKQPYLAFNYAASCAQDVEKSPSPFVDHPYPFMVDEDCLYLNIFSPDISKNAQTTYPVIVFFHGGNFQTGSANEWPAHGLASRGMVVVTVNYRLGAFGFMSMGDSETGNYGLQDQRLALEFVKNNIVTFGGDPQAVTVVGHDAGAASIGFHMQSPYSRHLFRSAATMSGAEVSYHSYIGKTALAFNNTMKLGRYAGCTQAVAQHRWDCILTRSTGDIIDATRNIPIEYNRYLFMPTVDGKYLPGNPLWTLVNAPSGETSIMSPVPMLIGMNAQDGSEVVLEDRRLGEFSQFNDVDHEYLKSYSLEYCYRHNYSMNREATADAILSKYTFWPDRAAAWAIKENFIQFATDAYYTAPMQLSSHLHSSSGSRVFQYVNNYNFSRQHPNLLFIPDWMGVCRDCDLYLMFGYPFLPDELRPIGLRGINFTDTDRNASRTFSNIIRRFSYHQNPNFQFDGSWAAYEPRRHWYINFNYTHEEDWKIPGTLARDYRYQDVAFWNEYIPALVNYMTTTFSPENVAYRREIMVFKWITGVNVIIIALLIVLAGAFGYMVWGNKEDEEAAYKAENHQLVEYRDTGHSVSDATISSRTRSPRSRITNL

SEQ ID NO: 6767 - protein, 536 aa, Caenorhabditis elegans
MGPIFDRANTWGGGPTHPSNGPNTFTLCEGFFVCVSENKFFPLPPTTPFPTNAVAATDEDGEELCTSDKTIIEKLLNNYKSFRTPSESGVIVWIEVWVQEVNSVNEITSDFDMDIYVTELWMDSALRYEHLNPCKYNLSLNSEILDQIWKPNTVFINSKSANIHKSPFKNVFLMIYPNGTVWVNYRVQVKGPCSMDFSAFPMDQQSCHLTLESFSYNNQEVDMQWMNWTTPLSLLKKEIVLPDFVMSNYSTSLKHEIYPAGVWNELTMTFVFSRRYGWYYTNMLLFFKHASPFSWISFCLGPKMIPARTMLGVNSLLALTFQFGNIMRNLPRVSYVKALDVWMLVCLTFVFCSLLELAIIGSMGARSENRQAQQQKQQDEEATKHQKGRENSTCSHLMSPSSCPNSPRICRNHIPNDVPQSFKSYGSTGINEGKMENTLISGNGCYPRMRKRLIIASSSTISHAPNANRSEKVLLLDGLEETQFSQVETKFSSMASIKMKKHWTTEEIDRLSMIMFPGLFTLFNIIYWTYYLTVNT

SEQ ID NO: 6768 - protein, 919 aa, Caenorhabditis elegans
MNLQVIFLFLGLLVIYSSQDCAWNTCHKVDQDPNVITAHLIPHTHDDLAKPELVPVGVQYIYNTVIDELLKNPDRRFSFAETGFLWRWYTSNSDFDRHQLQKLVKNGQIEIIGGGWVQNDEATSHYVDIIDQMTLGLQRLEQIFGECGKPVTGWQIDPFGHSREMANIYREVFDFSSSMSFYSYNKLFTGAFFNDNYGPPEGFCWDSLCGDDPIMDNLNIEGYNVKEKVDAFVDHVKNQAAHQSTNQVMLLMGSDFQYTNANSWYVNLDKLIKYVNADTSKKVRVIYSTPACYTKAVQAKTPTLSVKHDDFFPYASGRHSYWTGYFTSRPAFKGMIRQASCMLQLAKQLDVIANLGPEDDSDIEILREASALVQHHDAVTGTAKENVTRDYEKQLAKGVSEVEVVINDFMKKMNPDGLDPKLVLCPLINETICKPINGSSEFSVVIFNSNGRYFNGTIRIPYSQKTAVLRDAHKNVLESQIVETFQIDQLKDTDRLPYEIHVFVRVPPLGYTTVFVEKGSKPERVHFNNRKKFNTNVEIQNEYLIAGFDSQGYLSYITEKATKKKRSIRQEFFYYEGIDSKDDQPSGAYIFRPKTQQPIALTSKLALEVVPGAIINEVRQKVSPFVSQQIRLPRGKNYIEFEWIVGPIPKETKNPITKEFVTRYTTEVHSKNQSFTDSNGRQAMERFFDGATSFEYSDTEPIAGNYYPITSFGYIKDENAQFSVITDRAQGMVASDGVVEIMLHRRCFYDDHFGVEEALDEPGKDGAGLVAMGKHIVLFTDVKASTSQLRPLAIDNFHQPVLAFNKNPEKFEFNRLLEYSGLKFELPIGIHLLTLEKWHKKSSLIRFENIYHGEEGNSIKEFDPTHIFTNFDIVSFKELLLGANRVVGKNKESGSSFRSFEKSKILTFEIEVERKMSKL

SEQ ID NO: 6769 - protein, 457 aa, Caenorhabditis elegans
MEVENFTDCQVYWKVYPDPSQSIYAIVPFLTVYLFLFFLGLFGNVTLIYVTCSHKALLSVQNIFILNLAASDCMMCILSLPITPITNVYKNWYFGNLLCHLIPCIQGISIFVCTFSLGAIALDRYILVVRPHSTPLSQRGAFLTTVLLWILSFVVTLPYAFNMQMIEYTEERICGYFCTEKWESAKSRRAYTMIVMLAQFVVPFAVMAFCYANIVSVLSKRAQTKIRKMVERTSALESSCAFPSHGLEQYENELNEFLDKQEKEKQRVVLQNRRTTSILVTMVVWFGITWLPHNVISLIIEYDDTQSFFRLYGRDDYDISYLLNLFTHSIAMSNNVLNPVLYAWLNPSFRQLVIKTYFGDRRKSDRIINQTSVYKTKIVHDTKHLNGRAKIGGGGSHEALKERELNSCSENLSYHVNGHTRTPTPEVQLNEVSSPEISKLVAEPEELIEFSVNDTLV

SEQ ID NO: 6770 - protein, 239 aa, Caenorhabditis elegans
MLKVHVKESELKMIKELNSEYLVGVLDICNFDDFFCCLIMELCDCDLDHHMRNISVKGRLNPSNFRLLLDNIARGYKALYELKIVHRDIKPQNILITYTDASKQIACARITDFGISRTLDNEGEELCNVAGTFYYMAPEVGANLLKTCQYDSKVDMWSIGCLLYQCVTGEVPFDECSLCKLFLYVAGANFDAYDPPELPDELSQEVSGIIQSLLQLDTTQRCTPTQFYDKAINWSQQIC

SEQ ID NO: 6771 - protein, 808 aa, Caenorhabditis elegans
MILQKLVFLPCQLKKISYTFRRIFDRKQTTAPHWHHLSARESNFEEDDQDIGSLNDGQLTNYSSQYSINMGVQQVEPLLVPQAPDGGYGWVIVFAAFMSNLVVDGISTAFSEFKQSYKERYQESDGLTVFIGSLIIGTYLLVGPLVSALCNKYEQRYVVMAGGLISGIAFMIAPASPNIYVFMLIYGVMGGLGFGMIYLPAIVVVGFYFDSKRAMATGISVAGSGVGTFLVPLICQVCIANLGWQKTIWVLAVMIFSCVFYGYLYRPLPMVDLNEIRDQEMEPLRQALSKVEDDEDEAVESPHPNRSTSAASGAIEDEAVSQNPEVQRLRSILTEGDEGSETPKSDAHKVRSHTATRSRKHTMTSNSGSQHDLKLSRGNLSSDNRLSRVSARDFNQSLSKLSKSGGASNLSIAMSGVDPKEFQRPMNRQDIFYGGSIQNLKEFKEEGTMAGYRASTLSIPRSVVGQAVSQLNLSRTGSRLGGPGIAEDEEEMIEPFVDDGCCKVLPLPMRNALSEMIDLNLLKNKTMMILCISNLLGMMGFYIPIMFLKDLSESMKLDMSLAMFLVPIFGVFNTIGRVFFGWLTDQKILSALTINNLSLIVSGLLTLACPLLTSIAGQYFYAIVFGFIICKLFYYFQHLEFAAYICLTSIVLADLMGLENLTNSFGLLVVARGIASLVGPPFAGIVYDITGSYDTAFYFGGLVLLVAGLISATIPFVTKKDADTADGMPQLQDQDNVSGKLSVLTERSEEALTDYQRTIQSMKQQHQLLQDLEEEKRKQKQNGVVEEGNEMDDNVCSSNNDNDKLMFY

SEQ ID NO: 6772 - protein, 592 aa, Caenorhabditis elegans
MAIWWWFEILSAKSDFESIMAWSVFIYIQAALGGSLWTSISTPEGSVSLPSSTTATITSTTVTPVWVASKNSIPFADTLGSNSPLSEYLPVKLCLGIHDVFIALFLVMLILLTIFGNILVVLSVVVYKRMRTFTNILLTSLATADLLVGLIVMPMSLLDLLHNHRWPLGRFLCRMWATSDVLLCTASILNLCVISLDRYFAITSPLKYPRTRSRKMAAGLLTAVWAISFVVCSPPWVIPSWNLFIDNNNNTGSSEDFKCAYSPSVAYRIYSALGSFYLPLLVMLFVYFKIFRVASEREALMRQSVGTCRLSNRLTKTQQKNQRNNLRTASAPHSRTRVQVNHNCGRVNYSVRPVEYANRVENSLKPSHERFDSTDCEDSPPNGDSLEAGTTCNISMSLVTNSPPNGLQKEAKNSMERECHSLADIVNSADTPVRKNTEVGVAPSLSKRARQCNARLQPNNLLQKAHEHYQINGPGKAVRGSKEKMVYMRERKALKTIGIVVLGFIICWMPFFIMYLVEVFISDPVAESPIYRITSEFFLWLGYSNSVLNPIIYTMYNGDFRRCFRDLLSFGCVQHHRRTMSVKKLHQQSTIF

SEQ ID NO: 6773 - protein, 314 aa, Caenorhabditis elegans
MKVLLFVGLLAATALASHHSSDPSKDGEHFKGKEHDKKYDHEQFLGKDTAAEFDELTPEKSKEKLAKLVPKMDADSDGFIEENELKDHINFMQKRYVNNDVDRTWKNYKAEKIVDGKIKWEDYREMVYGSADGAGQELSPEYAKMIARDEKRWAVADYDSNGALDRTEYGCFMHPEDCDHMRDVVVAETVDDIDKNKDGSVDLDEYIGDMYRPDDYPELNGKEPDWVQSEREMFKEHRDKDGDGKLNQEEMRDWIMPVGFDHAEAEARHLVGIADDNKDGKLNLDEIVAHYDTFVGSQATDYGEQLQKHDPAEL

SEQ ID NO: 6774 - protein, 2288 aa, Caenorhabditis elegans
MSTHDDTRSSGGGDGTIHIPSADAKEPTPESPGSRSNYGEFYWDTSGENNYHHTSSFDDDLLLEIDSSRGAAVARLDRTQDDLNKFRQRIDNNVEQQREYSEMMAALQNKVHEYRKHIAELEGRMVGARNRMLDDPTSNVMIFDNYDPGNTYITNHNVELWSPARGKRETILGGGGAPGLTTVNVHAGAGYSGSGVAGYGGGVQAMVGDPNANYEMIARLDEERRRSDEYRMQWENERQKSLSLEDENDRLRREFERYANDSKDKEKTFINRERNLAQYLSDEQRKMLDLWTELQRVRKQFSDLKTHTEEDLDKQKAEFTRAIRNVNNISRNAAFSAGAGDGLGLYGLEDGGDVNRTTNNYEKVFIETIKRMNGTGGAGSASSADLLEELRKIRGGGSSEGDAELHKELMTKYEESIERNIELESRGDDSQRKIAELEAELRRNREKLNEAQGALKKLHEMAQDSEKNVDGTVSIKRTRSLSPGKTPLPPSEALRAVRNTFRNKDNDIQQLERKLKIAESQVKEFLNKFENADEARRRLDKQFADAKREISNLQKSVDEAERNSRRTDDKLRASEAERVAAEKARKFLEDELAKLQASFQKSSTDDARKLRDEMDEHTNSIQEEFKTRIDELNRRVENLLRENNRLKSEVNPLKDKYRDLENEYNSTQRRIEEKETQIRYSDDIRRNIQKDLDDLREKYDRVHTDNEKILGELEHAQKAAHLAEQQLKEIKIQRDDYQKQKDEHARHLFDIRHKLETEIKGRQDLEKNGARNNDELDKLRQTISDYESQINLLRRHNDELDTTIKGHQGKITHLENELHSRSGEIEKLNDLNQRLQKEKQDILNQKLKLDGDVQALKETIRKLENELEKLRNENKELVGKEARARDAANQQLSRANLLNKELEDTKQDLKHSTDVNKQLEQDIRDLKERLANIGKGGRISRDSTTGTDGGAFGDRSSVADPSRTRGAAGSTVFVPAAEDIESRGGGEIDIPSSGDVIHGRDGRDGRDAGNRGTHTITNTKERIERIEKNILDRYHDDELVEHKIREVNDRWKRELERLENEKDDLERRIRELEDELSQIGRGNDKTENDITELKRKHAAEIDKLKSDISALHDKHLSDLDDEKEQYGKAVENLKSVEDDLRDKLNNLEKQLADSLNRENELEREKRDYDEKINSLYGQNQKIKDEWDDFRNDADKEIQKWKTDAYTVRSEAKALETTNTALKAQLQAANDRIDHLTKTVNDHTSKVRDLTSQVRHLEDELADTKGNLVQKEMDLESTQNRLRSLEDQHSTLQSDANKWRGELDAALRENDILKSNNTNMETDLTRLKNRLKSAEDALKELKNSLSHAKTEKERLQNAFREKTKQADHLNQLASQFDTKLTKLRNELQDTNDKLITSDTERNALRNELQKLSQELKFGNEQIQRKSDEYQTTIDDLAHSHRVSEDSRLNALQELEARKYEINDLTSRLDSTEQRLATLQQDYIKADSERDILSDALRRFQSSANRVINFHTFVDGGAGYVDGVPGGTSVIGGGPSAQRSGAYDPSSGGVIGSGISGGPGGSDFGREIEIGRGDSDQSDVAYPRSVPFPPSADFSSGRPGAASAGGRVINNLDGTTTVNMNGGFDIANLEGTLQSLLNKIEKLEMERNELRDTLARMKKKTTETHTTINQKETRYRNIEDNLQDAEEERRALESRLQSAKTLLRSQEEALKQRDEERRQMKSKMVAAELQARGKEAQLRHLNEQLKNLRTDLDNAHTDIRSLRDKEEQWDSSRFQLETKMRESDSDTNKYQLQIASFESERQILTEKIKELDGALRLSDSKVQDMKDDTDKLRRDLTKAESVENELRKTIDIQSKTSHEYQLLKDQLLNTQNELNGANNRKQQLENELLNVRSEVRDYKQRVHDVNNRVSELQRQLQDANTEKNRVEDRFLSVEKVVNTMRTTETDLRQQLETAKNEKRVATKELEDLKRRLAQLENERRNSSQLSDGWKKEKITLLKKIELLENEKRRTDAAIRETALQREAIEKSLNAMERENKELYKNCAQLQQQIAQLEMENGNRILELTNKQREEQERQLIRMRQEKGQIEKVIENRERTHRNRIKQLEDQIAILRDQLDGERRRRREYVDRSMVNDIGRLGSNVLGIRNSYGDNSIDAIINGGSRSVGFYPRSTFASNPLTPPLGSSTPTHRPHVTDFRSAVDAGSSYRRPISTIEDSGSVYGGSIRDRDSVYGGGGRDSSFGTRAGDSISRAGVEPRDPSLVEIPSNEPPMTTSTHSQGGSRYDTLAPNRDDL

SEQ ID NO: 6775 - protein, 374 aa, Caenorhabditis elegans
MGHYVIVGGGGFLGAHVISALQKIGCKERIIVVDPCPQEFKTIKIDKSNISYIKASFLDDKVLENILNGASAVVHLAAVGHTGLIAGDRKSVHNFNVNGTKQLIKQCKALGVKRFLYASSVAVSFIGEPLDNVTEDDPLPDPKKYLDFYSASKAEAETYVLSQSTPDFKTVCLRFRGIYGPEDPNVTLKVANLIKNGLFIGMVSAHGRESVSCASSGVNCAKAFALADQMLQNPDGLHGRAYYILDGENVGQFQFWTPLVLALGKQPPSFYTPYDFIKAVVPYFQNVCYGVFKLPPLLTKFELSILAVDNTYSIERARRELGYEPEPCVMTDVAKYYQDLEENEVATATTEWKSAISILIVFISIAFLFLFNLN

SEQ ID NO: 6776 - protein, 150 aa, Caenorhabditis elegans
MGACCSSKKKNQGEVGEIREDDLKGIFREFDLNGDGYIQREELRAVMQKMGQSPTEDELDAMFQAADKDCDGNIDFQEFLVIAKANPLSLSLKAVFEELDVDGDGYITRSELRTAFQRMGHSLSDQDIKAIYRHVDQNNDGKINFQGEQF

SEQ ID NO: 6777 - protein, 907 aa, Caenorhabditis elegans
MKFHILLLLLVGACLPVFTQEIKPKPELLPADEAPKDPEAVFSEGEPFELTDALDTPKNGSVPVPEPEPKPEPEPEPEPKPEPEPSPTPEPEPAIKFDNIESEDYGDVAETAASTQPDELNTEVIEQLVDTFLNTGSIASNKTNKGPVFANPVAQALVNSSNYWKTDNLQAPGSIKDEEKLRSWLAGYEAEAIKVLREVALSGWRYFNDASPSLKLALDEAENVLTMFVRSTSMQAKQFDMASVTDEKVMRQLGYVSFEGMSALAPSRFADYSQAQAALNRDSKDSTICDKDVPPPCALQKIDMDSIFRNEKDASRLQHLWVSYVTAIAKSKPSYNNIITISNEGAKLNGFANGGAMWRSAFDMSSKVHKAEFDLNKQIDKIYSTIQPFYQLLHAYMRRQLAGIYSNPVGLSKDGPIPAHLFGSLDGGDWSAHYEQTKPFEEESETPEAMLSAFNTQNYTTKKMFVTAYRYFKSAGFPHLPKSYWTSSIFARVWSKDMICHPAAALDMRAPNDFRVKACAQLGEPDFEQAHSLLVQTYYQYLYKDQSLLFREQASPVITDAIANAFAHLSTNPHYLYSQKLVPSEHLDIKDSVIINKLYKESLESFTKLPFTIAADNWRYELFDGTVPKNKLNDRWWEIRNKYEGVRSPQPYNTSNLDALIHNSVSQVHSPATRTLISYVLKFQILKALCQRELFWLSEGCILSEDTTEKLRETMKLGSSITWLKALEMISGKGELDAQPLLEYYEPLINWLRNTNEIDQVVVGWDGEGTPFTVEEIPKTRQPGDGGNGLPSEDRVAFPGGECVNGQECLLDSHCNGTICVCNDGLYTLEIGNTFNCVPGNPADSGFGDGKGGLVIGLFNNEVTTPEPSAEPEPTAKTTTKMPPRVRAATSPFSLYLTVLLIIYFAL

SEQ ID NO: 6778 - protein, 686 aa, Caenorhabditis elegans
MTVGKLMIGLLIPILVATVYAEGSPAGSKRHEKFIPMVAFSCGYRNQYMTEEGSWKTDDERYATCFSGKLDILKYCRKAYPSMNITNIVEYSHEVSISDWCREEGSPCKWTHSVRPYHCIDGEFHSEALQVPHDCQFSHVNSRDQCNDYQHWKDEAGKQCKTKKSKGNKDMIVRSFAVLEPCALDMFTGVEFVCCPNDQTNKTDVQKTKEDEDDDDDEDDAYEDDYSEESDEKDEEEPSSQDPYFKIANWTNEHDDFKKAEMRMDEKHRKKVDKVMKEWGDLETRYNEQKAKDPKGAEKFKSQMNARFQKTVSSLEEEHKRMRKEIEAVHEERVQAMLNEKKRDATHDYRQALATHVNKPNKHSVLQSLKAYIRAEEKDRMHTLNRYRHLLKADSKEAAAYKPTVIHRLRYIDLRINGTLAMLRDFPDLEKYVRPIAVTYWKDYRDEVSPDISVEDSELTPIIHDDEFSKNAKLDVKAPTTTAKPVKETDNAKVLPTEASDSEEEADEYYEDEDDEQVKKTPDMKKKVKVVDIKPKEIKVTIEEEKKAPKLVETSVQTDDEDDDEDSSSSTSSESDEDEDKNIKELRVDIEPIIDEPASFYRHDKLIQSPEVERSASSVFQPYVLASAMFITAICIIAFAITNARRRRAMRGFIEVDVYTPEERHVAGMQVNGYENPTYSFFDSKA

SEQ ID NO: 6779 - protein, 364 aa, Caenorhabditis elegans
MGSISAIHHIEFIVSNALQSAYWYCSGFGFEKFAEKITDESTSIALRNGTARVIITSYNSQNIYTDQLIKHGDFIKDVSFRVDNLDAVLQNLVENDIKVIQQSEVSTKDGLVRTATLLSEGGDVTHTLFELGEFKGNFLPFFTPISNFELFENIEKMPAILMDHVVQNYPIGEMEAAADWYFKTMRLKRFWSVDDKVATSEFSAMTAWLLVNDDHTVQVTLAEGVKGRKGKSQIEEFINYHGGSGVQHFALLVEDIISAVQIMKSRSVEFLTIPSQYYDNLEERLSKTNLIVKEDLKMIRELNILMDFDENGYLLQIFSKPLQDRPTLFIEIIQRANFKGFGAGNFKALFDAVEREQEKRGTLF

SEQ ID NO: 6780 - protein, 531 aa, Caenorhabditis elegans
MRLVRDDPGLPLYNTTSPKGHTFRRIRARARHWFSTRNTPTKACIIFTILLSIFVLITICSQGEAKREQPIVEVGYSKRPTNDRQKAVVKAFQHAWIGYKKYAWGHDTLKPVSKSYSDWFDTGLTIVDGLDTAIIMGLEDEATEATEWIQNTLTFEKDRMVNFFECTIRVLGGMMSAFHLTGKKMFLEKSVDLGDRLLSAFKSPSPIPYSDVNLLKRTATNPQWGADSSLSEVTTVQLEYRALSRASGNSTYEDLTFNVFKHIHKIGCETHEGLCGMFINANTGNFKKDSTITFGARSDSFYEYLFKQWIQTGKTIDWLKEDYGKAMKAMEKYLYRNSKPNKMFFIGELLSGQTYSPKMDHLVCFIAGTLSQGSQHGFPRKHLDMAEKIGETCHNMYDNPTGLGPEIAHFNMIPGKEDLYVKPLDAHCLLRPEAIEAWFYLYRFTGDKKYQEWGWSAFQAIEKYARIPTGGYSSISNVKQINVRFRDSMESFLLGETFKYLYLLLGDDQTVLPLDKWVFTTEGHPLPIYDH

SEQ ID NO: 6781 - protein, 448 aa, Caenorhabditis elegans
MWVMRAKRGQTGSPCASSTSIVHSESIAVCVLPFRLLHWASGAAAAVAAARNLTYVFLLKFRNERRRPTECSSTSSSPQHQRPNNIGYLTSPMERKFTPLSMKPSPSRRDTEKDALEYEFLEGYKKSGTLEIDGEKQVVDPNEIHIISLLGSGSCGVVESATTMYKNDNKENLKRILRDVRIMSMCNSPFIVTSYGYFMFDSSVKICMQIMSACCEKLLRRIYHSKLDFFPEFVAGHIVYSAISALDYLKEKHSIIHRDIKPSNILFDDSGNVKLCDFGISGFMTDSMAHSKSAGCPPYMAPERLTIETNSKYDVRSDVWSLGITVYQLVTGLYPFPLNDMEFTTLTIIANLNLPSPSLREETKRSFSPLFIEFLDLCLRKDVRERPEYRQLMKHDFYLDYDPASGSAYKFKAINGKCNQVADWFVDVIRLSKTEDELKSIPNTPCVN

SEQ ID NO: 6782 - protein, 232 aa, Caenorhabditis elegans
MPTFGRRVPRPKLDLPALRETIPEVLKNGALGYICLSGRNLNVPEDMLHGGVRIGSGEGQSAVYRLIYNGMVIARKDVAVRLPQGGDEDSTNKLMAKRLREVNVINGCAPCPFIVHFFGYYVHKYKDCVKIHIFMEEMALSASVLKKEVLKRGGIVPEFVIGRIACSVIHAMWFLKEKMQIIHRDIKPGNILIDYDGRVKICDFGISGILQDSIAVSATGCQQYTAPEINEV

SEQ ID NO: 6783 - protein, 449 aa, Caenorhabditis elegans
MVHSPGYSIKSDIWSLGITIFELATLTYPYPVGISEFTLSSTIMTSPAPSLERELKFFVKNDIPFSCIGTGVGDSDNVLNARPSVGAWLDDFFFPRDTIPIYQLLVFLNNFSCCSFDKLDKARLVEAGRGASLTPKTGALCYRATFENENAGSVKMSQPPGRRMPRPKLDLPPLRETIPEVLKNGALGYICVSGRILSVPENLLYGGERIGNGEGQSAVYRLIYNGKLIARKDVAVRLPKGVDQDSTNKLMAKKLREVNVINGCAPCPFIVHFFGYYVHKYRDCVKIHIFMEEMALSASVLKTEALKQGGAIPEFVIGRIVCSVIHAMWFLKDRLQIIHRDIKPGNILIDYDGRVKICDFGICGILENSIAVSDTGCQQYTAPEILVKGVSNSPGYSIKSDIWSLGITIFELATLRYPYPVGFSEFTLLSAIVTTPAPYLERVTFSNNY

SEQ ID NO: 6784 - protein, 562 aa, Caenorhabditis elegans
MASRSCICQVSAGIIFLIGAALLVAGLVIVLNVFPNIVNNQINDSKVLGLNADGTLNSFTDSWVNSKYISTMQYWVYDYTNTIGIMNRAIYPDVREKGPYAFDEILTMDKLNFSENGEFMEFRQIQTFVFNPNKSCAGCDPYKDKVLIPDMGFQVGIDQIDTVIEGILKNPLAATICHAIMKGKPNANQTCSNLGALIEGELGTLISLFNVSPFTTTVDQLLFSGYKTPFVEKFLDEALGMLHFLFGTAPKPLDDPPIQLNPLNGTSDIINTVLTGKTDPLKAGYMTEFRSISNNSLFNSIGNTLPPMWWPYANKTYCKDPNSALVLTGTNGDYFKNFVKKTDILPAFVSDVCRTIHFVFDREVTVKGFKGYRFVMPPTQFDYSLDENCGYCIPLKYGSYEYPAQSACLPSGLLDISQCTGGPIIMSKPHFYQASKVVSKFVPRFKPTYDNDETMLDIEPNTGTVLQAQKRLQINMLVNQFKHIRSYSVMRPGAYPLAWVNESFYMDQNTIDQLNSQLFTPVSTVNTICWIAVGLGAGLIALSIVMVIVSFCCFRDEHHKTS

SEQ ID NO: 6785 - protein, 737 aa, Caenorhabditis elegans
MQNGDIADSQITASSSFDKQSVGPQNARLHSELASGAWCPKPQINSKSYEFLQVTLNDTFLITSVETQGRYGNGTGREFASHYMIDYLRPGSQWIRYKNRTGHVYMDGNFDTTTPVIRVLDPPIVASRIRFVPSSKNTRTVCMRAEIHGCKHEGVTYYSTVPDGSRLDTLDFKDSMFEDSQIYTESGIKRYGSWPANRRFRSAASPFEKNQMNNSWIGWNRDTTDGRITILFEFEEVHNFTDVVLATFGNRIDGIDVIFSQDGKTFPLFSQISSSERQSLNNTSRRYDFRVPLHNRAGRKVRISIKFSSDWMFLTEVHFTSAANLTLLSEKIPPPSSAATQQLLVVCGIIFLTIFACVAYCVSVCLKRRQKNKSVDSNVKKDLIITHMGNKPTCHVFPSNGKLSNGHYEVANDILYARSQKSTLLSVSSKSTFSCRAIPPTWTDFNFPPPPEGREEHTYSQPVSPENSSNGSYKSVRKIQALKKYPSSALLIGKAIGEGKFTMIKECIIFGGLKCAHKSTKEEDCVHGTRALGDEIACLLQCGRHPRIVELFGVDESYNLLLEHVEYGCIRNFWMASEAPLDTEFLVRICKDIYSAMAYLESIRIVHGHFTPNNILMDGEFHAKVCSPRGPSHHAQLRYSAPESIVNNEFTHKSDAWAVATTVYEMAYQCRQRPYEELTNEQIVDNACALLDHQPNAVVPLMPTVFNYEILQLLTRCFRVDQLERPTFERLVKPFQD

SEQ ID NO: 6786 - protein, 430 aa, Caenorhabditis elegans
MWNLNCSESDTKVACLNLGEAVLTISSMLTVMLLIIFGNLLVVVTVYRDRKLRMQRQNWLIVSLAVADMLVGLLVMPLTLTYEIVGEWTMGNLKVIEGKKFRMWKFAGNILCEIWLALDVLFVTASILHICAISLDRYFSVTSPLTYPATRTPLRMFIYIGVSWIVSLLICLPPIFGWRPERAEGECSVSTDLGYVLYSSLGSFYIPVVILIIVYAKIYSITIRHSRQRLKETERRDHTLNMLTIRSSTNERYNMEYELEENSDPIEDEKEKVVTNRDMINKVCWQLRKISEELPRQGVKVSIALDTNHNSPPASDLTRKLEEKKFCEKRKRKLKAKERQATLLLGIILSAFILSWLPFFLIYVIGAFGHEAPPLVFKFFFWLGYCNSGINPVIYTVFNPIHSSTHGVLQMKTSLQFEQFETGRALLYPF

SEQ ID NO: 6787 - protein, 420 aa, Caenorhabditis elegans
MKKSTQLARQVIRAIGCANGLAGRQLGCENAVEVIKASTYLAGVQTRLPLEWGKIIEEVNTGRHASAMSGVTQTCRQLAHETRQVIENKEELLVFGGDHSCAIGTWSGVATAMRPVGDIGLIWVDAHMDAHTPDTSDTGNIHGMPVAHLLGFGDKTLVKIGDRLPKLLPHNLCMVGIRDYESAEQELLEKLGVRIFYAHEVEKRGIQDVMQEAQYLVTRNTIGYGLSIDLDGFDVSYAPAVGTPSADGINALEFIKALLTIDLTKLIATEIVEFLPRFDDTQRTSEQLVSSLVEYIYKTKQFQINSVNEIAQRHFQFLLILLLVLMARLDCKICLKVYKSNRAKSTPRILTNCGHTLCEACAETLLAQHVGEIICPYDRKITIIDGGVEQLHKNYAILAYIDELQEEGNVSDDEEEPEQG

SEQ ID NO: 6788 - protein, 726 aa, Caenorhabditis elegans
MVDESDVKSALNGHDRPFTITLAIVLLKIVFFIYDVVTFIPFKIFADPAEKLEKSERVKAEPDNGDPTTPWKNVSAKDGLMNSSFEGIHDLGTQWEECVRRYGNQPCMGTREVLKVHKEKQSNGKIFEKWQMGDYHWRSYAQVDKRVNMIASGLTSLGQQEKEPIILFAETREEWMTTALACMKMNFPIATMYATLGDEAVQFAINEVGAKTIFTSEALISKVKKAMSNGATSIENIIFFDSVDPASRGESVDVDLPFTLLSFDQLLSRGEREYCMLLGAYPVPTRSKKDDLAFIMYTSGTTGNPKGVMISHQNIVAVTAGQAFNIVLGPDDRYIGYLPLAHILEVCAEMVVFTKGVRIGYSSAQTLFDRAPKIMKGEHGDCWVLQPTLMACVPAVMDRIFKAVIDEVNANSELFKQLFKTCYERKRSRYEEGYTSFILNKLVFNRIGKLLGGKVRQILSGGAPLSPETQRFMNICFCCPVVQGYGLTETCGGGTIADIHDLSTGTVGPPLTCCEILLQEWAEAGYSPKNDPPQGEILISGPNVALGYFKNDEKTKEEFVKVNGKTFFATGDIGEFREDGSLKIIDRKKDLLKLAHGEYISLGKVETNLLTNPNVDNVCVYGDSNKSFLVALVVPNQKNLTQLASKAGASNDNFEKLCEDKKVVEALQKELAQYGASKLQRVEIPQKIFICHEPWTPASGLLTEALKLKRKNIEKAFRKELDELYK

SEQ ID NO: 6789 - protein, 557 aa, Caenorhabditis elegans
MRVSLRFTILAVSAMIFFPVIVFIYVVEAHTSPKVIADDQERSYGVICDAGSTGTRLFVYNWISTSDSELIQIEPVIYDNKPVMKKISPGLSTFGTKPAQAAEYLRPLMELAERHIPEEKRPYTPVFIFATAGMRLIPDEYVLIGQKEAVLKNLRNKLPKITSMQVLKEHIRIIEGKWEGIYSWIAVNYALGKFNKTATLDFPGTSPAHARQKTVGMIDMGGASAQIAFELPDTDSFSSINVENINLGCREDDSLFKYKLFVTTFLGYGVNEGIRKYEHMLLSKLKDQNGTVIQDDCMPLNLHKTVTLENGENFVRRGTGNWNTCSNEVKKLLNPESSSEVCKAEAAKCYFGAVPAPSIPLSNIEMYGFSEYWYSTHDVLGLGGQYDAENIAKKTQQYCSKRWSTIQAESKKQLYPRADEERLRTQCFKSAWITSVLHDGFSVDKTHNKFQSVSTIAGQEVQWALGAMIYHMRFFPLRDSSRNLIVKETHSSSESLWAPLFFLSAVFCLFVLVCAKEQSVLCFDDKRRSSFGMSRSQYSYKMLKENRTSSSFLENFA

SEQ ID NO: 6790 - protein, 376 aa, Caenorhabditis elegans
MNNYSGDIVFMSGGNEEDQLAQCQAYVQRHNIQQLVKEAIVVLCIHKPDNPVLFLKDHFEKLNEQRAQEGGNPDAADDDDIIVEPPKRSGGRRTGISAEPIKEDDTEYKKVVIPKDDATRRSLESAMRKNLLFAHLEEDEQKTMYDAMFPVEKSAGETIIEQGEEGDNFYVIDKGTVDVYVNHEYVLTINEGGSFGELALIYGTPRAATVIAKTDVKLWAIDRLTYRRILMGSVTKKRKMYDEFLSKVQILADLDQWERANVADALERCDFEPGTHVVEQGQPGDEFFIILEGEANVLQKRSDDAPFDVVGHLGMSDYFGEIALLLDRPRAATVVAKTHLKCIKLDRNRFERVMGPVREILKRDVSNYNSYVKLMT

SEQ ID NO: 6791 - protein, 622 aa, Caenorhabditis elegans
MKAFSSYDEKPPAPPIRFSSSATRENQVINSSLHSSPKMGDNLSKVLLPNQMMHVLLAPLPPISISLFSILHVLTNSIFQVVGLKPLPKEPEATKKKKTMPNPFMKKNKDKKEASEKPVISRPSNFEHTIHVGYDPKTGEFTGMPEAWARLLTDSQISKQEQQQNPQAVLDALKYYTQGESSGQKWLQYDMNDAPSRTPSYGLKPQPYSTSSLPYHGNKIQDPRKMNPMTTSTSSAGYNSKQGVPPTTFSVNENRSSMPPSYAPPPVPHGETPADIVPPAIPDRPARTLSIYTKPKEEEEKIPDLSKGQFGVQARGQKAKKKMTDAEVLTKLRTIVSIGNPDRKYRKVDKIGSGASGSVYTAIEISTEAEVAIKQMNLKDQPKKELIINEILVMRENKHANIVNYLDSYLVCDELWVVMEYLAGGSLTDVVTECQMEDGIIAAVCREVLQALEFLHSRHVIHRDIKSDNILLGMDGSVKLTDFGFCAQLSPEQRKRTTMVGTPYWMAPEVVTRKQYGPKVDVWSLGIMAIEMVEGEPPYLNENPLRAIYLIATNGKPDFPGRDSMTLLFKDFVDSALEVQVENRWSASQLLTHPFLRCAKPLASLYYLIVAAKKSIAEASNS

SEQ ID NO: 6792 - protein, 661 aa, Caenorhabditis elegans
MKTLFLLGLIALSAVSVYCEEEEKTEKKETKYGTIIGIDLGTTYSCVGVYKNGRVEIIANDQGNRITPSYVAFSGDQGDRLIGDAAKNQLTINPENTIFDAKRLIGRDYNDKTVQADIKHWPFKVIDKSNKPSVEVKVGSDNKQFTPEEVSAMVLVKMKEIAESYLGKEVKNAVVTVPAYFNDAQRQATKDAGTIAGLNVVRIINEPTAAAIAYGLDKKDGERNILVFDLGGGTFDVSMLTIDNGVFEVLATNGDTHLGGEDFDQRVMEYFIKLYKKKSGKDLRKDKRAVQKLRREVEKAKRALSTQHQTKVEIESLFDGEDFSETLTRAKFEELNMDLFRATLKPVQKVLEDSDLKKDDVHEIVLVGGSTRIPKVQQLIKEFFNGKEPSRGINPDEAVAYGAAVQGGVISGEEDTGEIVLLDVNPLTMGIETVGGVMTKLIGRNTVIPTKKSQVFSTAADNQPTVTIQVFEGERPMTKDNHQLGKFDLTGLPPAPRGVPQIEVTFEIDVNGILHVTAEDKGTGNKNKITITNDQNRLSPEDIERMINDAEKFAEDDKKVKDKAEARNELESYAYNLKNQIEDKEKLGGKLDEDDKKTIEEAVEEAISWLGSNAEASAEELKEQKKDLESKVQPIVSKLYKDAGAGGEEAPEEGSDDKDEL

SEQ ID NO: 6793 - protein, 414 aa, Caenorhabditis elegans
MSVSKKLFSTAVRGKSWWSHVEMGPPDAILGVTEAFKADSNPKKINLGVGAYRDDQGKPFVLPSVKEAERQVIAANLDKEYAGIVGLPEFTKLSAQLALGENSDVIKNKRIFTTQSISGTGALRIGSEFLSKYAKTKVIYQPTPTWGNHVPIFKFAGVDVKQYRYYDKSTCGFDETGALADIAQIPEGSTILLHACAHNPTGVDPSRDQWKKISDIVKKRNLFVFFDMAYQGFASGDVDNDAFAVRYFVEQGHNIVLSQSFAKNMGLYGERVGAFSVVTSDADEAARVASQVKILIRPLYSNPPVHGARIASRILADPALNKQWLGDVKLMADRIITMRTTLKDLLAKEGSTRNWEHITNQIGMFCFTGINPQQVEKLIKEHSVYLTKDGRISVAGISSNNVAYLAHALHQVTK

SEQ ID NO: 6794 - protein, 702 aa, Caenorhabditis elegans
MCVQVICREGYEFASERVVGKSTCVNGKWKPEIAECIPKSCRVPIRLHVFFLKAGTSQILQSNDVVEDGTVAQMACLRGFHLSGNGVLECIKGDLREPLGHCVPQECILSELIVGKYNTTAETIKNGEKVLLMCTGTNVTISCSKGSLNPLPSCHENESRFCIAPQDTTPAIIYRYHGLRKTHIDRYQTAYPNGTIFQFKCNDKEEAGGIECVNGEWVSNLLPCVTANITNWKTPTNDEMCPPLRLELNQKIFNVENYIPHHMHLFAHGTILNVGCLTTSNSAETVPIKCRRGKWGYKKKLNCSKTETICTLKMNINSHTVIYHTQKKETVVFNQNFESGSKLLFRCANIGLEQLHGKKELQCYNGVWSSPIPYCIPIQATDCPFPSSRPSKLTKKMFIFTDCIFKFVLQILWCKTFKLVLLLFVNILSLKSLPLTVRIRRSGQRQKLEITMILTDLKRKMPTSNWPDKLTSRSIEPYIVRRNCCSVFVPPGFSVEGSAVSTCLEDATWSHSAPRCVAAHCPAVFVNGTRMTVTVTSYRTGGVAHFKCHKGFTLIGEQNLHCTTQGTWSHDFPYCNVVHCPPLLPPANGHFIGEPKEINTKGDIVLLGCLPNYMLTGGDFSVCQADGEWSEIKTKCDGYCRHPGQPDHGATTTIAKDYYSIGEKIVFYCPSQNYKLSSDNVLVCISPGQWSRRLPLCLPSNS

SEQ ID NO: 6795 - protein, 560 aa, Caenorhabditis elegans
MCDGECGLSCVNPIAMCHPLPNIENGFIRTAGDLRFGSNAEYGCNKGYILVGASQRRCQANKEWSSSQPVCRLQLKCGPPPEIPFAVHDGSSFSGEYDLDAEGLSISKCLLNRKNVAQWFGPDLRCKARACPDPGDIENGLREGDTFEYPHHVKYSCNPGFLLVGSTSRQCSSNGEWTNEPANCKATECSRPSSPLHGKVVGSSLTYQSVVTYSCDHGYRLVGQVQRICLAEGIWGGNEPRCEEIRCSVLPTLPNGYIEGSETSFGAVAVFRCLETMTHEGASKAKCMEDGQWSAPIPRCLASCRVPHIQNGKIRDKSEGQLIASGSKVIVECNKQHEANIDERLICSNSTWSHVPVCSPLSCHNWPPRVPHARILFSKSSHGSIAKYECNNGYHPNRNNQIIKCLYGEWTKDGPPMKCLPSWCEHPSKTYGTLPGGQILLEGILGAYEFQSYIQKVEEGRAISFQCGKGNYLIGPPKATCVNGEWMPKVSPKCVSQTHPMIEGKILWDRKKRSLPGRAVREYVDDELSTHRQHSGKCGIVSGKLERMIMQHSDNGVSVC

SEQ ID NO: 6796 - protein, 465 aa, Caenorhabditis elegans
MRELLLLLTFIFSWANGQLLEKSRSVWVEQGLVRGNIYNIDGKHIQIFRGVPYAEPPIGELRFKPPVKKTRWHQELPAVEYGPPCLQFMDFHKNDKFAKTNMDRQSEDCLYLNVFSPYDTDDESKTYPILVWIHGGSFLAGSADTGIDMEVIAANIVSKGIAFVSINYRLGPLGFMNYQNGDKLEGNFGIWDMVMALQWIQSNIKQFNGDPTKVTVMGESAGGAASSLLALSPKTSAMFYNMHQRDGLKRSDVEEQVYRIIDNSFHETASEKLANSTVQLIANATIVRYLETPNNEFIADQVVGALQKLESDIEFVAPCEREVAAYVDKGVPVYLYSFDYVPKSPILESERKIYSLFGTKPVEMKRTEKSEILEKAAFHGLDHAFIFSKGYSSNFEISPYTKREETMSKILCTMLTNFVKNGDPSTTRLSIKPKHDSNLHNLFRFSWPIFSGNSSQYVSLDVPLK

SEQ ID NO: 6797 - protein, 502 aa, Caenorhabditis elegans
MATEFFSLFENPIALSHVRSPTNKMAKLSKENLLLLFTVLGVVVGIGLGFSLRDPSKAWSKRHLSYLRFPGDLFVQMLKMLILPMIMSSIITSLASLDSGTAGRLGMVSMIYYTLTTFFAVFLGIVLVSVIKPGKWTTTNIEDLVGHVKTTPCVATAVDTIIDLMKSCFPENLIEATFRSQKICLKFFNGTTEIPPEIAMTMSPEQRAQFTEVPEKIVSDGMNILGLVVFSVALGIVIGVIGEDGKPMKNFFKSLEACSMKLIGWVIIYSPVGITFLIAAQIVGMKDPGQELHRLMGYVITVILGLLIHAFVVIPLLCVVLARRNPIKFVGGMAQALLTALATSSSSATLPLSIKCCEENNKVDPRVTRFVLPLGATINMDGTALYEAVAAIYISQCYGNDLSLGEVVLVSLTATLASIGAAGIPQAGIVTMIMVLIAIGLPTNLFILIFPVDFMLDRLRTTVNVHGDSIATAVIERLCEDQLQKDTHTKHLEENDEQVKFI

SEQ ID NO: 6798 - protein, 2338 aa, Caenorhabditis elegans
MLRSLGILCLLGAALAAPSRIASKDTDLVNDLPGLSFTPTFKQYSGYLDGSQGNHLHYCFLAFILHLILFWTVSKYTIPMDTKLVESQTNPQTAPIVLWLNGGPGCSSLLGLLSENGPYRIQKDGVTVIENVNSWNKAANVLFLESPRDVGFSYREKSATPDLLYNDDKTATDNALALVQFFQRFPEYQGRDFYITGESYGGVYVPTLTKLVVQMIQNNTTPYINLKGFAVGNGALSRKHLTNSGIDLLYYRGMLGTTQWENLRQCCPDTLNNPLVDCDYSKYVVFDNFGNPSPRNDTNDAQAIACGKMVINLSLNSIWETYNDVYNSYQDCYNFDSSVFGAAEERHAKVHQQTMRKIMRTTLSTTGANDAYNLFSNGFNPFIDQGSLYNKMSTDALNNYPCYIDDATTAWLGRTDVRSALHIPAAAPVWQECSDDINAKYYIQQYPDTTPVFQFLVDSGYPLKVLIYNGDVDLACNYLGDQWFVENLATVSYQMTLTTPRQQWNFTRAGTQNKYIPTLAGYLKSWNYQQFSIDLLTVKGAGHMVPMDRPGPALQIFYNYLYNTNGGYSNQVPYDLTATPLRSQFLAPPQKTWTRKQADRVWNLPGITYGLNFKQYSGYLNGVTGNYLHYWFVESQGNPTTDPLVLWLTGGPGCSGLMAMLTELGPFHPNPDGKTLFENVYSWNKAANVIFLESPRGVGFSVQDPSLNNDTIWDDQRTATDTYLALKDFLTVYPEYINRPFFVTGESYGGVYVPTITSLLIDKIQSGDFAQLNLVGMSIGNGELSAIQQFNSAIMMSYFHGLFSKDDFDSLQPCCNQTKTSSQWFEYCNFAQYIHLGPDGTAIPNDKSFCANKVADLGQQRFWNSLNDVYNIYQDCYQQADRAFGSRMSIKQKKEHMRGFIDQGAKISTSSTDNQGGLACYGTTQAANWINLPDVRSALHVSSAAGAWSACNDTINGLYVQQHNDTTSVFQHILDSKYPLRVLIYNGDVDQACNYLGDQWFIEAFALKNQLPVTKPRADWRYMTQIAGYAKKFDNNAGFSVDLITVKGAGHLVPTDRPGPALQMIANFFRNQDYSNPTVIDTTLHPLKNTYVVAEQLAASLNRSSTGVAHNGNRVHVKVHKVVRAGNFAKTGEQDTVRQPTERDAPPPPPTQTKAQDEVTNLPGLTFTPNFKQYSGYLNASAGNYLHYWLVESQLNATYDPLILWLNGGPGCSSIGGFLEELGPFHVNADGKTLFENTFSWNKAGNVLFLEAPRDVGYSFRSNEFAPDTMYNDTYTASDTVLALASFFNKFPEYQNRPFYITGESYGGIYVPTLTRALINAIQTGTIKNVNLVGVAIGNGELSGIQQINSAVSLLYFRGERDKSDWDAISKCCDTSVPQAYCDYIKYVNIDTSGNVWPKVNDNSLAGQCGQLVTQQGFLDVWTTDNDVYNTFADCYTAPGAGDSKLNELASGIRRVQNRRSKRAADVSPFLPSTLFVDQAKKINYQSTDANGGFTCFSGASSENYMNLPEVRTALHIPTSLPYWTDCNDNMNENYIQQHNDTSSVFTDIFATGYPLRFLIYNGDVDMACQFLGDQWFLEKLAKDNGLAVTRQHGPWNYTQGQFLPRVGGYWKQFTYTNTAKNTKVVFDQLTVKGAGHFVPQDRPGPALQMIYNFVNQLDYNRNLTLDYSRKQLLPQYQPAPVTVPRRKADHIFSLPGVTWNVNFMQHSGYLQATRGNKLFYWFVESQSGNEGDPIILWLQGGPGCASTGGLFSEIGPFFVNPDGETLFENIYSWNKAAHILIIDSPRGVGFSYQDKNVNNDTTWDDDKTALDTYTALEDFFVTYPPHRNSELYITGESYGGVYVPTLTRLLIQKIQAGQSNIQLRGMGIGNGMVSAVNDVRTLPDFLYFHGIYDKPMWEKLRACCPSADSSGDCNYDYYITIDSGVNVIAKQFPNNQTLQDCANLVENLSYDRNWKALYDQYNLYQDCYVTPRDQANPFAMKEKFSRLDVDHKLKTSIPQAITKTAPQDPLSTDATGGYSCWSLGAINNYLSLSHVRDALHIPDSVPRWGFCNKINYANLYNDTTQVFTDILNSGYNLKVLIYNGDVDSVCSMFEAESMINNFAAAQTFVSNQPRGSWMYGGQIGGYVQKFQKNNMTIDLLTVKGAGHMSPTDRPGPVLQMMNNFVHGQGNYNTSIAVSMVRQPLLAQFLEQGIGPVGTSAPVASTSTTNTPSPTNQSPVTQAPPVTLPPPSVATAGPTGPILTVVPVSSAPTSGAVSSTTNTPSPTNQSPVTLPPPSVATAGPTGPILTVVPVSSAPTSGAVSSTATAAPVITTTKTSSVLSVSFSMFIVLITKFLL

SEQ ID NO: 6799 - protein, 410 aa, Caenorhabditis elegans
MKVEVCSVENDRGLSRFFGFYVISSKHERINRRAGCLEIILSSIMIKTILLLAFVASTSAFVIPFKVHAAVTNITKGGQTLEQTSTFFVANLTMGTPGQLFTVVIDTSTADIVIPDMSCKTANNCYNKRRFNQAKSSSYYAYGNKYTYKNNLGTFQGFDAKDTVVIGDRKTDLITIPGVKFMQATDLGLLMDGLGADGILGLGFTASSQIGGNSPFVQGVNAGDISGTFYSIWLEHFNQTDDLGTHGVIYYGGFDPVHCAPNPTYVPLASAYAYQLTMSSFKVVGSSATNSNNKYIQTYLDTTTAQIGLPKTYISQVFDSLGISTNVMNAIYPTIVPCNTKITLTFGFVSGTTVSITERDLVISFFGTCRLQIIPTTDRIILGLPLYRGRCTYFDPIMQRVGFTPALLQD

SEQ ID NO: 6800 - protein, 604 aa, Caenorhabditis elegans
MPNYTVPPDPADTSWDSPYSIPVQIVVWIIIIVLSLETIIGNAMVVMAYRIERNISKQVSNRYIVSLAISDLIIGIEGFPFFTVYVLNGDRWPLGWVACQTWLFLDYTLCLVSILTVLLITADRYLSVCHTAKYLKWQSPTKTQLLIVMSWLLPAIIFGIMIYGWQAMTGQSTSMSGAECSAPFLSNPYVNMGMYVAYYWTTLVAMLILYKVFSSGYQKKLAHFLCVLQGIHQAAKNLEKKAKAKERRHIALILSQRLGTQVGVSLMLQSKAEKEKAEEAQKDSGYTSNQAGGSLNTENDQNLGVIEEERSGFLSRRSRYSASESITTTHENDEKEVEKADSLQKLFADDELGSVLNFKEEKLKNTDSNNDSDTTSVILQRSRKYKKNKRPRSSRRSEHSTPRQIAKVKQAEGTAAQLIEESVPDDDQTETIEVKRTDRWVVSMKKRIARALIRRRSTTRPERGSSSNSDDSSSEVEGEEKPEVRNNGLKIPQLTVNNENRGETSSQPGRDRLAPPNKTDTFLSASGTITFIVGFFAILWSPYYIMATVYGFCKGECIPSFLYTLSYYMCYLNSSGNPFAYALANRQFRSAFMRMFRGNFNKVA

SEQ ID NO: 6801 - protein, 1087 aa, Caenorhabditis elegans
MLAGQHHVTDIESPLMVVLWRVAAGVFLPLVPTMAVFGNVLVIMSVFRERSLQTVTNMLIVSLAVSDFMVAIGVMSFGVYYEWNDFKWGLGSFFCHVYQALDVACSTASILNLLAISLDRYIAIGHPISYAQYGARGGRAMISITIVWGVSVAVALPLLLGVNPMEENDECELANPYFNMISSIFSFFIPCIAMIILYTIIFRRLRQRERARSLRQAQRSENDKISSALLGGAQIARQMGKHFKNRTDQILLEISFQTSSFPTMSESSEDASTISPMINSFNNFLPKKTPYPSTSIPAIPECGSMPNLTIIERPEAEKEKEISIMDLRDTVEMLDDKYSSAILTRSFGEELEEILPFIDGSNSVKHSREQLHTTRSNTSTTRLLDVKPELRSISVPSIQDEKKLSQKSNDLPFSHQNGTHKQKLLPNPGILMKSKSTTLLKTNGYMDTDSLNRNSHKKSLADLLANDEFSFSDSMRVYKNRLFKSLSRATSGWNKPRPSRHMVKKATKQMRREHKATVTLAVVLAVFLFCWLPFFVLHLSNSICLIIDENSACVGFLPLYLATWLGYLISFNVPMILFCRFTGVFHCGSFYTQVRCLLQQFLKITFIASLCCQLKDFLPCVMQLSAQKVDFNMNPIEVIFNITTEAKLMHTCRTYSRILPCFDQKMVQCGKPSEKTQLERGKRLHSYLCAPFSLQRQKIFLRRSKCIQDVLAEPQSSVCNRNDTVFADKLQSCREMCTRPDCVSKIELSEVSTCTYINIGKKCTAEAAQFFAQMQQVLTNKEYPMQCQYDLRKKPESELKKGLPIESLVAQTTSSTTYVTVHPPALPSVIDGVVTRTSLPIMRRTDPNSKFKPRPTTSQSNGPVIKTVIVDERGAPMNQPTSTQKPKVVHKFLPNPYTTKNPNTLKNDIIRTTRTIIPVVDKHTYVPWNYKVDAVQVSTLTSALAPVKPTETVISSPPVAFNFKLPAEQTSTQPFRVEINWHDDEVKQEPTKAPGVFVSPWYLKTPSHIPPEIEFATPTPLISSPLEAVSPILSQLKSNSLNFTELGNQANNYFSAALSAFAETKKEMAHNDPWRTIIGAILKFLRE

SEQ ID NO: 6802 - protein, 379 aa, Caenorhabditis elegans
MKTLLFLSCIVVAAYCACNDNLESVLDKYRNREIDSEAAELDGDDLIDYVNENQNLWTAKKQRRFSSVYGENDKAKWGLMGVNHVRLSVKGKQHLSKTKDLDLDIPESFDSRDNWPKCDSIKVIRDQSSCGSCWAFGAVEAMSDRICIASHGELQVTLSADDLLSCCKSCGFGCNGGDPLAAWRYWVKDGIVTGSNYTANNGCKPYPFPPCEHHSKKTHFDPCPHDLYPTPKCEKKCVSDYTDKTYSEDKFFGASAYGVKDDVEAIQKELMTHGPLEIAFEVYEDFLNYDGGVYVHTGGKLGGGHAVKLIGWGIDDGIPYWTVANSWNTDWGEDGFFRILRGVDECGIESGVVGGIPKLNSLTSRLHRHHRRHVYDDNY

SEQ ID NO: 6803 - protein, 744 aa, Caenorhabditis elegans
MDEESGSSVSMWLTMRKLSPVAMVSRSQKKTTDQAAPSDEQQEAGSSSAIGQESRKTVVFQEPDIGFPSEHDQLTTLHDSEEGNRKMSLVGKPLTYKNYRTDQRFRRMQNKMHNFLERPRGWKAATYHLAVLFMVLMCLALSVFSTMPDFEVNATIVLYYLEIVFVIWLATEYICRVWSAGCRSRYRGISGRIRFATSAYCVIDIIVILASITVLCIGATGQVFAASAIRGLRFFQILRMLRIDRRAGTWKLLGSVVWAHRQELLTTVYIGFLGLIFSSFLVYLCEKNTNDKYQTFADALWWGVITLSTVGYGDKTPETWPGKIIAAFCALLGISFFALPAGILGSGFALKVQQHQRQKHLIRRRVPAAKLIQCLWRHYSAAPESTSLATWKIHLARELPPIVKLTPNGSNNATGLINRLRQSTKRTPNLNNQNLAVNSQATSKNLSVPRVHDTISLVSTSDISEIEQLGALGFSLGWKSKSKYGGSKKATDDSVLQSRMLAPSNAHLDEEEAVGYQPQTIEEFTPALKNCVRAIRRIQLLVARKKFKEALKPYDVKDVIEQYSAGHVDLQSRVKTVQAKLDFICGKNIEKIEPKISMFTRIATLETTVGKMDKKLDLMVEMLMGRQASQRVFSQNTSPRGEFSEPTSARQDLTRSRRSMVSTDMEMYTARSHSPGYHGDARPIIAQIDADDDDEDENVFDDSTPLNNGPVSVFTLFKFYHKYMFIDNSPKKKEMKTLNTTFSQ

SEQ ID NO: 6804 - protein, 946 aa, Caenorhabditis elegans
MNVLIVGSGGREHALAWKMKQSPKVKNVIVAPGNGGHSERIDINSNDLDAVADFCEKHNIHCVLIGPEEPLSNGLADHLIRIHPNLMVFGPLKDGAQLETSKSFSKHFMKEYGLPTADFVTVSIENVKSLDCVFERFPAADGLAAGKGVIIPRNNAEAVEAARSILHGQFGNAGRTVIIEERLEGYEVSALAFTDGISFKRMPLGKDHKRLLESDLGPNTGMGVVAPVSVPKEVDRQIDEIFEKTLKGLADRKIKYCGVLYAGFMIVDQKPLLLEFNCRFGDPETQVLMRLLESDLFEIISSCVNQTLNTCDINWSTKSVCGVVLASGNYPKSGDKGSPITVVTNGGRILCVTSLADTLHDAREHANKIAQNIQFTGKQFRKDIGKTIDIGTPSLSYGSSGVNIDEGNQFVEDIKLLVKKTLLPGAAQIGGFGAVLDLKKAGFSNDSQLVVGIDGVGTKIEVATHCNNFTGVGYDVVAMCVNDVICHCAKPIAFLDYFVCGKLERSMATQVLTSISEACVEAECSLIGGETAEMPGVYSTHQWDLAGCAIAARESTWPMLPLSSEIRDGDVILGLPSSGLHSNGFSLARKILTVNGVKYNDPLPWDSKSTFGTELLRGTKLYVKKVLPLLSTGLVKGCAHITGGGLTENAIRVLDKNSKDSLVIDCASWKFREIFNWMAAAGPVDTKEMIRTFNCGIGMVLIVSPDNVEKVKKQLRKHEEEFYEIGHVENSKNGEAIKFVNEEKMFQREKYTTQRKRVRVAILISGTGTNMQKLIERSKTPDSNCDVVLVVSNKEGAGGLTIAASYGIPTKVVPHTADRVTGDTELAQVLKDFGTELVCLGGYMRILSPCFISQFPSRIINIHPSLLPAFKGAHALQDALNFGVRIVGCTAHFVDELVDHGDIIAQRPVVVEDTDTIETVRQKIQLQEHEMFPNAMIAVAAKILEK

SEQ ID NO: 6805 - protein, 1010 aa, Caenorhabditis elegans
MGEDEDRLVIDLFREYNFLIRPVKNVSSPPVVVDFGVAMILLINVDEKNQILQTNVWLTMKWNDFQLAWNPAEYGNISNLHVPSDRVWLPDIVLFNNADGNYEVSFKSNVFVDHHGDVTWVPPAMFKSSCRIDVEWFPFDEQCCTLVFGSWTYNSEEVRLHWYNNIQAVQLHDYSYSGIWDVIDVPGQLVHKPDLKENKMVFNVVIRRCDNNLLKSNSQCHVFRKTLFYTVILIIPTVLMAFLSVMAFYLPVDSGEKVSLTISLLLALVVFLLLVSKILPPTSNIPLMGKYLLLAFVLNITAVVGTVVIVNIYFRSALSHKMPTWVRKVFLEFLPHLLVMKRPERIPIFNGYFVEEYCASEIFDASLVMPSMTATMLPFLQVTTNLKAASSTSSGQSSEHHENCSKWKKRLSIRMSKRRAPRARLDDDSEDIIDDTNGNHVDSLQEKISKEMKTTVEAIAYIAEHMKREMSLKKMRDDWKYVAMVLDRLILLIFFGVTLGGTLGIICSAPHIYFNFDYLKCTSSELQCYPNSAEERLLSYIFDGYNSLIRPVLNASSPPIEVFFSLAFVLLINVDEKNQIMQTNVWPTMKWNDYQMQWDPREFDGIKTIRVPPDKVWLPDIVLFNNADGNYLVSFYSNVVVEHTGDMLWVPPAVYKSSCLIDVEFFPFDEQVCSLTFGSWTFRKDELQLSYLSGKRHVCWLREGICEEIQFHGTFQVELNDYLPSGVWDLIDAPGLLIDERSKISYQIKIRRKALFYTVILIMPTVLMAFLSMMVFYLPAESSEKITLAISILLALVVFLLILPPTSSTIPLMAKYLLMTFIMNMITIMVSVIIINVYFRGPATHIMPNWVKTVFLKFLPVLFVMRRPESTEKELAKMKREKRERRSMKSALKTFFKRNDAKISEQPKQTSRKDGSSSEEKLSSDAKKAIEAIEYITTHLTHDNAFKRQREEWKFVSVVIDRLLLYLFFAVTTGGTVGILLSAPNVFEQVNQTSVIERLKQQAAEEMLNS

SEQ ID NO: 6806 - protein, 290 aa, Caenorhabditis elegans
MAEDKTKRLGRWYFGGVAGAMAACCTHPLDLLKVQLQTQQQGKLTIGQLSLKIYKNDGILAFYNGVSASVLRQLTYSTTRFGIYETVKKQLPQDQPLPFYQKALLAGFAGACGGMVGTPGDLVNVRMQNDSKLPLEQRRNYKHALDGLVRITREEGFMKMFNGATMATSRAILMTIGQLSFYDQIKQTLISSGVAEDNLQTHFASSISAASVATVMTQPLDVMKTRMMNAAPGEFKGILDCFMFTAKLGPMGFFKGFIPAWARLAPHTVLTFIFFEQLRLKFGYAPPVKA

SEQ ID NO: 6807 - protein, 826 aa, Caenorhabditis elegans
MPTRPRLEDSPVAEHDHHIVVDVFTVNNDDGTWKQASRFARYEEDCEGFDNHLGRPHVPCIPMGTYDALKMVTAKSILFPKVQYESLDEFVNFLETKIVDPDVPKLGEKIAKLINDRIAEIEKMRPLHQRNSSSTQSLDASNPQTISTVGIFPRSLLSAPNNLGSLAHHPMRRLPTSHSGLRFGSSFLPQQPVVSQLEPVIWDEDNEISMLVAGEIPHVNVCRFIAIRFVETTAMEKIFPNMTNVRHLFFLIGPALENVTYLDLGRALASVVSNPPATTTFDQLKSPDSITKAIERFLAGTVVIAPGRIDNKNLVRSDLIRKLVNMQGEKTETKIVHPKDVDVERNATKKAEEAEDKPFRLFSGVTSDLRNRAKHYFSDYRDGFNISIFTVVFYMFCVTVVPTLTFGAIMGAGTSGLLAVKECLVSQALSGLIWSVLSCQPLLVMSPTGPFLVFEKALFKFTDQNDMDFLEVRFYTGIFLFFISIVGAATNCAHLIHYVTIYTEDIFCALISLIFFSEVVEFIHLQEEHNSIENLKYYIENAANCTVTEVKDCALSRPNTFLLQLIMVVVSIAIFHYLRQVSRSTFFGRTFRNLCKNFGGIFAVIAVSIAYRILFQNVGVAVVDIPVAVGQSRPFDGIFVIPSAPPTASTLTIALISSILLFVLIFVETEIPEQMALREGRKLKKGGGLHWDLIVVGFCTLVSSVLGLPWMCPAAVQSLAHITSLTEYKKSAPGVPSRISHVIEQRVSGMVTYLLLGTFAILGHFLAIPAATIFGVFFYLGVRNLEGSKMILRLKLCFLPSKYRGSHKFLEIVSSLKICSLIFNLH

SEQ ID NO: 6808 - protein, 505 aa, Caenorhabditis elegans
MLLDTNTITFPFFVNGLFRFQDSANSLVIQTKMPSCAHSISALSFLESIRTLAFTARRNSSPLYRKSTKKLKKSRLVGKNGICNVYNTNVPKKDRQYLRDIFTTMIDVKWRWMLMLFASAFVLSWSIFGTTYYLIALVHGDLSLPTPVNHTACVMNLDSVYSSFLFAVETHHTIGYGHRYITTECYLAGAIVCLQAICALLLQSFMVGIVFAKMARPKKRAETIIFSDKAVICLRDGQLCFLCRVGDMRNTHLVEAHVRLQFITDRETNEGEIEPLHQFEMKVGPSIADDDRLFLVWPTTLCHVIDSRSPLYNYNQQTLMSAQFEIIVLLEGIVESTGMTAQAKTSYLPSEVLWGHRFRKLVTYQRSNGSYQIDYDLFHSTYPVRTPAMSPAEFYSSKPNLKDYYCHDSHEHKLEDNRSSDSTPLPSPSPYSYPSTPLNHFQSSSNSPVFSNNHSKFNTEAVTCEAGMLCPPTIVVQCPSTCASPNHMRRTRNQMDKSRTRYSIA

SEQ ID NO: 6809 - protein, 681 aa, Caenorhabditis elegans
MRRELALFLVCSVFATVFGTDSSPSFKIDTVNSQFLLDGDPFTYIAGEIHYFRIPHQKWDDRLKRVRALGFNAITVPVPWNLHQFYQDETPILSGNLDLVKFIKAAESNGLYTILRIGNRPYISAEWDNGGLPWWLIRNTKIGKYRSSDPSFMTEVTQWWKHLLPKIYPLMRKNAGPVLMVQIEHFYGALGICDQQYLLQLANMAKENLGNDVVLFTVNPPVLQFMRCGTLPNILPTIEIVPNANAGEIESWFSMQKAFMQGAPAVASQFLINPFKLWGKNVSDPYPNNLIIQTAKTAFALNASLSFHMTHGGTNFGYWNGAVDPYPVTTSYDSFAPISEAGDVNPLYISIRNWISNIPGWQNPPTPIPANLPRTAYPDVQLTVFDTISGFIIGANPECWSSPETPRTAEYIRQGYGYIYYNTTIIECGSLYIPTFADNAYIFLNQNFVGALYKQFGSIHNNTIDVQGCLDQFNSLEIIIEITGRDHNNYPVMSRGIQGNVYMRNITLENWESCEVPIETYEISLKSQSAAIEQPSVFIGNLIIKTAPADTFLDTRGWGKGVVTINQYNIGRYWASIGPQQTLYIPSEFLHKGENLIMFYEFEGATTACTATACTAKFTNIPVCLHQNSPYPVHHFHYSEGFCTNAKNFHTVLPLLQQFVFQPGHDQLKGEAQLYPLNKHN

SEQ ID NO: 6810 - protein, 398 aa, Caenorhabditis elegans
MSGRVFLLLALVALASAIQRIKLEKRTYTREQYKFGSIQEHLKAKYVPGYIPNKDAFNEGLSDYSNAQYYGPVTIGTPPQNFQVLFDTGSSNLWVPCANCPFGDIACRMHNRFDCKKSSSCTATGASFEIQYGTGSMKGTVDNDVVCFGHDTTYCTDKNQGLACATSEPGITFVAAKFDGIFGMGWDTISVNKISQPMDQIFANSAICKNQLFAFWLSRDANDITNGGEITLCETDPNHYVGNIAWEPLVSEDYWRIKLASVVIDGTTYTSGPIDSIVDTGTSLLTGPTDVIKKIQHKIGGIPLFNGEYEVECSKIPSLPNITFNLGGQNFDLQGKDYILQMSNGNGGSTCLSGFMGMDIPAPAGPLWILGDVFIGRFYSVFDHGNKRVGFATSRTGK

SEQ ID NO: 6811 - protein, 436 aa, Caenorhabditis elegans
MSLRFDGKVAIVTGAGGGLGKTYALELAKRGCKVVVNDLGGDRHGTSSSSSMADKVVQEIKSAGGQAVANYDSVEFGDKIVKTAIDNFGRIDIVINNAGILRDVSFLKMTELDWDLIFKVHVKGAYAVTKAAWPYMRDQKYGRIVVTSSNAGVHGNFGQANYAAAKSALIGLSNSLAQEGAKYNILANTLVPTAGSRLTETVMPQNLVDALKPDYVTPLVTYMVHDSFEESGKVFEAGAGWYGTIQYYKSKGKVISHASADDIAKNWSTITNMNGAEYIGTITEQSARLVSILEEHEASSGSSSASSGASSGGAFPSNIRSSALFQEMADGVKADPTAVKTLKSIVLYIITDGKNELGKFTLDFKSASPSVYLGDVKNGEKANATVTVADSDFVDIAAGKLNAQKAFMSGKLKVKGNVMLLQKLQTVLEKAKKSKL

SEQ ID NO: 6812 - protein, 612 aa, Caenorhabditis elegans
MITSVLRYVLALYFCMGIAHGAYFSQFSMRAPDHDPCHDHTGRPVRCVPEFINAAFGKPVIASDTCGTNRPDKYCTVKEGPDGIIREQCDTCDARNHFQSHPASLLTDLNSIGNMTCWVSTPSLSPQNVSLTLSLGKKFELTYVSMHFCSRLPDSMALYKSADFGKTWTPFQFYSSECRRIFGRDPDVSITKSNEQEAVCTASHIMGPGGNRVAFPFLENRPSAQNFENSPVLQDWVTATDIKVVFSRLSPDQAELYGLSNDVNSYGNETDDEVKQRYFYSMGELAVGGRCKCNGHASRCIFDKMGRYTCDCKHNTAGTECEMCKPFHYDRPWGRATANSANSCVACNCNQHAKRCRFDAELFRLSGNRSGGVCLNCRHNTAGRNCHLCKPGFVRDTSLPMTHRKACKSCGCHPVGSLGKSCNQSSGQCVCKPGVTGTTCNRCAKGYQQSRSTVTPCIKIPTKADFIGSSHSEEQDQCSKCRIVPKRLNQKKFCKRDHAVQMVVVSREMVDGWAKYKIVVESVFKRGTENMQRGETSLWISPQGVICKCPKLRVGRRYLLLGKNDSDHERDGLMVNPQTVLVEWEDDIMDKVLRFSKKDKLGQCPEITSHRY

SEQ ID NO: 6813 - protein, 488 aa, Caenorhabditis elegans
MCFAEKGEGAGEDVDHHSLFCPKKLVGNLKGFIRNQYHQHETIQILKGSALFLLVLWTIFANSLVFIVLYKNPRLQTVPNLLVGNLAFSDLALGLIVLPLSSVYAIAGEWVFPDALCEVFVSADILCSTASIWNLSIVGLDRYWAITSPVAYMSKRNKRTAGIMILSVWISSALISLAPLLGWKQTAQTPNLIYEKNNTVRQCTFLDLPSYTVYSATGSFFIPTLLMFFVYFKIYQAFAKHRARQIYRQKVIRKHIESTILHEISHVLPTSDEFAKEEEEEEDSESSGQVENGLGNGNDAIIEEDECEDEDSDEKRDDHTSMTTVTATVTGPTEAPYMKREAKISKSVPIEKESAIQKREAKPMRSVMAISYEKVKRHKNRKERIYRKSLQRKPKAISAAKERRGVKVLGIILGCFTVCWAPFFTMYVLVQFCKDCSPNAHIEMFITWLGYSNSAMNPIIYTVFNRDYQIALKRLFTSEKKPSSTSRV

SEQ ID NO: 6814 - protein, 166 aa, Caenorhabditis elegans
MLRVLFFTLVALLCFVSPNCLPGDTPFEIYCFSYNRVHGTFNDSDAHCLKTVGGSLVSIHSMIENNWIQKLAVDNLDADYDLFWIGGSDEGHTNDWRWTDGSVLNFTNPGPGQPLEDRHCGAMQLSTGRWFSDLCTVKHQFLCQYPNGAYPTGGSYTCPPCPSCSK

SEQ ID NO: 6815 - protein, 506 aa, Caenorhabditis elegans
MASLNYREEFKNILQKLIDSPNEQHDPLTNFIGNEFARSEKLMDSVNPSTGKPWIKIPDGTAREVDQAVEAAKEAFKTWKKTTVQQRSALLNKVANLIEEFNDDIAILESRDQGKPIGLAKVMDIPRCVQNFRDFANAALYSLSTSTILEQPTGKFVNYVKNDPVGVAGLISPWNLPLYLLSFKLAPALVAGNTVVCKPSEMTSVTAWVLMHAFKLVGFPPGVVNMVIGEGKSAGQRLVDHVDVPLISFTGSTVIGKKIQEDGAKLNKKVSLEMGGKNPGIVYSNYRKSDIASIARSSFLNQGEICLCTSRLFVQKPIFADFVKSYVEEAKKFTVGDPTTQVQIGAMNSKVHYEKVKSYIELAKKEGADILCGGVTTIQNGCENGYFITPTVIVGLHDASKVMTDEIFGPVVCITPFDTAEEVIERANSTPYGLSATVWSSDSDELLNTANELRAGTVWCNTWLARDLSMPFGGCKQSGNGREGLHDSLHFYSDAKTVCVNIAAKY

SEQ ID NO: 6816 - protein, 1557 aa, Caenorhabditis elegans
MGQPQPAELYPSVDPNHFGADGNPCYDRATRQPQRCVPDFVNAAFNLEVQVTNTCGTKRPTKFCVQSGHTGQRSVCETCDDRHEGFSHPAKYLTDFNVGNNETWWQSDTMQEGQQYPTTTNLTLVLGKSFDITYVRLKFISPRPESFTIYKKTHTDSEWEPWQFYSGSCRATYGLSDRAPILPGNEATAQCTKEFSDISPITGGNIAFSTLEGRPSAHAFEESEVLQKWVTASAIRISLNRMNTFGDEVFKDPQVLRSYYYAISDFAVGGRCKCNGHASECVGSSSVDGENRLVCRCEHNTQGADCNECLPFYNDRPWRSGTSVEANECIACNCSQLSNRCYFDQQLFEETGHGGHCIDCQGNTQGVHCEQCIANHWRRPGENYCVACGCNEIGSLSTQCDNEGKCQCKPGVTGRFCDQCLDGFYDFSTNGCKNCGCETSGSLNNQPRCDSSSGSCSCKLNVEGRQCDKCKPGYFDLSTENQFGCTPCFCFGHSSICNTADGYFAMNVSSVFDQDKQKWAGQNRIGLQDTQWAELDKAVAVSDTDNSPVYFVAPEQFLGDQRSSYNQDLVFTLKVAKHVTNQDVKDIIIVGADRQELSTSITAQGNPFPTTEAQTYRFRVHADPYFGWYPRINELDFIGILSNITAIKIRGTYSYKDIGYLSNVNLGTAGVAPSAANPKQATWIEHCECLPGFVGQFCESCESGFRRETKFGGPFNHCIKCDCHNHSNSCEAESGSCICEHNTAGDTCERCARGYYGDALQGTEEDCQKCPCPNDGPCILHADGDVICTECPNGYTGRRCDECSDGYFGNPKDGTECVECACSGNTDPNSIGNCDKITGECKKCIFNTHGFNCENCKPGYWGDALIEPKGNCQSCGCFAAGTRRPNNDYTLLECNQQDGQCDCLPNVIGIQCDQCAHGFYNITSGLGCQECNCDPLGSEGNTCDVNTGQCQCKPGVTGQRCDRCADYHFGFSANGCQPCDCEYIGSENQQCDVNSGQCLCKENVEGRRCDQCAENRYGITQGCLPCDDCYTLIQSRVNVFREKVKSLDNTLQEIIENPAPVNDTKFDEKVKETSRAASEVWEAVKQKTKEGGGTIKTKSKAIKDEIVAALEKLTSIDESVAQAKVGADAAENDMKRWEIIIENARREIENVLHYLETEGEERAQIAYNASQKYGEQSKRMSELASGTREEAEKHLKQASEIEQLSEQAIANATQANKEASDAIYGGEQISKQIAELKEKQNQLNESIHRTLDLAEEQKKSADEANNLAAVSLTNVEAVKIPSVDPKELRNDVAGVLEESENLVDSSVKENSANDELFDEVNRSVADARNELQSSQDQQRVSDQLMLELEKSRERIVDSVSTADKTLKDAEAALQVLEEFGAKIEKSRNDAVAEFAGVEGINQRLDDIIDAQDKRRNSLPIDKQFVIDYRKSADVLLNETHALADRYKDIIHSDVDTRDSTEAVQYDIEQLMEELTDSNENLQYYKKQAEDDKQMATEAVRKQLLPRILPSKQMLPFSLRKMKSRKSSILWVLNLEEIRDNLPTKCFNVINLEQEGQK

SEQ ID NO: 6817 - protein, 1283 aa, Caenorhabditis elegans
MSNEKNKNESTNKTNEIGNAEKKEEAETEDKKSLKSMIYPIEPSTLYIDDLKNSKKAYDVTMDDPLDKSSDSKPKLGFFEPYKRLYAFADSIDMQLMAMGLFSALLQSALPPFVWLIMGNFVSISILREEGKLGLKNLTSDYPIDDQFAHSATPAFISMLGLSIAMFIAAFCQRIAWEISSIRQVFRIKKAYIRKLLLMDISWLESRQSGHVAAMLQEFEKLSAEHSKLTEERLRSSVVFDSLTQILLTELIFTGALCYGIWRVADNSPGRLCALAINMLYMCVTSISIGFHMNGATRAKDNAKEICEVLNEQPKIEVELASIDNNIDYVPVTRCKYRRQSMKFMGKGALHFRDIHFSYPSRKETEVLRGISFKVEAGEKIAIVGSSGSGKSTLTALLLRFYDPTKGAILLDGENIKTMCPDDLRGQCSLVSQEPVLFDGTISDNIRYGRLDATQQEINDAARKVGAWKFINSLPDGMQTRVGERGHQLSGGQKQRVAIARAVIRKPIVLIFDEATSALDNIHEEEVNAAIDLASEGLTTITIAHRLSTIKNSDRIIVLHEGKIVEEGVPDELIADANGIFHKMYNDQRLDQLTQQHQQLHQQQAKPPSLQQQMSFSPPPNMDPDQQRRAWARSSLGGNKKLGKSYSVNSMEKEKLKLPVMSKKKSERLDYKYSKVHSMDVKQHTDSMHDDDDLPGKETNFTVLKDLIYSYRTGLPLLAGAIPTTIVRAVFYLLICFQVASVLEISIAPDEERALQIFIVAAIYTALIIVKTIFEALGRIFIALYGHGFCKFMRNEMFRKVLRHGAAYFDEERNSPGRLVHKVINESSTLNEIMEQKLDMLIPGVVCSLFSIVCALWINWKMALLCSFQFPAYFVIRILQIREGTKRQRQMVDEEKKAANLASVVLANMSTIKAYNLQSHFYNVFCDALKPVSQCMQKQSLISALVFACQYSFTYILIAITLHFGKVMMLANEISVFDYMRVVLLTQFGANFFSQLIASVSDFTKAQIAAENVMRVIREPPVDMDNLSEEGLRPKLEGNLCLKDVSFRYPSRPIVPVLTNLNLKVRGGESIALVGPSGSGKSSVISLFQRMYNATDGVVIIDKYNIKSINPAYLRRCIVQVGQEPDLFSFTIKENIAFGMMESEATIDKVIEAAKIADIHNFITSLPQGYDTEVGEFGAQLSGGQKQRIAIARAIIRKPTVLLLDEATSALDSASEREVQNAFERVKRSTKTQCTCIQIAHRLSTIRNVDKIYVIVHGEIAEEGSHEQLINLKGIYYEMNQMT

SEQ ID NO: 6818 - protein, 811 aa, Caenorhabditis elegans
MDLDPNLVINHDDTNLSEASFTMEQHTSSYSDIHMGSTPCTGHRKVDMWRNHNFDSGFQTMNHSEAPSIISSLHPSSHLSGMSSMADYEPIPTLSDQQKQKFDGITQNQADGQYNTVRAIPELTMLMKDQDNEVVHKAVILMQNIAKMECDPMRRQNEARIVDPRVIFTLRDLLRDKVEFPNIIRCTLGTFFHICNRQEGIDLVTRAIAEQPDIIPNLIRHIGTYPSSIYKYAILTMHSILSDKQRGGQSVIIARQQDAITHVTPWLEAEKSEKLLPVIVDLIRVLCEKNTEQKIKFVKMGGPQKLLMLLQHRVYENLLWRTTQLLKTFSNFDAPNLVAFGGRQILANLLSHGSPRLVQSTLETLRNISDVPSKIKEDLLLKSLLELVNSRNTTIRLYSAQIMSNLVANNRHNKEFMCGNNGVVILVRALTIATKEMGDLRDKEAQQMEDYIESLICTLRHLCVGHPMSDKVQAFVFRDPALFLHKLLTMRPVLLKHTLSLLLKVVSQHALLAPFRSCRIGDKGFVEQLIHILRVACTQLNVQESIEGVRVKDIIHLCIQILRWITRDQDILNEVVFFLQTPENSRMGDGHTLPIFVLQKANVEENTKSSALALIYNLMHHEQMANVLDRDDVLVKMLQNVQMQSQTHPELASLANNILKMMYEKREKTRNTLPRYNSYLESQFGHMSMTTPRSEALNSSGEVCEGAGEQWSTPLTDDTMMDSYCNSSGRDSSKPYNSPMYHSPPAMYPEYSIGPPETYLDPHATASCYPRPTPPQYNSYDRSPPVYNDLPSNPGPSSHSSDYYPSRNSRF

SEQ ID NO: 6819 - protein, 504 aa, Caenorhabditis elegans
MADDSENFVLTVDIGTTTIRSVVYDSKCKERGSYQEKVNTIYTTRNDDEVLVEIEPEQLFLQFLRVIKKAYETLPPNAHVDVGLCTQRNSIVLWNKRTLKEETRIICWNDKRANNKCHNLNNSFLLKATQRLKFLGGMVSHRLMVTIDRSEKLKLMKADGDLCYGSLETWLLMRSSKSNILCVEASNISPSGMFDPWIGAYNTLIMKIIGFPTDMLFPIVDSNLKDMNKLPIIDSSHIGKEFTISSIIADQQAAMFGCGTWERGDVKITLGTGTFVNVHTGKVPYASMSGLYPLVGWRINGETDFIAEGNAHDTAVILHWAQSIGLFNDVTETSDIALSVNDSNGVVFIPAFCGIQTPINDETACSGFMCIRPDTTKVHMVRAILESIAFRVYQIYAAAESEVNINKNSPVRICGGVSNNNFICQCIADLLGRKVERMTDSDHVAARGVALLTGFSSGIWTKEKLRELVTVEDIFTPNYESRKGLLKTFQTWKKAVDRCLGFYH

SEQ ID NO: 6820 - protein, 377 aa, Caenorhabditis elegans
MLREAYSTSLHCVQAQEGMSVSPDVIAKIEEGYAKLQAAPECHSLLKKYLTKEVVDQLKDKKTKLGANLLDVIQSGVANLDSGVGVYAPDAEAYTLFKPLFDPLIQDYHNGFAPDAKQPNTDLGEGKTSALVDLDPEGKFINSTRIRCGRSLQGYPFNPCLSEANYLEMESKVKAIFDNITDPELAGKYFPLDGMTKEIQDQLIKDHFLFKEGDRFLQAANACRYWPKGRGIFHNNQKTFLIWCNEEDHLRIISMQEGGNVGQVLERLIKGVKTIEKQAPFSRDDRLGWLTFCPSNLGTTVRASVHIRLPKISAKPDFKSICDGLKLQIRGIHGEHSESEGGVYDISNKARLGLTEFEAVKQMYDGIAHLIALEKAA

SEQ ID NO: 6821 - protein, 700 aa, Caenorhabditis elegans
MTAVSANGKTTEKHENGAHTNGTTNGTTNGSMNGNEISHVQKLQPVYYKPPQNLETFELSLRNHFEEKTNKKFADYREFHRFTCDNYGIFWEDLLKLSDVKLHQNYNQVIDHNLKINERPRWFNGATLNYTENVIERGTATDIAVLNASIEETVTEYTYDNLRKDVYRIATSLRNYGIGPGDTVCGFVPNTYDTLVAVFATAAVGAAWCSASVDFGPAGVLDRFRQVHPKVLFTVNHVTYKKKLIDQTDKINEIVKELPTLEKIVVSDTFTSVKFDATKYNQSDKFSSLEEFKTPIADVVLPFVYTPVPFSDPLFVMFSSGTTGIPKAMVHTVGGTLLKHIEEHLVQGDSKKHDRMFFYTTCGWMMYNWMISFLYSKGSVVLFDECPLAPDTHIIMKIAAKTQSTMIGMGAKLYDEYLRLQIPFNTLYDLSKIHTVYSTGSPLKKECFAYINTYIAPGALIASISGGTDIIGCFVGGIKSLSITPGECQCLFLGMDIKSFNYMDEEIINSDEQGELVCVTPFPSMPSHFLNDTDGKKYRDAYFARLEPFWAHGDFVRVNHSTGGVEMLGRSDATLNRGGVRIGTAEIYSVVEKIPHIADCIVAGRLVEEGMDEEVLLFVKMVPGQELTHSIQAAIVSKLRNDMSPRHVPNKIYAVDDIPYTSSGKKVEVAVKQIVSGKAVQKASSIRNPESLDHFVQYRL

SEQ ID NO: 6822 - protein, 317 aa, Caenorhabditis elegans
MSSATASIKLSNGVEMPVIGLGTWQSSPAEVITAVKTAVKAGYRLIDTASVYQNEEAIGTAIKELLEEGVVKREELFITTKAWTHELAPGKLEGGLRESLKKLQLEYVDLYLAHMPAAFNDDMSEHIASPVEDVWRQFDAVYKAGLAKAVGVSNWNNDQISRALALGLTPVHNSQVELHLYFPQHDHVDFCKKHNISVTSYATLGSPGRVNFTLPTGQKLDWAPAPSDLQDQNVLALAEKTHKTPAQVLLRYALDRGCAILPKSIQENRIKENFEVFDFSLTEEDIAKLEESKNSQRLFLQDFMTGHPEDAFAAERK

SEQ ID NO: 6823 - protein, 202 aa, Caenorhabditis elegans
MGFHGNIIRYSFTPLILLFARHSATASSLLDSSSGLTPVAAPQPATLGGQQAWTNELAPGRLEGALRDSLKKLHLEYVDLYLAHMPTAFSDDMSQKIESSVEDIWRQFDAVYKAGLAKAIGLLLHLSCVMKMCWISLKKYHKSPAQILLHYALERGIAIIPKSVNETRIKENFELFDFEPTQNEISKLEGSKISQRLFLQDL

SEQ ID NO: 6824 - protein, 490 aa, Caenorhabditis elegans
MEVKDIDNYCDRGISPNASNYLTYPFDGLCLQKFFYQLQTSLRRFTPYEEIIYTTVYIIISVAAVIGNGLVIMAVVRKKTMRTNRNVLILNLALSNLILAITNIPFLWLPSIDFEFPYSRFFCKFANVLPGSNIYCSTLTISVMAIDRYYSVKKLKIASNRKQCFHAVLVSLAIWIVSFILSLPLLLYYETSMLYVMREIRVVDQSGQEVIRSYGWRQCRLVSAGRLPDITQSIQLLMSILQVAFLYIVPLFVLSIFNVKLTRFLKTNANKMSKTRAPPKRFDRSDSHHNSLKNNNNHTSSLRSPSMPSIRSSITERNKTNQRTNRTTSLLIAMAGSYAALWFPFTLITFLIDFELIINQDYVNLVERIDQTCKMVSMLSICVNPFLYGFLNTNFRHEFSDIYYRYIRCETKSQPAGRFHHDVSSIAHHRQDSVYNDEATLLTTGRQSNGKDGSSSPIGFRSSVRVCSGQTKMIGDRIVLDDDIEKDSFV

SEQ ID NO: 6825 - protein, 505 aa, Caenorhabditis elegans
MERDFDLGMGRPGGLGGLGGEPIMQQMPQPAPHHPSRSSNDHNVKNLMKQAEENSGYLTLQGNRRKADLKELQFVEDIGHGSCGTVTKCRYKSVIMAVKTMPRTSNSYEMSRILMDLDVICLSFDCPYIVRCFGYFITNFDVRVCMECMATCLDRLLIRIKQPIPERIIGKLSVSIIKALHYLKTKHQIMHRDVKPSNILLDWSGVIKLCDFGIAGRLIESRAHSKQAGCPLYMGPERLDPNNFDSYDIRSDVWSFGVTLVELATGQYPYAGTEFDMMSKILNDEPPRLDPAKFSPDFCQLVESCLQRDPTMRPNYDMLLQHPFVVHHEKIETDVEEWFADVMGDDSAYHNSNEISNLTDQYAQSLQQQIQLLQIENAFLKEQQVKREENEQERIRNIEMEEQYRADKFRQEQQAKEFEDLQHRRESVSQINQSRRGTTTQILARGNEVSINGETWCQLPPHHPPIPAIISDRSQYSQRIGRDRVSRLIIGFCSKTKLIKCKNRR

SEQ ID NO: 6826 - protein, 488 aa, Caenorhabditis elegans
MQKLNWKLLILSAVLAITAIFQMGYTNAYPNTAIGSFRIFLNESANEPYTLSNSEFEWAWSAMLAIYFIGFAAGSVISAGVADRIGRKWTLFLGTCGSLLSSLIALFAIILKMPLMFGFSRLVMSLSAAISMNGLILLFQESSPSHMRGLISFNAEMAFVITNLIGGLFGMQSILGQNIVGLIAVSIIPSSVACFLTVFLKESPKYLFLKKHDATEAGRALQFYQNIKDEEEKMNVLNDLKLEKEEMGHQKNGSLFDIMANQPVRRGFLLGLATMQLTASVWPVVFYSTDFLMDAGFSYELSESVSTGMLFLSSLSTIVGMFIVEKYSRKWLLIGTASVNIAAILVFSLSAILSHYWTWIGYGCIICLILHGISYSVAMGPIAWFITSELVPINFRAASQSLVLALNHTVALVLAFLTFPLYKTIGPITLVIFFVIPGILCIIMLILYLPETKDKHINVIVEQLRETKAKRKESQKLETEESIGMNKL

SEQ ID NO: 6827 - protein, 426 aa, Caenorhabditis elegans
MTAEITLTACVSEKVKNKAVEKKDDRNERELAKHLLDDYYQYTRPVRNYSSVLNVTVQPQIYNLVEVNEQNEQIKILLWFPQSWKDDYLTWDPKEWNGIERIIIPKSQIWIPDGYIFNTVEETEPLENHNARVRYDGRVEVDFNKLVDLTCPMSVLSFPFDVQLCALQFGSWSYQAHAISFNVLDTFVPKKSKNSEWDIVSFNATKMTTKYGDTLGGFNVYEEIFYYLELRRKPLYYIVVILLPSFLIVTVSNIGLFTPHGVHGDREEHVSLGLTTMLTMAVILDMVTGQMPRSSEGIPLLGMYVLIEFVISVIAVLVSVVIIFAHERMLYLDATPPYWVCKLFSDDCKMSLEEIEEDFCSKPADLVQELRFCMEEIKRYLDEQDSTEKNRIIWQRFFSWTDIIFIGHNLLYGFKILEKMITKLSY

SEQ ID NO: 6828 - protein, 2195 aa, Caenorhabditis elegans
MGEHYSDGRQSDSCTKNIMVRHSPSSVVSTAIAADPESFALRSQFVCAAALMLMSAPNANRLFNSLKNLNRLNHAVIVLKIMLQNEIMADHRTINQSFRGNFFRRRNYDGPRAYQIAPDLTCSYDNQCAGYPLAICHSVCQCVKGALNTGTTCIASSTAIQTSVACPAGQTYIREAGVCMTVQQPGEPCQYSQQCSALEPGAYCLKMRCECVYGMKKSSNGCTFVNNDCKERGHIFISEIGECREVFPPGGKGCSHNLQCSGAYPDATCFMQTCTCPPNLPVAADGTCGRSCPNNQVYSGVTGECLPEKQPGQDCIYSSQCQASFGGLVCDKNTCRCPNGLVFDGLKCSHGCPPHKRVIDKEICVEGCPSGIVEVAGRCVKQVSIGQPCVANAQCNFGSFCQSGTCQCPPGFYVQDEQCQAIESEPNESCQNNEKCTKGSVCYNGKCSCPRNHELINGHCQQNRAAAHAYNTALENIRKIRLRFASQSKSRNSSPQLTDVENDNDTVPIGSACVRIGVTCDGGSVCVAGICVCPLGKTPRNGVCIEHVAARPGTSCQNEEECVDHSYCSPETNKCECMKASQMVIGGECRERLKAHPGYGCTMGEMCVGNSVCVNGKCACVDGKVEINKICIDQVSAKPGDTCGKGIICEGGSYCNTDSGKCACRRGENSINGICKGFTFVYPGDLCTDITSRCTGGSYCARGRCECPPRMSAIDKKCVHQQTAAPGEPCSEKVACSPFSVCENNVCKCVNNMMIRDKMCVQRRKVNIGNSCNNEDQCLGNSTCMDNNCQCGIGFVASMDVCVLRKTGKPNFLTPGYLCNPEDICTGQSVCIKGVCQCQPDYKQMHNICVKKNIGIEGSPCSSRDDCGEGLMCGASGKCSCPEGLFSVNGKCRSYVQLGQTCTSDDRCAERNAQCQENYCTCRTGYTNINGQCAANIVTPAEPETLSQVKCMSYQFLFLSPSGLLGHICTSNDHCKIAHSQCRRNVCQCIDGYRIFGSTQCIPRPGKPKERKTEKESKLVELGDKCDKLSLCSKGAICEKGVCSCPETFFESDGACVKNVAKIKVVVPPLSSCLGGEECSGNSECVHGICFCKEEFTLFEGKCQRLRIIEKLTVLESKKLIKPIKAHTTPTAASNTTPIPVKTTTTLQTTTATTLPENYVSSSTNRPLTPIIISMKLGSTSSPSPQITSNPEYKWRLSKPGHMCDNKTHCTNCSVCVNGFCRCPEGLVHYGDKCVSEIDATKCLASNQCPSGAQCVKGECRCKPGLGITRYGFCVPITFAEPGTSCAYGEHCQKDSHCEDGLCTCNEPLVLKENKCVVSPREKRFISDVHRKLLRFTPKKLAKLGEYCFRNSHCESQRQCLKNVCKCASNFVQSSFSCVPRMSVISSLALPGESCRKGFCVGGSTCENFMCKCPDDYFKKGDSCVRYESRIGAACGTASGCSGGATCTSSFCQCQDQYDADVDECYPYEPSVRSRNVKAISGRRKVNRVVSASTINCPIGYDLVNGMCVNSETLSVIQLAAPGGACEDGTILCTGNSVCANNVCICPGGETVQNGTCVSINTYSSPGDPCDLTNTICTGNSQCIDGICKCPNNQGAINGRCSNMGNANCGNIQCGTNQICIQDSCQCRPGYYQQPGSCLQDRCNCIQEVESDSCLNRQCGMNQVCIQDQCQCRSGYLVLQETCISDRCNCVQPSVDAISGGCMNQCGNNQVCIQDQCLCRNGYYAQPETCTGDRCNCVQHVVPDMGNCQRQCGNNQVCIQDQCQCRNGYYAQTETCVADKCNCVQRAVAIPSPCVGNGCAPSAQSQSYLQFIGLPGKMCDLRPNAIPCRNDAQCVNNYCICPSNRVISGSNCVFYLGDALPGQSCQNNGMICRGGSSCNQNICQCAVGFSVDNGRCTPTIEVRFTMLPVTTAIPVFIIELNPGQTCDPSCAYQPCMQRCSGGSSCSNSICSCPQGSGVLNNVCSPSFPQNDNYNLTRTARPGDSCDNTIVCIGGSSCLIGTCLCDSGYEPSSDRSSCVLNDRYNVRSRSYPKTFCTFDSECTGGSICIDKRCACRNDHEMINGVCQLANLPGSRCHTSFCSKGAECRNGYCVCAKTNYSDSTLDCVSSINANQGSMAYPGSKCNATTSCQQNSSCFFGYCVTPQDEIDREANIKIRHIEKKKCGSYKDCGKSQTCSSDRLCECTFNTNLVNGECV

SEQ ID NO: 6829 - protein, 347 aa, Caenorhabditis elegans
MDSPQEEDVEVKKKATEVEYVVRSLASDEPAPFSDEALAITTREAVDYSKKITLAMAEANEAGRPVRIYADGIYDLFHHGHANQLRQVKKMFPNVYLIVGVCGDRDTHKYKGRTVTSEEERYDGVRHCRYVDEVYREAPWFCTVEFLKNLKVDFIAHDAIPYVAPGEEDLYEKFRREGMFLETERTEGVSTSDVVCRIIRDYDKYVRRNLQRGYSPKELNVGFLAASKYQIQNKVDSLKSKGIELLSTWKSKSDDIIRDFIDTFHKDGGLNAFGGRLKGIMSMSRSPSPSPHEGSPTGIEHHLETQDEEEEEEALEEEKVVEQKIVEKKEVVKKRSSRNKAKTPLEY

SEQ ID NO: 6830 - protein, 724 aa, Caenorhabditis elegans
MLRAASSIRAVANRGLATAAVARPGVPLDEREGKEIYTTVGIDYNEPKFDKILIANRGEIACRVIKTARAMGIKTVAVHSDVDSNSLHVKMADEAVCVGEAPTAKSYLRADRILQAVEDTGAQAVHPGYGFLSENTKFAAELEKAGAKFIGPNSKAILDMGDKIHSKKIATAARVSMIPGYDGEIADEDMCVKVSRDIGYPVMIKASAGGGGKGMRVAWNDKQAREGYRLSKQEAASSFGDDRMLVEKFIDNPRHIEMQVLCDKHGNALWLNERECSIQRRNQKVIEEAPSSFVPPEMRRKMGEQAVQLAKAVGYDSAGTVEFLVDSQRNFYFLEMNTRLQVEHPITECITGIDIVQQMLRVSYGHPLPITQEQVPLNGWAFESRVYAEDPYKGFGLPSVGRLSRYVEPKHVDGVRCDSGIREGSEISIYYDPLICKLVTHGDNREQALNRMQEALDNYVIRGVTHNIPLLRDIVQEKRFRTGDITTKYLPEVYPEGFQGTSLSPKEQDVVIAFASALNARKLARANQFLNQNKQRSTHVASFSKTYKFVSSLPVKEGERPTEHAVEVEFVEGSANKAQVRIGGKTVTISGDLNLSHPVNSIEVDGEHITTQIVGKRAGEITVLYKGTPFKVKVLPEQAVKYLQYMKEKAKVDLSTVVLSPMPGAIKNVNVKPGDMVSEGQELVVMEAMKMQNSLHAGKTGRVKAVNVKVGATVDEGEVLVELE

SEQ ID NO: 6831 - protein, 482 aa, Caenorhabditis elegans
MINTRSCRYVALSTSDKDSNQIAMVIPSTRKGHAASRDNFGNSNHHGDEIVHRLNNGRRSEIDEVKPDLVSGAGDTVIKLNVGGTSFRIRISSIFARSADEKLSAFAQLNHEQRLQACDAFLMVGEAPPQEEYYLERSAVLFDSIFKYYISGQLHRPLDVCPTEFATELAYWKINDGLMSNCCWRGYNMSPSLEELVAPKEKKIELHDRSMRSRIHQFCEGDGSLFSTLFTFGSITFVLISVIGLVLGSIHEFQVPIYKKGGKSERISNWSIVENENIIWEPHPIFGYVETVCIIWFTVEFIVRLAVTPNRFQFLVGIMNIVDMIAIIPFYLELGLALFGIDVASLSDIKGALLVVRVLRVLRVVRILKLGRYSSGMRTFALTLKSSARQLGMMGMVLSTGVVFFSTLLYFVEKDEKDTPFTSIPAAFWWAIVTMTTVGYGDYVPVTVPGKLIASGAIISGVLVLALPITIIVDNFMKVSGK

SEQ ID NO: 6832 - protein, 398 aa, Caenorhabditis elegans
MDLSIKEEDENWIVSEIRQANVICVVYSVTDESTVDGIQTKWLPLIRQSFGEYHETPVILVGNKSDGTANNTDKILPIMEANTEVETCVECSARTMKNVSEIFYYAQKAVIYPTRPLYDADTKQLTDRARKALIRVFKICDRDNDGCLSPSELQNLFSVCPVSVITKDVGRAGNTLDSIRVTRERKKDLENHGTDRKVFQCLVVGAKDAGKTVFTQSLAGRGMADVAQIGRRHSPFVINRVRVKEESKYLLLREVDVLSPQDALGSGETSADVVAFLYDVSNPDSFAFCATVYQKYFYRTKTPCVMIATKVEREEVDQRWEVPPKEFCRQFELPKPIKFSTGNIGQSSSPIFEQLAMMAVYPHLRRVFYLNDSNLLSKITFGAAIVALAGLQHQSLAV

SEQ ID NO: 6833 - protein, 441 aa, Caenorhabditis elegans
MREIVHIQAGQCGNQIGSKFWEVISDEHGIDPSGQYVGDSDLQLERINVYYNEAGSNKYVPRAVLVDLEPGTMDSVRSGPFGQLFRPDNYVFGQSGAGNNWAKGHYTEGAELVDNVLDVVRKEAESTDCLQGFQLTHSLGGGTGSGMGTLLISKIREEYPDRIMNTFSVVPSPKVSDTVVEPYNATLSVHQLVENTDSTFCIDNEALYDICFRTLKLTTPTYGDLNHLVSATMSGVTTCLRFPGQLNADLRKLAVNMVPFPRLHFFMPGFAPLTSRSNQQYRAITVPELTQQCFDAKNMMAACDPRHGRYLTAAAIFRGRMSMKEVDEQMLNIQNKNSSYFVDWIPNNVKTAVCDIPPRGLKMSATFIGNSTAIQELFKRISEQFTAMFRRKAFLHWYTGEGMDEMEFTEAESNMNDLVSEYQQYQEAAADEDAAEAFDGE

SEQ ID NO: 6834 - protein, 343 aa, Caenorhabditis elegans
MERKGRERKLPGMKIVMPTPVETPTMNLEDRCLIKLTNESEEIEIAATDLVVLEELGKGGYGIVEKMQHRQSGIIMAVKRIKSSINDQSQKQMLNELDACRRSDCCPQMVRFYGAMFREGDVWICMEVMDTSLDKFYRHAYKIGKHIPEPFIGKMALSVIEGLNFMKEQLNLIHRDVKPSNILLNRHGQVKICDFGISGHLTNSMAKTVQAGCKPYMPPERIDGETKSAYDVRADVWSLGITIIEIAVGTHPYANWKTPFEQLKQVVKEPPPKLPMESGFSVDCQYFVKRCLEKDYNERPKYPELLAMPFMEQARNEKQFSMARFINEVRFAAIKKTIFLLKN

SEQ ID NO: 6835 - protein, 463 aa, Caenorhabditis elegans; identical to SEQ ID NO: 5761

SEQ ID NO: 6836 - protein, 1657 aa, Caenorhabditis elegans
MQADRGLFHFEEMTYWSSTSKFGNKFWVIIKFPYSVKRTRSVLGRRTSAITVNRRQSQSTRRHEDVEALGSIEGSKETLQLSEHGRLASSSEASPSRWEGRQIEWGNEEQIEEESELPYPGFAEPALRCFYQARPPRKWALQMVMSPWFDRITMAVIMINCVTLGMYRPCEDGPDCDTYRCQILDIIDNCIFVYFAFEMVIKIMALGFYGPAAYMSDTWNRLDFFIVMAGIAEFVLHEYLGGNINLTAIRTVRVLRPLRAVNRIPSMRILVNLLLDTLPMLGNVLLLCFFVFFIFGIVGVQLWAGLLRNRCVINLPKTISENQSALFNNVKLTRFYIPEDTSLEYICSQPDANGLHTCSNLPPYTVDGVKCNLTLDEYDKVTNDSCINWNIYYNECQVNIYPSLMTIAISCFIKVMQRNPFQGSVSFDNIGFAWVAIFLVISLEGWTDIMYYVQDAHSFWNWIYFVLLIVIGAFFMINLCLVVIATQFAETKRRETERMLQERKMLLNRDSISCTGSEIGGASSKEEGDTVYAAFVRFIGHTFRRTKRAAKKKYTAYMEERAERKSSERQQRRKSKLDDMATLSRIEEKAEDEEDETTITRENGDDQIEQNGDGVRIKRVKIEEEPKIKIGNGNSNGPHYKHSSSDEESDEDGEEDQVYDGEEAKKKSTPSKLWWFREKIQKFVICDHFTRGILVAILVNTLSMGVEYHQQPEILTVILEYSNLFFTALFALEMLLKIIASGLFGYLADGFNLFDGGIVALSVLELFQEGKGGLSVLRTFRLLRILKLVRFMPALRYQLVVMLRTMDNVTVFFGLLVLFIFIFSILGMNLFGCKFCKVEEKFLGGLAKKCERKNFDTLLWALITVFQILTQEDWNMVLFNGMAQTNPWAALYFVALMTFGNYVLFNLLVAILVEGFQESKEEEKRQLEEDARKQAVEEEDERKRELELIIAKTTSPAFNNGVAPAECTCQRPSSPEESPSPRLLSANYHPSPERKHSANLDAIIDKRLVLRNSAPFDRSPVSEGRDDSRLNRHASLVLPVANGVPYRRQRVHSWKASQELKQALAEEEKRNEAKQNTFVRKLLKKTCLHNRTEFSLFLMGPKNPLRIKCLQTTQKKWFDYTVLFFIGINCITLAMERPSIPPDSFERQFLHISGYIFTVIFTGEMMMKVSHRIPTLKPIGNIVLICCTFFIIFGILGVQLFKGMMYHCIGPEVGNVTTKADCIEDYRNKWVNHRYNFDNLGQALMSLFVLSSKDGWVSIMYQGIDAVGVDVQPIENYNEWRMIYFISFLLLVGFFVLNMFVGVVVENFHKCKEALEKEMREKEKEKRLKRKLKRQKFEESMAGKRKKNRIVWAGSAIKSIFSVERNYPYYHDYGHTRLFLHGIVTSKYFDLAIAAVIGINVISMAMEFYMMPMGLKYVLKALNYFFTAVFTLEAAMKLIALGFKRFFIEKWNRLDMFIVILSIAGIIFEEFEALELPINPTIIRVMRVLRIARVLKLLKMAKGIRSLLDTVGEALPQVGNLGSLFFLLFFIFAALGVELFGKLECSEDHPCDGLGEHAHFKNFGMAFLTLFRIATGDNWNGIMKDALRDDCDSSDHCETNCCVDPILAPCFFVIFVLISQFVLVNVVVAVLMKHLEESNKRDAEGPAEPTGFSFFHF

SEQ ID NO: 6837 - protein, 253 aa, Caenorhabditis elegans
MFAIALLSFLVVLINAHPPMHAEMHSAVVTLANEIDTNYLTSPAKIKIVAPLESALIPGGETYQLRCDIMSTPAATIHWKFNGKLIQGSNELNVEEKLLNFGKAIVDTGIVASILTIQCPSAENSGTYSCVGYNGHQTIETVAEVEIEGEASGCRSNHKSAPEIVFWTDSRFEMTGNVATLVCRANQQVDWVWMSNDELVKNNDKFTVLSNGDLVIKNIVWDDMGTYTCIARNQFGEARQETFLYPTAKKSSF

SEQ ID NO: 6838 - protein, 228 aa, Caenorhabditis elegans
MEAVAEHDFQAGSPDELSFKRGNTLKVLNKDEDPHWYKAELDGNEGFIPSNYIRMTECNWYLGKITRNDAEVLLKKPTVRDGHFLVRQCESSPGEFSISVRFQDSVQHFKVLRDQNGKYYLWAVKFNSLNELVAYHRTASVSRTHTILLSDMNVETKFVQALFDFNPQESGELAFKRGDVITLINKDDPNWWEGQLNNRRGIFPSNYVCPYNSNKSNSNVAPGFNFGN

SEQ ID NO: 6839 - protein, 300 aa, Caenorhabditis elegans
MVAEIVSGLEYSKKVLHDVGQKIAKTREHHPNFHAVLAIVQVGNRSDSNVYINSKLKKAKEIGADGKLIKLPDTITQGDLKREIMALNHDNEIDGIIIQLPLDCKHEIDADSVIDLIDPLKDVDGLTRINAGRLARGELQRTIFPCTPFGCLYLVQQATGDANFVSGKEVVVLGRSKIVGSPAAALFLWHHGTVTICHSKTPNLKEKCLRADILIVAIGRKHFVKADWIKPGAFVIDCGINVGDDPNSRKIYGDVDTEAAKEVAGFLTPVPGGVGPMTVAMLIRNTFEQAKRRRLGQKVK

SEQ ID NO: 6840 - protein, 155 aa, Caenorhabditis elegans
MPRKLLEERSTGSATKWLREEEKIEKKSRADQLKIKFMQTRDNSDINSIFSEPPSEFSVLCDDDDCDKGSVVSSTLTTSIRKTFSSFRFDENQRKKGTRKRRSSEKGRICRRKVHIILARNMLRKENELYKKDAEYCQTPRAVADGCSFSTLPTI

SEQ ID NO: 6841 - protein, 314 aa, Caenorhabditis elegans
MAITASWNEVTIQFETIEFDKQAPIIGRGRFGKVLRGFHYGDVAVKVYTMEHISDASKKAEEFKLEVSAYKNTRHDNIALFLGYFMSDGQYGMVMSLSKGSQSLYTLLHVVREKLDLATTRKIAQQICQAVSYLHTKKILHKDLRSKNILLESKNKVVITDFGILSMKRLAHPKQKSGYLTSKFWTNYIAPELAMAMRTEYDEYECDDFPFSENSDVYAFGCVWFEMLTGALPYAGELPHQILFAKTQGIRPVLPNVKCTQELKELLVSCWNTAPQDRPTLTDINLKLTALPKKPRVNRSPSFPVMMKSYESTF

SEQ ID NO: 6842 - protein, 259 aa, Caenorhabditis elegans
MLILLSFFVFQRLNHKMENLKHEQMFNDFILKFDRKYTSVEEFEYRYQIFLRNVIEFEAEEERNLGLDLDVNEFTDWTDEELQKMVQENKYTKYDFDTPKFEGSYLETGVIRPASIDWREQGKLTPIKNQGQCGSCWAFATVASVEAQNAIKKGKLVSLSEQEMVDCDGRNNGCSGMNVVKAMYSYRSGIFNPSVEDCTEKSMGAHALTIIGYGGEGESAYWIVKNSWGTSWGASGYFRLARGVNSCGLANTVVAPIIN

SEQ ID NO: 6843 - protein, 305 aa, Caenorhabditis elegans
MLSAMYNFLIKQRVDNYGKKTVAISGCDSGFGRLLAVRLVKQGVPNGESLKKEVNTPSLLTFGILNVANDESVKEFVKLVEKTVENRGLWGVVANAGILGNSGPDDWLSAQDYINTMQVNTFGVMRFIQGLKKFVKKQEGRVVIISSISGRTPRPTVGPYCVSKHAVEAYADVIRHELIDFNVSVHLLEPGFFTTNITQTATNDLDAVWERLDDETKKEYGKEFYDDYKNSRFSRLSHCADDLNPVIDAYDHALLGKYPKTRYWVGWDTILFYIPLATLPTFAQDWFISFQRCSRPVPASMKNHH

SEQ ID NO: 6844 - protein, 130 aa, Caenorhabditis elegans
MRTILIDWFSDAVREYIFRNEAVHLAVSLVDRALPMFNINKMRFQLVGITSMRIAVKYEEIFPPILSNTRHSFDGAILYWKVRLHRRNAHTILDRIMLCTENELYKKDAECCQTPRAVADRFSFSTLPPI

SEQ ID NO: 6845 - protein, 646 aa, Caenorhabditis elegans [sequence omitted]

SEQ ID NO: 6846 - protein, 568 aa, Caenorhabditis elegans
MSKLNPRVAHNPVLSRIIESGRTNLPSGITSAGSLSAYAQAAAVTIRDNRDREKREIADLNNRLARYVEKVRFLEAQNRVLENDIGLFRQAAHIHTGKVRDYYDAEKTSLATLVREQEAKVSSAKQNIRKLEPEITTAIRTLASSLEHRQRVRSDKKEQLKHLSDLESETAYIKRLINDCDDEKSHLKTEISRIRGEIKRILALRDKERNGFSRSQTAAQDLLKKLNATISTHEIAIREEINKARRDSTDKNREFFHRELHMSMKEIRDQFESDSKKARKTWEEWYKKKITEIKKRSEKFSLTQNQAREEVLRIRSLLNELRTKISDADSMTQALSKRIEDMKFREDEELRMFEQSLTEKELAVTRMRDECAKLSVELETLVENQINLRSEIAHYRKLMEQAENLRTSYQSDFVIDTPSPLMRTSSHHYGSSYSLNVRDTHNKTVHHDNYDISSASTINTQQFRSYGKGDVKIIEHKDESIVIENSNSYKSKDLSNWKINHYVNGALTGTFILPVATHIHPHEKISIHSLKSPNLMDDIVATQIYSFDFSKNTKTVLLDDVDDVSQFH

SEQ ID NO: 6847 - protein, 655 aa, Caenorhabditis elegans
MREMPDSPKFALVTFVVYAVVLYNVNSVFWKFVFIGYVVFRLLRTDFGRRALATLPRDFAGLKLLISVKSTIRGLFKKDRPIHEIFLNQVKQHPNKVAIIEIESGRQLTYQELNALANQYANLYVSEGYKMGDVVALFMENSIDFFAIWLGLSKIGVVSAFINSNLKLEPLAHSINVSKCKSCITNINLLPMFKAAREKNLISDEIHVFLAGTQVDGRHRSLQQDLHLFSEDEPPVIDGLNFRSVLCYIYTSGTTGNPKPAVIKHFRYFWIAMGAGKAFGINKSDVVYITMPMYHSAAGIMGIGSLIAFGSTAVIRKKFSASNFWKDCVKYNVTATQYIGEICRYLLAANPCPEEKQHNVRLMWGNGLRGQIWKEFVGRFGIKKIGELYGSTEGNSNIVNVDNHVGACGFMPIYPHIGSLYPVRLIKVDRATGELERDKNGLCVPCVPGETGEMVGVIKEKDILLKFEGYVSEGDTAKKIYRDVFKHGDKVFASGDILHWDDLGYLYFVDRCGDTFRWKGENVSTTEVEGILQPVMDVEDATVYGVTVGKMEGRAGMAGIVVKDGTDVEKFIADITSRLTENLASYAIPVFIRLCKEVDRTGTFKLKKTDLQKQGYDLVACKGDPIYYWSAAEKSYKPLTDKMQQDIDTGVYDRI

SEQ ID NO: 6848 - protein, 378 aa, Caenorhabditis elegans
MLQACLNTTEDQCDCLAFNCPIVYSHSESEKEACYMEHCFISKRALDDVTLYKVTALYIFIFLVGVIGNTTTCLVMKKHPMMKTHASMYLMNLAVSDLVTLCVGLPFEVMMNWNQYPWPFPDYICNLKALIAETTSSVSILTILIFAIERYVAVCHPLFLMKVQPFKRNIGTIIGFTWIFSILCAMPFAIHHRADYIMKSWPGTDNRIPVKSSKMCMIAVMFEPKLASTFKILFHFSAIAFFALPLFTIVILYARIACKVSSNRTIQPGELDITEELQMRINAILCAIVSAFFICYLPFQLQRLLFFYFDNEVILTWVNQYMYFISGFLFYLATIINPIAYNLASSRFRRAFKDILIDYCWRGGSERYPRSSFSKYSL

SEQ ID NO: 6849 - protein, 1039 aa, Caenorhabditis elegans
MNGEWKSALRLQIEALAKRNELHRKSSVDEIKKRTVDMDKRIVKLRELVGSSANDAALFYLECVCHADETERLLNRGSSVGKEKKWKKVKRKTSSSVAPPLSRTISSLPGVSSPDVIQTIDVSALEDQTPQRPHWWDQFQLYRRTDLLRFSKQNDRRELWRTQKDFFLSCLGFMVGVGHTMRFPAKVYQHGGGVFFIPYLFSLIFFGLPLVFLHLSLGQYTGQAANTAFQRLMPIGSGVGWALVVIAIPVAVYYNIIVAWAIHYFFQSAKGLLLGDELPWETCRDGELFKTQNNHNWNDPNIEWQLDNRCCNLHNLHSCFNSTNSITAPEAFFHSEVLSLSTFGDFALGPLQSHLVLSLAAAWLLVFFGVFKGLGSIAQTMNVTATVPYLLLSILLLRGISLPGANKGLTFLFTVDSTKLWKWQIWKSAAEQVFYELGIDAGPLISMAAFSRYRNNIYRDSVLLVIMDALTSCLSGMVIFSFVGFIASESNSNVNDVLKHDPLYLSFTVYPGVTSFMYWGGLWATLFFGMLVLAAIDAEFAWLEMIASAFMNHFSMKNKAVENRLLAFLCLAGFFLGLPLCAQGGIFVFHAIENLNANWNSFSLALLSVAIVCYVYGIDNYLTDISAMLRVPRIQISKATRLKEKLIYFFGPGGIYIKFSLCFICPVILTVLLVASVLGYQRISFAGRPIPIDYEIVAWIVMIGPLLVVPLVAFMQIRQIRNEGKLLKSLFDTSEWRESQDDSLEPKDLYMRQSGKFESPPNRRRTPTIFTHRENTYMYIDSRGPTVRSRVFPLGASLDPYGWKAGRLRDRQQQIEETASNYSEEDSATTNSFMASTVKHNDDMELTLFGSPPAILGDDEKIMTTRFSESMPVNYKCRNVEVPRIPNKLPQNMERMARKTRKKRSSPSASDPPVPTSPLPPPPKLQHCRSEPPMMNSKESHSPEIITPGDDSPSISNSSDDSSDDCFRRATVIRRKTSDDDAFTHFSTATAESISITPLDFPRQRSLSSVAIYDQEQKNGRSKVLSQLKRPKPIDMPPK

SEQ ID NO: 6850 - protein, 798 aa, Caenorhabditis elegans
MSQAIPLVTIAAVVIAVGIAIGSLVLNIIILGNVNTLTTTVNNNPVYHYTPAPQVNSTPGTVNTSPSYTQAANYLLNGLDDTVDPCQDFYAFTCNKFLQNTDLQKLGRSRLGTYDQAQVDVYSEIVAALSKIDVTSTTTSKTERITKAAFETCKNNLASPADKTAVVYAEITSLFGGVPFFGEPLKTNVDYWMVAGQIEQKHAVGTLTYTIASSDYKDHTKNALYTGPPGLSLARDFYVKPQYIAEVNQRVSDVNDLLTAFANAAKKNVGADALLAAAQEVVNFEVQIAMASWPDDLLRNYQQQYNPYNIASATTAYRAINWKSYLGQLFHGVASDADQANYNIVVTEPSYFAWLNSVFDGKTSNSTVVANYMIAQLLADESDFINPATAKVSSDTNYIHYALRNGRGIKKIGKREYRMADLDGISEGCMDLLTAYMPYGTGYVYVKSKSERNKVQADVKDQTTLIINNFQGMIDSLNWMDTFSKNRAHNKSDSLVKNFGWPEAMFGDFNDFTTVDAYNQDYASIIDLYTKDKNDIYGIFAVLKKGMEVREFFRIMGEPADRTNFLQSPAMVNAWYQPERNSITFPYAAWNPPYYNLNYPQAYNFAGQGGTGGHELTHGYDDEGVQFGFNGELTDCSWNKCGWMDTNSSSGFIDMAQCVVTQFSTQCCPEKTGNIHCANGATTQGENIADLGGQQAAYRSYRQYVATTRKGVEEDRLPGLENYTPNQIFWITYGYSWCMKQSDANLVHQLLTNPHSPAQCRTNQVMQDIPEFGKDFGCVRGSPMYPEPSGRCKVWVGQ

SEQ ID NO: 6851 - protein, 229 aa, Caenorhabditis elegans
MRSAKVGVARQLETKKPQTGRKISTSSRGTIHSQQSQPEDIQMKYTRKELKEYRQLFNMFDTDGSGAIGNEELKQAMISIGLHANKAEIDNVIKEVDADGNGEIDFEEFCACMKKSQNIVKSTNEELIRECFEIFDQDRNGIITENEFKYIAKEFGDFDDELAEKVFRELDVSANGHLSADQFATIVEDYLLNDPKHDIDTGDSDVERYDDRHDDRASPMPNHLSTVPE

SEQ ID NO: 6852 - protein, 343 aa, Caenorhabditis elegans
MPLPPCIVLATSSPVSTINLLLLGSGESGKSTFVKQMHIIHGAGEFTADEVRAYRQQIYQNAISAMRVLLDARNKLGIAWEDPKRQVEVEKVMRFSVGDLLKGIDFTTFVEVAPIISDFWNDAAIRKTYEQRNLFQISDSCQYFFEHIPRIAMPDFYPTNRDILFCRKATRGISEHIFEINKIPFRFIDVGGQRSQRQKWFQCFTDITSILFMVASNEYDQVILEDRRTNRVVESRSVFETIVNNRAFSNVSIILFMNKNDLLQEKVPKSDIRQYFTDFTGDHTLVRDVQFFLVDKFEASRRDRARPFFYHFTTAVDTENIRRVFRDVRESILEQNLKTLMMQ

SEQ ID NO: 6853 - protein, 399 aa, Caenorhabditis elegans
MGLQGRAIRIPLLNAFYHFWSVGMNIDSNLTDFQCEYPAIDIGIHMKTLLAVGYGLVGALSLVGNLAVLLIVICRREMQTVTNIFISSVSAADLVITSFSLWATPLAYYQRVWHFGKYMCYMVSIIQGLSLMWVPLTLAAVALDRYSLVASPFRQPMSKKTCLLIIAGIWMGGFAVLSPMIRMVDFVDSYGPCHFCLESWDHDKQHYRLFYGLSVLVIRSAIPLVLISLCHWRIAVILNTQTKKFQTLRSASTVTQSTDIRRKQRLQTLLLAMVVIFAVSSLPLDLSNVLQDLIVVYQVRPVPDNVRHFIFFFCHWTAMAGTLLNPLVYAYYNENFRRQIQTCFGEMRGQGEFKRGLYSIVSGRYSYRADDEENHHRQNTRIELANNQTGDIEVLRTDL

SEQ ID NO: 6854 - protein, 861 aa, Caenorhabditis elegans
MEVPQAQSLAAAALISPVKNNSTGGGGNQQLCIRKSISNPSSLKVYAHHEAPGIIHFPRFEFSHRLSIRPLLKRLHEQAQRIEGKAFVRRGALRQKNVHEIKSHKFIARFFKQPTFCSHCKDFLWGITKQGFQCQVCTLVVHKRCHEFVNFACPGADKGVDTDDPRQQHKWKVQTYSSPTFCDHCGSLLYGILHQGMKCQSCDTNVHHRCVKNVPNMCGTDNTEKRGRLRIEAHIENDQLTIKILEAKNLIPMDPNGLSDPYVKCKLIPEDSGCKSKQKTKTLRATLNPQWNETFTYKLLPGDKDRRLSIEVWDWDRTSRNDFMGSLSFGISELMKEAASGWYKLLSAEEGEFYNINITPEYDEDMEKVRKKMNENFITRDNSSSKPKDPAAPRASTLPLGSSNHNVIKASDFNFLTVLGKGSFGKVLLGEQKTTKELFAIKVLKKDVIIQDDDVECTMTEKRVLALPEKPSFLVALHSCFQTMDRLYFVMEFVNGGDLMYQIQQVGKFKEPVAVFYAAEIAVGLFFLHSKGIIYRDLKLDNVMLERDGHIKITDFGMCKENIFGDATTKTFCGTPDYIAPEIILYQPYGKSVDWWAYGVLLFEMLAGQPPFDGEDEDELFTAITEHNVSYPKSLSKEAVSLCKALLIKNPSKRLGCTGDDESASRDIKEHPFFRRIDWFKIETRQIQPPFKPKLKTDRSTENFDHSFLKLPTKMTPPDWEVLENLKGDEFSNFSFVNPFYVKDVEPHIFYVLFIFLILRPFLLLPYLSHLQLTLSAIHSPLLLLSASVFFKFLFKNNFSQSPYNKIKVLLKSADDTSNFDSEFTHEVPKLTPIDRLFLMNLDQTEFEGFSFVNPEYVQEC

SEQ ID NO: 6855 - protein, 309 aa, Caenorhabditis elegans
MLSSTCTAAVRGLSTTAQLSKINNVTIIGAGLMGSGIAQVSANAKLNVTVVDSNQSALEKAQQGIANSLKRVAKKKHADDAAAQTALVSSVLDRIKMSTNVSDSVKDADLVIEAIVENIDIKRKLFAEVEVAAKPTTLITTNTSSLRLADIGLNLKDKSRFGGLHFFNPVPMMKLLEVVRHTETSDATFNQLVDYGKTVGKTTVACKDTPGFIVNRLLVPYMFEALRLYERGDASMEDIDVAMKLGAGYPMGPFELSDYVGLDTCKFIMDGWHAQYPEEVAFTPSPLLNSLVDSGKNGRKSGEGFYKYK

SEQ ID NO: 6856 - protein, 444 aa, Caenorhabditis elegans
MREIVHIQAGQCGNQIGAKFWEVISDEHGIDPTGAYNGDSDLQLERINVYYNEASGGKYVPRACLVDLEPGTMDSVRAGPFGQLFRPDNFVFGQSGAGNNWAKGHYTEGAELVDNVLDVVRKEAESCDCLQGFQMTHSLGGGTGSGMGTLLISKIREEYPDRIMMTFSVVPSPKVSDTVVEPYNATLSVHQLVENTDETFCIDNEALYDICFRTLKLTTPTYGDLNHLVSMTMSGVTTCLRFPGQLNADLRKLAVNMVPFPRLHFFMPGFAPLTSRGSQQYRSLTVPELTQQMFDAKNMMAACDPRHGRYLTVAAMFRGRMSMKEVDEQMLNVQNKNSSYFVEWIPNNVKTAVCDIPPRGVKMAATFVGNSTAIQELFKRISEQFTAMFRRKAFLHWYTGEGMDEMEFTEAESNMNDLVSEYQQYQEATADDEGEFDEHDQDVE

SEQ ID NO: 6857 - protein, 448 aa, Caenorhabditis elegans
MRECVSIHIGQAGAQIGNACWELYCIEHGLDEAGFLKEEEKNKKQQSLQAFFSESMNGKHVPRAIYVDLEPTVLDEIRNGVYGNLFHPDQIINGKEDAANNYARGHYTIGKELIDVVLDRIRKQTENCEGLQGFLVFHSFGGGTGSGFSSLLMERLSVEFGKKSKLEFSVYPAPQVSTSVVEPYNSILTTHTTLELSDCSFMVDNEAIYDLCRQKLHVERPSYSNLNRLIAQVVSSITASLRFDGALNVDLNEFQTNLVPYPRIHFPLATYAPVISADRAHHEPLSVQDITHMCFEKANQMVKCDPSAGKYMAVCLLYRGDVVPKDVNAAISSVKAKRGINFVDWCPTGFKVGINYQAPITVEGGDLAKVHRAVCMLSNTTAIAEAWARLDHKFDLMYSKRAFVHWFVGEGMEEGEFMEARDDLAALEKDYAEVSRDTADLEEENDEF

SEQ ID NO: 6858 - protein, 5198 aa, Caenorhabditis elegans
MGRSPSWLYGVLGLLLLATTCSSVNDDKNDPTGKSSLAFVFDITGSMFDDLVQVREGAAKIFKTVMAQREKLIYNYIMVPFHDPYLGEIINTTDSTYFMRQLSKVYVHGGGDCPEKTLTGILKALQISLPSSFIYVFTDARSKDYHLEDEVLNTIQEKQSSVVFVMTGDCGNRTHPGFRTYEKIAAASFGQVFHLEKSDVSTVLEYVRHAVKQKKVHLMYEARERGGTVSRNIPVDKHLSELTISLSGDKDDSDNLDIVLRDPEGRTVDKRLYSKEGGTIDLKNVKLIRLKDPSPGVWTVNTNSRLKHTIRVFGHGAVDFKYGFASRPLDRIELARPRPVLNQDTYLLINMTGLIPPGTVGEIDLVDYHGHSLYKAVASPHRTNPNMYFAGPFVPPKGLFFVRVQGYDEDNYEFMRIAPTAIGSVIVGGPRAFMSPIHQEFVGRDLNLSCTVESASAYTIYWVKTGEDIIGGPLFYHNTDTSVWTIPELSLKDAGEYECRVISNNGNYSVKTRVETRESPPEIFGVRNVSVPLGEAAFLHCSTRSAGEVEIRWTRYGATVFNGPNTERNPTNGTLKIHHVTRADAGVYECMARNAGGMSTRKMRLDIMEPPSVKVTPQDVYFNMREGVNLSCEAMGDPKPEVHWYFKGRHLLNDYKYQVGQDSKFLYIRDATHHDEGTYECRAMSQAGQARDTTDLMLATPPKVEIIQNKMMVGRGDRVSFECKTIRGKPHPKIRWFKNGKDLIKPDDYIKINEGQLHIMGAKDEDAGAYSCVGENMAGKDVQVANLSVGRVPTIIESPHTVRVNIERQVTLQCLAVGIPPPEIEWQKGNVLLATLNNPRYTQLADGNLLITDAQIEDQGQFTCIARNTYGQQSQSTTLMVTGLVSPVLGHVPPEEQLIEGQDLTLSCVVVLGTPKPSIVWIKDDKPVEEGPTIKIEGGGSLLRLRGGNPKDEGKYTCIAVSPAGNSTLHINVQLIKKPEFVYKPEGGIVFKPTISGMDEKHVAVVNSTHDVLDGEGFAIPCVVSGTPPPIITWYLDGRPITPNSRDFTVTADNTLIVRKADKSYSGVYTCQATNSAGDNEQKTTIRIMNTPMISPGQSSFNMVVDDLFTIPCDVYGDPKPVITWLLDDKPFTEGVVNEDGSLTIPNVNEAHRGTFTCHAQNAAGNDTRTVTLTVHTTPTINAENQEKIALQNDDIVLECPAKALPPPVRLWTYEGEKIDSQLIPHTIREDGALVLQNVKLENTGVFVCQVSNLAGEDSLSYTLTVHEKPKIISEVPGVVDVVKGFTIEIPCRATGVPEVIRTWNKNGIDLKMDEKKFSVDNLGTLRIYEADKNDIGNYNCVVTNEAGTSQMTTHVDVQEPPIILPSTQTNNTAVVGDRVELKCYVEASPPASVTWFRRGIAIGTDTKGYVVESDGTLVIQSASVEDATIYTCKASNPAGKAEANLQVTVIASPDIKDPDVVTQESIKESHPFSLYCPVFSNPLPQISWYLNDKPLIDDKTSWKTSDDKRKLHVFKAKITDSGVYKCVARNAAGEGSKSFQVEVIVPLNLDESKYKKKVFAKEGEEVTLGCPVSGFPVPQINWVVDGTVVEPGKKYKGATLSNDGLTLHFDSVSVKQEGNYHCVAQSKGNILDIDVELSVLAVPIVGEDDNLEVFLGKDISLSCDLQTESDDKTTFVWSINGSESDRPDNVQIPSDGHRLYITDAKPENNGKYMCRVTNSAGKAERTLTLDVLEPPVFVEPVFEANQKLIGNNPIILQCQVTGNPKPTVIWKIDGNDVDKSWLFDESLSLLRIEKLTGKSAQISCTAENKAGTASRDFFIQNIAAPTFKNEGDQETIFRESETITLDCPVSLGDFQITWMKQGLPLTENDAIFTLDNTRLTILNANRDHEDIYTCVANNTAGQVSKDFDVVVQVLPKIKNAVVTLEINEGEEIILTCDAEGNPTPTAKWDFNQGDLPKEAVFVNNNHTVVVNNVTKYHTGVYKCYATNKVGQAVKTINVHVRTKPRFESGLTESELTVNLTRSITLECDVDDAIGVGISWTVNGKPFLAETDGVQTLAGGRFLHIVSAKTDDHGSYACTVTNEAGVATKTFNLFVQVPPTIVNEGGEYTVIENNSLVLPCEVTGKPNPVVTWTKDGRPVGDLKSVQVLSEGQQFKIVHAEIAHKGSYICMAKNDVGTAEISFDVDIITRPMIQKGIKNIVTAIKGGALPFKCPIDDDKNFKGQIIWLRNYQPIDLEAEDARITRLSNDRRLTILNVTENDEGQYSCRVKNDAGENSFDFKATVLVPPTIIMLDKDKNKTAVEHSTVTLSCPATGKPEPDITWFKDGEAIHIENIADIIPNGELNGNQLKITRIKEGDAGKYTCEADNSAGSVEQDVNVNVITIPKIEKDGIPSDYESQQNERVVISCPVYARPPAKITWLKAGKPLQSDKFVKTSANGQKLYLFKLRETDSSKYTCIATNEAGTDKRDFKVSMLVAPSFDEPNIVRRITVNSGNPSTLHCPAKGSPSPTITWLKDGNAIEPNDRYVFFDAGRQLQISKTEGSDQGRYTCIATNSVGSDDLENTLEVIIPPVIDGERREAVAVIEGFSSELFCDSNSTGVDVEWQKDGLTINQDTLRGDSFIQIPSSGKKMSFLSARKSDSGRYTCIVRNPAGEARKLFDFAVNDPPSISDELSSANIQTIVPYYPVEINCVVSGSPHPKVYWLFDDKPLEPDSAAYELTNNGETLKIVRSQVEHAGTYTCEAQNNVGKARKDFLVRVTAPPHFEKEREEVVARVGDTMLLTCNAESSVPLSSVYWHAHDESVQNGVITSKYAANEKTLNVTNIQLDDEGFYYCTAVNEAGITKKFFKLIVIETPYFLDQQKLYPIILGKRLTLDCSATGTPPPTILFMKDGKRLNESDEVDIIGSTLVIDNPQKEVEGRYTCIAENKAGRSEKDMMVEVLLPPKLSKEWINVEVQAGDPLTLECPIEDTSGVHITWSRQFGKDGQLDMRAQSSSDKSKLYIMQATPEDADSYSCIAVNDAGGAEAVFQVTVNTPPKIFGDSFSTTEIVADTTLEIPCRTEGIPPPEISWFLDGKPILEMPGVTYKQGDLSLRIDNIKPNQEGRYTCVAENKAGRAEQDTYVEISEPPRVVMASEVMRVVEGRQTTIRCEVFGNPEPVVNWLKDGEPYTSDLLQFSTKLSYLHLRETTLADGGTYTCIATNKAGESQTTTDVEVLVPPRIEDEERVLQGKEGNTYMVHCQVTGRPVPYVTWKRNGKEIEQFNPVLHIRNATRADEGKYSCIASNEAGTAVADFLIDVFTKPTFETHETTFNIVEGESAKIECKIDGHPKPTISWLKGGRPFNMDNIILSPRGDTLMILKAQRFDGGLYTCVATNSYGDSEQDFKVNVYTKPYIDETIDQTPKAVAGGEIILKCPVLGNPTPTVTWKRGDDAVPNDSRHTIVNNYDLKINSVTTEDAGQYSCIAVNEAGNLTTHYAAEVIGKPTFVRKGGNLYEVIENDTITMDCGVTSRPLPSISWFRGDKPVYLYDRYSISPDGSHITINKAKLSDGGKYICRASNEAGTSDIDLILKILVPPKIDKSNIIGNPLAIVARTIYLECPISGIPQPDVIWTKNGMDINMTDSRVILAQNNETFGIENVQVTDQGRYTCTATNRGGKASHDFSLDVLSPPEFDIHGTQPTIKREGDTITLTCPIKLAEDIADQVMDVSWTKDSRALDGDLTDNVDISDDGRKLTISQASLENAGLYTCIALNRAGEASLEFKVEILSPPVIDISRNDVQPQVAVNQPTIMRCAVTGHPFPSIKWLKNGKEVTDDENIRIVEQGQVLQILRTDSDHAGKWSCVAENDAGVKELEMVLDVFTPPVVSVKSDNPIKALGETITLFCNASGNPYPQLKWAKGGSLIFDSPDGARISLKGARLDIPHLKKTDVGDYTCQALNAAGTSEASVSVDVLVPPEINRDGIDMSPRLPAQQSLTLQCLAQGKPVPQMRWTLNGTALTHSTPGITVASDSTFIQINNVSLSDKGVYTCYAENVAGSDNLMYNVDVVQAPVISNGGTKQVIEGELAVIECLVEGYPAPQVSWLRNGNRVETGVQGVRYVTDGRMLTIIEARSLDSGIYLCSATNEAGSAQQAYTLEVLVSPKIITSTPGVLTPSSGSKFSLPCAVRGYPDPIISWTLNGNDIKDGENGHTIGADGTLHIEKAEERHLIYECTAKNDAGADTLEFPVQTIVAPKISTSGNRYINGSEGTETVIKCEIESESSEFSWSKNGVPLLPSNNLIFSEDYKLIKILSTRLSDQGEYSCTAANKAGNATQKTNLNVGVAPKIMERPRTQVVHKGDQVTLWCEASGVPQPAITWYKDNELLTNTGVDETATTKKKSVIFSSISPSQAGVYTCKAENWVASTEEDIDLIVMIPPEVVPERMNVSTNPRQTVFLSCNATGIPEPVISWMRDSNIAIQNNEKYQILGTTLAIRNVLPDDDGFYHCIAKSDAGQKIATRKLIVNKPSDRPAPIWVECDEKGKPKKTEYMIDRGDTPDDNPQLLPWKDVEDSSLNGSIAYRCMPGPRSSRTVLLHAAPQFIVKPKNTTAAIGAIVELRCSAAGPPHPTITWAKDGKLIEDSKFEIAYSHLKVTLNSTSDSGEYTCMAQNSVGSSTVSAFINVDNNILPTPKPSSNQKNVAVITCYERNQAYSRGLTWEYNGVPMPKNLAGIHFMNNGSLVILDTSSLKEGDLELYTCKVRNRRRHSIPHLTSAFEGVPEVKTIDKVEVNNGDSVVLDCEVTSDPLTTHVVWTKNDQKMLDDDAIYVLPNNSLVLLNVEKYDEGVYKCVASNSIGKAFDDTQLNVYEGDFLPLTGFEGSGINIDDSSNAGGSSRREAYKKENEDASTTTITTTSPTTTTTETPLTTTIIPALITLPAKQYPTDDYHEGSANDDGFGPTTQDSLFEFNPPLHPEISVVNTDCAGTINENGDCVDKDGKTHNLKILTGENHCPEGFAMNPHTRICEDLDECAFYQPCDFECINYDGGFQCNCPLGYELAEEGCRDVNECESVRCEDGKACFNQLGGYECIDDPCPANYSLVDDRYCEPECENCTSTPIQVHMLAIPSGLPISHIATLTAYDKSGRVLNDTTYAISDTGAPLARGRMTSGPFTIKAVKRGHAQVWTNRVLAAGDHHKVRVRAHSDHATNELHAPKETNFLVLINVGQYPF

SEQ ID NO: 6859 - protein, 5175 aa, Caenorhabditis elegans
MGRSPSWLYGVLGLLLLATTCSSVNDDKNDPTGKSSLAFVFDITGSMFDDLVQVREGAAKIFKTVMAQREKLIYNYIMVPFHDPYLGEIINTTDSTYFMRQLSKVYVHGGGDCPEKTLTGILKALQISLPSSFIYVFTDARSKDYHLEDEVLNTIQEKQSSVVFVMTGDCGNRTHPGFRTYEKIAAASFGQVFHLEKSDVSTVLEYVRHAVKQKKVHLMYEARERGGTVSRNIPVDKHLSELTISLSGDKDDSDNLDIVLRDPEGRTVDKRLYSKEGGTIDLKNVKLIRLKDPSPGVWTVNTNSRLKHTIRVFGHGAVDFKYGFASRPLDRIELARPRPVLNQDTYLLINMTGLIPPGTVGEIDLVDYHGHSLYKAVASPHRTNPNMYFAGPFVPPKGLFFVRVQGYDEDNYEFMRIAPTAIGSVIVGGPRAFMSPIHQEFVGRDLNLSCTVESASAYTIYWVKTGEDIIGGPLFYHNTDTSVWTIPELSLKDAGEYECRVISNNGNYSVKTRVETRESPPEIFGVRNVSVPLGEAAFLHCSTRSAGEVEIRWTRYGATVFNGPNTERNPTNGTLKIHHVTRADAGVYECMARNAGGMSTRKMRLDIMEPPSVKVTPQDVYFNMREGVNLSCEAMGDPKPEVHWYFKGRHLLNDYKYQVGQDSKFLYIRDATHHDEGTYECRAMSQAGQARDTTDLMLATPPKVEIIQNKMMVGRGDRVSFECKTIRGKPHPKIRWFKNGKDLIKPDDYIKINEGQLHIMGAKDEDAGAYSCVGENMAGKDVQVANLSVGRVPTIIESPHTVRVNIERQVTLQCLAVGIPPPEIEWQKGNVLLATLNNPRYTQLADGNLLITDAQIEDQGQFTCIARNTYGQQSQSTTLMVTGLVSPVLGHVPPEEQLIEGQDLTLSCVVVLGTPKPSIVWIKDDKPVEEGPTIKIEGGGSLLRLRGGNPKDEGKYTCIAVSPAGNSTLHINVQLIKKPEFVYKPEGGIVFKPTISGMDEKHVAVVNSTHDVLDGEGFAIPCVVSGTPPPIITWYLDGRPITPNSRDFTVTADNTLIVRKADKSYSGVYTCQATNSAGDNEQKTTIRIMNTPMISPGQSSFNMVVDDLFTIPCDVYGDPKPVITWLLDDKPFTEGVVNEDGSLTIPNVNEAHRGTFTCHAQNAAGNDTRTVTLTVHTTPTINAENQEKIALQNDDIVLECPAKALPPPVRLWTYEGEKIDSQLIPHTIREDGALVLQNVKLENTGVFVCQVSNLAGEDSLSYTLTVHEKPKIISEVPGVVDVVKGFTIEIPCRATGVPEVIRTWNKNGIDLKMDEKKFSVDNLGTLRIYEADKNDIGNYNCVVTNEAGTSQMTTHVDVQEPPIILPSTQTNNTAVVGDRVELKCYVEASPPASVTWFRRGIAIGTDTKGYVVESDGTLVIQSASVEDATIYTCKASNPAGKAEANLQVTVIASPDIKDPDVVTQESIKESHPFSLYCPVFSNPLPQISWYLNDKPLIDDKTSWKTSDDKRKLHVFKAKITDSGVYKCVARNAAGEGSKSFQVEVIVPLNLDESKYKKKVFAKEGEEVTLGCPVSGFPVPQINWVVDGTVVEPGKKYKGATLSNDGLTLHFDSVSVKQEGNYHCVAQSKGNILDIDVELSVLAVPIVGEDDNLEVFLGKDISLSCDLQTESDDKTTFVWSINGSESDRPDNVQIPSDGHRLYITDAKPENNGKYMCRVTNSAGKAERTLTLDVLEPPVFVEPVFEANQKLIGNNPIILQCQVTGNPKPTVIWKIDGNDVDKSWLFDESLSLLRIEKLTGKSAQISCTAENKAGTASRDFFIQNIAAPTFKNEGDQETIFRESETITLDCPVSLGDFQITWMKQGLPLTENDAIFTLDNTRLTILNANRDHEDIYTCVANNTAGQVSKDFDVVVQVLPKIKNAVVTLEINEGEEIILTCDAEGNPTPTAKWDFNQGDLPKEAVFVNNNHTVVVNNVTKYHTGVYKCYATNKVGQAVKTINVHVRTKPRFESGLTESELTVNLTRSITLECDVDDAIGVGISWTVNGKPFLAETDGVQTLAGGRFLHIVSAKTDDHGSYACTVTNEAGVATKTFNLFVQVPPTIVNEGGEYTVIENNSLVLPCEVTGKPNPVVTWTKDGRPVGDLKSVQVLSEGQQFKIVHAEIAHKGSYICMAKNDVGTAEISFDVDIITRPMIQKGIKNIVTAIKGGALPFKCPIDDDKNFKGQIIWLRNYQPIDLEAEDARITRLSNDRRLTILNVTENDEGQYSCRVKNDAGENSFDFKATVLVPPTIIMLDKDKNKTAVEHSTVTLSCPATGKPEPDITWFKDGEAIHIENIADIIPNGELNGNQLKITRIKEGDAGKYTCEADNSAGSVEQDVNVNVITIPKIEKDGIPSDYESQQNERVVISCPVYARPPAKITWLKAGKPLQSDKFVKTSANGQKLYLFKLRETDSSKYTCIATNEAGTDKRDFKVSMLVAPSFDEPNIVRRITVNSGNPSTLHCPAKGSPSPTITWLKDGNAIEPNDRYVFFDAGRQLQISKTEGSDQGRYTCIATNSVGSDDLENTLEVIIPPVIDGERREAVAVIEGFSSELFCDSNSTGVDVEWQKDGLTINQDTLRGDSFIQIPSSGKKMSFLSARKSDSGRYTCIVRNPAGEARKLFDFAVNDPPSISDELSSANIQTIVPYYPVEINCVVSGSPHPKVYWLFDDKPLEPDSAAYELTNNGETLKIVRSQVEHAGTYTCEAQNNVGKARKDFLVRVTAPPHFEKEREEVVARVGDTMLLTCNAESSVPLSSVYWHAHDESVQNGVITSKYAANEKTLNVTNIQLDDEGFYYCTAVNEAGITKKFFKLIVIETPYFLDQQKLYPIILGKRLTLDCSATGTPPPTILFMKDGKRLNESDEVDIIGSTLVIDNPQKEVEGRYTCIAENKAGRSEKDMMVEVLLPPKLSKEWINVEVQAGDPLTLECPIEDTSGVHITWSRQFGKDGQLDMRAQSSSDKSKLYIMQATPEDADSYSCIAVNDAGGAEAVFQVTVNTPPKIFGDSFSTTEIVADTTLEIPCRTEGIPPPEISWFLDGKPILEMPGVTYKQGDLSLRIDNIKPNQEGRYTCVAENKAGRAEQDTYVEISEPPRVVMASEVMRVVEGRQTTIRCEVFGNPEPVVNWLKDGEPYTSDLLQFSTKLSYLHLRETTLADGGTYTCIATNKAGESQTTTDVEVLVPPRIEDEERVLQGKEGNTYMVHCQVTGRPVPYVTWKRNGKEIEQFNPVLHIRNATRADEGKYSCIASNEAGTAVADFLIDVFTKPTFETHETTFNIVEGESAKIECKIDGHPKPTISWLKGGRPFNMDNIILSPRGDTLMILKAQRFDGGLYTCVATNSYGDSEQDFKVNVYTKPYIDETIDQTPKAVAGGEIILKCPVLGNPTPTVTWKRGDDAVPNDSRHTIVNNYDLKINSVTTEDAGQYSCIAVNEAGNLTTHYAAEVIGKPTFVRKGGNLYEVIENDTITMDCGVTSRPLPSISWFRGDKPVYLYDRYSISPDGSHITINKAKLSDGGKYICRASNEAGTSDIDLILKILVPPKIDKSNIIGNPLAIVARTIYLECPISGIPQPDVIWTKNGMDINMTDSRVILAQNNETFGIENVQVTDQGRYTCTATNRGGKASHDFSLDVLSPPEFDIHGTQPTIKREGDTITLTCPIKLAEDIADQVMDVSWTKDSRALDGDLTDNVDISDDGRKLTISQASLENAGLYTCIALNRAGEASLEFKVEILSPPVIDISRNDVQPQVAVNQPTIMRCAVTGHPFPSIKWLKNGKEVTDDENIRIVEQGQVLQILRTDSDHAGKWSCVAENDAGVKELEMVLDVFTPPVVSVKSDNPIKALGETITLFCNASGNPYPQLKWAKGGSLIFDSPDGARISLKGARLDIPHLKKTDVGDYTCQALNAAGTSEASVSVDVLVPPEINRDGIDMSPRLPAQQSLTLQCLAQGKPVPQMRWTLNGTALTHSTPGITVASDSTFIQINNVSLSDKGVYTCYAENVAGSDNLMYNVDVVQAPVISNGGTKQVIEGELAVIECLVEGYPAPQVSWLRNGNRVETGVQGVRYVTDGRMLTIIEARSLDSGIYLCSATNEAGSAQQAYTLEVLVSPKIITSTPGVLTPSSGSKFSLPCAVRGYPDPIISWTLNGNDIKDGENGHTIGADGTLHIEKAEERHLIYECTAKNDAGADTLEFPVQTIVAPKISTSGNRYINGSEGTETVIKCEIESESSEFSWSKNGVPLLPSNNLIFSEDYKLIKILSTRLSDQGEYSCTAANKAGNATQKTNLNVGVAPKIMERPRTQVVHKGDQVTLWCEASGVPQPAITWYKDNELLTNTGVDETATTKKKSVIFSSISPSQAGVYTCKAENWVASTEEDIDLIVMIPPEVVPERMNVSTNPRQTVFLSCNATGIPEPVISWMRDSNIAIQNNEKYQILGTTLAIRNVLPDDDGFYHCIAKSDAGQKIATRKLIVNKPSDRPAPIWVECDEKGKPKKTEYMIDRGDTPDDNPQLLPWKDVEDSSLNGSIAYRCMPGPRSSRTVLLHAAPQFIVKPKNTTAAIGAIVELRCSAAGPPHPTITWAKDGKLIEDSKFEIAYSHLKVTLNSTSDSGEYTCMAQNSVGSSTVSAFINVDNNILPTPKPSSNQKNVAVITCYERNQAYSRGLTWEYNGVPMPKNLAGIHFMNNGSLVILDTSSLKEGDLELYTCKVRNRRRHSIPHLTSAFEGVPEVKTIDKVEVNNGDSVVLDCEVTSDPLTTHVVWTKNDQKMLDDDAIYVLPNNSLVLLNVEKYDEGVYKCVASNSIGKAFDDTQLNVYGGSSRREAYKKENEDASTTTITTTSPTTTTTETPLTTTIIPALITLPAKQYPTDDYHEGSANDDGFGPTTQDSLFEFNPPLHPEISVVNTDCAGTINENGDCVDKDGKTHNLKILTGENHCPEGFAMNPHTRICEDLDECAFYQPCDFECINYDGGFQCNCPLGYELAEEGCRDVNECESVRCEDGKACFNQLGGYECIDDPCPANYSLVDDRYCEPECENCTSTPIQVHMLAIPSGLPISHIATLTAYDKSGRVLNDTTYAISDTGAPLARGRMTSGPFTIKAVKRGHAQVWTNRVLAAGDHHKVRVRAHSDHATNELHAPKETNFLVLINVGQYPF

SEQ ID NO: 6860 - protein, 5198 aa, Caenorhabditis elegans; identical to SEQ ID NO: 6858

SEQ ID NO: 6861 - protein, 5175 aa, Caenorhabditis elegans; identical to SEQ ID NO: 6859

SEQ ID NO: 6862 - protein, 516 aa, Caenorhabditis elegans
MDSQKECVFVSEKSKIFPSTRLFFSFLLCLCFVALAIGTSNISQSMVCMVKKPDTNYTCPLAEPEVEAIPCNHPKQFAWSSIQQGLIYSGQNFGSLFMVITGWQADRLNGKWTIVAAMAFIIVSNAVLPISAGASFALVFFLRVLTGFGDALLSPASSSLITRWFPPKERPSALGIVTSGRQIGTLIILPIGGWLCGSDGSKFLGGWPAIFYLSSVVAAAVLVIWVVFSADKPSKHLCISHNEEAYINRKIEEENIGKRNNRKNTPWKAIFTSKQVWVAVAALVCHEFPLVIMLQFLPKFFSDVLGLSNTVNGLVSALPMAILFLSKCLSASLASYLTANGYLRKTQSCKIFNFIASLGLGICIAATPLMSNLQHAIWAIIILCLANAFAGLHTPGVLTAIVQLAPAFSGIITGLAFAVASCFSIFNKLLISQILRTGSKHEWTIVFEISAFVAILPTIFFTLWGSAERTEWASNRVSVPKDADQKSNDSGSSTSSTIQAIAKYSMFLSHDLTNSA

SEQ ID NO: 6863 - protein, 508 aa, Caenorhabditis elegans
MGRCLQFGRLRVGRLRACATKTKTSSANIDATIIRHTKHQDHQDSKVTTKTSFPPPPRSFTMLSTLFLLLYATRETVNAMTAEISPTVSYLLDRGCANDTEIIDHLLIDRALYYNKHKLPSPQVDVRIEMWVQEVTSVSELTQDFEIDLYMNEYWTDPGLAYDILNPCQGNLSFDWAVMQNIWTPNTCFINSKKAQLHSSPFTNVFLMVFPNGSVWSNWRIKSTGPCVMDLTKFPMDSIECTLTFESFNYNKDEVFMRWGDPPLTIFKPIELPDFTMTNFSTSNKFQLYAAGYWSELNVNFLFRRRSGWYLLQGYIPTYMTVFISWIPFYLGPKAIPARTMIGVNALLALTFQFGNIIRNLPRVSYIKAIDVWMLRFVSVSTSSLLVLPLQLFITSAPKNLHIFFSFSGICFVFASLFELATIGFLMRNEGKPATKSSRSTKNSNRWQQPSVCREDTQRKSQNIVFCERLDNTSRLMFPGLYVCGIVFTFYNFIYWFVYMKQAWDQAP

SEQ ID NO: 6864 - protein, 508 aa, Caenorhabditis elegans; identical to SEQ ID NO: 6863

SEQ ID NO: 6865 - protein, 1071 aa, Caenorhabditis elegans
MTTTNKDGPFRQQYLPGVHKEPNLAISESTHSSDWYSATSSEDCFQAASQSFSSQKSNGNVITQQPGKLHCEISDPKSCSFVPAISTDNAQMGTSGIIKYRSYSNPDLLVAMSPLAYRDEAPQSQKSVANSRQDLTQTSCEVVTVSETVVNADSITTTTVTSSTTTTATASQEDFIMVEAEQDETAGLCDATMPLVDKKNITTSSTTSSPSRQITPRIENGLSFENVVSLVKIFPAFVNKLLKKPWYASRCDEVCQFPKAELAYYDIVSTDVDDEHFVIVAGKVTTDEHLMDNQFHLVFAPVGFSEDVSLDERPFSLFRATDKKDLMDLLHLCDEKSFLFTSLDMSTMRADILRSKIEELVIQIRLKPHYHMIHVAIATDRLDFFSDGMIKTMNETLEPFESQLRCLCHTENCYPVHLALTMDRQKIVERLLELDPTLFCETDKAGNNVWHHVNSSFCAQIIWDRCPASQHFIDERNMDGQSPLNEAVSTAKPLVATFLIGKGAKFTRGDRNELFVAMTSKNAQSVVEVVLTDKPEIANERDALGNSAIHVALYKESLNALLNRKVELGLDIDVKNNAGETALLLFITTRKPDLLPLLVTLYAHGANMNATDPHGNTALHKSAALVDAKKISLECVKFLISAGSNPNKINLRGESPRHLAASLQNQEMLAILKAAGATRCPKGYKGCRSNCRHDCSSAEDEYEETLQKIRIGNESDYEKTEFTASEKLNIQDTLDGSRRGKKAKVNLISMDGGGIRGLVIIQTLIAIEERLGDDIFKYFDWSAGTSTGSLIMAGLATGKSLREMQQTYLLLKDRVFDGIMPPYDTVQLEKFIQDQFGTGTVWEIPYPRLMISAVNSEKLPVRLEMARNYKPAKDVAPETPKEMPLWMALRRSTAAPVLFKPSEDRYIDGGIISNNPALDLMSEVHAYNRELQLSGRKSDAVQMNVLVSFGTGQIPSTVIETLSIDSNSPLQSIKTIKNLAAMFIDQATASEGAPVARSRQWADSLEIPFFRFSAPLSKNIFLSSTSDLDVCTMMWDSFIYCRKHRDYIDELVKVLKHDTDHPHVKTPFTDL

SEQ ID NO: 6866 - protein, 536 aa, Caenorhabditis elegans
MVSIKRYEIISFVIAAFFFLSGLSMWIAFWPIFNSELRSNYKLGANDDGSLHYAAFLYANPPMKNVMKFNLFNVTNPDEVKYLGAKPELIEVGGYAFLESEQKKYYEFSSDKTKMFYQNYKQYHYSEVDNDAGYNYNDKIMFPNSIAEGAVSTVFGPQSEFSPTAKILVSIGLVMLGEYPFISKTVKDVLMDGYEDPLLSVAHSGIFISLVNFYGYGSQLNYIPEMKTFAYLSGYNNSYDENYWINTGYNDFNKLGFVESWAGLEQLPASFWPTLEARQIKGPDSGSLSKIHLTKTDELPFFLSFMCRSFKRTYWQDGLVDGIKTMAFAVPYEEFDTTLEKNAGFRYKNQENVDYFPDWCDKNTTTSLSQCQKTANGTFLLPPGIFPLVCYPGHNAQPPFTVLVSPPHFLYSPPEVQHHLSGMNPDPEKHKPMVFHQEKTSGTALQVDVRFQVNLPVVNNKGSIMSSQMPNVIIPLFYEDSHALVKDFVMDTVWLGVIIVPRIIEYLKFVLSFISICILTTLLVIRVRVKGTVSVV

SEQ ID NO: 6867 - protein, 1573 aa, Caenorhabditis elegans
MEPNLQAKLKGIDAFCGERYWDPAVWNASTVPILSQCYQHTTLVWFPTAIVFLLAPILTAQIFYRRPNPIPWTRRIQLKIGLACILIADSLSLFTVAIYETLFQGFPYAVDFVYPLTLCLAMVVLTALIVSCRNYGIVTSGGLFISWLVFTISAIPELLYWIQQIVNPAEAWNWIDYPRCIAFFIWFFCCAFETYLHCYADASPEGYKYLSAARNPSPETTSSFLNRITMWWFNSLCSLGVKKPLEVSDLYSLNEADTSNLLVPKWYNLWDKQSKKFEETAARRRIGSNASRTNRRRTSSNDTTPLLNDQSTDDYGSVPAGQSTQKMPSIIWTLFLMFKWDVITAMFVKLLSDVLLFCNPLLLKSLIRFTEELERPMWQGVVLAFTMFFSAELSSILLSHYFYLMYRVGTRVQTCLTAAVYRKTLRLSNAARREKTVGEIVNLMAIDVDRFQQITPQTMQYWSNPFQIGLALFLLFQQLGVSVFSGVAVMVLLFPINFVITMIIRKWQIAQMYYKDERTKMVNEVLNGIKVIKLYAWEPPMEQVIEDLREQELGLIKKAAFLRTFSDMLNTASPFLVALSTFATFIYIDPKNVLTPEIAFVSLTLFNQLRSPMSQVAELITQTVQVVVSNRRLKEFLVSEELNVEAIDHRARDNNDVICLKEACLSWESAEHQPVPTLTNISFSVNRGQLVTIVGRVGAGKSSMLQALMGEMEKLSGSISMHGRLCYVPQQPWMQNNTLRQNITFGKQFDEYFYSRVLDACALYRDLQILPLGDNTEIGEKGINLSGGQKARISLARAVYQNHDIYLLDDPMSAVDAHVGSQLFGSVIGPEGMLRNKTRILVTNELSFLEKSDLIIVMNEGKIEYSGKYDDLMQQGAFEQLLIECEKEERERREAEASADEDDENSEPGGIMIGGDSDFEYDDDVMASPIIDHVLGTSHMSTVSGIINRRRISTSTHKQRRRLSTTKSHTHSITSASTQTRQLTGTERVETGRVKMDTYYKYFGAMGMSIAVLFVLGMTTSTIFSMGRNLWLTDWSNDNAARSGSNTTGQPIAIRLGVYAGLGFSEIILLFIGMLSLLYGGVSASRNLHAPLMRNLFRVPMAFYDTTPFGRILNRIGKDIETVDVLLPFNVQFFAQCLLQVVSTLIIIMISTPVFGIVIIPLSVMYLMVMRYYIATSRQLKRLESITRSPIYSHLSESIQGSATIRAYHLVDRFCKLSETKVDSHVQCRYLNYVANRWLSVRLEFIGNCIVLFSALFAALTRTTTTSGVIGLSVSYALNITTVLNFAVRQITKLETNIVSVERVKEYAETETEAEWKSEPGKEPPQNWPSEGRIVMNNYSARYRPGLNLVVKQLNVEIKPHEKVGIVGRTGAGKSSVTLSLFRIIEAAEGQIVVDGINLAEIGLHDLRSNLTIIPQDPVLFSGTLRFNLDPFNHYSDGDIWKTLEMANLKEFATAHNEQLNYIITEGGDNISVGQRQLVCLARALLRKTRVLILDEATAAVDVSTDALIQKTIREEFANATVLTIAHRLNTIMDYDRIIVLNDGKVGEFDSPANLLSNRNSEFYSMAKRAGLI

SEQ ID NO: 6868 - protein, 1573 aa, Caenorhabditis elegans; identical to SEQ ID NO: 6867

SEQ ID NO: 6869 - protein, 736 aa, Caenorhabditis elegans
MKSQACLKVCLALIGLVSIVSTAYIANDVVSDYAEVKELLAAFYRKHAKKYGHDYDPAAIQAIAENMDKSVKNDKTEATVNRKLWNEVFENDIILTLPQAESLLSESNSPRSRRQAHPDPRNFWPNLTISYEFYGGEETWRQLIRSAIRHVEQNVCFKFKENGGDRDGLRYYRGNGCWSNVGRVGGRQLVSIGYGCDSLGIVSHETLHALGLWHEQSRDDRDNFISIVADKITRGTEGNFAKRTAANSDNLGQPYDLGSVMHYGAKSFAYDWSSDTIKTRDWRYQNTIGQRDGLSFKDAKMINTRYCSNVCQRSLPCLNEGYTDPNNCGRCRCPSGYGGTYCETVEYTSCGGSLTASSSYKKIESGIVQPDANCVWRIRNPGGNVEVMFDQVNFQCADPCQSYVEVKYLSQKTSTGARLCCSLPSVIRSEGDDVIIILRGTPNTAVGWRGFTLKYRAIGGTPITPATVRPTYATTTRPYWTRTASGWIHIKNPPLYKPDGQIYTSDEQSAETKYSSEELYDPSTFLSPSSSSASPALLLPSDASPQRPSAQEHDLSQLSQNALTRPTPTTTVAPDTASWSAWGEWSACSQPCGGCGTKTRVRACYGGNQVCPGSNLDRESCNAHACAKPKKGMICNGRLLLPCDLLAKLNFGSNNYLNPKLKQSGFARSSTLPLPRISQRKPVFVNERFIYQCPTALLTIQMEYKPDTQGTNDAYFQQYPECCSGYTPRRGVCYKN

SEQ ID NO: 6870 - protein, 553 aa, Caenorhabditis elegans
MFNTRWKVFIFLALCYRISHGEELDKKKLQKEAYDMFMHGYNSYMNYAFPADELMPLSCKGRIRGVTPSRGDVDDVLGNFSVTLLDSLDTLVVMNELDEFEKAIDLVIKHVRFDSDHVVSVFETNIRVLGGLISAHVLAELVKEKYPNRLTTYDNQLLKMATEVGNRLLPAFNTTSGLPFSRINLKHGMQDHLKRQKDTCTACGGTMILEFAALTSLTGDPIYEKKARKAMDFLWQQRHRSSDLMGTVLNVHSGDWTRRESGIGAGIDSYYEYTLKAYILLGDESYLDRFNKHYEAIKRYINKGPIFVDVHMHRPTVATRGFMDSLLAFWPGLQVLKGDVKEAIEMHEMLFQVIQKHKFLPEAFTHDFQVHWAEHPIRPEFVESTYFLYRATKDPHYLHVAKQIMDSINKYVKVPCGFAALKDIRTMVKEDQMESFVLSETFKYLYMIFTDPEDLMFDPDHYVLTTEAHFLPLSIGHKEKIENKINPRRMILRADEPQQKNYVCANPIDFTKLPTEREEAQLIRERTKIMLGELRNGASAGGAAPGNMICESP

SEQ ID NO: 6871 - protein, 999 aa, Caenorhabditis elegans
MDKKWSLEQRWLHLLNQQFLDCLNHLFNHYRRLSTFQKPPSIIRHMFSVLALAIQILANVNVVAQTTEAVDLAPPPKVRQIRIPGDILIGGVFPVHSKSLNGDEPCGEIAETRGVHRVEAMLYALDQINSQNDFLRGYKLGALILDSCSNPAYALNQSLDFVRDMIGSSEASDYVCLDGSDPNLKKQSQKKNVAAVVGGSYSSVSVQLANLLRLFRIAQVSPASTNADLSDKNRFEYFARTVPSDDYQAMAMVEIAVKFKWSYVSLVYSADEYGELGADAFKKEARKKGICIALEERIQNKKESFTESINNLVQKLQPEKNVGATVVVLFVGTEYIPDILRYTAERMKLTSGAKKRIIWLASESWDRNNDKYTAGDNRLAAQGAIVLMLASQKVPSFEEYFMSLHPGTEAFERNKWLRELWQVKYKCEFDTPPGSTASRCEDIKQSTEGFNADDKVQFVIDAVYAIAHGLQSMKQAICPDDAIENHWISRYSKQPEICHAMQNIDGSDFYQNYLLKVNFTGKTISIFSSFRLSPFSDIVGKRFRFSPQGDGPASYTILTYKPKSMDKKRRMTDDESSPSDYVEIGHWSENNLTIYEKNLWWDPDHTPVSVCSLPCKIGFRKQLIKDEQCCWACSKCEDYEYLINETHCVGCEQGWWPTKDRKGCFDLSLSQLKYMRWRSMYSLVPTILAVFGIIATLFVIVVYVIYNETPVVKASGRELSYILLISMIMCYCMTFVLLSKPSAIVCAIKRTGIGFAFSCLYSAMFVKTNRIFRIFSTRSAQRPRFISPISQVVMTAMLAGVQLIGSLIWLSVVPPGWRHHYPTRDQVVLTCNVPDHHFLYSLAYDGFLIVLCTTYAVKTRKVPENFNETKFIGFSMYTTCVVWLSWIFFFFGTGSDFQIQTSSLCISISMSANVALACIFSPKLWIILFEKHKNVRKQEGESMLNKSSRSLGNCSSRLCANSIDEPNQYTALLTDSTRRRSSRKTSQPTSTSSAHDTFL

SEQ ID NO: 6872 - protein, 642 aa, Caenorhabditis elegans
MEIENIVANTVYIKARESGGQKKGKSKKWKNYLQFPHYTECLPLKTEIEVTYAFVVEKQPIGKLLFHEFCQATNSQYHQCCQFLTKVEEYETSDDDGQSRRDLASSIVSLLHSKPEDNPSGSQDEQEFWCSFLSDEVISTCITTADSATHDDEPRSDIFTEPYRLTCQYLTDAPFKEFAESMYFHRFLQWKWLEKRPVDKHTFRLYRVLGKGGFGEVCACQVRASGKMYALKKLEKKRVKKRHAETLSLNEKQILQRINSPFVVSLAYAYETKDALCLVLTLMNGGDLKFHLYNLMPGGFDEKRVQFYAAEITLGLQHLHSERILYRDLKPENILLDDFGHVRISDLGLAVEIKDNEPIKGRVGTVGYMAPEIVKNERYSYGVDWWGVGCLIYEMIEGKAPFRQRKEKVKREEVERRVREDQEKYSEKFSEAARTLCRGLLHKEPGFRLGCRRVGRPEDGAEEIRAHPFFNTADTVTGREPVPWKKMEAGKVTPPFCPDPRAVYAKDVLDIEQFSTVKGVRLDATDTQFYGKFNTGCVSIPWQSEMIETECFAELNTFHDEDGNVMWNLRPDGINMDERRNGTSKPGFFSRLFRKKNIEVTKSLHDLSHLGVEQQQPPKTSTQTPAVRSSRAASASGRTLVI

SEQ ID NO: 6873 - protein, 515 aa, Caenorhabditis elegans
MKFGFIFIIVLTTVSQSFHKSIDISKSPCNDFYDYVCAKDTRSISNLTFTKMNQELEILKPNVTIENNGTFIALDKIVKLTRVMKWCTEIEVLFTGVFTVDYFGDLHSENKMIHSERYTAVVSRLKEINTTMANIFYNALHANTEILQQMEIPISSKNKFLHHLFNTLKTNAINELETTTISEAAKKSMKKGIEMSKVYFAFYDFNNITVYKEAKLVYETEYYRLKKWLSPKPPKNNFLHIFIQNGNLMRVRDLTNPIAEKILRLGAIDASMTLFAKTISEYDIRFLFQAIVANPANDGFQYLNNNHITVITRNDLNQPEKAIADTIFVTTHEIMHRVYPYGNFLMNSNVTTAALQCARREVQMLGDTDAVKPISGWFNKDVAHEDVVNIMAMRMIMKMATIKSTNEKQLKEALETIVGGLCKQSERKNELIPHHNPLETSLNCAVRQYPLFKTLYGCRIGDRMFAKHEEFCKPFGDDVKVEDYAVKSSSANKDVGGFFKDLLKTSKSFNFTYGI

SEQ ID NO: 6874 - protein, 515 aa, Caenorhabditis elegans; identical to SEQ ID NO: 6873

SEQ ID NO: 6875 - protein, 606 aa, Caenorhabditis elegans
MKLYFLPSIALWAVFGNGDQVILRLKHSCFNTVGVQHAKDLSSEHPIPCNNFYEYICHKNITRVPSRLRDVRAMEVSDDIDQYQEYVFHASNKQRLWQSVNPDIVSKWLVQFNTYWKGVNWNEHQKKHESFLNLDAHEKYKNLENSFEGYDFQILTKFYKSLKLSVEYLTELKIPISTRNHFYHGLFDEIRDIHILNIRTMSKFSEDRKNELIENVRNLKIIFPYLEYNDVKVWRDAKTAYEKEYYRLKIMIYEPNLSPIIVDKIIRVAAVNPAMEIFEKYITSFTSRFVFQHITAAASGLSFNYQNEIHISVFTMFNPIADPKSVYDQFLYVLCHELQHVHYNVDPPVFDEATWASEKQCVVDRIDHFAAAYKTNRANWTGAPFSYEDSANVAGLRLMLLYVAQKTSDSQEIRDTVERSVARFCTKNRENLHHNPLDVSINVAASEMPTFNSLYNCKPGDRMYVAPENYCKTLNMDIDVEEYKSQKIENDDLFVLTHFMDVLEDTAVELDAANITTFEGKLFDITVEEVEEQEESKEGSAESSSSSSSESDEESSVERELDEVSDGLDDSENETELRKSEIASTSRSSFIWPATVFTLLIKYIKF

SEQ ID NO: 6876 - protein, 363 aa, Caenorhabditis elegans
MVQEDDENLRNSMSLRPTSLSTRPTSLSVNGNEKTLPEESVLRSLSTGTLKYPDDEHLYTFSSANLQDLGAIGNGNFGTVYKMRHKETGKLIAVKRIRCNNIGHREQIRLLREHDTIVKSEKGPNIVKFYGAIFSEGDCWICMELMDISMDLLYKRVYMVKNSRLNENVVGHITVCTVDALDYLKKELKIIHRDVKPSNILVDGTGAVKLCDFGICGQLEESFAKTHDAGCQPYLAPERITSSDKYDVRSDVWSLGITLYEIATGKFPYQEWNSLFDQIATVVSGDPPILHPDSDDFHYSLPLVKFINTCLTKDRRHRPKYDTLKSFDFYRIYAVAGPEIEEAKRILGVEAIDTRNHPVDHRG

SEQ ID NO: 6877 - protein, 363 aa, Caenorhabditis elegans; identical to SEQ ID NO: 6876

SEQ ID NO: 6878 - protein, 359 aa, Caenorhabditis elegans
MDHGDDQDFPMFARPVFLANRPTLESLSSNDGSVAEENPLRSMSTGILKFPDDAHLYPFNHTNLRHLSQVGAGYYGTVHKMQHNESGRLIAVKKIRYNNICDQTRLLKEHDTHMKSENVPNIVKFFGACFSEGDCWICMELMDISIDFLYKRVYSVKKSRLNENIIGHITVCIVDALDYLKRKLNRIHRDVKPSNILINAAGDVKLCDFGICGDLVGSYAITVEAGCVQYLAPERIENMDKYDIRSDVWSLGITLYEIATGVYPYRGWSNQMEHIEIVVNGDSPILLQNMHNLHYTDPLCRFINTCLRKNKDDRPKYVNLKTFSFYKMYAVGGPDIEEAKRILGLEAIDARDHPVEQRA

SEQ ID NO: 6879 - protein, 181 aa, Caenorhabditis elegans
MFWEVVDETHFSKNEVRAIYRAFKETSPNAVINKNIMREKFAELFPHGDIEHYSDLLFETFDNDGNGTINFQEFVKALSILCRGTLDEKLDWLYKLYDPKEKGEVTWDRLFYVITSMDDLMGKHARPHHTREQKCELTNQVFAKFDVGKKGRITKKDFLHICKTDRTILNSISALYTLLPG

SEQ ID NO: 6880 - protein, 453 aa, Caenorhabditis elegans
MIKPLVIIAVLLVNDVVCPPPLRQQAEQAQAQDNVQHQPATGDAQQGQGQAQNTEQQGEYDGRHPGYQFAYTKYLEEVVKILESDPKFNERLKNMKEEDIKAGNIADHIDDLPQEVFDKLHKAKFDEIERLRKQIEEQIKADGGAHNIKMPDHLDVQELEKFHKEDLRKLIQKTVADMNVMDEQRKDDFKQYEMKKQAEEDHKLAQMTPEEREKAKSEHEESLKRHNDHEKLKHPGSKDQLQEVWEESDHLEKDQYDPKTFFALHDLNGDGFWNDFELESLFQLELEKMYNETNPDDDMKERAEEMYRMREHVMKQIDVNQDRMISMQEFLNDSDNQNSNPPKQEEWEDLGQKKVYTDEELQQFEREYAQKQEQQHPQEAVQQPPQAQQQVHPAQQPIQPVNANPPPVQNAQPPVQQQQQPPQQPPQQPPQQNLPPVHHEPIQDHTKDPTYGI

SEQ ID NO: 6881 - protein, 680 aa, Caenorhabditis elegans
MRNKRVLKISDSNSKLRSGGLANIKKSRSMPESPFRTGTPSRMPSAFGEKTYKKKIVDMEKGQRPMIDANRKLSDRNKVLQQEVKKVEQRFSHSRDDFLTLKDIHERLLKENACLKEKRVSPEKLEELSRYRNKVLEYSKCITALRSSAYEKDKRYEMLVQKFKRLQKCLKKSENDDDRMSNGGSDCSAASTVSLDTITEDFEEVFAKDIETDYQALYRENAELQRALNELQLNTSDLSEESFLRDQISFANSTIEQQQLVIDATQDMMSQTAQLKSTIAGQQEHIRSLETTVDDLKQQIASQTERNDVLEFQVLEMEENQKQQDTIAAKQSTFESEKTQLLKELDEVKKAHANQLKSIALIKKELEDHKAAAPSVKPTLSESEQVDALQQKFEKAEAANVSINEELRSASKELGKIRFQMQGKESDLSRERKMTEALSAQLQSVVSSSQEEALKKEEELKKLKATVELQQAEIEKMHEDKKEADQKFKNLEKEYAAYRDEQRPEIKTELERRYEEAKYRLKNALEKIHDYELLYEAAKKSENDGSISKHLEEELIEVKEFNAHLERQFQSQSDIIEALKKKLLQHRSFCDKINKLSELEDASRIQEELVMFSRENNCDEGKIAANIALIIKDIRKNTFYSPLEISTAHHKIRPYSSVDSSAEWQSNSSEGIVSPDEHDE

SEQ ID NO: 6882 - protein, 680 aa, Caenorhabditis elegans; identical to SEQ ID NO: 6881

SEQ ID NO: 6883 - protein, 412 aa, Caenorhabditis elegans
MEMEYFRPFFISMYCAVFLVASSGNFLVSNIIFDFSSFPTTVFKVVYVVMTNKRMQTITNIFITNLAVSDIMVNFTSLWLTPTYTSIGHWIFGGGLCHGLPLFQGIGLHIDGKLSSDQASNYTGTSIFISTWTLTAIAIDRYIVIVHNSSNININDRMSMRSCLSFIVLIWLCSLLLVTPYAINMKLNYIHEPCDFLICSEDWSNAEFRSIFGIVVMILQFILPFVLIAISYIKIWLFLNSRQSMTERKSDIKRKKRLLRMLIVMVVIFAICWFPFNLLNCLRDLKLDNFMRGYFSFVFLSVHLMSMTATAWNPILYAFMNETFREEFAKVVPCLFARRPGTGPIRVITERTAMITNPFRRANRKKKVEEQPVTVISETDSESPLQTAVEPQRSIVYLDEPENGSSCQTLLL

SEQ ID NO: 6884 - protein, 557 aa, Caenorhabditis elegans
MTSSTFSEQNSLPSLPLPELEETIGKYLKSLVPIVPKDELETITTLANDFASSQNGQILQRFLKEKTISSKNWLEDWWYDAYLTNRDSLLTQNMGAVVPKFSVNDSSQIESASHIIHHLMSYWSLIRQEKIEVTKSRGNSWDMNQDYNLFNACRVPALPKDRIKRYFRTEAEGKCPSHVIILCNGHVWKLETTCENSKFLNIFEIQNALKRIKESSRTSVECSIVQLTSLGRDNWAQIRESMIQNSNRNVELFHDVDSAVFCLTLSDDFVENESEVVRVRSTILHCLKLQLMKYSIFGSPLNAYCDKNLNIIVLRDGKTCLQAESSQNKSSSMQPVMPVKIEFLLTGSVSQKISEAERDFYFLSSKTNVNVYHYTNFGATYCKQRTLYADTIIQIALQMAYLKTHNKLAPTYETASTRMFYHGRTETVRSLTTDMEKYLTACENSATNETLKLLFFDAYNSHNTLMDAAREGKGIDRHFYGLRKAQTAIQSYGKSVEIPFLDHKSFSASGGNGNFLLSTSFTFTISNWLDDATNGDEFRENLEYSLNFIKNVILTNE

SEQ ID NO: 6885 - protein, 298 aa, Caenorhabditis elegans
MASTSATLDVLETSKKCLAGSAAAAISKTTTAPFDRVKLVLQLQRQSEFAMAEYNGIRDCISKIRLEQGAMALWRGNGAGVARCLPNHTLNFAFRDIYRNTLLKNVDRNESFGKFLAGTFVSGGLGGATTLFMLYPFDFARTRLALDVKKDGSRKYKGMVDCLKKIKASEGVASWYKGLSSALQFVIASRAIFFGIFDSIRTSVEDPKSLNFAACWAIAQISITTSGMVCYPLDTVRRSMMMQSGKQIKQYTSTKDCWKTLYKKDGINGFYRGALTNSLRSTGGALIITFYYEFSKYM

SEQ ID NO: 6886 - protein, 402 aa, Caenorhabditis elegans
MVAISLFKPEDEKAPISHVEHHPLAGNHCSEHACREQKRFNLQKRHLVLFTIWLMFIIFVVPLFTKLQAEKVSRRAHTNERGIQNIAKEYIAYTEKFDKSYATSQESLKRLNAYYNTDENIANWNIQNEHGSAEYGHNDMSDWTDEEFEKTLLPKSFYKRLHKEAEFIEPIPESLTAKKGESSSPFPDFFDWRDKNVITPVKAQGQCGSCWAFASTATVEAAWAIAHGEKRNLSEQTLLDCDLVDNACDGGDEDKAFRYIHRNGLANAVDLPYVAHRQNGCAVNDHWNTTRIKAAYFLHHDEDSIINWLVNFGPVNIGMAVIQPMRAYKGGVFTPSEYACKNEVIGLHALLITGYGTSKTGEKYWIVKNSWGNTWGVEHGYIYFARGINACGIEDEPIGILA

SEQ ID NO: 6887 - protein, 629 aa, Caenorhabditis elegans
MRYNTDGKNTELHQIHHYQTLSDRKKSIPCRVDSETPLNNSSPRDETDNTMNFAFLLRIFVYAGLFFYVNPNRYADQMYEDLLYYYNKNVRPIKNASESVKVKFGSSLIRIIDVDEVNQVLTTNLWLEMQWFDYRLMWDPGRWGKIRKLHVPVDQIWIPDILLYNNADGEPHITIMSDAIVYYNGLVVWKPPSIYKSFCSIDIEYFPYDTQTCWMKFGGWTYNGFLLDVRQLPVEEWTLVVTTRKLQVCAHASSISFFFRSLEWDLMELNSARHEKIYAGCCGQDFYIDITFKIEIRRKTLFYTINLMIPCTMFGMFFLNTTKSYFECSSTKTKILHFSCKMQIRLFFCLLSKCLSAILTSIVFYVPPIEHKMTFSISILVTLTVFYLILIDLVPPTSLVIPLIGKYLLFTMFLVSISIMLSVISLNFYRRDGSSFPMPHWMKVVFIHTLPRYICIKTAEEDDGSDRGSSISDIGPFMDSRRPSPFFITVNERQLNGRLSELKKKGMHPDLIRNMIQNVEFIAEYFNSLKKEDKVSEDWSYVANVIDRIFLIIFSIMNVVGTWVILLNSPALFDNRTPLFINSVARPLSGDTFEHFINENFTQLAWWASTIKNSTTDVSDSDLCPIKYQ

SEQ ID NO: 6888 - protein, 763 aa, Caenorhabditis elegans
MRCNKQIHQFMYINLQPHITVQVYIFDLFHNTFPLSSLCAHQLRVCLHTQRSVFAYFPRGLIFGNTCFDSFYCLLSHSYFVSDSFCYHFCVLKVIMSNYSTNGSRKIRISNSDDDSRETRFSIQPRNSHKTKEERYRDKEKERDHERHHDRERRDDRYRKVDSRDHRDRNRRSPAGSRTYCRDEPDRRRNNHSDRNRRDRSSERDRDNRSSKSKTKSPDSLRSKSSRKSQTPNHLPDDGKLFDRILDPNYKKKEKTVMEVEDVEMSPVEMLDEEEVSTFTFDDACGPVRPSNEPEEKDYKSEGDPESRPATPKTPLTPDYLENTIVSLNETLSDDEDKGPDDKYGKTPDKEQWESMTENEQKLHRDAMKKRREQRHREAVSKLPVYYPGLRGCQHISEYVILNVIAEGTYGEVFRGKNTRTDEVVALKRFKMEKEKEGFPITALREINMLLKAGAHENIVNVKEILVGSTKTEVYMAMEYVEHDVKSLIDKMRSRNQRFKTGQQKTLMSQLLSGIEHMHKLWILHRDLKTSNLLISHSGILKIADFGLAREYGEARDIEKRMKLTPIVVTLWYRSPELLLEPKTYSTPVDMWSIGCIMAEFIMMKPMFQGDSEPNQVHQIFQMMGTPTEQIWPDIKELKVWNMVEFPPVKPGQLRRIFKGEKLVNETGFDLLNGMLCLNPANRLTASEALQHDWFSEHPKAVPPEDLPVYPAKSELNAAPPENRRKNRLEALLADEEPERAALLRQFNVKAEQLKPSGFQLRG

SEQ ID NO: 6889 - protein, 435 aa, Caenorhabditis elegans
MKKYWSTLHLFQVLCIFIFIRTSSPLTQPNIYNLLQQSNTRPPTANASVPLGVKLGMYLESLGNFRSSEMSFDVDLYVYMSWQDPRLAHNFSDYVLINNDEIRKQIWLPDLYFANARQASFQEVTVPNFNLFVAPDGTVAYSCRCTLTVACSLNLRYYPMDQQLCSIRVLSYAYIAKQVNVTWFDKNPVRFNEEIGLPEFQIEHVSNAYCNGSYQYALTENSYKSDDFSCLSGNLFLSRSIGYNLVQSYIPTGLIVMISWVSFWIDRRAVPARVTLSFTTLVSLTTLGNGLRFGLPQVSYAKAIDLWYGACMFFVFCALLEFATINSYMRKSEKFDSMAKKMQSVVLTGRTRDYLVRGIKESMRIAGGAAGNVVDALNDDWCTYSTENGRKSFSAMVGDIFERAGNAISPRRNRYRGVDQCGHFLLITLKSVFWF

SEQ ID NO: 6890 - protein, 417 aa, Caenorhabditis elegans
MRVMNGFVEPVIKTYNCTKDQADTAVLVVPMASSLILGPFCSIFYQRSGARISIIAGSFLTGGSFVVGPFCKNIYLLMLATFGMGIGCGLMRNSIISIQCEYFKKKRNTVMAAISIGPGLGIFILPRTLKFIMVKYNSWGPAWWFLSLFYIVSAIMGLFITKPPSEQTSTFSFGSAFKVCKKLEFDLHLIACFFASSVMFIYIANILILMESENIEDKEILYGYQGLTSIAGKFVLTFVMSLNKVHNGIIMILSYVIAQLSLSAAAFCYKFWQFRLQNAFAGIGIGLYQACLAPFLVALVGPSQLAYALGFTNLINGVSIISGVWISGLPPSILLSKFSNLIGHNFSGFASKGTTGDHARSAFFVSIWLGLAAIVMSIATSSVLMAREKHKRKPSMKQMKHSSELNALTNITSVENS

SEQ ID NO: 6891 - protein, 288 aa, Caenorhabditis elegans
MILKLNFCLSTYSVLILLSLSTQAFAANQAKTKVVPSSTISTKSLKNGISEQVEGSANIPGRLADIEVNGSGYPTDDEDGDDVHGSGKPPSSATTKSDKVTSPSHAVVTAKPTTVPTTTASFKPPVQPKPKPAANDKEIKVEEDEDDDEDEDEDDEDDEEDFADENIHNDEDFFTTTTTTTYRPIVVATTSTPRSAATNPPRQQPPMVTSTISSGPFSPFHETLANGFYAAIAGGVLVAVITAILLVLFVVFRIRKKDEGSYALDEPKQARPYASYGYTKASTKEFYA

SEQ ID NO: 6892 - protein, 751 aa, Caenorhabditis elegans
MFHQQPPVVDLNNLFMYHLLVSFNEPTNYCQLLQIHNYSYPLNTPQIIKCKEQEKRWRHRKIKSPQMSTPDDPVIHSPPSIGAAPGYHGSGVKLEESSGACGSPDDGLLDSSEESRRRQKTCRVCGDHATGYNFNVITCESCKAFFRRNALRPKEFKCPYSEDCEINSVSRRFCQKCRLRKCFTVGMKKEWILNEEQLRRRKNSRLNNTGTCNKRSQPGNQQSPQGPNQQPHLSPHHPGVAIYPPQPQRPLTINPMDNQMMHHMQANRPNAMPQLISPPGAQPYPLTSPVGSSASDSPPNRSLTMMHNGEKSPDGVSGSAGKYDPNIMAHRAPPPSFNNRPKMDSGQVVLSTEEYKQLLSRIPGAQVPGLMNEEEPINKRAAYNCNGHPMPAETTPPYSAPMSDMSLSRHNSTSSGTEKNHMTHSTVSAIPGNSAQNHFDIASFGMGIVTATGGGDAAEEMYKRMNMFYENCIQSALDSPENQEPKPQEAMIPKEEYMTPTHGFQYQSDPYQVPPAERNINYQLNAAELKALDAVREAFYGMDDPMEQGPDIMNIMDVTMRRFVKVAKGVPAFREVSQEGKFSLLKGGMIEMLTVRGVTRYDASTNSFKTPTIKGQNVSVNVDDMFAKLNANAQAQKAKCLEFFGFFDEEIKKNELAVYLVMLAVLFSVRSDPPMNENDVRIVTERHNHFMSLLNRYLESLFGEQARRIFERIPKALGLLNEIARNAGMLFMGTVRSGEAEELPGEFFKIK

SEQ ID NO: 6893 - protein, 318 aa, Caenorhabditis elegans
MEEIIKHFFDIIIEMSERALRRTTFSGRLLRFKEEEEEIDRKTAIVKGGIYMALDIVIVLGISCSLFLWFSGSGINPYERAMPCGDISIQQPFKENTVGLKHLLVITLGSPFLIVALVEAILHFKSKGSNRLAKFFSATTITYLKYLLMYAACTFAMEFLKCYVGRLRPHFFSVCKPDWSKVDCTDKQSFIDSSDLVCTNPNPRKIRTARTSFPSGHTAAAFHVFLFVYIYLRRMAENTGIKEIITIRNILVPSYALWTVFCAVTRVTDNWHFPTDVLGGVILAVVFIIPAFYSSWTTTEMIYKTRKIEPGNQNKKTD

SEQ ID NO: 6894 - protein, 558 aa, Caenorhabditis elegans
MLDACSFNRFDSNRSSARRFSRRGSDYFGDKGISMDERIVLNVGGVRHETYQATLKKIPATRLSRLTPSLANFDPLLNEYFFDRHPAVFAMILNYYRTGKLHYPTDVCGPLFEEELQYWGLDASDTEPCCWMQLLHAKDTQETLAVLDRMDADHEDDPQLREQDTMKKFGWEEDYFQGKRTRWMKLKPQMWSLFDEPYSSQAAKLIAGISVLFIFISIFSFCLKTHQSFRLPVLIGQNITMPGGVVQPSIERVSTEPLPIFGQIEMLCNIWFTLELIIRFVFCPSKIRFFKSPLNMIDLVATLSFYADAMMVRVVEDEPKDVVEFLSMIRIFRLFKLTQHHQGLQILIHTFRASAKELILLVFFLILGIVIFAALVYYAEKMEANPNNQFQSIPLGLWWAICTMTTVGYGDMTPHTSFGRLVGSLCAVMGVLTIALPVPVIVSNFAMFYSHNQARDKLPKRRRRVLPVEQIRLQARRHAAVLEPSASQGGLGGGQAIRRRNMPILIDQNCCDEENHNHKHREKSENSDEGTNSSSTTGVDTVVKLGPSETAITTTIIS

SEQ ID NO: 6895 - protein, 558 aa, Caenorhabditis elegans; identical to SEQ ID NO: 6894

SEQ ID NO: 6896 - protein, 1283 aa, Caenorhabditis elegans
MHLHSLRLFCFSYVFFFCSFPLLPFSSNTNWSNVCKFIKVIVGSTNNFLKKTFGFQIKCTTRYEKLLFFLGVVFSILTGMCQPFESYTLGETSQVLVKVTNAINNKTIDPVDLAHAYKLFESDMNRVVLLFFLVGFAYFTFGFLQFSIMKFVGDNTAYNVRRQYISRLLRKDISYFDGMSTGHLSIVLNDNMERFREVFNEKIALIIALLTDFVIGTILAFYTDWRLACYGTVFSFGIVLSGLLDSWGKMKNNEKQNEHISNAGSIAFQALGCYKTVSSLNGQQQEVERYTEELKNGEKYALNRAFVFSLSRSADYFFTNALNFVILYFGANMIYEGTIEPGVVVRILYYILFGSYCLGEAILHISRLASAIPLTVPIADILLDSDATADEFFSEEIKDTFQGIISFKNVLFSYPTRPDVPVLKEISFNVQGGECIALVGASGSGKSTVIQLLLHYYNIDSGRISIDGNDIYNINIKQLRQAMGVVFQEPVLFNTSIEENIRFGKPDATEQEIIDALKNANAFDFVCNFPDGIKTIVGERGAQLSGGQKQRIAIARTLVRNPRILLLDEATSALDNESEFIVQEALQKASIGRTTIVVAHRLSTIRNANKIIVMEKGEIVEVGDHKQLIAMNGVYNNLVQTQLMSTNYEKMNENEERVTRQSSHSDFPSNEISHQKIDQEDDYVKKLIAEIKEEGAKKSNICEIIKYCRSEYCILFIAVLGSAIQGIYYPLSSQLMIKSYEAYAFDKDEMLSKSHFWALSILFLAFTRPIFIFFQYYFFGKTAEKLSIKLRSMSFKHLMSLPCAFYDDPCHTATRLSNRLNADSSNVTAAVDDRLGSVIMTLVAILLAVIMSFFYSWKMSLQVLMFCPLLYLAGYCNDNFVDQAVEEDSIAFEKSNRAAIEALENVRTVRALNMENRVILLVTSHLQKIRNSYFKRAVIQGTANGFACSCYFFIYAVSFKFGTWLVLREEILPMDTYLVLMTLSMTASYAGSAVAYLPDHRKAIHAAGLIFHLFTYPAIMPYDSSQGKRNIKNGEIELKNVSFEYAQRSDKMILDGVSLKLPAGRTLALVGPSGSGKSTIISLLERFYHAVDGEVKIDEENVVDVNLHHLRESVSLVSQEPVLFNCSIKENFLFGISHNASQLEIDQALKVANAFSFVSQFPQGLDTLVGERGAQLSGGQKQRIAIARAILRNPKVLLLDEATSALDSDSEKVVQNALDTASERLSTVVVAHRLSTVVNADSIAVLKNGKVAEQGTHEELLRKRSIYWRLVQKQGIQVETLIE

SEQ ID NO: 6897 - protein, 1238 aa, Caenorhabditis elegans
MENSENDVLIPVENEKKTTNWTKFVKVVWQCTSKWEKFLFVIGVVSAICTGLTQPFMSYTFGEVSQAFVRITAAVNNASLDPSDLEKAYEMFHADMNNVVIHFGLVGCAFMFFGFIQFSLFKYIGDNTTYRLRHKFILRLLKKDAKYFDTISTGYLSTVLNDNLERFREAFNEKIAFIICFSTDFAIGTALAFYTSWTLASYGSVFAFGIVISGLLNSTSMMKSNEKQSMHYSNAGAIAFQALCSFKTVISLNGQTQELEKYSAELKEGEKFGSRRAFFLATSRGLSHFFCNALNGTILYVGADLIYNKTMNTVAIVTLFHYMLFSAFSLGEAFLHISYLLNAINSATPIFDVLTSDDDMIENNQDNEQTDSNKTIQGMLSFNNVKFAYPSRPDVDILRGISFDVKQGECIALVGASGSGKSTIVQLLLHFYNIQSGTIKIGDSHLHDINLKQLRNAIGVVSQEPVLFNTTIEENIRFGNPNATSSEIYEALRKANAYDFVCNIKDGLKTIVGERGAQLSGGQKQRIAIARVLVKNPAILLLDEATSALDSASERAVQLALKKASEGRTTIIIAHRLSTIRHCDKIMVMSNGKIAEVGSHEELISMDREYSNLVRAQFFDSQSVEEDINGQGAEEVIQKTPPNLNDGEPLEELLKETSSDIEIKSNIWEVLRECRPDAFLLSMAVIGSAIQGCNFPILSQIIVQTYKAYAMDGENILTYGHFWAAMFLVLGVIRPITLYCQFFFFGKVSEKLSTRLRIKSFQHLLSLPCAFYDDPKHSPTRLVNRLNTDPSNIKAAVDARLGSLLMSMVSFSLAILIACYYSWKLTLQAILYYAKFLYKKTTTISIKEDSVAFENSNKIAIEVLDNMKTVKALNMEARVINLVMEYLAVLKTSYPRRSVVMGLANGFSAGCSQIVYAISFKFGTYLILQKEVIPMDMYLSLITLSYTSNMAGSAISYMPDFRKAIHSAGLIFNLFTYPATMPFNSDTGSRSITKGEVNGENVKFHYHQRPDYTVLDSVNLKVEAGKTLAIVGPSGSGKSTIISLLEMFYRADQGFIKIDNDNVENINLDHLRSNLGLVSQGPVLFNCSIRDNILYGLTRNISQTEIENALQIANAFNFVFQLPQGLDTIVGDRGAQLSGGQKQRIAITRAILRNPKLLLLDEATSALDTESEKIVQNALDTASERLSTIVVAHRLSTIINADSIAVLRNGKVVEQGTHNQLLAVKGDYWRLVQHQKSS

SEQ ID NO: 6898 - protein, 1238 aa, Caenorhabditis elegans; identical to SEQ ID NO: 6897

SEQ ID NO: 6899 - protein, 1158 aa, Caenorhabditis elegans
MEESSNDYTTPLIAQSNEKKPLELCSFIRVIFKCTSCFEKFLFLIGVFFSLVTGLCQPFVSYTLGETAQVLVTITNAINNKTIDPADLKKAYEQYERGMYQVVLYFFLCGCAYFTFASIQHAIMKYVGDNTTYRVRKQYISRLLRKDAEYFDNVSTGHLSTVLNDNLERFREVFNEKIALIFALLTDFVVGTALAFYTDWRLASYGIFFSLGIAFSGFINSAGVMKTTGKQNTHYANAGSIAFQTLGAYKTVCSLNGQNTEIERYTEELKAGEKYGIHRALMYSISRGFTYFFCNSLNTVILYVGANMIYSGSLEPAVVVRIFHYMMFGAFCLSEALPHISRLAGAISSTAPIAEMLIKEDNVIEKDETDYDVEVEVNGNISFKNVKFSYPTRPDAQVLKGISFDVQNGECIALVGASGSGKSTVVQLLLHYYNIDSGNIFIDGMDLNDMNIKRLRRVIGVVSQEPVLFNTTIEENIRFGNPNVSLPEIYGALRKANAYDFVCSFPKGIKTIVGERGTQLSGGQKQRIAIARTLVRNPKILLLDEATSALDNESEQVVQKALENASQGRTTIVVAHRLSTIRNASKIIVMQKGEIVEVGNHDELIAKRGVYNDLVQAQLLESHDDHEELPPLAARQLSQELSPLHSYAIQRSTSNDAGVHDDDMERILDELSKEGAKKSNLREIVKQCRPDYCFLFIAVFGSAIQGVSYPILAQLIVRTYEGFAMIGEDMLYYSHLWALSFMFLAVFRPLTLYCQYYYFGKVSEQLSTRLRIKSFSHMLSLPCAFYDDPNHSATRLSNRLNTDSSNVKAAVDDRLGCVIMTVVAISIAITTASLYCWKMTLEVLIFFPLLYLAEYCYDAATETSIQEDTIAFENSNRTAIEALENMRTVRALNLEDKIMSLISEHLQKIHKSYFKRAIIQGAANGLSLSCYLFVYSVSFKFGTYLALRKEVAPMDTYLILETLSMTANMAGSAAAYLPDYKKAVHAAGLIFHLFTYPATMPFSSSDGKKNIEKGEIIGENVQFHYDQRPDRMILNGVNLKVDPGKTLALVGPSGCGKSTIISLLERFYHAVDGEVVSIDAHKIDSENVEDINLNHLRSNLALVSQEPTLFNCSIRENLLYGLTRSVPQLELEKALQTANAFNFVFQFPQASFNCAQLT

SEQ ID NO: 6900 - protein, 1114 aa, Caenorhabditis elegans
MEENSNNFSTPLLPQSDEKKPSQICSFIRVVFKCSSCFEKFLFLLGVLFSLMTGFCQPFMSYTFGEVSQVLVTITNAINNKTIDPADLEKAYEEYERGMNQVVFHFFLCGCAYFIFASLQHAIMKYVGDNTTYRVRKQYISRLLKKDAQYFDSVSTGHLSTVLNDNLERFREVFNEKIALIIAFVTDFTLGTALAFYTDWRLASYGIFFSLGIAFSGFINSAGVMKTTGKQNTHYANAGSIAFQTLGAYKTVCSLNGQKTEIERYTEELKAGEKYGIRRALMYSISRGVTYFFCNSLNTVVLYVGATMIYSGTLETAVVVRDDNVIEKDETDYDVEVEVNGNISFKNVKFSYPTRPDAQVLKGISFDVQNGECIALVGASGSGKSTVVQLLLHYYNIDSGNIFIDGMDLNDMNIKRLRRVIGVVSQEPVLFNTTIEENIRFGNPNVSLPEIYGALRKANAYDFVCSFPKGIKTIVGERGTQLSGGQKQRIAIARTLVRNPKILLLDEATSALDNESEQVVQKALENASQGRTTIVVAHRLSTIRNASKIIVMQKGEIVEVGNHDELIAKRGVYNDLVQAQLLESHDDHEELPPLAARQLSQELSPLHSYAIQRSTSNDAGVHDDDMERILDELSKEGAKKSNLREIVKQCRPDYCFLFIAVFGSAIQGVSYPILAQLIVRTYEGFAMIGEDMLYYSHLWALSFMFLAVFRPLTLYCQYYYFGKVSEQLSTRLRIKSFSHMLSLPCAFYDDPNHSATRLSNRLNTDSSNVKAAVDDRLGCVIMTVVAISIAITTASLYCWKMTLEVLMFFPLLYLAEYCYEAATETAIQEDTIAFENSNRTAIEALENVRTVRALNLEDKIMSLISEHLQKIHKSYFKRAIIQGAANGLSLSCFLFVYSVSFKFGTYLALRKEVAPMDTYLVLMTLSMTANMAGSAAAYLPDYKKAVHAAGLIFHLFTYPATMPFSSSDGKKNIEKGEIIGENVQFHYDQRPDRMILNGVNLKVDPGKTLALVGPSGCGKSTIISLLERFYHAVDGEVKIDSENVEDINLNHLRSNLALVSQEPTLFNCSIRENLLYGLTRSVPQLELEKALQTANAFNFVFQFPQASFNCAQLT

SEQ ID NO: 6901 - protein, 677 aa, Caenorhabditis elegans
MRLQVQIGTECVVVPCKPDDTIHAVAKKSVEKLRRLRPKLPLADDYFEVRRTVGNSLLDPEDLVSDVLKDSDFIIVAASVEETEDAKEAKKQEEIDNARAEIEKIDNRRRKVSFADSLAPMVLAPPTKLLILDGNSLLPEDLVRCEKGECAIQLSMESEDRIRKARTFLEKIASEHRAVYGVTTGFGTFSNVTIPPEKLKKLQLNLIRSHATGYGEPLAPNRARMLLALRINILAKGHSGISVENIKKMIAAFNAFCVSYVPQQGTVGCSGDLCPLAHLALGLLGEGKMWSPTTGWQPADVVLKKNNLEPLELGPKEGLALINGTQMVTALGAYTLERAHNIARQADVIAALSLDVLKGTTRAYDPDIHRIRPHRGQNLSALRLRALLHSEANPSQIAESHRNCTKVQDAYTLRCVPQVHGVVHDTIEFVREIITTEMNSATDNPLVFADREEIISGGNFHGEYPAKALDFLAIAVAELAQMSERRLERLVNKELSGLPTFLTPDGGLNSGFMTVQLCAASLVSENKVLCHPSSVDSIPTSCNQEDHVSMGGFAARKALTVVEHVEAVLAMELLAACQGIEFLKPLISTAPLHKIYQLVRSVAPPLNEDRYMKPEIDAVLEMIRENRIWEAVLPHLETLEAMEELDPDALRQFTKTPTGIVQDRSMIPISDDEESIE

SEQ ID NO: 6902 - protein, 435 aa, Caenorhabditis elegans
MIGRISQPLLNTSQKFMAPAARTLMLHEHHGMKILQNYEIKVPPFGVAQDAETAFSEAKRIGGKDYVVKAQVLAGGRGKGRFSSGLQGGVQIVFTPDEVKQKAGMMIGANLITKQTDHRGKKCEEVMVCKRLFTRREYYFSITLDRNTNGPIVIASSQGGVNIEEVAATNPDAIVKMPIDVNVGITKELAHEIAVKMGFSKDCEQQASEIIEKLYQMFKGSDATLVEINPMAEDVNGDVYCMDCKLLLDSNAEFRQAKLFDLKDKKQEDELEIRAAAANLNYIRLDGTIGCMVNGAGLAMATMDIIKLHGGEPANFLDVGGGATVEQVTEAFKIITADKDKVSAILVNIFGGIMRCDVIAQGIIQAARELDLKIPIVVRLQGTKVEDAKALIATSQLRILPCDNLDEAAKMVVKLSNIVDLARATNVDVKFELSI

SEQ ID NO: 6903 - protein, 1227 aa, Caenorhabditis elegans
MKLKLTVLLILVHASASYKPPAIEVEDYQVQEHDSIGKFVELEEHTRLILKCSAHHNGDLKYNFPSMEGNVGYDENNFKKRMEEYYDDAFGDKVLTLNDVRESDTGTYSCSSMEHSSLNDTIYVFVHRKKVFLPLKSVMIIYKQGEVMVPCKTTKFVDKSDIELYASNVLVKEASKYNYDQRYGFKITKKLYSEKQIVDVNFECRYKKEENQTATYIITEKEASSDDGYHFSWEKGFQWPHVGYNFSLTCNLNYNGSKIFHGYTNKLSIECPQCSHDPGSHVHVDRHRIIGNKISTTVRIQHLELEDSGKYTCIWEHENKETKYTDYHLYVAPKKAQIKVIETSPTIMRIKENRATSLTAKFAIYPFEKESYTAKWSRIYNSSIHEGPQSETIINDDFRKIAATSFGDGAFSENLDIKAFAVSTNMSGTYVLSISHMDTVQVVQWEVAIENDEPDVQITVREPSSFFISNQEYYKPDTNLHIECISISIPPADVVFEYKTKNSEQFQEIEPNKLVSVGGTFDRGLIYNVTFTEGMDLKCSSIRKGNRAITVNKLIKIGEGFEVRPHHEKSSKATESEPSKIIYEGDNVKLTCVFPLDSDDWSVSWRFENSKSSDISSIPTTTETEIKQYSKHLILNLRDVTTSFTGTYTCVVKNEDSEKLLETSIDVKAISKPSITGGNSNAVVIVDYDQYFEINCNMTGTPPPVYQWFKDGNPYTHGDVDGSILRVSRARGEDDGEFHCLATNRAGDKLNSIEVQVNNAPKGSLFFYWFLALLLLISIIAVFLLTCKLRASNRLTKQKDIALNTLYETMIKHQAGPLPEEMKDLPVEERTYYLPYNNDYEIDPVNLEILNPIGSGHFGVVKKGLLGMAYPKSKIESKTRLPVAVKSSTNPFNVELQKMMAEELKVMCAIPKNPNVLALIGAVTKNMRQGQLYIVTEFIDGGNLREFLQAHRNTFINELVEDEHVPVDDSYLVPNSVKKKIYKFDEKLGEGTRLLVEDPDALCTSDLLSIGLQIAKGMAWLADVPCVHRDLACRNVLITKTKIVRIADFGLSKKHTNKTYYRTKKSKDTPLPVRWMPLECIEEFKFTQKSDVWSFGICLYEIFTLGGTPYPNCDTFNVIEFIRNGNRNKQPEYCHDEIYELMKVCWQFNPKDRPTFNDCITFFENHMRDSSSQFLERVENMLHTEMQEQSKLDDWIQDSRPDVPNVSFQKSPKKQKEERYLIVESHA

SEQ ID NO: 6904 - protein, 1103 aa, Caenorhabditis elegans
MSYFLASCLGVGLLSTVSCSLQGLTSHYRENIPRFKHVANERYEVFLGDEIKFDCQTAASKISAFVEWYRNDKLLKNDQIDKDKIRKDNNRMMLHLKNIDVSDQGLWSCRVHNAYGQISRNFTVEVIDFCDYFLFPDIHHLNIPMECVCLWKYNKEAKRSDVNYAAVTGEVCSKYASRMINRARKPLPMIPCFGDHCKEFDTTPVSDFGLPGKPEDDPLVKRVVLKKDDVIVPVHDSEESPSESRTEFINADEKENKEDEEEDYSVSQPVAPDAGLTELNITAEEPPYFKSNDNIVLFNETHALPAGRTLKLNCRAKGYPEPQIIWYKNGKMLKKSSARSGGYEFKFNRWSLEVEDAVVADSGEFHCEALNKVGSAKKYFHVIIVNRMRRPPIIVPNILANQSVNINDTATFHCKVVSDLLPHIIWVRINKINGSYSYYNNSAEEYMFNYTEMDTFDKAHVHHVGDESTLTIFNVSLDDQGIYACLSGNSLGMSMANATLTVNEFMAIHLLTGDEPKIDRWTTSDYIFTTILLFLLLAATLFGILFMVCKQTLHKKGFMDDTVGLVARKKRVVVSKRPMNEDNENSDDEPSPYQIQIIETPITKKEAARKQRKRMNSENTVLSEYEVDSDPVWEVERSKLSLVHMLGEGAFGEVWKATYKETENNEIAVAVKKLKMSAHEKELIDLVSEMETFKVIGEHENVLRLIGCCTGAGPLYVVVELCKHGNLRDFLRAHRPKEEKAKKSSQELTDYLEPRKASDKDDIELIPNLTQRHLVQFAWQVAQGMNFLASKKIIHRDLAARNVLVGDGHVLKISDFGLSRDVHCNDYYRLKRGNGRLPIKWMALEALDSNVYTVESDVWSYGVLLWEIMTLGGTPYPTIAMPELYANLKEGYRMEPPHLCPQEVYHLMCSCWREKLEERPSFKTIVDYLDWMLTMTNETIEGSQEFNDQFFSERSTASGPVSPMESFQKKRKHRPLSAPVNLPSEVDQNPQHTICDDYESNFSVEPPNDPNHLYCNDNMLKNHIITPETSQHQTHQYYNTTSKIQYLHFTFDDPDCMTRSRDSAIFEESYHPNYIQSHPLYSKIIIKKNMTPRNPLPTKETIV

SEQ ID NO: 6905 - protein, 353 aa, Caenorhabditis elegans
MPERADASSGMVLLTGNSHPELAKMVSERLEIRLGEATVYNKTNRETSVDIKQSVRGKHVFILQSGSKNVNNDVMELLVLIYACKTSMSKTITVIMPYLPYSKQCRMLRRSSIAMKLVAEMICKAGASRLVSLDLYKKEIQGFFSCPVDNLRASPFFLQHIKTNIPDYKNAIIVAKSPGVMNKATSYADRLRLGVAVIHGEQKDEEESGLEDGRQSPPPNVTSYDFLPAQESKQKPPLTVVGDVGGRIAIMVDDIIDDAQSFVAAAEVLKARGAYKIYVIATHGVLSSDAPALLEASPITEVIVTNTVPHDLQKMRCHKIKTVDVSLMICEAIRRIFHNESMGQLFRDVTLDD

SEQ ID NO: 6906 - protein, 383 aa, Caenorhabditis elegans
MLWKKRKVLYFAGISVFILILLLLKLNSKPKANVWPTSSKIVIYNRIPKTGSTTFTNAIAYDLYKENGFSVLHVNMTKNRQVMSLPDQYTFVNNITTWTERLPAFYHGHVAFIDFQRFGIANPIYINIIREPLERLLSHYYFLRYGDNYRIGLKRSRAGNNETFDECYSRGGKDCDMKQMWIQIPYFCGHYHFCTEVGNPEALRVAKQNVLEKYLLVGTTSRMRDMIALLEVTVPDFFKGALGHFDSLDANRAHLRYTKKKIPPNDQTLSMIRRDEVYKMEREFYDFINNLFDAVFNFSCNLHLYQILLIVLFPYVIISSLKKLRLYFFFLVLFPISHHCVVCFFFIFIFNFSSIFPTIPKQNQTGRAIYCSNSLCHLVSFYV

SEQ ID NO: 6907 - protein, 435 aa, Caenorhabditis elegans
MLSRLTSRNVLLARNVATAATQERQKIKVDNPVVDLDGDEMTRIIWKEIKNKLILPYLDLDIKYYDLGLEYRDETNDQVTIDAAHAILEHSVGIKCATITPDEARIKEFNLKKMWLSPNGTIRNILGGTVFREPILCKNIPRLVPGWTQPITIGRHAFGDQYKCTDLVIPSGSTLQLLVNKPDGSKDVHNVYDFKKSGGVGLAMYNTDESIKGFAHSCFQYALMKQWPLYLSTKNTILKKYDGRFKDIFQDIYEKKYEADFKNNKIWYEHRLIDDQVAQALKSSGGFVWACKNYDGDVQSDIVAQGYGSLGLMSSVLMCPDGKTIEAEAAHGTVTRHYREHQKGNSTSTNPIASIFAWTRGLHHRGVLDNNEALKTFSLTLEKACIDTVEEGKMTKDLSICIHGTKKGTEKGAYLITEDFLSAIDTKMAELMRQD

SEQ ID NO: 6908 - protein, 567 aa, Caenorhabditis elegans
MSFTSTTPSARAPLGGRTTGNVTSQDRMLKIVTEMRSGAGSGLSPFGQNAASTIRDSREREKKEMSDLNDRLASYIEKVRFLEAQNRKLAADLDALRSKWGKDTHNIRNMYEGELVDAQKLIDETNKQRKDMEGQLKKMQDELAEMRRKLEDATKGREQDRAKIDALLVTLSNLEAEISLLKRRIAQLEDEVKRIKQENQRLLSELQRARTDLDQETLNRIDYQNQVQTLLEEIDFLRRVHDNEIKELQTLASRDTTPENREFFKNELSSAIRDIREEYDQVNNVHRNDMESWYRLKVQEIQTQSARQNMEQGYAKEEVKRLRTQLSDLRGKLADLESRNSLLEKQIQELNYQLEDDQRSYEAALNDRDSQIRKMREECQALMVELQMLLDTKQTLDAEIAIYRKMLEGEENRAGLKQLVEQVVKTHAITQETDTETMRVVKGETASRQSFQRSAKGNVSIHEASPDGKFIVLQNTHRAKDEAIGEWKLKRRIDGKRENVYTLPRDFVLRAGKTLKIFARNQGVASPPDQLVYDAEDSFGSGNNVQTILFNKEGEERATHIQRQSTA

SEQ ID NO: 6909 - protein, 567 aa, Caenorhabditis elegans; identical to SEQ ID NO: 6908

SEQ ID NO: 6910 - protein, 572 aa, Caenorhabditis elegans
MQQPLIILGIGIVLALVSNVESGVLRKPVDEHEYEKWTNARGNEAAVPPPKYKMLRYAKKAINEPENRKMSCLFCTFAVDGVQALIAQNSTDNEIAAFLVNLCDLFDVEQPHVCKNIIYAFKDEVVFVLERSVFTPEEICGAFIANCGHSDKPLTHMWNITIPGGKPPIKPWPKIPDNKPTFKVLHLSDIHIDHQYVVGTEAYCQLDSALGTYAMCCRDYSQDSQGAPTNLKDKPIYVPAGPWGMPYLCDLPYQTFESAMKHISKTFKDLDYIIITGDFEAHDSWDYTEDLTRENMNNMTNVFLEYFPGVPVYVSIGNHEGVPQDAMAPHTMPEYDTRGPQWLYKIMSEMWSHWIPQEALDTVQYRASYAVYPKPGLKLISLNTIYCSEFNFYLYVNEVDPDATLEWLIEELQDSENKGELVHIISHIPPGDNYCLKGWSWNFFEIVKRYENTIAQMFYGHTHYDQFMTVKDAKTYFANVTEANMKNKEPEWVLSYDTREHYQMADFSPQSWSDLSDKLWTNTTLFRDYVRLYYRNHYNNECYTDYKCRYTFVCDIKKGRSYDESFCDHLTK

SEQ ID NO: 6911 - protein, 444 aa, Caenorhabditis elegans
MSLGNVIIASSVNTRSPIDSHLFRKILCFRIYDDTISFERKIGIIIPTIFAVIILVGLVGNALVVIVAFGRQMRNSTNTLIIGLAISDLMFLLLCVPFTAVDYAAPTWIFPEWTCSMINFFQHTSAYCSVWTLTLMALDRYLAVVYPVESMTLRTPRNTVIALCFIYIIIIASQIPVGRMHGIYVYDFIMEKRSTCAILTIATAEATPTMARTYFMTFNVFGYVLPLGISVVLYGLMLRKLWDMPRPGNSQSVGGRNLTNRDSGSSIRRRPEATAAKRKVTRLVLCVLITWALCWLPLNVCFFMSGLAYPEPLVISHGVIMVIVQIASQVLAYTNSCLNPILYALMSQSFREGFIRVMKMLINKLSRGRFCTNYRRSALRTELTHYNQTPAHPANTVVQVSNGERSSLLKDNSSSATSVQPLRTSIQAKKTKNVCDTMLFVCFF

SEQ ID NO: 6912 - protein, 887 aa, Caenorhabditis elegans
MAFNNLIRNLAIGDNVYKYFDLNGLNDARYNELPISIKYLLEAAVRHCDEFHVLKKDVETILDWKNSQRNQAEIPFKPARVILQDFTGVPAVVDLAAMRDAVQNMGADPAKINPVCPVDLVIDHSVQVDHYGNLEALAKNQSIEFERNRERFNFLKWGSKAFDNLLIVPPGSGIVHQVNLEYLARTVFVGKDGVLYPDSVVGTDSHTTMIDGSGVLGWGVGGIEAEAVMLGQPISMVIPEVIGYELVGTLSDTVTSTDLVLTITKNLRDLGVVGKFVEFFGTGVASLSIADRATIANMCPEYGATIGFFPVDSRTIDYLTQTGRDTDYTQRVEQYLKSVGMFVNFTDDSYRPTYTTTLKLDLGSVVPSVSGPKRPHDRVELASLAQDFSKGLTDKISFKAFGLKPEDATKSVTITNHGRTAELTHGSVVIAAITSCTNTSNPSVMLAAGLVAKKAVELGLNVQPYVKTSLSPGSGVVTKYLEASGLLPYLEKIGFNIAGYGCMTCIGNSGPLDEPVTKAIEENNLVVAGVLSGNRNFEGRIHPHVRANYLASPPLAVLYSIIGNVNVDINGVLAVTPDGKEIRLADIWPTRKEVAKFEEEFVKPQFFREVYANIELGSTEWQQLECPAVKLYPWDDASTYIKKVPFFDGMTSELPSQSDIVNAHVLLNLGDSVTTDHISPAGSISKTSPAARFLAGRGVTPRDFNTYGARRGNDEIMARGTFANIRLVNKLASKVGPITLHVPSGEELDIFDAAQKYKDAGIPAIILAGKEYGCGSSRDWAAKGPFLQGVKAVIAESFERIHRSNLIGMGIIPFQYQAGQNADSLGLTGKEQFSIGVPDDLKPGQLIDVNVSNGSVFQVICRFDTEVELTYYRNGGILQYMIRKLIQ

SEQ ID NO: 6913 - protein, 447 aa, Caenorhabditis elegans
MDRTIVTEWNRVCDNNWSRAHVHMSYSLGYLVGCFVGGFISDRYGRKTAITGFGILTMLFGFLLTYSKEFEIFLVVRFLLAATNEAADLAAYVLCMEVTGTKYRSIVGSLIQAPWACGYAFLALIAYLTKSWTMIHLICVLLHIISLMLLYFLPESPRWLILNNKTKQAEKIIREACHYNKSRLPSDLGLVRHAEKKKWMKHNEKPSYFHLFRSSELRFRNVVLFIVWVIQKNIFQNSRFQYSDSNCSGLLRNGYCIVRSVITRKVGRTLSEKFYRNQKLCFRRVFDGNFFLNNAMAGAIELPTLVFCVFLLRMGRKRSQMLVLFGSGLFLLTSVVMVYRKQSTLALIFMLLSKACIQGSFNILYIFTSELNPTVVRNSAVGISSMVARMGAGASGYIAILSDVTMPLVPMTIFACFSLLAGCLVLLLPETQGLPLPDTILVIVLFF

SEQ ID NO: 6914 - protein, 1268 aa, Caenorhabditis elegans
MKKTKVNPEDDITLGKFTPKPSPQDSYQGNFFDVFRDADYKDYILFSGGLILSAVNGALVPFNSLIFEGIANALMEGESQYQNGTINMPWFSSEIKMFCLRYFYLGVALFLCSYFANSCLYTLCERRLHCIRKKYLKSVLRQDAKWFDETTIGGLTQKMSSGIEKIKDGIGDKVGVLVGGVATFISGVSIGFYMCWQLTLVMMITVPLQLGSMYLSAKHLNRATKNEMSAYSNAGGMANEVIAGIRTVMAFNAQPFEINRYAHQLNEARRMGIRKAIILAICTAFPLMLMFTCMAVAFWYGATLAAAGAVSSGAVFAVFWAVLIGTRRLGEAAPHLGAITGARLAIHDIFKVIDHEPEIKCTSSEGKIPEKIQGKLTFDGIEFTYPTRPELKILKGVSFEVNPGETVALVGHSGCGKSTSIGLLMRFYNQCAGMIKLDGIPIQEYNIRWLRSTIGIVQQEPIIFVATVAENIRMGDVLITDQDIEEACKMANAHEFICKLSDRYDTVIGAGAVQLSGGQKQRVAIARAIVRKPQILLLDEATSALDTESERMVQTALDKASEGRTTLCIAHRLSTIRNASKILVFDQGLIAERGTHDELISKDDGIYASMVKAQEIERAKEDTTLDDEEDEKTHRSFHRDSVTSDEERELQQSLARDSTRLRQSMISTTTQVPEWEIENAREEMIEEGAMEASLFDIFKYASPEMRNIIISLVFTLIRGFTWPAFSIVYGQLFKILSAGGDDVSIKALLNSLWFILLAFTGGISTLISGSLLGKAGETMSGRLRMDVFRNIMQQDASYFDDSRHNVGSLTSRLATDAPNVQAAIDQRLAEVLTGIVSLFCGVGVAFYYGWNMAPIGLATALLLVVVQSSVAQYLKFRGQRDMDSAIEASRLVTESISNWKTVQALTKQEYMYDAFTAASKSPHRRAIVRGLWQSLSFALAGSFVMWNFAIAYMFGLWLISNNWSTPYTVFQVIEALNMASMSVMLAASYFPEYVRARISAGIMFTMIRQKSVIDNRGLTGDTPTIKGNINMRGVYFAYPNRRRQLVLDGFNMSANFGQTVALVGPSGCGKSTTIQLIERYYDALCGSVKIDDSDIRDLSVKHLRDNIALVGQEPTLFNLTIRENITYGLENITQDQVEKAATLANIHTFVMGLPDGYDTSVGASGGRLSGGQKQRVAIARAIVRDPKILLLDEATSALDTESEKIVQEALDKARLGRTCVVIAHRLSTIQNADKIIVCRNGKAIEEGTHQTLLARRGLYYRLVEKQSS

SEQ ID NO: 6915 - protein, 1268 aa, Caenorhabditis elegans; identical to SEQ ID NO: 6914

SEQ ID NO: 6916 - protein, 1266 aa, Caenorhabditis elegans
MKIASEHVELGSRPDKKKKKSRSSQGNSLSNLFRHSGCADYLLLLGGLVLSAANGALLPFNSLIFEGITNVLMKGEAQWQNGTFDYDTFSSGIQHYCLLYFLLGVLMFTCTYFSNACLFTMAERRLYCIRKHLLQSVLRQDAKWFDENTVGGLTQKMSSGIEKIKDGIGDKIGVLVSGIATFISGVALGFYMCWQLTLVMLVTVPLQLGSMYLSAKHLNRATKNEMSAYSSAGGMANEVIAGIRTVIAFNAQPFEIERYGAQLAKARKMGIRKAIVLALCSAMPLFLMFVLMAGAFWYGAILTSYGVATSGTTFGVFWAVILGTRRLGEAAPHMGAITGARLAVNDIFKVIDHEPEINCTKQEGRRPDKVNGKLVFDNIQFTYPTRPDVKILKGVSFEVNPGETIALVGHSGCGKSTSIGLLMRFYNQCAGSIKLDGIPIEDYNIQWLRSTIGIVQQEPIIFLATVAENVRMGDDSITDKDIENACRQANAHDFIGKLSEGYNTVIGAGAVQLSGGQKQRVAIARAIVRKPQILLLDEATSALDTESERMVQTALDKASEGRTTLCIAHRLSTIRNASKILVFDQGLIPERGIHDQLIRQNGIYANMVRAQEIEKAKDDTTQDDDELVEEDNYSISRRLSTSEEELRKSKSLLRDSTRFSQSMLSVTSQVPDWEMESAREEMIEEGAMEASMMDIFRFAKPEKMNIVIALIFTLIRGITWPAFSVVYGQLFKVFAEGGEDLPVNALISSLWFVLLAVTSAVTTFISGSLLGKTGETMSSRLRMDVFKNIMQQDATYFDDPKHNVGNLTSRLATDSQNVQAAIDHRLAEVLNGVVSLFTGIAVAFWFGWSMAPIGLITALLLVIAQSAVAQYLKYRGPKDMESAIEASRIVTESISNWKTVQALTKQEYMFHAFTAASKNPRKRAFTKGLWQSLSFALAGSFFLWNFAIAYMFGLWLISNNWTTPFAVFQVIEALNMASMSVMMAASYFPEYVRARISAGIMFTMIRQKAKIDNRGLTGETPDIRGDISMKGVYFAYPNRNRQLILNNFNMSAQFGETVALVGPSGCGKSTSIQLIERYYDAICGAVKIDDHDIRDISVKHLRHNIALVGQEPTLFNLTIRENITYGLENVSQEQVEKAATLANIHSFVENLPEGYDTSVGASGGRLSGGQKQRIAIARAIVRNPKILLLDEATSALDTESEKIVQEALDKARLGRTCVVIAHRLSTIQNADKIIVCRNGKAIEEGTHQTLLARRGLYYRLVEKQST

SEQ ID NO: 6917 - protein, 2014 aa, Caenorhabditis elegans
MFIQGSCGGPFYIPVDSTGNKPTQTIQIHVSAAGIPYVNMTDAKGVVFSPSYSVADDSYSLNVYADLPSGGYTLSIDNQGVPTSECIIEVNGDPSGLKAVDGFVYSPQSDDPPYGESAINGVPMYMAAHVDNSPAQVQSITIRQGNSLAPVYRAALTRRYQCGYEYYAGQWQCQLGNAYFYHIDGVDANGFNFRRTGRFSCMQLLTSPAPPTTTQAPVTTCFNNGTLLNVANQGQTCFCSELFNGKQCEKVNCMNAGFPDPDGNLCECAAGYHGTNCQDVTCPLNWEQYLTNYKTLVVIIRSTVSMNQNLNAISSAIYKELTSNDGNNYEVYKGFVIVKFANGAYTNTYYPAFDQNAFLAAINQASTAVGQCSDATFDAIGSIFNEVALYQKSPVYLFTDATASDVEKWQTVIEQNTRMKFPIYTHYFVQSNCAFDEMSQGFQAIEYASYYSGGLILRPSVDSLQQIFQYVIKATAYKMNSVLIDDLASCATPTRVFFVDTSTTELMILAVGQQLTVSVTDPNGNTNTLLKIVDSGTTQLYEISNPVVGEHLVTVVSNVQNTPCSYRVQARSEYDLFIGTSVGVNDDASDSEPVVGQSSHIVAQLTGLKGKVADPFRLFSEISITSNVNVDNKYQKPMYYSSGKYRDGCGFHMYFGAADFCDFMSQPFYATVYADDGKGFTIQRTTTGFCSGTPTTPYPPNSCQNGGVTDPTNNATCICPPGFYGQYCTNIQCVNGGTPRGGMCVCPVGTAGTFCEQYMCTTFNNNPDVSFDGQSIAFVVSTRSTMKVAVQKIADNVQAMTRDMQQASDKWINKWILIAVNSNTSYLLVNSARPADFVAGVTNLNGNFSNYAADETSCQIQIEQAMLGAVLLSERRSSVWVFADSDGPNDLSYVQLFDVSQQYQLSLNLVGVGSSICTTPENNGQFPYYLRSLSQTTLGDIYMTDKLDQIMLFIVSMYKSAVSHRYYVPDCTSATSYYMPVDGWTQSLTLAVTGTDLYSVEVTFPDGQKGQNSDYELVAINDPETKLNQYVAACSGSFWNHRQQNCFTFTADKLSWLDTWDMCHAQKAYLLHIDSQATNDYVASQIGSYRVWIGLAFNNGQWYWDVPDGNFAQPLTGYTNWAPNVDPTNPAYNHAVINSNGKWEPADPNDAANNFAACMKHRYGQGYYPGEGVNIVPGGLWKVTVQSNSGSCEIQARSQSDIQVFFGFVTDPRNDKPSTYANIQSNSNYLIAYPTGVLPYTPDTKPSMEGKLNYAVLSSNRTITNSLPLGNRACTYATISAPFSCPVTDGSLSDFSIKFTGIDQYGYAFERYSDALCTKAVINCANGGFLNNGVCVCRAGWVGTDCSTPVCQNGGIEKSGVCDCSSVPQFTGQFCQLAQCEPPYPTSFNDKDRTLVLMLETSYNMGSSIFQLKKNLKASLDSINNDPTTQGWFTNFVLYPFDSTSNKDSWYPPTISRNSDDIVTALKNISTMSCPGSAPCSSQCPRPIVSVLSSILDMNALAAPNSVIVVITRSSPEDYLQVGQISQKLQTKKAYINFVFPAIDSPCGEGWNSPNTDALFQIISYSQGNTFTMNAVDLSKNFLTQYVPTLYSSGGIAASNGNCQTDEIIFQVEHEMYEFSIDFYHPLMETIKVFDPSGDQLTLPDNIINSDSNYIGVFPVNETGATRAGTYRILLTGTGGNNCFATVRGRSNLELFLGFVDSSSDGHNGATNDATHYAPVNLENNTIVVHANGLGAGIVRYVQIVMPRFGLLHTTEMRKRDSACSYEWYATTPFSFDYDQYYVIIYGSSEFGSNWKRNFYVSTVGQRPPLPPPPATCDLNVVKQDTLFLIDSSLKDSNVTFRILQQFAVQAVQPFNYVSGLGQVAALRVADKAYGGFSYNAGENSFDRVSELIYNMQYIGIDGQNVTAGLQYALDYYDLPSQGYRTGSDVRHLLVYVTQTNPTDADPSELLRTIKRSGLYEVVVVALDMQPSDKLTNMVNPRCFYLAQDFHDLMNYGVNFVQGQSCLRWNFCNY

SEQ ID NO: 6918 - protein, 2014 aa, Caenorhabditis elegans; identical to SEQ ID NO: 6917

SEQ ID NO: 6919 - protein, 2014 aa, Caenorhabditis elegans; identical to SEQ ID NO: 6917

SEQ ID NO: 6920 - protein, 195 aa, Caenorhabditis elegans
MSSPSRQIKCVVVGDGTVGKTCMLISYTTDSFPVQYVPTVFDNYSAQMSLDGNVVNLGLWDTAGQEDYDRLRPLSYPQTDVFILCFSVVSPVSFDNVASKWIPEIRQHCPDAPVILVGTKLDLRDEAEPMRALQAEGKSPISKTQGMKMAQKIKAVKYLECSALTQQGLTQVFEDAVRSILHPKPQKKKKSCNIM

SEQ ID NO: 6921 - protein, 558 aa, Caenorhabditis elegans
MWIPQRISHIFLLVIFILHIVTINANKHVSQLLENLLTDYNKAVRPVHNASDALKVKFGANLCRLIDVDEVNQVLTTSLWLEMQWYDKKLTWNPTDWGGVEYIHIPSDQIWIPDIVLYNKLVFVSKTNSYYLTVFFHFSILTFVNLSADGEPHITITSLAKIDHHGRVVWQPPSIYKSFCPINIKYFPYDWQTCEMKFGGWSNDGETLDLYQIPVDVDDIPQVKRQDDGVEFLYLEKGLGLSFYHESAEWDLLSATSSRYAQIYPGCCGQQYYIDIKYRIIIRRKAIFFTVTLTIPCMLIANVTPFVFLILPNEHKMTYSISVLVAFSVFYLVLIDLIPPTSLSLSLIGIYLLFTLLMVSVSIILSVVTINMYRKQAFSSGMSHWQRWLFVQRLPKLLRLKTLEHTLGPDEGSETTTPRTGSVSVTASVTQRTLNPNNNSPVFPPQRLRLLSLVQMDEALKQRCAADNLDLFRKIAGHLKIISAHFHNQQMEGKITEEWQLMSLVIDRIFLILFLAVSMAANIMFVYNSPTLFDDRPSLVPSVAHKPLSGGTINVLNT

SEQ ID NO: 6922 - protein, 248 aa, Caenorhabditis elegans
MSDGKEELVNRAKLAEQAERYDDMAASMKKVTELGAELSNEERNLLSVAYKNVVGARRSSWRVISSIEQKTEGSEKKQQMAKEYREKVEKELRDICQDVLNLLDKFLIPKAGAAESKVFYLKMKGDYYRYLAEVASGDDRNSVVEKSQQSYQEAFDIAKDKMQPTHPIRLGLALNFSVFFYEILNAPDKACQLAKQAFDDAIAELDTLNEDSYKDSTLIMQLLRDNLTLWTSDAATDDTDANETEGGN

SEQ ID NO: 6923 - protein, 542 aa, Caenorhabditis elegans
MTYPQQRLLTVDILNFKCYQHHKSFGPFDHVTTFIGMNGCGKSIMIEAIAFVFGEDLPDPKNPHNEHLFYDYNIRCVVSLKFEMPDGSTKRFTRIGLKTTYTYMIFNKYVTEEEYLLELGKMNFRFAGQNISVYNKTTLKVTRKSAEELGAFFDIVSNSIEFKPEYDELKAKLNFAESTVLRWAKMIDSIELEKEKFITLTLYKLYLCDKEIQETKEKFVAEQLKVNAKNAKMPLRISRYSEAIPKQTPSPNFKNNAIVVRPKTHNHYDNLITVDKLNSYLNEKVTERRELLQFAVNHPNMNIRFSEEGPNIYAREIDYTELPEYYKKESDDIIATSYKRSMLEKEIKKIRQCWLDENNIKDDANIDNINMRIKEATTKHTLALNIESEARLNWEKVSLRVMRSARFNNFMAPLQTSLSRIYAEIAQDEDSLAFLRPLDEEEPYLAIDAFVKERHSEHISTRTFHGGSRMIVDLALIFAIHEWKPSPLVVIDDIDRNLYHEASKKVSTYLVQSFINIHLNAKKNNCISFSAMYSQSFVKLKK

SEQ ID NO: 6924 - protein, 1577 aa, Caenorhabditis elegans
MVTAFSGSICEEERAITPTENESEYIQTLKEEISQLRDINHSLKEEKAQWALRQRLQNAEQSESSLINMLEDRLNQAENQIQDYRDENTVLKCELRELQETTFATSDEKLREKIRTTEGLCDELMEENEQLKAEVKDLQQEIEEMQDQYREEEIEEFRELQRELELNAKNCRVLQFKLRKTERSRDQAEAEKMHSEKKLDEYMNSCPEAVAASIKSDSAKVKELEYEIRVAKEVSVRLHNELEQTEEKRCKLEDEVFYLKEKVREIQTQNKWREARNKTDIAVKRLSAEIAASVPNIPENEMSKELRDALEREIDLREQMRFSEEDLKRTQIRLQDVENENEELLKKLSKASKLRPPMIRSARLVTACTCQKVSDITFLMFCRCDGNAHLQLELAESQVQHLNTKIERLEKTNDHLNKKIVELEADCKRGGVTSAHSKAGEFKLTPEMEKDMSKMIVTISELERKNLELTTQVKQLETKVTPKPNFVVPSGTTTTELRKEQEKRKALEAQVNELKTTVFKSDNQKVISLATKIEQLNGQLQMVNERCNTLHKKQVKDGEIQYSDELKQKIEDLEKRLSEKLAIDSVSELQGKIPTIDEIEQCCEVLAAVETQTGRLCKQFEKIDHAQKDERRRSLSKDSGAAIIAELANVMQEMKNVHQKLDKIKNVTPNTGLSVKRIPSKENLLEIKCSKCDQLQTSIDEQANEISFYKKKNKDLTNQVLQTEDRWTIEIEKQRQIFEKEIKTLGIRVADAKRQNDELSELLESKSTTLVEKTRSLEEQEERSKKLRAETELLRKDMQELETDKKTVKEFEIKYKKLESIFETEREKMNGERNRSKNELAAMKKLKDDAEEHLKKLSDDQKKNDAAWKIEKSKLEKDIALLKKQLPDEHEMKESTATPQNSISGESSPLRRQDSEKMLVLELKKQISILEKRIADSNSSLEECKIQNAELRDQLAKVQANWEKDKEVFQHKTRKSEKLRTVEIDAMQQKFSSRMRIMEDTNKALHSQLVLARRERDTNKDALTNFEKQVTDERNNLKVKEKSANESTEKVKELQNRLTAKEEELERLNTDLRLTKEARKADQILWNIDRARNRNEKIDNTDSVETIRKQYRDCETFYSKEMDRLNDKITEITAEKNRQKNEAQKTIRVLSEQIKVLEIEQKNLSQNKDSQQVVKEMIESERERLQQIVHLNELQKLTRKYRLSSIIDQLAYVSEATRKTSREAEPDGIRYIINQLTVLRDDEAANNLNPDERAGSVLGEKASNGYAPSISECGEGTYDNISQSSFSIRSVNSAPLRHAYRHANLPIPTTTASVSTTISETEPYYSKPEKLNIISNYTTKRSFSTESSNGFDKYGRPMRRGLYHEPSSSNNLSVPGRKTSNDEYSMSRAASFDNRSQFSEDEVTEDGRSSRPNSTGANILYRVRREELARGGQPSVKLMAKAFEAIDEPRTDKRGFFGIRKSRSVETTQNGKHSKFEEAANSALMHSLGQVEEGVSSNYATLPRGGRNPFKNMGSRLVERVRRSLSRSSRQSRDSDREDEIEVQVYKKPEKPISSPKKTKKKSAESKARKNSSNIFT

SEQ ID NO: 6925 - protein, 1577 aa, Caenorhabditis elegans; identical to SEQ ID NO: 6924

SEQ ID NO: 6926 - protein, 1577 aa, Caenorhabditis elegans; identical to SEQ ID NO: 6924

SEQ ID NO: 6927 - protein, 403 aa, Caenorhabditis elegans
MSSKFLFTSESVSEGHPDKMCDQISDAVLDAHLKQDPNAKVACETVTKTGMVMLCGEITSKAVVDYQVLVRRVIEKIGFTDSSIGFDHKTCNVLVALEQQSPEIAAGVHVNKDGEDVGAGDQGIMFGYATDETEETMPLTLILSHKINAELHKLRRNGTLPWVRPDSKSQVTIEYESRHGATIPLRVHTVVVSTQHSPDVTLEKLRETILADVIKKVIPASLLDESTVFHINPCGTFIVGGPMGDAGVTGRKIIVDTYGGWGAHGGGAFSGKDPTKVDRSAAYAARWVATSLVKAGLAKRVLVQLSYAIGIAKPISVLVYAFGTSPLTDEELHQIVEDSFDLTPGKIIKELDLKRPIYEKTAENGHFGHSEFPWEQPKALKISPALLEKAKGNPIPATSAIAH

SEQ ID NO: 6928 - protein, 423 aa, Caenorhabditis elegans
MPAKKEGFNRVLDGLKKRQLQHDFKLERAAETYEPTQNIGSGAFGIVCEAVETSSNQKVAIKKVAHASATPTLARRTLREIRVLRYINHPNIVPLRDIFRTKGPLGIDVFLVMDLMQNNLHHIIYGNEDPLEEHYINAFLGQLLRGLEYLHAACIAHRDLKPSNLLVNQDGTLRIADFGMAKCADNSSKKHDDEEHCYYMTQHVATLPYRAPELLFVLPEHSTAVDMWAVGCIFGEMVIRNEILPGRSVQGQIKMLLTMLGQPPQEVINEVRCDRTRKLIQDFGRKADAEWDDIMFCKARGDDQIVRGNCDTIDFVKQLFQYDAQKRINIQDALLHPYIQRVIPAEAPQKKCPFRVKKDMMQVEDLNHQELISMMKQDVRSAENPITYSELHSGGKNFAFTVFLFCFLLTTHVCAFLNTNTSF

SEQ ID NO: 6929 - protein, 423 aa, Caenorhabditis elegans; identical to SEQ ID NO: 6928

SEQ ID NO: 6930 - protein, 279 aa, Caenorhabditis elegans
MKIGFIGAGKMAQALARGLINSGRITADNIIASSPKRDEVFLDQCKALGLNTTHDNAEVVQKSDVVFLAVKPVHVSKVASEIAPALSKEHLVVSIALGITIRNIESLLPTKSRVVRVMPNTPSVVRAGASAFAMGSACRDGDAETVEKLLSTVGFAVEVPEIHIDPVTGLSGSGPSYMFAVIEGLADGGVKVGLPRDLALKLAAYTLLGAAKMVLETGIHPAQLKDDVQSPAGSSVYGMHKLESGGLKGVLMDAVEAATNRSRATGDKALPRDFRNTEM

SEQ ID NO: 6931 - protein, 1137 aa, Caenorhabditis elegans
MSKRDEPGPSGSSFSSPELKDPKPVKRRKIMDGEKVIIAGRVASIHLKNFMCHANLLIEFDVANKNCFYIGGPNGSGKSALFAAMNMGLGGRGSDSERGNNVQAYIKDGTTQAKITITLTNEGLNALPEYDELISIERTINRTASKYTIRNIKVNTHKYKMERVVSTKKSDVDSVVTRLNIHLTNPAFWMSQDRSRSFLANFKPSTVYKLYLESTNLENIRQSYNRFAESIDHSAELVTAKSEEIANEKRKLKRAQESRVLQLKLEKDRNLLASYRWKFLFCRVRDYDNNIMLNKKKQEVHKKLHKEVKDAYYKNRTERSEVQKKLQELRDEVEVQDEEIKESRADVDNLRKIVNDLKHEIKMSESQMRRKKVEIMLIRKEIAKAQKQLREALGKFGHEELTKKLAEAEDKRESLNIEIEEIEHVQLKALRKKYEKLTKELRNEEEEKFNTRGKIATLRRTIEQDQKILRSMKATKKNDVNKFGPYMSEILTEIDHRSSQFKQKPKGPLGKYVTLVEPKWACATEECFKNIANNFLCCSQEDAATLRKIFDILKIPSNDRPTIVVSRFTGIKYEDLQQPGYQFKTLYRTLAFSDVDVHNAIIDKSNCEQFLLIEDKTAAMKLMGCDDPPKYAVKAYTPDASQIFANGLHSQYRFYSSRGKRAVGLFGVNQKQVDEETLEQELEAANRELIRLENHDIKLIEKTLRELTMERSTIKSTIDKLDKKTRELQYERVKIDRNINDWKADMTQCANTEQVDNINDALGELQEKLSILEEEAYCIQDKLDELDEKFQPAIKTKNESEKNYVELQQEVKGYAAQTLSFQKQLRKLDEDGEAGKNRLDKLKSNEDELYHDEARLKSERDEALNIVEKEKVTIERPRREADPPDLSEFPSTKDARKKIIEMHKAISRDAAECGDTVTIGSVKEFKENLKKLRESCRMLEEVVEEMQTVHNGRLKAYPTLKKYTELKVTDKFKELLAIRGHFVGGLEFDHEKENLNVNVHSTKEKDALAGKEYSSTDEDEDDEQEFYKNGKPKKKRSKKTKKKPVCDLKGLSGGERSFVTAALVMSLWEVMEQPFRMLDEFDVFMDMMNRKLVMDLLVEMATKKFPHNQFIFFTPQGIKELNRVDGLQIFEMEKVRD

SEQ ID NO: 6932 - protein, 1391 aa, Caenorhabditis elegans
MNISSNITTSFSSFLDDLCGEGIPLTILSAPVTCNPSISSCPDGYSCQFYERTGSSYCCQNPTPTAKSSTDKINCGEGRVTYIEMATGKPRSCVLTGDNSCPAGFGCTLVAGTTTRCCAKDLGCATNSAPQLRGSNPVECSPTDGSACKNGYVCSKSQYLNKFICCSNPDGEIMGSCPGGETPLENIQCSATKPCPNGFSCNDKKCCPYASACPAGAPLNNGPMKCSENAPCPEGHSCVSNAGIQYCCPAKEKVCNMPRNSGVQCASSMKSSNRYYFDIGTATCRSFKFTQCGGNANNFGSLEECEGFCVDTQCPNGQAHRVGAVNANCALAQADTCPNQHFCQLPLFGPSPICCPTPELTCNEMVSAGTPCFGRGLTIQRFYFNPSTQKCQPFHYYGCSGNGNNFETVDQCQNFCLHSADSACDGLVPLKNPNSELQRCSEEDPCPAGYECNDSSYCCPSSENACNANMSRGNGCKGSTQRSMWFYDKSKKKCSQFVYNGCGGTPNRFTTKVACTESCVQSSAFGLCPRGMNPFTEEGEITPKTCTLNVRSTCPSGASCVKSSTNQSICCKAVTACPDNRIPYNIPGTNSVVACSIERDDCPDDFQCLESATAPGFHMCCSGPLPSAQRPVRPIAPVAPMPRRPFEPDSFADLLSNISPCPPQLFSSGQSCTVNQVGDCPKNHICFRDIGFKQGSCCRTTPPKCSQRGYVPVFLDRTQVQVCQVDLDGCPEDAKCMTSSVAKLAICCQKYQPPSPNNNRPANRGVNQGSVSNNNQNNNKGAVCANGETPFRGPDNKFQECNFVHNTCPSGYQCEFSSTGQAVCCTNTNVIRCPSGSSVFEYGGRPLACPAGSNKCPQGYSCMPSTNPQHHLCCSSGSGMGVSQPQCLRGVAYVNPATNQRQFCSPMKADCPAGYTCFESDQSSQFICCTHGDLSDRFQGYCPPRQIPYISRDGFPPTCHMQLSPCPTTAPYVCIYSPEKQDSYCCAPIDTAVHVVNPDRGYASPAKNIDLLETPDVPSSNVPGMTQTFPGGPPAPGMGPIGMPDPIPGIENARILPPALAQAEMEKKIREQFANKNNNEHGNSFANFEGNSGESGNFGNNNFNMGGGAVPGFGNQASQSGCPLGSRPLIGFNQQITECSQQPCPDGFSCVFAEKDNRFQCCSSVSIMLAVNKPTNKQSTPSPNGQIDCPPGFFNMDGKCLKILFAGQKGCISDEQCSSREANSTCDNGYCICPTDKPLVHGGKCIATCPEGFSNIAGRCYDPTTVIFMDSVDERKNGTIGGYCMETLIEEKRCLVKNSYCSEKTITCTCQLGYDLEMNFDDKDDKGKCKKNSDSKYHDLKATTASPFDDELYFIDISSMNHESPLNDTGVESEDLNKYLFQSDEMIPVFA

SEQ ID NO: 6933 - protein, 329 aa, Caenorhabditis elegans
MSEASKSIMDLLSEVVKITDMTMDNEAVNKLKPQIKINPFYRAVQDVLVEQKSKIDLSTKMMKDLEAQENDERLDTMLKAEGVAGPDDSLLRIQEAAGTDQYEYRQQLLKVRRELENETKAFDKHCKKWCEYVEDVLQQQGEFRPITQQSTEKFMNKMSGKFNKVCFVLKQTACEEVIQLKKRYLDARRKRRNFSKTSTEILNEYFLANINHPYPSEEVKQALAMQCNISVAQVSNWFGNKRIRYKKTMAKNEDERRENRKPEDRPPPGAPGAPYSLVPNAFAGMMNPYQMMLPGHQFPIGVAPFNFSMYNPEMMAQYQQSLQNPNQTR

SEQ ID NO: 6934 - protein, 238 aa, Caenorhabditis elegans
MLKFTAISFVLLNAAESVDHQKPIRALDSQPLLKFTRTPNDSNVTFGEKFVLSCGANGAPLPSIYWELNGMRIQGEETSNVYENILNDGKQVSNAAMVSSHYRIPCATARNSGAYKCIIDNGLTKLEHVAKVFVGGNKTNCALNDNGAPFISMTVDFRLEISNNAVALSCRSETATEWSWHKGEQLLTNDGERYQMFPSGDLIIRNISWSDMGEYNCTARNHFGETTAITFLYPTLAK

SEQ ID NO: 6935 - protein, 243 aa, Caenorhabditis elegans
MRETILMMAWAMIGTAFFVFFALKMGLTAGYGRYTNQAQWGINPKLAWFIQESPAFFIPFYFLFGGLSSTGRILNCIFLVHYFYRALIYPFRIRSTTKSPLLIVAAAVAFCTYNGTLQGVWNSYYQLEEELTYRHLIGSILYFSGMFINHKSDNILMTLRKPGETGYKIPTGFLYEYISCPNYFGEIMEWIGYAILGWNLPALAFAIFTFANIGPRAIAHHNWYKEKFPKYPPTRRALIPYIY

SEQ ID NO: 6936 - protein, 243 aa, Caenorhabditis elegans
MREILLTMAWAMIGMAVIVFLALTRGFTAGYGRYADRSKYGINPKLAWFIQEAPAFFIPLYYLRRGPSNSGYELNAAFLFHYFFRALIYPCRIRSTTKSPVAIVAAATFFCAYNGFLQGYWNAFYQPEEPWTTRKLVGSLMYCTGMYINHKSDTILRELRADGGTGYKIPTGFLYEYISCPNYAGEIMEWIGYSILAWNLPALAFAIFTIANIGPRAVAHHKWYKETFPGYPPNRRILIPRIF

SEQ ID NO: 6937 - protein, 294 aa, Caenorhabditis elegans
MDKISNIYNFDDPPPDKLSLELFIIEKKIGKGQFSEVFRAQCTWVDLHVALKKIQVFEMVDQKARQDCLKEIDLLKQLNHVNVIRYYASFIDNNQLNIVLELAEAGDMSRMIKHFKKGGRLIPEKTIWKYFVQLARALAHMHSKRIMHRDIKPANVFITGNGIVKLGDLGLGRFFSSKTTAAHSLVGTPYYMSPERIQESGYNFKSDLWSTGCLLYEMAALQSPFYGDKMNLYSLCKKIENCEYPPLPADIYSTQVSANLCFVQLSSATWYPVVYFQKLQNDQRPVKFYRFVPR

SEQ ID NO: 6938 - protein, 294 aa, Caenorhabditis elegans; identical to SEQ ID NO: 6937

SEQ ID NO: 6939 - protein, 531 aa, Caenorhabditis elegans
MPGQCSPSKHQNISRLSRIRDMYDRLDADNDGSIDIRDLTQALSLQAHIPASVAPKLLERMKSEHSDRVTYADFTNYVIAHEARLAEVFDKIDLNSDGEVDMAEIKSYCKEMGVNLDDQKAMSIVKKMDQSGSSSVNLNEFQDFMLLYPSTDMRDMVDFWRHNLVCTCLESNSRFRTQNFQIIDIGEDGQVPEDFTPQELLSGVWWRHLVAGGVAGAMSRTCTAPFDRIKVYLQVMYLHLLFHIMFLKALQVNSTKTNKLGVVSCVHLLHAEGGIKSFWRGNGINVIKIAPESAMKFMCYDQIKRWMQEYKGGAELSTIERLLAGSSAGAISQTAIYPMEVMKTRLALRRTGQLDKGMFHFAHKMYTKEGIKCFYKGYLPNLLGIIPYAGIDLTVYESLKSMYTKYYTEHTEPGVLALLACGTCSSTCGQLASYPLALVRTRLQARAISPKNSTQPDTMVGQFKHILQTEGFTGLYRGITPNFMKWFSKCSSAHFNMRLKFINVPAKKNSGCFIILAFLIKSATLIPDSSH

SEQ ID NO: 6940 - protein, 965 aa, Caenorhabditis elegans
MRELDPDESNLLLDEQLSIRDVIEQGPFSNVYRILHGPSNRKFLLRSINLNLFRQHTGLGFEEIDEEIRICQNLQHPYICRLEKTINSVHYRHIIFENMEGNDICFEIVQRASNGFVFSEYVVSHYTRQLLDALDYCHTRKIVHRDVRPHNLVLASKDTSAPLKLCGFGVAKDLSEIGGSMACGRVGVPQFMAPEIVRKDRVSCSSDIWSSGVVLFLLLAGRLPFSGSTSDIYERIMQTDVDVDGYMPNISESARNLVRRMLNADPSKRISAKEALNHEWIRDKEHMASRKHMNDVIDQMRRYNESRKLKSNVLSAVNSGRFDETTPRQDTPQTAFVDGSSPGGDCCHRGESSSNDAAEPPADKDLSGAYKVLGSLDAINSLLDPNSYKPGSTTFQKIHDDGSVRNLLRLYDKIKALPCEPVVTEVDTSTLRKETLNQIDGLLGPSPEALELRQLLNSPHLASCVQALDVVVCEIRDPKNEASGSGDKEGNASLFCVSSDPAPAYLNGGVLPLGAQRAGTSFEHFNQSAVHTSYDEEEEELYDCMSRLRLVQFQKDTQEPMGITLKVNEDGRCFVARIMHGGMIHRQATLHVGDEIREINGMSVANRSVESLQEMLRDARGQVTFKIIPSYRSAPPACEIFVRAQFDYEPSQDDLIPCPQAGIPFKTGDILQVISKDDHNWWQARFVSSFPSIGNSSNAQRSNQQQVAGLIPSPELQEWRTACLAMERSKNTCNTHCMWFNKKKKYYTTKYLQKHSALFDQLDLVTYEEVMRLSQYRRKTLVLLGAHGVGRRHIKNTLIHRHPNRFAYPIPHTTRPPRKDEVDGKHYYFVTNEQMMADIQNNEYLEYGTHEESMYGTKLETIRNIHKSGKIAILDVEPQALKVLRTAEYSPFVVFIAAPNLQGMQDPDGSLEKLLNESDVLRQAFGHLFDFIITNSDIDDTIAQLERLVEKLPAYPQWLPVTWVY

SEQ ID NO: 6941 - protein, 624 aa, Caenorhabditis elegans
MSSAATPPPMEHTSSEDSTTAPLQTPSSSSCLDVTVAVGTSVSYLKASPLVSSPTSLVVDITESSSTLLYDKIKALPCEPVVTEVDTSTLRKETLNQIDGLLGPSPEALELRQLLNSPHLASCVQALDVVVCEIRDPKNEASGSGDKEGNASLFCVSSDPAPAYLNGGVLPLGAQRAGTSFEHFNQSAVHTSYDEEEEELYDCMSRLRLVQFQKDTQEPMGITLKVNEDGRCFVARIMHGGMIHRQATLHVGDEIREINGMSVANRSVESLQEMLRDARGQVTFKIIPSYRSAPPACEIFVRAQFDYEPSQDDLIPCPQAGIPFKTGDILQVISKDDHNWWQARFVSSFPSIGNSSNAQRSNQQQVAGLIPSPELQEWRTACLAMERSKNTCNTHCMWFNKKKKYYTTKYLQKHSALFDQLDLVTYEEVMRLSQYRRKTLVLLGAHGVGRRHIKNTLIHRHPNRFAYPIPHTTRPPRKDEVDGKHYYFVTNEQMMADIQNNEYLEYGTHEESMYGTKLETIRNIHKSGKIAILDVEPQALKVLRTAEYSPFVVFIAAPNLQGMQDPDGSLEKLLNESDVLRQAFGHLFDFIITNSDIDDTIAQLERLVEKLPAYPQWLPVTWVY

SEQ ID NO: 6942 - protein, 1968 aa, Caenorhabditis elegans
MDYENDPGWKYLRRSREEMLQDQSRAYDSKKNVWIPDSEDGYIEGVITKTAGDNVTVSIGQGAEKTVKKDVVQEMNPPKFEKTEDMSNLTFLNDASVLYNLKARYAAMLIYTYSGLFCVVINPYKRLPIYTDSVARMFMGKRRTEMPPHLFAVSDEAYRNMLQNHENQSMLITGESGAGKTENTKKVISYFAAVGAAQQETFGAKKAATEEDKNKKKVTLEDQIVQTNPVLEAFGNAKTVRNNNSSRFGKFIRIHFSKQGRVASCDIEHYLLEKSRVIRQAPGERCYHIFYQVFSDYLPNLKKDLLLNKPVKDYWFIAQAELIIDGINDKEEHQLTDEAFDILKFTPTEKMECYRLVAAMMHMGNMKFKQRPREEQAEPDGTDDAERAAKCFGIDSEEFLKALTRPRVKVGNEWVNKGQNIEQVNWAVGAMAKGLYSRIFNWLVKKCNQTLDQKGISRDHFIGVLDIAGFEIFDFNSFEQLWINFVNEKLQQFFNHHMFVLEQEEYAREGIQWTFIDFGLDLQACIELIEKPLGIIAMLDEECIVPKATDLTLAQKLIDQHLGKHPNFEKPKPPKGKQAEAHFAMRHYAGTVRYNCLNWLEKNKDPLNDTVVTVMKASKEHALIVEVWQDYTTQEEAAAAAAKGTAGAKKKGKSGSFMTVSMLYRESLNKLMTMLHSTHPHFIRCIIPNEKKASGVIDAGLVLNQLTCNGVLEGIRICRKGFPNRTLHPDFVQRYALLAADESIIGKTDAKKGSALMLARLVKEKKLEEENFRVGLTKVFFKAGIVAHLEDLRDQSLAQLITGLQAQIRWYYQTIERKRRVEKITALKIIQRNIRSWAELRTWVWFKLYGKVKPLVNSGKIEAQYEKLQETVATLKDTVVQEEEKKRQLQEGAERLNKETADLLAQLEASKGSTREVEERMTAMNEQKVALEGKLADASKKLEVEEARAVEINKQKKLVEAECADLKKNCQDVDLSLRKVEAEKNAKEHQIRALQDEMRQQDENISKLNKERKNQEEQNKKLTEDLQAAEEQNLAANKLKAKLMQSLEDSEQTMEREKRNRADMDKNKRKAEGELKIAQETLEELNKSKSDAENALRRKETELHTLGMKLEDEQAAVAKLQKGIQQDEARVKDLHDQLADEKDARQRADRSRADQQAEYDELTEQLEDQARATAAQIELGKKKDAELTKLRRDLEESGLKFGEQLTVLKKKGSDAIQELSDQIEQLQKQKGRIEKEKGHMQREFDESSAALDQEAKLRADQERIAKGYEVRLLELRLKADEQSRQLQDFVSSKGRLNSENSDLARQVEELEAKIQAANRLKLQFSNELDHAKRQAEEESRERQNLSNLSKNLARELEQLKESIEDEVAGKNEASRQLSKASVELDQWRTKFETEGLIGADEFDEVKKRQNQKTSEIQDALDACNAKIVALENARSRLTAEADANRLEAEHHAQAVSSLEKKQKAFDKVIDEWKKKVDDLYLELDGAQRDARQLSGEAHKLRGQHDTLADQVEGLRRENKSLSDETRDLTESLSEGGRATHALSKNLRRLEMEKEELQRGLDEAEAALESEESKALRCQIEVSQIRAEIEKRIAEKEEEFENHRKVHQQTIDSIQATLDSETKAKSELFRVKKKLEADINELEIALDHANKANEDAQKNIRRYLDQIRELQQTVDEEQKRREEFREHLLAAERKLAVAKQEQEELIVKLEALERARRVVESSVKEHQEHNNELNSQNVALAAAKSQLDNEIALLNSDIAEAHTELSASEDRGRRAASDAAKLAEDLRHEQEQSQQLERFKKQLESAVKSVHLFPPSQLLILLRVTDLKIDLQERADAAEAAVMKGGAKAIQKAEQRLKAFQSDLETESRRAGEASKTLARADRKVREFEFQVAEDKKNYDKLQELVEKLTAKLKLQKKQLEEAEEQANSHLSKYRTVQLSLETAEERADSAEQCLVRIRSRTRANAEQK

SEQ ID NO: 6943 - protein, 1968 aa, Caenorhabditis elegans; identical to SEQ ID NO: 6942

SEQ ID NO: 6944 - protein, 374 aa, Caenorhabditis elegans
MNGSDCLNLNSELWLYREDLSSRWYIMLVFAFLYLIIIAAGIIGNSCVILAITRNKSLQTVPNLFILSLSCSDIVVCCTSATITPITAFKKEWIFGEALCRIAPFIAGISLCFSTFTLTAISIDRYILIRFPMRKPITHYQAVGVIAIICAFAATITSPIMFKQKLGEFENFCGQYCTENWGANESQRKIYGAALMFLQLVIPLTIIIISYTAISLKIGQSMILKGAKKQKTDNWEMELSDQQRIAVKRRQRTNRMLIGMVVAFACSWIWSVTFNILRDYEYLPELIKTQEYIFGIATHCIAMTSTVWNPLLYAVLNLQLRAAFIDLMPHWLRRHLNLEGDNSSPLLNHPTMTITNKYGSTATKVNARSTTLCT

SEQ ID NO: 6945 - protein, 497 aa, Caenorhabditis elegans
MLSKKCKKHTRLWFVAVDDEDEQKANIDIVFAAGDHEDGEPFDGKGNILAHAFFPRYGGDVHFDEDELWSANKTSIVFLFSINHKNDSFFLYTNKVENSKMFLKVQEGVDLYAVAVHEIGHSLGLKHSSNHLSIMAPFYKQYTGAVMHLHQDDISAVKRLYGAPVKIRKKASEHHIWRSELCTKPYLDAVTTLKNGTILAFRGKMFFELKTTRKWLLPRKINRIFPFEGPLEAATTDRHGNVYFFKRSWNKENSTNRECKSNFQTVFECAVLIKCVRLLEKPYKWNKSNINQRNDFQKDTYWVMTKHGDMMNGYPKKISQGLTDTPDGINAALYYHEDGKPYFFKSMQRESYRIELFTILESYFWQYSRYGKHKLWPRAIVSIFENQVPIVSWLRVSITVYCKRHFFSRSSKFTVGFSFKSEKNIFFISQVKNYKFSVHKIYISFQNSPPEIDAAFQLNNTSSFLFHQNKYWKVSGDPMRIEKGFPRSLSRDWFNCL

SEQ ID NO: 6946 - protein, 169 aa, Caenorhabditis elegans
MRLLTCDCTFMGQKHSGSVSVEKKNQENDGPPTYEIVFGWSQSFENLMKHRAGQKYFAEFLKGEYSDENILFWQACEELKREKNAEKIEEKARIIYEDFISILSPKEVSLDSRVREIVNTNMGRPSASTFDEAQNQIYTLMQRDSYPRFLASNIYKTVMGTFGIKEEAV

SEQ ID NO: 6947 - protein, 169 aa, Caenorhabditis elegans; identical to SEQ ID NO: 6946

SEQ ID NO: 6948 - protein, 1318 aa, Caenorhabditis elegans
MKWRKNGDAIEPIDGIPMENGKKKDTTVNVSTEDVGSIDSDEEPKIVYEPSKMEKLINYMLCRGDLASRELSVKPVTLLGLFRYAERTDYALLCFGIFLSFISGIAQPGLGIIAGNITNSLLIHNATSDDFYDSAMTNVWLFGGIGIIVLIVNFVQYMCFQYCCIRITSKMKQHYIQSILRQNAGWFDKNHSGTLTTKLHDNMERINEGIGDKLGVLIRGMVMFVAGIVISFFYEWRLALMMMGIGPLCCVCMSLMSRSMSSFTSKELAGVGKAGSIAEESLMGVRTVQAFNGQEEMVEKYTVELGKGKSFAIQKGLWGGVFGGIFLLFLFSYFGGGIYYGGQLLRWKIIETPGDVFIVVISMLIGAYFLGLISPHLMVLLNARVAAATIYEIIDRTPDIDVYSTEGQKMTNVVGKVVFEEVHFRYPTRKKVKVLNGLNLTVKPGTSVALVGHSGCGKSTSVGLLTRLYEPEGGKVMIDGQDVRSLNIDWLRKTVGIVQQEPILFNDTIHNNLLIGNPSATREDMIRVCKMANAHDFIQKMPNGYETMIGDGSVQLSGGQKQRVAIARTLIRDPKVLLLDEATSALDAQSESVVQSALNNAAKGRTTIMIAHRLSTIREADKIVFFENGVIVESGNHEELVALGGRYAKLVEAQKFKESDDIEDNGDEHEEETSTVGRHDRLSSRQVSFHKSCESLASADLEIGYASTFNTFTLKTAQEEIENEDFAEEVQRVMEEDGVINSGYLDIFKNAQGNYLYLSVGTFFAILRGSELALLANMFGFVFAAFKEPEDEMVKALGLIFILYVALGLFVFITQVISGTLFTIVAENLGLKFRVQSFKNLLYQDASFFDNPAHAPGKLITRLASDAPNVKAVVDTRMLQVIYSITSITINLITGYIFCWRIAIAGTIMIVLFATMMISMAYKIARENLKQIRKDEAGKIAIEIIESVKTIQLLTSTQRFLTHYKDAQLVQHKSEMRKSYIQSVNNAISQTFMYFAMFVCYGVGTPLMYHGIVEAEPTFRAINCMMMGSVAVMHSSHNFPEFVKAKTAAGMLFKLIYRKSKTGDVMEGNNTEIRGNVLFESVKFSYPQRPMQPVMTDLHFSAHSGQTVALVGPSGTGKSTCIAMLERFYDVSGGALRIDGQNIKSLSLHHLRTQMALVGQEPRLFAGTIKENVCFGLKDVSVEKVHQALELANASRFLANLPAGIDTEVGEKGGQLSGGQKQRIAIARALVRDPKILLLDEATSALDSESERAVQEALDRAREGRTCITIAHRLSSIQNSDLIVYIDHGMVQEAGNHAHLMSLRGKYYNLIKKQDLTT

SEQ ID NO: 6949 - protein, 1291 aa, Caenorhabditis elegans
MPPQENTDGSGKNLSSLRTKIDFDEKISATSFSDSSYNDDDNDKKVEYYPSVFEKFVNFLLCRCDLSEQVLEFQPVSLLQLFRFATTFDYILLLIGLITSVISGVSQPVLAIISGRMTNVLLVIDPLSKEFKTKTMENVYIFLGLGIFVSINDFCQYMCFQRVCSRMMTVMRNRYISSILRQNAGWFDKNLSGTITTRLNDNMERIQDGVGDKLGVLIRGISMVIASVVISLIYEWRLALMMLGLIPVSTICMTLLSRFLEKSTGEELEKVGEAGAIAEECLMGVRTIQAFNGQEEMVAKYEKQLNSGKKHAIWGGFWSGFFGGIFFFWLMAFMGCGILYGGYLLKVGIIKSPAASIYKTIDRVPKIDPYSRHGKKIEKVVGKVTFENVHFRYPTRKEAKVLNGLNLTVEPGTSVALVGHSGCGKSTSVGLLTRLYEPEQGSVQIDGVDVRDLNLEWLRNVVGIVQQEPILFNDTIHNNLLFGNPDATRETMIRVCKMANAHDFIKKMPKGYDTQIGDGGVQLSGGQKQRVAIARTLIRDPKVLLLDEATSALDAQSESVVQSALNNASKGRTTIMIAHRLSTIREADKIVFFEKGVIVEAGNHEELVNLGGRYFDLVKAQAFKQDPDEIALEKEEEDQFDEFDKPTVFNRKVSVRNSRSSGRSGSEEFRRGSLANHSFDRFRKASHIPSAEDEAFALRVKETMEKDGEITAGFLDIFKNAQGRNYTYMLIGLSAALIRGLDLPTFALLFAWVFEGFEFVPYGGKMMHRLAMSVIAHCAAGLGIWFFQTLSTVMFAIVSENLGVRFRVAAFRNLLYQDAAYFDNPAHAPGSLITRLAADPPCVKAVVDGRMMQVVYATAAVIACVTIGFINCWQVAILGTALIFLLGFIMAGLAFKISIVAAEHMENDDAGKIAIEIIENVKTIQLLTRTRRFLNSYENESKKRKRTELRKSVYEAVNYCISQNFMYYMSCFCFALAIRIINQGDQTVDKTFRCLMAMMLCCEGIIMSAQFFPQFVGAKSAAGQMFNLINRQPQTGDLKSGTKPEIRGNILFENVKFSYPQRPHQPVMKQLQWTALRGQTVALVGPSGSGKSTCIGMLERFYDVTGGALRMDGQDIKNISLYHLRTQMALVGQEPRLFVGTIRENVCLGLKDVPLEKINQALELANANRFLGNLPDGIDTEVGERGGQLSGGQKQRIAIARALVRDPKILLLDEATSALDSESERAVQEALDRAREGRTCITIAHRLSSIQNSDLIVYIDDGRVQESGTHKELMQLKGKYFELIKKQDLAI

SEQ ID NO: 6950 - protein, 1327 aa, Caenorhabditis elegans
MAPKDDPDNRGFDDQRRPSQRSTVLAIPALAVNDPKSDPKIASDLPANYVDDDDDAPKMYTPSLLEKILNYALCRGDIANQQLEAQPVSIPGLFRYGKKFDYLLLFIGTICAIISGVSQPILALVSGRVTNALLVYPPTSKQFRNKANENVYIFLGIGIFISITNFIQYMCFQHCCTRVMAQMRHRFVYSVLRQNAGWFDKNHSGTITTKLNDSMERIREGIGDKLGVLLRGFAMLIAAIVVAYIYEWRLASMMLGVAPTCCICMSLLARQMTSTTIKELIGVGKAGSIAEESLMGVRTVQAFNGQEEMVGRYEAELEKGRKFAVWKGFWSGFFGGLFFFWLFSFLGCGMLYGAYLLKVGIITTPGDVFIVVMSMLLGAYFLGLISPHMMVLLNARVSAASIYQTIDRVPKIDPYSKAGKRLQNVVGRVKFENVHFRYPSRKDAKILNGLNLVVEPGTSVALVGHSGCGKSTSVGLLTRLYEPEAGNVTIDGTDVRELNIEWLRNTVGIVQQEPILFNDTIHNNLLIGNPGSTRETMIEVCKMANAHDFIEKMPKGYDTLIGDGGVQLSGGQKQRVAIARTLIRDPKVLLLDEATSALDAQSESIVQSALNNASKGRTTIMIAHRLSTIREADKIVFFEKGVIVEAGNHEELVRLGGRYFDLVKAQQFKADPEATEEFEEEEIDLDDTSRSSRRSSMTSARSGSEAFRRGNSLNDSFSGSKRSAQADAENSAFAANEAAIMAEDGQITAGYLDIFKNAKGNYLYMFLGTVFALIRGLELPALALIFGWVFEGFTFVPYGGRMMHRMAMAVIAFASVGVGVWFSQLASSVLFAVVSENLSMRFRVQSFRNLLYQDASYFDNPAHAPGKLITRLASDAPNIKAVVDARMLQVIYALAAIIANIAIAFIYCWQIGILGTSLILLLAFVMIGLAYKISLMNVEQIQNDDAGRIAIEIIENVKTIQLLTRCELFFDHYQTSSKQQKRSELKKGMIEAINYSLTQSFMYFMMCFTYAVGIRIIYQGDKSSDDTFKGIIAMMLGAVAVMNSAQYFPEFVKAKTAAGMLFNIIYRKPRTGDLMEGDRPEIRGNILFENVKFSYPQRPLQPIMKGLQWTALRGQTVALVGPSGSGKSTNIGMLERFYDVTGGALRIDGQDIRKLSLFHLRTQMALVGQEPRLFAGTIRENVCLGLKDVPLEKINQALELANANRFLANLPAGIDTDVGEKGGQLSGGQKQRIAIARALVRDPKILLLDEATSALDSESERAVQEALDRAREGRTCITIAHRLSSIQNSDLIVYIDKGKVQEAGNHTQLMHQKGRYYKLIKKQDLAV

SEQ ID NO: 6951 - protein, 1270 aa, Caenorhabditis elegans
MFPVADPPRAGPEDIGRNSRQSTIRGVPAFPVSEPKHTSAPIEFVDDDEIKKEYRPSCFDKLIDFILCRGDVAKRTYETQPVSIFGLFRYAKAFDHFLLFIGVICAIISGVSQPVLTIIAGRVTNAILVYAPQTKQFRNKATENVYIFLGIGIFVTITNYIQYMCFQHCCSRIMAQMRHRYVYSVLRQNAGWFDKHHSGTIATKLNDSMERIREGIGDKLGVLLRGVAMLVASVVVAYIYEWRLACMLLGVAPTCIGCMSLMARQMTATTVKELGGVEKAGSIAEESLMGVRTVQAFNGQEEMVERYRVELNKGRKFAIWKGFWSGLFGGMFFFWLFAFQGCGFLYGAYLLSVGIIKSPGDVFIIVMAMLLGSYFTGLISPHLMVLLNARVAAGSIYETIDRVPKIDPYSKKGKFLDKVIGRVKFENVHFRYPTRKDAKILNGLNLTIEPGTSVALVGHSGCGKSTSVGLLTRLYEPEAGNVTIDGTDVRELNIDYLRNVIGIVQQEPILFNDTIHNNLLLGNPNATREKMIEVCKMANAHDFIEKMPKGYDTMIGDGGVQLSGGQKQRVAIARTLVREPKVLLLDEATSALDAQSESIVQSALNNASKGRTTIMIAHRLSTIREADKIVFFEKGVIVEAGNHEELVRLGGRYYDLVKAQAFKPDNDGTVDEIEDEIDLGQSASGLHSRQSSFTSSIRSKMSGAEAFRRGTLGADSFAGGKSTARADAENAAFAEEVAKVMEQDGQISAGYMDIFKNAKGNYTVMFLGFVTGLIRGLELTAFALLLGWVFEGFQYLNIDNGKMMHRMAMAVIAYGCSGFGCFISQFLSSIFFAIVSENLALRFRVMSFRNLLYQDASFFDNPAHAPGKLITRLATDAPNCKTVVDSRMLQVLYALSAIIANIVISFIYCHSGNCTHYFTRFYNKRSELKKGLIEAINYTITQSFMYYMMCFCFALGIRLIYHGNKSPQDVFQGNIAMLLTAMGVMNAAQYFPEFVKAKTAAGLLFNIIYRKPRTGDLLEGSRPEVRGNILFENVKFSYPQRPHQPIMKGLQWTALRGQTVALVGPSGSGKSTCIGMLERFYDVTGGTLRIDGQDIRGLSLFHLRTQMALVGQEPRLFAGTIKENICLGLENVPMEKINHALELANANRFLANLPAGIETDVGEKGSKLSGGQKQRIAIARALVRDPKILLLDEATSALDSESERAVQEALDRAREGRTCITIAHRLSSIQNSDVIVYIENGRVQEAGNHKQLMSKKGKYYELIQKQDLGI

SEQ ID NO: 6952 - protein, 406 aa, Caenorhabditis elegans
MTCRISAKACGIGQKYIEADCLLSDQELKRLKEHKYSAVDNSWLDELCMKRWWEFVITLCPMWIAPNLITWIGLVINLITVLVLSSFSYSATESAPSWAYLQAALGLFFYQTLDAIDGKQARRTGSSSPLGELFDHGCDSMTQVFVTLNICYAMSLGTVPYGVLIVSVISVVMFYCAHWSTYCTGQLRFSKFDVTEAQMSVISVLLFTAIFGNGVWETPIAFGYTLKYFVVGSSFLVSLYQIHGYVHVIFSGGVGKNGSTIAGTSVLFPLFPLLMVVIPFIMIYNKTESTVFDDHITLFSLCFGAVGAKATNRLVIAHMSKSELRLWDWIYVGPLALMLNQYYDFVFDEYVLLWIATVGFENFFVHLAGIVQTFCLVFFSIIGNLKSDFCFLKTKPHYCEKIAQVL

SEQ ID NO: 6953 - protein, 406 aa, Caenorhabditis elegans; identical to SEQ ID NO: 6952

SEQ ID NO: 6954 - protein, 800 aa, Caenorhabditis elegans [sequence omitted]

SEQ ID NO: 6955 - protein, 926 aa, Caenorhabditis elegans
MKSFILGPLGLLVAICCLYQPADAALAAMSIDLGSQFIKIGLVKPGVPMDIVLNKESRRKTPNVISFKNDERFFAEAAAAMSSSHPQSSYNFLLSMIARKEGDDAFVTFQKTFPFTAFEFDEVRKTVVFPYKEEKYNVETLLAMILWNAKKVTEAYADQTVKDVVITVPIFLNQAERRAIASAAEIAGLNLLQLLNDGSAAALNYGVFRRKEITEKPTHMLIYDMGAVKTTATIVQYVLESTRKDGKDKQPTLRTVGVGFDKTLGGLEITNRLRDHLEKVFRDTVKTSKDISTNARAIGKLHKEAERVKQVLSANKDTYAQVESLFEEQNFRAKVINLLVTREELEKMIEDLEPRIAAPILDAIGMAQISTNDIDLVVLMGAGTRVPKVKEILKTILKDKEISNFLNTDEAIAMGAVYQAAHLSKSFKVLPFNVHEKILYPVFVNFLTKTEEGTMKPIRKSLFGENYPVPNRVMHFSSYSDDFKIDIQDADKNPLSTVEISGVKDAIEKEVTDENSVLKGVKTTFSIDLSGIVSVEKASVVVEKVPTPEEKDKYEVDKKEFDEWEKEQEELKKKEKAEKKEKEEKKKTEGEEEKNEDAAGEEKTEEKTEEVEKPVVVKKTKPVEPKAKKINVALTIKETKTDNIDLNEEEVTAAKKVLGDFEQKEKEKHDREEAMNRLEGLLYDLAVRLEDGEEYAEYATEEEKKAILEEVAVLKLWFEDDVSLETKKEEFDEKRAKLEELTAKPNARKQERLDIPKVAEIIEDHFNRSMTFHAMALNLTQFEEGNKTFTDTELEVLTKLIESTTEWWNEKKDLFEKQAKNEDPVVKASEIAEKARDLEREVRYLVNKLKIASSKKSKESEKKKKTKKEKDTVKERKEEETTETTTEDQANEQQTPPPFENDNTKDDESASTEEPKKDTEHDASEL

SEQ ID NO: 6956 - protein, 62 aa, Caenorhabditis elegans
MENIKASTEQLCAEANIQRKKVSEVSKELLDFCEKNKTNDMLVSGPTDQHNPFQEKKSCSVL

SEQ ID NO: 6957 - protein, 531 aa, Caenorhabditis elegans
MRLFVAIILAAVILLVFALGIFLLIPFPIAIFQSIVDSQVYLQQKSDGQLPTGTFYWSKIPAVQIWTFHLFNVTNPDEVLYYGATPNMLEIGPYTYTETEFKDFTQFRDNDNEIFYVNNKTWVYDPTRSCEDCKLSDSVQFANTAYMVSGTVTAGGTLFDGYNDPLITLINSPLVKVLLSVLGNPVQLPQVPAAGFFPHYSHTCDGNYTIRTGKDNTDYVGQIKTWNGLTHLPWWKTEDTSDLRGTCDGTIQKPGIQKTDTVVQFQSFLCRKYNLHYHESKTVNSIPTYGFKVEDDSYDAIKNPGYRYENFEKVNYFPNWPCGLNHTKQNNGNCALVDCNQYDNFCNACCDGSHVNGTYVMPPGMVPQRCLPGQMVPTPFGAILSAPHFYGAPKVVTESMVGIHPDPELHRPGTFYINPATGSTIGGEFRMMLSIPVFQSLAWTLMSNAPNAIMPSFTLTIGVVMKDYAVNYIYFNTVTIPNIVLGLGIGFTAVSLIAVLLWGFCYFRSKRNAKPFVLQQHRTEPTWSVAE

SEQ ID NO: 6958 - protein, 365 aa, Caenorhabditis elegans
MSSSNHCIDIRAYLWQTKHDLTLHPIPIAILATIYTIIVVVGVTGNLLVVMSVMRFKVLQSVRNMFIVSLSVSDIFVAIVSGSVTPITAFSKVWLFGGPLCHLLPLLQGTALSFSTLTLTAIAIDRYILICHPTKEPIRKDQALKMISFNSAISVGLSVPLFMKQELMQFRNYCGEYCSENWGPDAYLRSVYGTVVFIIQFVFPLITITFCYASISIKLRRGVFVRGSQKELMSEARRQLTQRRLRTNRMLIIMTVTFALSWLPSVGFNFLRDYSALPGIIDSQDYLFGIIFHCISMTSVIVNPFLYGYCNEHFRAAFAALLDTVKAACGMRRVSPGNPACSQLLSTHFESTTRRSVTTTIPSSI

SEQ ID NO: 6959 - protein, 747 aa, Caenorhabditis elegans
MRLLILVFILAIIKPFASELDARIADVASYRLPRHVSPSHYDIHIKTYLPGYGWKADENKITFEGNVNILLDIKETTDKLVLHSSSLNIISATFQSDEQNVSISHWNVQTESQFLTFYLNNTVKVQSSAGIQINFQGKVRTDGLGLFATNSTREDGTVMTNFATQFETIFARNMIPCFDEPEFKATWNVSLEHPTGSTALSNGIEVESKVNDDWKTTTYKKTLKMSSYILALFIGDIQFKETILNNGVRIRVYTDPVNIDRVDHALNISRIVLEGFERQFGIRYPMEKLDFVSVQNFKFGAMENWGLVIHNAYSLIGDPMDVTEIVIHEIAHQWFGNLVTMKYWDHIWLNEGFASYMTSYGLTFLDPDYQRDTFYLNCQFNPQINDGGVSLNFGKNLSSVMNNAATVYMKGCSFVRMLENIFGTEYFNEAIKFYLEKNQYDNVDDNDLYEAFRTSSETLDTNGKPFDIEKFARCWTHQNGFPTIQVSNDNGIATLTQSHLYEPQLMLNECDYKWDIPIWYQEPGEARVQMAWLNRNSTSLELVADDSVIINANSIGYYEVLYSDKMYEKIAEQVAINVSRYSVNSLRRTLHDVFRYSRDGLTPFHNAFIIAYVLVFGENEILRHESVLYLVDAVYNTNNKSIVNSKDIETVKGLVNQIENFELFPKCVQSQTFSSCYQKRIPQNINLRAIMQLKLSQNTMDLIVAWAENGVNEEAKLGPKLMLGCSTKENLKKISGKLGGKQMKCNL

SEQ ID NO: 6960 - protein, 786 aa, Caenorhabditis elegans
MRFSFLFILLTFFKTTDLQVVTQETDDTNYRLPRNVFPTEYRLHITTFLPGYKWEADEKSFTFIGDVKIQIEVKEETDTIVLHTDSLNINNVLLHNACVCANLKNLIQYFRLAITKFENRQQTNSKYSLYGKIGKIREDGEGYYRTISPGLNETTMYNAVTQFEPTAARFMVPCFDEPEFKAIWHVTVVHPTGSTALSNAKEIDNTKTNDDFSTTEFESTLKMSSYILAIFVGDVQFKEAVTKNGVRIRVYSDPGHIDSVDHALNVSRIVLEGFEKQFGYPYEMDKLDLIAVYNFRYGAMENWGLIVHQAYTLIENLMPGNTDIISEVVAHEIAHQWFGNLVTMKFWDQLWLNEGFATYMTAYGYTFLDPNYDRDYYYLSPQFESQSGNELGPLNSMIKLSHGAIGNPSQNYAKGCSFIRMLEKIVGTEHFNEAIRTYLHTHDFSNVEDKNLYDALRVYSDKLEINGKPFDIEEFGRCWTHQTGYPTVYVSSYYAGQTRLSQVKVKEIVTGDFHECNNKWDIPIWYQQSGSTEVELTWLEKDQDELEINTTGFAIINANSNGLYDVVYSEVLYEQVASELKNNTQMYSASTKARVLSDAIHYYYKGEVSLKNSLIIAQALANDTNQEIRSKAAMHLTHAIAKLNQDINEASRILEGIQIEEVNDIDIFSKCGPFKEFPKCFFNAFNSYDHFCASMKLDLSKSSIDQIVWWLKFDQYKSMLISMLHCLNEDSMQKVLHEFVDVSETPGPENPHNKGKLSDSQGKTRAGNFFKFSDKSPFSEFLKMQK

SEQ ID NO: 6961 - protein, 364 aa, Caenorhabditis elegans
MGAGATGLRGARLSPEERANSSKSRAIDRALSKDHTDDLNRFKILLLGTAESGKSTIFKQMRVLHLDGYAKEDALEYLSIIHSNCMEALTQLVDACTAFGINHDITVQEDVNRFEDFKRKLRDPEGLVIPVVIGRCMDRVWHSPSLQLCYDTRRFRFALLDSAKYFMDNIVRLTEDNYVPSIQDIVHCRISTTGINELAFNYKKMDFKMVDVGGQRSERRKWIHCFDNVDMILFIVSMSDYDQLDPEDNKYNRMKQSYEIFKTIVHSDLFRHASIVLFLNKYDVFVEKLKTSPLRRSFKNYEGDNSEESAREFIKKLFRRCITDRHKFFVFETTATDTGNIDLVFGSAVAHIVNENLRSAGLHE

SEQ ID NO: 6962 - protein, 444 aa, Caenorhabditis elegans
MNRCILLLLGALLLVQGLHVHKRQQKLRTVSLKKQPTLRETLLQAGSFETFAKHRHGYKKYLKTNGNHHFDKYQALNVEGEIDELLRNYMDAQYFGTISIGTPAQNFTVIFDTGSSNLWIPSKKCPFYDIACMLHHRYDSKSSSTYKEDGRKMAIQYGTGSMKGFISKDSVCVAGVCAEDQPFAEATSEPGITFVAAKFDGILGMAYPEIAVLGVQPVFNTLFEQKKVPSNLFSFWLNRNPDSEIGGEITFGGIDSRRYVEPITYVPVTRKGYWQFKMDKVVGSGVLGCSNGCQAIADTGTSLIAGPKAQIEAIQNFIGAEPLIKGEYMISCDKVPTLPPVSFVIGGQEFSLKGEDYVLKVSQGGKTICLSGFMGIDLPERVGELWILGDVFIGRYYSVFDFDQNRVGFAQAKTADGRPVDPAPRPFRSVFDNESEESMEQDDE

SEQ ID NO: 6963 - protein, 173 aa, Caenorhabditis elegans
MTTPRSAPLYKLKSEDGQIFNVERGPMKFCAFINQKFIDHGVNDRNCERADPILVPFHSSIVQAVIEWLYHYQDNPLARRDSKIRYHDFSEWDKQFFNVESGVLFALLNASHALGVEDLMNMGCAAAAELIRGKSTEEIRKIYGIRSDEEQMEEALANGGEGTSAMTFTTDSD

SEQ ID NO: 6964 - protein, 182 aa, Caenorhabditis elegans
MQVEEPVILYKLRSTDGQRFLADRRTIGMIGRIEDLFRNAGLDLIPADQLQPIQLEIPATVMRKVIEWCDHHKHDPPYDESEPETNDIPDWDASFLMVRHNMLFDIIRAARDFTVPGLFAMCCRVVGQNPREIIDGLVNDEEEEQPVYPVKKCKNHTNFVNNATLFFKFESKILFSIPYKKT

SEQ ID NO: 6965 - protein, 491 aa, Caenorhabditis elegans
MSVFILAFVIFIIFYVFHFYWKVSKYPKGPLPLPFIGNIHQFPPDNVQKYFDVLSKTYGPCFTIWIPFPAIVLTDYEHIKDAFVNQGDTFTYRAHRSPETLLPVHDHTGILASDGDHWRLQRRTSLKILRDFGLGRNLMEEQVIRSVHEMLIQLENINDKKNVDVFWPIQLCVGNVINETLFGFHYKYEDSEKFKTFVKIVDKHLRHLQGKMPLLVSAFPWLKHVPIVGDIGYHNIKNNISSYHTFIEEEVATQVKKYDGESEPENFVHAYMQQMKQTGNPGLDITNLCATVLDFWLAGMETTSNSLRWHLAFMMKYPEVQDKVRKEILDNVGTARLPSMSDKPNMPYTQAVIHEVQRCSNMIPFLGSHQCKEETEIHGNRVPAGSLVFAQLWSVMRNDTVFEDPETFNPSRYLQSDGKTFDKAVLEKTIPFSIGKRNCVGEGLARMELFLIFSALIQKYEFVATSNIDLTPDWGVVLTAKPYTCNIIPQF

SEQ ID NO: 6966 - protein, 492 aa, Caenorhabditis elegans
MSILIVAFLVSITVYIAYFYWKVSKYPKGPFPLPFIGNILQIPSENIQEYLDDLSKTYGPCFTLWTPLPAIVLTDYEHVKEAFVTQGDAFIYRADRPPETLLQPHLNTGVLFSNGDNWRFQRRTALKILRDFGLGRNLMEEQVMRSVHEMLAQLERIADKKNVDMFWPIQLCVGNVINESLFSYHYKYEDSKKFETFVKVLDKHLKTVQGKTIFLMSAFPWLKHFPVIGELGYHRIKKNIQSYQEFINDEVTSQIKHYDGESEPENFVHAYMQQMKQSGNPNLDMNNLCASVIDFWLAGMETTSNSLRWHLAFMMKYPEIQDKVRKEILDNVGTARLPSMSDKPNMPYTQAVIHEVQRCSNMIPILGTHTNRDDILLKGKKIPTGTLVFAQIWSVLKNDPVFEESSKFNPDRYLMADGKTINKSVLERTIPFSVGKRNCVGEGLARMELFLIFSALIQKYEFIPKTNIDVKPVCGAVLTTKPYICELVPQAA

SEQ ID NO: 6967 - protein, 491 aa, Caenorhabditis elegans
MSPLLILAFFVATVGYLVHFYLKVRKYPKGPFPLPVIGNLHQIPGGNLEIWFDELAKIYGPCYTVWSPLPCVVLTDFDHIKNAFVTQGEFNNRAHKPPESLLHVHDNTGILNSSGENWQLQRRTSLKILRDFGMGKNLMEEQIVKSVQEMMTQLEKTDDKKKADIFWPVQLCVGNVINQVLFGYHFKYDDCERFQKFVSVIDFHLRTLLGKCSLLVSAFPMLRHVPIIGEYGYQRIKRNIKSYQYFIEEEVATQMKSFEEENEPENFVHAYMQQMKQNGHPGLDVKNLRACALDFWLAGMETTSNSLRWHIAYMMKHPDIQDKVRKEILDVVGNSRFPSMSDKPNMPYTQAVIHEVQRHSNMVPFLGTHQSNKDTNVLGQNIPAGTNVLVQAWSVMRNDPIFINQLSFNPDRYLMADGKSFDKNILEKTIPFSVGKRSCIGEGLARMELFLIFSALIQKYEFIANGPVDMSYDFGAVLTIKPYTCQLKAQF

SEQ ID NO: 6968 - protein, 491 aa, Caenorhabditis elegans; identical to SEQ ID NO: 6967

SEQ ID NO: 6969 - protein, 332 aa, Caenorhabditis elegans
MYREILTVFDPLVFIVSLCFQSTLIYTIIRHSPKNISTLKSILLINSCFQLVQSSMAFFSQVRYVSNLVPLELWSYGPCRHFEAFICYSTFHVLQTSSLISALTVFLTTFMKYQAAKHVHLSEKKTWVVVCTILAIILVSTLEIKNISANVVNGCAISLVIMQALPLEIRQKYILINQSLDEYSVIGIVDYSVLPSRINATIVNGLVIILPITCLLLRRKILKLLTGPDRSSDALHSQNRIFIQGLTLQIFCHTLVYVPIFVCSSISLVTKTEYIFPQYFIFVLPHLTTVIDPAVTMYFVTPYRKKLIIWLRLKNNKMHSIAHSTFVVSVNQ

SEQ ID NO: 6970 - protein, 807 aa, Caenorhabditis elegans
MSAKSNVQKFKIVFSFIHPDKIYLLVERLETPSESEMTARRRPSMRTRMKAEDVSCWVEHNQQPFSPSDEPRVRFEAPAPVSARSDDSDAESVESLTERPVYKDGGYGWLVVLASFLMHAVCDGASFCFGIVFVKIQEHFQCGRFVSMITASMFLSLPLIMSPVAGIVSDILGCRMSIIIGASICTVSCIIAMFCSHIFFFMISFGLGCGVGMSFIYNAAIVIVTYYFEKRRGLATSFAVSGTGVGTVIYPILLNLSMIYLASFVSDIRIILIFFAVMYFVIAVIGFFIKDVEWESDKTDFKLRKFQKYIAKMDDEKENNTNPTDAFMRHAISLPNLNILNNHSGSIQSICDAAKAERKSDKPTRSKSVALFDNKHQMSSIPEYSMLNTNLANLEHLDLELANSPCTTVRAQRRRVISKVSMSVDQINELEDEAFHINLFQSSTESESDDESSSDDSEMSNDGDSSSSELSEKNLDEPTTKLINKNLENVAFRATSSVPNSARMNRNSVAAGTSNMFGGRVIASNAIQSRHATNLIAMGKIPSAPMLVARKNRKSMIGKPIQGFYKKWLETEKPIYQEVIHCRAYIYLALSVLCLYFILDVPYVCFYEYSIDTLKMEESEANYIYYSIGISNFISVLLFGTLADWTRKHITTIYASSMVGVGITIMFSTRINSLVELVIVGVCFGVTITSNYVLQSILVTICFEDVNLFQVAYSLIAMIEGVASLIGPPIFALVREATGGYTVVFFISGIFALASGFFGFMFSYEMNKRNTGDKDSIESGKPTELTNGNNRQTSTGSGAEQETLLDV

SEQ ID NO: 6971 - protein, 278 aa, Caenorhabditis elegans
MPKRFSKKVAIITGSSSGIGRETALLFAKEGAKVTVTGRSEEKLEETKKALLDAGIKESNFLIVPADITFSTGQDELISQTLKKFGRINILVNNAGASIPDAKKRTGIDQGIETYEQVMKLNVQSVIEMTQKVRPHLAKSRGEIVNVSSVVALKAGWTRTPYYPLAKAALDQYTRSAAIALISEGIRVNTVNPGIVQTGFQANASGSSSDDAQKFYDDMGSNTTAIPCGFAGRPEHIAKAIAFLADRNSSEYIVGQNIIADGGTSLVLGIHGPAGGKK

SEQ ID NO: 6972 - protein, 638 aa, Caenorhabditis elegans
MRWTPQLLISVLIGYVQARLEISELRFKDILSSHYIFKPLEVPCNESLCTGPLSEIYCHGPILTNSWQFGLQKTCPGDKLKQFCEEHFEQVNYLEVVNLTDYEVQPKFLNEIGNLSHRKLAAEMHERWERLARQFTSDVQHHPDLYPLIPVQNPFIVPGGRFDVYFYWDTFWIIKGLLVSRMFETTKGIINNFSNLVVTLGYIPNSGNLQLSRRSQPPLFPHMIWEYTKATGNYEKQWIDSMDMEMKFWENNRTIAIGTHKLFLYKVFSYIKFLWFKNMNSSNYVNVNNYIHTLTNCPRPENFLGDFNIGKAAKTPSDVWRSISSACESGWDFSSRWMHNNDTDLSSIHTDLIIPVDLNVFIANNYRYMAYYANHFGRFDKSASYRQKYEKLRYAIQEVLWDNNLGAWFDYDISIQKRNLNFYPSNVYPLMLEGMDKFADRVEDYMKKSGALEFVGGIPSSLPAQSTQQWDFPNVWAPNQHFVIQSFMACNNSFLQQEAKKQAMEFIETVYNGMYNPIAGLDGGVWEKYDARSTNGAPGAGGEYVVQEGFGWTNGAVMDLIWTLRDSHKKQIRSENLKLDQGQHFALVLTAFIFCIAIAFIVIIKGIIKGNTLNQRDDEEAGARLLAEENDEDDQEEL

SEQ ID NO: 6973 - protein, 342 aa, Caenorhabditis elegans
MCENLYGEEYKMEILRLQKMMNNMTCGQMAKPLTMKDFQIHQALGKGAYGNVYRVRSLHDGKDYALKQIMISSKNEGIPQSVLREITVMKHLARKAHPNIISLKSVFHQLDPVRAILKINMIMERCDWDLHTFLRNIPRGVPEQQAKHVTAQIVRALDFLHTHSIIHRDLKPQNILLNRDQTVKLADFGLSKEYSNTTAFTTLVVTLWYRSPEVLLQSYYNSTVDMWALGCIVSEIYCRQPLFVGQNEAEQLTDIFKKMGTPVGKDWPSESVIARDSFPQYRPTNLKDLSPQMSKQAIEFVQQCLRYDHSKRLSARGALSHPFLKPAVATKSRVLKQINFNK

SEQ ID NO: 6974 - protein, 335 aa, Caenorhabditis elegans
MTIRHILAIRKKSLELPSDLKTFLRVLANCQHLKKALGKGAYGNVYRVRSLHDGKDYALKQIMISSKNEGIPQSVLREITVMKHLARKAHPNIISLKSVFHQLDPVRAILKINMIMERCDWDLHTFLRNIPRGVPEQQAKHVTAQIVRALDFLHTHSIIHRDLKPQNILLNRDQTVKLADFGLSKEYSNTTAFTTLVVTLWYRSPEVLLQSYYNSTVDMWALGCIVSEIYCRQPLFVGQNEAEQLTDIFKKMGTPVGKDWPSESVIARDSFPQYRPTNLKDLSPQMSKQAIEFVQQCLRYDHSKRLSARGALSHPFLKPAVATKSRVLKQINFNK

SEQ ID NO: 6975 - protein, 342 aa, Caenorhabditis elegans; identical to SEQ ID NO: 6973

SEQ ID NO: 6976 - protein, 565 aa, Caenorhabditis elegans
MFSFNWALILLVAVGGTNAFKIKRTAKDLESQLYEDLLFDYNKVPRPVKNSSDILTVDVGASLIRIIDVDEKNQVLTTNLWLEMKWNDAKLTWTPEKYGGLKTLHIPSDFIWTPDLVLYNNAAGDPDITILTDALVTFEGNVYWQPPAIYKSFCPIDVTWFPYDSQKCEMKFGTWTYTGRYVDLKQLPQEEVVTITKDDNDVEFMQQGMDLSFFYRSAEWDLLSLTSERHSVLYASCCGPEKYVDITYYFGLRRKTLFFTCNLILPCFLISILTTFVFYLSDHKITFSISILVTLTVFFLVLIDLMPPTSLVIPMFGRYLITTMILVALSTVVSVITVNFRFRSGSAHKMSPWIRAVFLKFLPKILLMSRPEKGEVTKQPPLVNAASLVGSNYATAAKAANEYRNKAKGKNNDLMSLRGKPSSQAVLNNTFDMRMRNNDSTVENRLKPYLCAQNNNAPTVAFRKTKRQKSKSVDDVVFMNLLNQVRFIAEHFRHNELEGEISDDWTFVAMVLDRLFLIIFSVLNVGTVFIILESPSLYDYSKPMNITVPNKPLGQANFYSSWNLK

SEQ ID NO: 6977 - protein, 245 aa, Caenorhabditis elegans
MASPISHSSHENASGKYGYGDESQHGKNFHQKAEHSGHEAKEKGYSQDGKAADHDALHKDAAEHKQNKEAHQSGSGNKYVDDASNYNKDVKTKTFGFFDYRYVQPQYHMEQYHTDEKHANKYAGDEHNAGQQHKDNGGYHADGHQGYDKAQEKHGASHTNYGNEDAGHKSKYDDNEGKYGDHTDGYYNKGYDNYGQGHDSESYQPSYYQPKPKYYGGHQSHYQPSARHSSPYQGDQYYGYEAPHY

SEQ ID NO: 6978 - protein, 798 aa, Caenorhabditis elegans
MERIYLLLLLFLPRIRSYDVRSVTTSWGMVRGEVVSPEGDDLPPVAQYLGIPYGVAPTGQYRFNMAISAAKWTHMPKDARKVSPVCIQTDMPELSETKAFKHTSAQRFDFNHRLLPHLKKQSEDCLYMNIYVPERLEISRDNYLPVMVIVHGEEYGWGTGNAFNGTTLAAYGHIIVVTLNYRLGVFGFLGRCESSSCSGNSGISDLVSALTMLNVILPSFGGDSKSVTLAGWGSGASLVSLLMASPLTQPGRRLFRRAILLDGSALSPWAISQNPQQYFMQLAEELACAPKNRTSSFNDNVDTIVRCMQVHSSENITKAVLKIDVPTFLSGFAPIVDGQLIPNKPQVSFSTQYGSLFREIDLLVGISSNPSHHMISNEDLKVGISKEKRMRIFRSLVRNLYDFHREEILASIINEYTDWENPRDHPKSIRNGVLNALSDVLYTAPLIETLRSHSADEVRKEANTFMFAFAHETRSWSQEQPNSGIRGSLSGDIVPYIFGYPLAQGDSEERLYSGFNTDDKGISKVMMHYVSNFVKSGDPSKPNPMSKNFPMGDVFHSTAWPQFDQPNREAYLEITDRPRVKNYYRNAQVGFWNNFIPQLHKNGKETEPVGEEHHLLSDHFRKDSYFGKTRHFSSYANLPFPPPPMPPSPPPELTTKPKPSESPTTLQTTTESEKAAAGSFTGKALGGVIFIGCGFLIMNVCLLIAVRREWGKKRRNEKKFQLQYQTYNSNHGGGAEQYNSLNSPEPLLSASHKNSTSMRPAGISPTCPRHGRAALALQNSRGNSLTAAQAPTLEEIQV

SEQ ID NO: 6979 - protein, 798 aa, Caenorhabditis elegans; identical to SEQ ID NO: 6978

SEQ ID NO: 6980 - protein, 542 aa, Caenorhabditis elegans
METMVLFTVIHALHCVLFHLLTEVHSSADEYRLLADLRHNYDPYERPVANASEPLVVSVKIYLQQILDVDEKNQVITLVAWIEYQWTDYKLKWDPSEYGGIKDIRIPGNANAIWKPDVLLYNSADENFDSTYPVNYVVSYTGDVLQVPPGILKLSCKIDITYFPFDDQICHLKFGSWTYSGNFIDLRINGPEGKNISDEGIDVQYYVQNGEWNLLAVPARHETNIFDEQPYPSLFFYLIIQRRTLYYGLNLIIPSFLISLMTVLGFTLPPDAGEKITLEITILLSVCFFLSMVADMTPPTSEAVPLIGLIIFSGAFFSCCMLVVSASVVFTVLVLNLHNRKPETHEMSPFLRELLLIWLPWLLLMRRPGKTIFNCTHLKAEKAEEKAKQGSIKNGVGPGKPTDSVHPSEGLSLMKNIKLGRQQTIDFEYEFHVQHNHLMPVAPSEMTPRVTYSKVMAESYVEDVVMTELNKYMQKACLELKNISSQTRAMRKKMEEDERDEQAANDWKFAAMVVDRCCLITFSVFIVVSTCGIMFSSPHLIA

SEQ ID NO: 6981 - protein, 952 aa, Caenorhabditis elegans
MTDTLDLKLSSRRQWNPVRCPVRLEVDGSAQTPTSLVQTALNNPSFDLVIAAPNGQNVYIPFTEDRKLFTANIADDPSTSSLISHCHFEGVTEDGRHALSLCDPGEITGLLMTQTNRFGLSTSNNGSFVLIPYVENNCDLGSLVHSSSRKKRQIGKQNTVIDRNPSYIREHLDGRKRFVELALVADYSVYTKYDSDEKKVNDYMQQTMNILNSLYFPLNIRITLVHSEIWKKGDQISVIPDSKETLNNFMEYKKIMLKDHFFDTGYLMTTLKFDEGVVGKAYKGTMCSYDYSGGIYVDHNNDTVETVATFAHELGHTFGMDHDPNDKDVCYCPMPRCIMNPQSGHMEVWSECSVKNLASGFNRGIDLCLFNEPGKKPSDAKCGNGIVEPGEECDCGPLKCDNHCCNGSTCKLIGEAECASGDCCDLKTCKPKPRATVCRAAIGICDLDEYCNGETNDCPADFFVQNAALCPGKENEFCYEGGCGSRNDQCAKLWGPTGKNGDENCYRKNTEGTFHGNCGTNAHTKEIKKCETENAKCGLLQCETQAERPVFGDPGSVTFSHSTVYSSLKRDDKKFCYVFKSAYGGLNAPDPGLVPDGAICGEEQMCIGQKCHKKEKISKVTAQCLDNCNFRGVCNNVGNCHCERGFGGIACEIPGYGGSVNSNEAYRFRGITLSSTFLVFFCLFGIFIGGLCVYYRVKRKRNLVSEWWSVVKKKFDLHGDLVPVRKAPPPPYAQRIRQSFTAMWGEDHSHVAVAQPAHPRNCYNSCCRQPPRFDPPSIPMVTLKNPNLASPTPLLNPAEKEEQNQERATHQHVELYPVAESFRSDSAASFNTRTGSFRPNVQPPPVPRPSDDVLSKLNEDLAKEKNAKFDRLNKTLPLPPPLPKEKPKTASSTSLRRNESIRPEQAPPPPPPAHAKPTLPTKQPKVSEDAAATEEKVDVRSMAAIFDQKLKK

SEQ ID NO: 6982 - protein, 952 aa, Caenorhabditis elegans; identical to SEQ ID NO: 6981

SEQ ID NO: 6983 - protein, 552 aa, Caenorhabditis elegans
MKLLSVSCLLLLHFASVLADPTYDVTVQTPNGSATIRGIQHTYGTSFRGIRYAQPPVGLFRFGAARRLDPVGLVEAQAYGNICVQGDGRTSHEDCLFINVYTPNVSLGNVTQASKLPVYVYIHGGGFVEGGGNMGAGIYPNLVNKGPIVMVSINYRLGPFGFFSTRQMTAPGNWAISDWIEALNWVQRYISFFGGDPNRVTIGGQSSGAEAVSTLTLTPLAKNLFKQSIHESGSAFGAAVMSYSEKTRSTSKQLSIKLGCATSDQWDNGQSFGTILTCLRNVTYDKIVAADNSLPGHRMKWSIVQDNKYLTQRLEYLALQRDPKKNVLIGDVHDEWLGSEMNNVLHNINSSHNTAHQMRDDLSGSYEMTYWDNKQSVLVAADNKYINNQGWTDDNHREWEARRIQLWSEMVFIGPTLRDAAYFQYMKNNVYLYSLDWLSPPALPLVTDPLFRGCEHTWELQYIFSTSCNGFTCTAQDEILRNYFTTTWLNFIIGGNPTPAGSPLPFKWLAMDSTNRFLSFSPNPKMQPHYHPDSMFWVCTAPTIDGYKGPFC

SEQ ID NO: 6984 - protein, 317 aa, Caenorhabditis elegans
MTNGGRNGEENKNLMNGEAKAEPETFAQFLYNKDKGTVLGRTGTSWCQITVFYIIFYIFLSAFFIGCLSIFLRTLDPKVPRFYGKGTIIGVNPGVGYQPWLKENPDSTLIKFNLQDSKSWEPYVKQLDNYLSKYKNTNETRDCGASDNNDALETDTDTFPCRFDLGLFEKANCGAKDQYGYKSGKPCVAVSLNRLIGWRPVNYDDGSVPEEIKGRYKPGSITINCEGATSFDKEHLGKVKYIPETGIDGRYYPYVFVPSYQQPIAMVKFDTIPRNKLVIVECRAYASNIEHDISTRLGMVYFELFVEDKKPVAAPAA

SEQ ID NO: 6985 - protein, 596 aa, Caenorhabditis elegans
MPDNNQQADEKAAAHQDPETVEKELEDAGFIAPPDGGYGWAIVAASFLLNMIVDGVIFTVGKILQPAWVHSFGISEASAAMTMSILSGCYFFAGPIASVLCNVFGCRQVALAGSLIAALGFLLSISAPNIYVLYVSFGLIAGAGFGMMYLPAIVIISQYFAKKRSVATGIAVCGSGIGTTVFALLNDVVWDFVGGDWKQFLVYTAAVTISGLGACILLRPLKPSKDQIEKVAKVLEDYEEHKEKVPESPLLSKHNTPFLSSLELHTAGKLENGHHTGSIKSIVDAVSKEIEDLNKPLLRKDIFYSGSTTNIAARSRTGTMTREEAAEHQQSLRFRGKVETPQQYLSKADLNAGDNGDVAIANESKIQEIKQALKQLVDKELLFSPSFLLLAFSGTLTLCCFYVPFIYLGNHLDKIEGLTTAEKSFTVSLIGVLNIVARIGCGILADRPEVSALAVNNFALIAAGLATMTVPLYTAYWQFLAFCVPFSIGVACFAALRSIIVVELIGLEKLSNAFGILLTFMGVGAVVGSPLAAAMKDYTGNFDTSFYVMGALMTISGAMCIPLGGLRKRELARSDSSDAKKAIELQKLTDTQDNTN

SEQ ID NO: 6986 - protein, 138 aa, Caenorhabditis elegans
MIFRMADLKQITLKEIAEHNTNKSAWLVIGNKVFDVTKFLDEHPGGCEVLLEQAGSDGTEAFEDVGHSTDARHMKDEYLIGEVVASERKTYSYDKKQWKSTTEQDNKQRGGESMQTDNIVYFALLAVIVALVYYLIAA

SEQ ID NO: 6987 - protein, 437 aa, Caenorhabditis elegans
MLTNFARQPSENVGEHQESIWVEFGKLAIENKAVSLGQGFPDSPAPKFVTEILKDIASHPEKIESHQYTRAFGHPDLVGILSKIYSYFYGVNVNATDDILITVGAYNALYYSFLGWISKGDEVIIIEPAFDCYFPQVKFAGGTPISVVMKLKEGSKSASQFTIDFEELEKKINKRTKMIVINNPHNPTGKLFSREELQHIAELARNYDLIVVADEVYEFHVSQPKEMIRFASLPGMYERTISIGSAGKALSVTGWKLGWAIGPQHLLSPLKTISQNCVYTCPTPIQLAIARAFQQDWPKFMENPNQSYLATGLPKEVMQKRKILANMLEKANFQTILPEAGFFMLAECKLPMKSFSFSPIVGKDPLDVQYSKWLCREKKLAVIPFSIFFSSKDQKHLSGRFVRLCFFKKDTTLQAAEKIFKTFENNDEKILERPVKL

SEQ ID NO: 6988 - protein, 528 aa, Caenorhabditis elegans
MSTENAHLQKEDIVIESWLHKKGEHIRNWRPRYFILFRDGTLLGFRSKPKEDQPLPEPLNNFMIRDAATVCLDKPRPNMFIVRCLQWTTVIERTFYADSADFRQMWIEAIQAVSSHNRLKENAGNTSMQEEDTNGNPSGESDVNMDATSTRSDNDFESTVMNIDEPEEVPRKNTVTMDDFDFLKVLGQGTFGKVILCREKSSDKLYAIKIIRKEMVVDRSEVAHTLTENRVLYACVHPFLTLLKYSFQAQYHICFVMEFANGGELFTHLQRCKTFSEARTRFYGSEIILALGYLHHRNIVYRDMKLENLLLDRDGHIKITDFGLCKEEIKYGDKTSTFCGTPEYLAPEVIEDIDYDRSVDWWGVGVVMYEMMCGRLPFSAKENGKLFELITTCDLKFPNRLSPEAVTLLSGLLERVPAKRLGAGPDDAREVSRAEFFKDVDWEATLRKEVEPPFKPNVMSETDTSFFDREFTSMPVQLTPPRRGEELPTVDEEEELQANFIQFASYYVSGSLERSYDTNRSADKYEIR

SEQ ID NO: 6989 - protein, 528 aa, Caenorhabditis elegans; identical to SEQ ID NO: 6988

SEQ ID NO: 6990 - protein, 379 aa, Caenorhabditis elegans
MLSRTVSSLSRVAPQTLGAVNAASSRQYSITAPRPPTELNQKLKVTIIPGDGVGPELIYTVQDIVKQTGIPIEFEEIFLSEVHYTRSSSIENAVESIGRNNNVALKGAIEESAVLHTEGELQGLNMRLRRSLDLFANVVHIKTLDGIKTRHGKQLDFVIVREQTEGEYSSLEHELVPGVIECLKISTRTKAERIAKFAFDYATKTGRKKVTAVHKANIMKLGDGLFLRTCEGVAKQYPKIQFESMIIDNTCMQLVSKPEQFDVMVMPNLYGNIIDNLAAGLVGGAGVVPGQSVGRDFVIFEPGSRHSFQEAMGRSIANPTAMILCAANMLNHLHLDAWGNSLRQAVADVVKEGKVRTRDLGGYATTVDFADAVIDKFRI

SEQ ID NO: 6991 - protein, 161 aa, Caenorhabditis elegans
MKAIDNMEECREVFMLFDKKGDGKIDAAQASFIDRFVDARASLKHIQVFEVLRSLDENPKNSDVHQCLAKFDKTARISFENFLPVLSHVRNNKIPYSMEDFIKGLSHFDKEGEGFITSAELRQVLTTMGDKLSDEEFDKLVAGQEDNGKIKIETFVKTIMQ

SEQ ID NO: 6992 - protein, 270 aa, Caenorhabditis elegans
MEDVGGMFEQKKLLEQVIIWPRKYPQLFESVGVPVSKGILLHGPSGCGKTLLANATISNSNFSVVNVKGPELLSKYIGASEENVRLVFEKARSCAPCILFFDELDSLAPKRGHDSTGVTDRVVNQLLTELDGAEGGMKGVIILGCTSRIDLIDDALLRPGRFDHHVYCGHPEKTERLDIMKVLTNKLKPTDVDFECLAQKTDGWSGADLQLLFTNAQFYNARQIAKEEDGLEEDNVPIDQASIESVFNDSIPKPKRSQVDNRIGQKVTLA

SEQ ID NO: 6993 - protein, 395 aa, Caenorhabditis elegans
MEQRGRASQDEEQAIVGAETGSQPSLPVSPMRPIIAPSPAMVLPTPGHGMGIPQFGPVGLPAQASTPMLSSTPGPSYSSAPTPMPNPSAANLWPTYKLVAEIPNAHKKSISGIKFSPDGRYMGSGSADCSIKIWRMDFVYEKTLMGHRLGINEFSWSSDSKLIVSCSDDKLVKVFDVSSGRCVKTLKGHTNYVFCCCFNPSGTLIASGSFDETIRIWCARNGNTIFSIPGHEDPVSSVCFNRDGAYLASGSYDGIVRIWDSTTGTCVKTLIDEEHPPITHVKFSPNGKYILASNLNNTLKLWDYQKLRVLKEYTGHENSKYCVAANFSVTGGKWIVSGSEDHKVYIWNLQTREILQTLDGHNTAVMCTDCHPGQNIIASAALEPDMRIKIWRSQS

SEQ ID NO: 6994 - protein, 277 aa, Caenorhabditis elegans
MVKLYSTIFKFRNDFVKHTSENWFHLIIECNWRTICILFLLGFIVSWTIFAVIYYVISRLKTVKKDESCIANVDTLISAFLFSMESQHTIGYGLRYMTDLCPPAYLTLCVQCVVGVFLQTILAGIVIAKILRPKKRRQRGDRELIGVKDMNVGYDSGWDRVLLLWPIIVRHVINEDSPLYGMSRENIVKADFELIMTVEGIVEATGMTFQARTSFLPDEILWGYKFKPMVLMNEKLSKYEVHYSFFDQTERVCDFDAQTIETEETEDEHHHNASGFL

SEQ ID NO: 6995 - protein, 148 aa, Caenorhabditis elegans
MSFLSRFIPTVTARTAIRFASNGRLYTKKHEWIVVNQSVGTVGITDFATEQLGDVVFIELPEAGVEIEKGDSTGAVESVKAASDIYAPVSGKILEKNTKLEDEPGIINKSPLEKGWLYRLEITSNEQLNELLTEEQYNKFKSEEEAEH

SEQ ID NO: 6996 - protein, 463 aa, Caenorhabditis elegans
MTDTQSPFSFAAALLQCGSPGQTFSMESLLKPELGEYSPSGENGIDGEESTICSVCCDEASGRHYGVVACFGCKGFFRRTVRAGKNYVCRYSKKCRIDKAGRNVCRSCRFQKCLEVGMEPDAIRPDRDKTGRQKNPRRNTEGSIKKVSVGSILGDLPCLNKFKDDSDDAATSPSSRADSAPMDLRPSFIDESVLTTLTEIENIVIQLQDNFETNQQSLPPMGEAITKPSLIAARTLLNFNGAKGVADANCVSSNLRRMIVFTFDYINTLRPIADLHPSEKLVIARSIISPFCILFCGYQSVAIEAPEHDSIYLPSGHKLPASQLLFTKDSDQKKYILLENKADNVRRNMTEMIIQQLRRLNVTKTEMVALKAIMALDHNVKGLSAESCELLVVARESVQNALFSHLIATFGTAEATSRFAHLLLLIASATRVAYSLSSFFQLSRDVNYEIDYVLEELLFLDRI

SEQ ID NO: 6997 - protein, 458 aa, Caenorhabditis elegans
MRLLLFNLLIAGWVYSQCPTLQLQEPCTCTSTRYEAVSINCDGGSSLDAVLESLSNSPQAIDSLTISNTPIEKVLVFNHDKISYLLFEQMPGYAFQGFQIKKLFLRNNGLRSFHPNTFTGNLENSLEELEIRGNYIDGIPQSGVSILKQLKILSLPDNLIEYVQDNAFLSYHSRDSLLKLDLSANNLTAIHPTGLLGLENLSQLSLDKNLLSEIPSQALENIPSLEDLSLGVNRIHTISRNSLPLPNLKSLSLEVNQIRLIPSDSFSETPLLSYLYLGNNLLTSIDASMFLHIGGLKVLSMSNNKDITSIQANGKLSVQQFKLCICILAFQHAPSLIRLELFDCSISRIEPKSLQKVQHIQVILLSRNQITQINAVDDFAFSQLPMLTSLDLSSNRLESLPSNVIYDSLMQKKTSPVQRKLSIQNNPWRCDKDLMWLRKWLRDNGDVTTAASNSPPAK

SEQ ID NO: 6998 - protein, 367 aa, Caenorhabditis elegans
MNRMRRSTAFSEHVTFHTVMAKRGTGSKLDREVEIQFTNLQLIGTGSFGAVYKAVLRENDEPIAIKKIKVDDRFKSRELTIMHEMDHPNIIRLLYYYVMQQENCLNFVMEFMPKDLAYVHRQFAHNDKQMPAYSIKLYMFQLLRGIGFLHLHNIVHRDIKPKNLLVDESNGILKICDFGSAKRLEKNEPNITYICSRYYRAPELIFGSKNYDTSIDTWSVGTVVGELLHNSPIFLADSAVDILALQIKAFGTPSKEDMAKWNYEYVHIPYDTITGVGIQKFIGRKLSLSTLELLNSLMKMDPKLRIKPYEALTLPYFDDLRDPHYKLPSGAPIPPLFDWLEREYIANHEIIKDIFPRSEEGDKVECL

SEQ ID NO: 6999 - protein, 601 aa, Caenorhabditis elegans
IKSKFIEAGIARCEYPNTVSNQLLLTAQPYQFTCDSKVPTKLATKCDLCLNSPCKNNAICETTSSRKYTCNCTPGFYGVHCENQIDACYGSPCLNNATCKVAQAGRFNCYCNKGFEGDYCEKNIDDCVNSKCENGGKCVDLVRFCSEELKNFQSFQINSYRCDCPMEYEGKHCEDKLEYCTKKLNPCENNGKCIPINGSYSCMCSPGFTGNNCETNIDDCKNVECQNGGSCVDGILSYDCLCRPGYAGQYCEIPPMMDMEYQKTDACQQSACGQGECVASQNSSDFTCKCHEGFSGPSCDRQMSVGFKNPGAYLALDPLASDGTITMTLRTTSKIGILLYYGDDHFVSAELYDGRVKLVYYIGNFPASHMYSSVKVNDGLPHRISIRTSERKCFLQIDKNPVQIVENSGKSDQLITKGKEMLYIGGLPIEKSQDAKRRFHVKNSESLKGCISSITINEVPINLQQALENVNTEQSCSATVNFCAGIDCGNGKCTNNALSPKGYMCQCDSHFSGEHCDEKRIKCDKQKFRRHHIENECRSVDRIKIAECNGYCGGEQNCCTAVKKKQRKVKMICKNGTTKISTVHIIRQCQCEPTKSVLSEK

SEQ ID NO: 7000 - protein, 417 aa, Caenorhabditis elegans
MTWIKLASLALVVVLASAGISKNEDLECMFLGYPDLEYDGFDRTEVLTEKNFNRTVFAEDTKSVVFFNDVEEDDSELDQYECFLQLSAQIMTKRGYNFYTVNTTKEHRLRKQEEVEKGEDTIHVYKDGYKIEYNGVRDPETFVSWLMDIPDDPVTIINDEHDLEEFENMDDECVRIIGYFEPGSVALKEFEEAAEDFMGEIEFFAVVTSKWARKVGLKRVGEVQMRRPFEEDPLFAPTSADTEEEFEDWVEKNKEPVMQKLTLDNYFNLWRDPEEEERMILAFVDEETREGRAMKRLLDKIADENSEHAGTLEIILVDPDEFPLMVDVWEDMFGIDIEEGPQIGLIDISEKEGIWFDMSQVNLDDPKKHSDSNFEALQSWIDQILSGSISLDDDDDDEPEPPAPPPTPKGKKSRKEL

SEQ ID NO: 7001 - protein, 322 aa, Caenorhabditis elegans
MLSQQIANNARTLQKGAARFYNSTYNNLKINKDTKVIVQGFTGKQGTFHGKQMLEYNTKVVGGVNANKAGTEHLGLPVFKNVSEARNKTGADASVIYVPASAAGSAIEEAMDAEIPLVVCITEGIPQHDMVRVKSRLLKQNKTRLVGPNCPGIISADQCKIGIMPGHIHKRGCIGIVSRSGTLTYEAVHQTTQVGFGQTLCVGIGGDPFNGTNFIDCLNVFLEDPETKGIILIGEIGGSAEEEAAAYLKEHNSGANRKPVVSFIAGVTAPPGRRMGHAGAIISGGKGTAADKINALREAGVVVTDSPAKLGTSMATAFLGKI

SEQ ID NO: 7002 - protein, 2105 aa, Caenorhabditis elegans
MAAHQILLLCLLLLLAPLRNGQTTPTTRAQADLVNQLPGTIFQVNFKQYAGYLNSDPNKNYNNLHYWLIESQLTPSNDTLLLWINGGPGCSSVFGQIQEIGPFHVSSDSQTVYENVFAWNKVSNLLAIDGPGAGFSWQQNLFQDDSYVTGALLNALMDFYTVYPNMLNSDLYIAGEGYGSFFASSLVESLMVNNTPRPDIVTSPVNIRGLLLANGDLSARLQYNSLIPFYYTHGFAGSKQYDDLKSVCCTNASTQTCDFFNSNTACRTKADNAIATWSNYQANKIVLTRRGCSEINAAVDNYNSTDSFRGYPCFALSATAAYLNRQDVQAALHVSVNASTNFQTCRNLTYGELSTDLQIRISSILTSEKYAQNNMKIMIYNGDLDLWSNFIGAQRFGQEIAAALKLNTTEDRIWRHNYDSAAFVWMDGGVITSYSSNFHIASIRGGGHFAPQNRPSQSLQLYRDFVLGLFFNNCLSRVNKVAAPLLPAYQQLAAPATRRDADKIVNLPGLTYQINFNQYSGYLNASDTHRFHYWFVESQNDPTNSPVLLWLNGGPGSSSLWGMLTENGPFRPNKDGQTLYENVHSWNKFANVLYLESPHQVGYSYSTVANDYTYGDDLTASDNYNALKDFFNNIFPQYKQNPFYITGESYGGVYIPTLSKLLLQMLSAGEININFKARLIFIGIAIGNGELTTKLQVNSAIFQLYTYGLFGENEYNALVARCCKNVTDPTQCDFYTPYVFFDYLGNYKAVDGADPFCSSTGLLNLASSDPFDGFPCWSTDATTTYLNRDDVRNALHIPTTVQQWQSFNQTVNAQLYNRSYFELDAVLNRILSSYYYKQNNMKILIYNGDVDMVCNHLGDQWLIEQVASNAGLKTVSPRQPWNYVMAGENYLPQLAGYVKVFDSNLNLVTVKGSGHLVPQDRPGPALQMIFNFISGVNLNTTFPYALPAAPLLPAYSDLQGCQAPQYPTAQSLPTLPPLPPLPPGVTYPFVAKKDVVEVAEPGTIAADEHGSQIYPTALNDAAKADMILSLPGLTFNVTYRMFSGYLTADETPLNHLFYWFVESQNDPVNDPVVLWLNGGPGCSSLGGFFTELGPFHPNDDGGQTLYENVFSWNKKANVIFLEAPAKVGFSYTEDPNYYWDDDTTAQNNGYAIKSFFQKKFPQYAQNQFFITGESYGGVYCPTLTLNLVQQIDAGILNLNFKGTAVGNGILSEYLQTNSEIVLQYGRGFNGVDDWNNLKTACNLTNSDTIYYDYQGAPEGSACYQAVDDNQKKFYGLDERYGDPYNMYQDCYLYNNKGAWQTPSAQQQTKPKTRRERALRAHMNRRKSFASASIKFDNSNSKNWYGSTDPFRGLNCFAGDALVTYLSRDDVQTAIHSRKQPLWVDCADENPANHFRYHTQEKYYDMQNTISDIMDSKWYTQNSMRLMFYNGDVDTICQFLGDQWLIEKLVTRRNLTVTSPRQPWYYQQGSQYVTTIAGYAKSWTQNLVQLTVKGSGHFVPSDRPAQALQMLTNFLSNQANYSTPAGIDVTPQPLTNVISQTNCTTGQTDRIINLPGLPADMLFKQYSGFLDGLSGHKVHYWLVESENNPSTDPLLLWLNGGPGSSSLMGLFEENGPFRVSKDSQTLSRNPYSWNKFANVLYLESPIGVGYSYAYNNTNIQYDDVTTAQENYAALKSFFAQYPQYTTSDFYTTGESYAGVYLPGLSALLVQGIKSGDININYKGVSIGNGVIDKRTDMNSQLHYQYYHGGISATTYNTALQLCCSGDEFKCRFSDRMTNFNNSIPWGDLSDPCYDFVVATGAQLLLTAFDPYNMYQQCWTIPYNDTTPRTPYGETWTGINYESSDFLNGYPCYDDSAMEGYLNRPVVRKALNIPDSVPYWAANNNIINAYNQQVDSIVPNLQIIMANAPANFKMLLYSGDADTMVNWLGAEIFTANNFAALGLTTSSPRAQWTFQYNSTFQPTVAGYQTSYTSNAINIDVLTVKGSGHFVPLDRPQQALQMIYNFVKSRGYNTPFDLNSNFTTTTTTSTTTTTPGTGPTVTAAQTTTTTPSTPGAGTTGTPGTGPTVTAAPTNGISTTQPIITTTKGAEGRGVLTIMATILSVLLFN

SEQ ID NO: 7003 - protein, 2105 aa, Caenorhabditis elegans; identical to SEQ ID NO: 7002

SEQ ID NO: 7004 - protein, 2105 aa, Caenorhabditis elegans; identical to SEQ ID NO: 7002

SEQ ID NO: 7005 - protein, 464 aa, Caenorhabditis elegans
MQTLMSHSRITPLPGAITKEEIKNQLLVHERRFLSKPNRKDQWNVLPQSAHSKNTVNPVRKIADACAVPPHPEKKVIKLHLGDPSVGGKLPPSEIAVQAMHESVSSHMFDGYGPAVGALAAREAIVERYSSADNVFTADDVVLASGCSHALQMAIEAVANAGENILVPHPGFPLYSTLCRPHNIVDKPYKIDMTGEDVRIDLSYMATIIDDNTKAIIVNNPGNPTGGVFTKEHLEEILAFAHQYKLIIIADEIYGDLVYNGATFYPLASLSPKVPIITCDGIAKRWMVPGWRLGWLIIHNHFGVLTDVKNGIVALSQKIVGPCSLVQGALPKILRETPEDYFVYTRNVIETNANIVDSILADVPGMRVVKPKGAMYMMVNISRTAYGSDVSFCQNLIREESVFCLPGQAFSAPGYFRVVLTCGSEDMEEAALRIREFCYRNFNQHSDSEDSSDEGLDLSAMESD

SEQ ID NO: 7006 - protein, 829 aa, Caenorhabditis elegans
MENDNYDVEEQGCSVFNGKHGYFARSCCVVFILIICVIFVFSVIFTFMQNPINLNSDNGFNQTSGNTSSLEATTLKPKFSSLMTTTRRFTFEQLFSGKQFLVDYYDYIWLPDGSFVQMNDDFTIRKQMKKIPLGSSVAEPFFNNGEYVKALSSNMKYAYGSKKVNELWRHSAEYLYHIVKINNKTVSTEQWHVGPEENSLIQAFYWNPNASSNDFVYVHNYNLYYQKDPEKPDGAIQLTVGGSTFNRFGLANWLYEEEILEASSAVWWSPSGRYVSYLRFDDREVNRIFLPKYTDDDSYVEYFELPYPKAGVQNNTLVTQYIWDSENHKIVETAPPNELSAANGDYYVLTNKWITMPRNGSDLGEERLVTVWANRDQNHVYFSLCNEQDCVMALSFQFSIDNRQLWVSPKDVRGVFPTETGFLTVLPHKHDDGNIYNHVAHVELDGTGTGKITKWIGENFDVILVLGYSSKIDALTFSAYGDGVGEFSTYIVREAMYSNKKTTLQKVTDQFEDCKTLGSQSADPTGQRIVVQCEKPFDNTRLYLVDVVDTTKKIMLEGGTKAVIPFDVPNMKFGKLKLPSGIDGHYMMLTPANLLDGAKIPLLLDIYGGPDSKQVFQKTPTAHAIQIVSQYDIAYARIDVRGTGGRGWDVKEAVYRKLGDAEVVDTLDMIRAFINTFGFIDEDRIAVMGWSYGGFLTSKIAIKDQGELVKCAISIAPVTDFKYYDSAYTERYLGQPAENLQGYINTNVIPHARNVTNVKYLLAHGERDDNVHYQNSARWSEALQQNGIHFTQLVYANEAHSLSHKLFHLYGEVQRFLMNDCFKSNLDLL

SEQ ID NO: 7007 - protein, 398 aa, Caenorhabditis elegans
MNNNTLNITNQRTAAAMSQIYFLVVYQTAVMIVSLLGNLFLLFVIFRANQVMKRRVSPVQLLIIHTCVADLLFALLSLGTEILTLRTYPQYYGSNFVCKLMRYVQMFPMYASPFLLVAISADRYQAICRPLAHFRSSRYRRPNWMAAIAWGLALVLSIPQFFVWTKHSKTGRCSTIYGQNKNTVKITYVIMFNTLAWLLPSILAAVFYYCVCKAVRLSSTKSVRAMDSQKRNGKYSSGATEDYIEELRKKSKGFRQQMSEFDRKRVQTVRLTITIVACNFFLWMPFCLINVIQALWPEISHIMFINYVAILGNLNSCLNPWIYILFNRSHVRKALCRSRRSFTEVTKKRSFENFECSSTATMNNNYNNCHAYTAFSNRSQLKFDSYATDSTSLKTNSN

SEQ ID NO: 7008 - protein, 123 aa, Caenorhabditis elegans
MGLFFSKISSFMFPNIECRFNVETVTFQKLTLIVWDVGGQILKHYFPNTTILVFVVDSSDIERIPEAKEKLFSLLAEPELADSHLLVFANKQDMPNARSPAELTQLLDLGSLKNREVNSCIVL

SEQ ID NO: 7009 - protein, 300 aa, Caenorhabditis elegans
MNGGLAGIIGVSCVFPIDLVKTRLQNQTVGADGKLQYSGIADCAKQTWRSGGASTLAKFRGMYSGSGVNILLITPEKAIKLVANDFFRHKLAKEGEKQLSVGRGMLAGGLAGMFQISVTTPMELLKIQMQDQGRTLKPGQQKLSATQLTMKLVKENGIAALYKGLSSTLARDVTFSVIYFPLFAYLDSLAPRKPDGSGDAVFYGSFLAGLTSGAASSFCVTPLDVIKTRMQTINKGANEIVYKNIPDAFVTIFKNEGPKALFKGAACRMMVMAPLFGIAQTVYYIGVAEKILGIQKATHV

SEQ ID NO: 7010 - protein, 377 aa, Caenorhabditis elegans
MGVWQDSNYTMCIKVVEEYAQCLQGFCRVCPDVLRDLVISVSLTLSFVSVILLVAAIVLFSIFDSIQCRRLSIHKNLATAFVFRFAVLAIWTIVQTTNVFQDCTRLTPLPLWDYEWICKAILWFVIYFNVASVMWMLIEGAFLYSRFTVFAMRHSDAPWSLYLACGWGVPFVVVTAWALVHQYISSQQTNSFCWLPYAQGLHLWILAGTMGSALIMNLIFLLMIVVILVQKLRTENSAESKKIWRTIKATLLLVPLLGISNIPLFYEPEHPSSVYMLGSAILQHSQGIFIAVLYCFLNSEIQGALKRQLSKVPFEFFKTRNRFETERTYVPEARNATKNGVPMEEMNKTKNIESGENTESQDQVSTGKQIYSVSTKS

SEQ ID NO: 7011 - protein, 453 aa, Caenorhabditis elegans
MLSRNIGAVRGAHKAATTKPVEKVAKLGNGLTVGTIDSHKPIAHLVLAFRAGSRYEKANQAGLSHTIRNFVGRDTQEYFGNTVVWTLSQTGGVLKKCGLINLEQNYQIFMSIPKSLTDIARVMFQKSFTSRDLFGVSLTIPRESTSVGLSVLGQVAGNPGFKPWEVEDVLPTMRADNGYRTAYDLVVDQIHKAAYRNGGLGNSIYAPCSKIGSICTSTLSSFAEQHFVTGNGVLFATNAVHDDLLLYGDNHAPIRSGNAASPSSSAYKGGEVRRDADSKYAHVIVAGEGAAGNNTKALATQAVLLTALGNSSPVKFNTGTTGVIAKAVGQNGSASAFQAVHADSGLAGVYLVVEGSQANQAVSNVVGALKSLKVADIEAVKKQAFNNALRASAHSDNFAIERASQLFQSQDNYIQQIPNVSASDVEVAAKKLTTKLSLASYGNVSEVPYVDTL

SEQ ID NO: 7012 - protein, 578 aa, Caenorhabditis elegans
MSNDAAAAATWHNNTSTPMDTTEPATNSHNPGETAVIGGPEALLLPSGSGPEEMNRHPLLMAQAHGEHHQPRLLHNFPVIPPPIQQHQQPPLLQQAQPSQIPHPTQPQIDPTMFTQQSGFNWPPIDPNTIAALAQAQLASSHAQFVSLALTLDPTLLSHFLATQQIPPVPQPLVHKKAEMELRVGNRFRLGRKIGSGSFGDIYLGQNIQTNEEVAVKLECVKSKHPQLHIESRLYRIMLGGIGIPEIRWCGQEGDYNVMVMELLGPSLEDLFNFCQRKFSLKTVLLLADQMLSRVEFIHCRDYIHRDIKPDNFLMGLGKRGNLVYIIDFGLAKRYRDSKHQHIAYRENKNLTGTARYASINTHRGIEQSRRDDIESLGYVFMYFNRGTLPWQGLKAVTKRQKYELISEKKISTRVDDLCAGYPEAFAQYLNYCRSLGFEEQPDYGYLRNLFRTLFHRQQFCYDYVFDWNTYNKRYQINVDINCIISFSSLCSISSLISHFLPPFCDTIHVSFASSFSPPSCLFFSSVFFCCFLKNNNNNNNLFLVFHLQRFLPFLSVHFPRSVIDLCLSFFGCIFLLF

SEQ ID NO: 7013 - protein, 501 aa, Caenorhabditis elegans
MVLRAIDSIRDSVINASSAVSTTTLPPLDIPMTSMKPPSIIPTVELVLGTITYLVIIAMTVVGNTLVVVAVFSYRPLKKVQNYFLVSLAASDLAVAIFVMPLHVVTFLAGQFSFLLCSALFLFSGKWLLGVTVCQFFTTADILLCTSSILNLCAIALDRYWAIHNPINYAQKRTTKFVCIVIVIVWILSMLISVPPIIGWNNWQENMMEDSCGLSTEKAFVVFSAAGSFFLPLLVMVVVYVKIFISARQRIRTNRGRSALMRIQNAEGDDDYRKMSIKRASVESARTSSRVGEKTPLVIADGQTTVTTLAAHSTDGGSLPKDETTKHMKYHNNGSCKVKVKDVKEDEGNPNPTAVLRKREKISVAKEKRAAKTIAVIIFVFSFCWLPFFVAYVIRPFCETCKLHAKATPPLTIYYRQNKHAIFFIRFIFGLHDRLNLSRKQWMRTLVQQVEQAFTWLGYINSSLNPFLYGILNLEFRRAFKKILCPKAVLEQRRRRMSAQP

SEQ ID NO: 7014 - protein, 830 aa, Caenorhabditis elegans
MSWQNQGMQALIPVINRVQDAFSQLGTSVSFELPQIAVVGGQSAGKSSVLENFVGKDFLPRGSGIVTRRPLILQLIQDRNEYAEFLHKKGHRFVDFDAVRKEIEDETDRVTGQNKGISPHPINLRVFSPNVLNLTLIDLPGLTKVPVGDQPADIEQQIRDMILTFINRETCLILAVTPANSDLATSDALKLAKEVDPQGLRTIGVLTKLDLMDEGTDAREILENKLFTLRRGYVGVVNRGQKDIVGRKDIRAALDAERKFFISHPSYRHMADRLGTSYLQHTLNQQLTNHIRDTLPTLRDSLQKKMFAMEKDVAEYKNYQPNDPGRKTKALLQMVTQFNADIERSIEGSSAKLVSTNELSGGARINRLFHERFPFEIVKMEIDEKEMRKEIQYAIRNIHGIRVGLFTPDMAFEAIAKKQITRLKEPSLKCVDLVVNELANVIRQCADTMARYPRLRDELERIVVSHMREREQIAKQQIGLIVDYELAYMNTNHEDFIGFSNAEAKASQGQSAKKNLGNQVIRKGWLSLSNVSFVRGSKDNWFVLMSDSLSWYKDDEEKEKKYMLPLDGVKLKDIEGGFMSRNHKFALFYPDGKNIYKDYKQLELGCTNLDEIDAWKASFLRAGVYPEKQKAQEDESQQEMEDTSIDPQLERQVETIRNLVDSYMRIITKTIKDLVPKAVMHLIVNQTGEFMKDELLAHLYQCGDTDALMEESQIEAQKREEMLRMYHACKEALRIISEVNMSTLGDQPPPLPMSDYRPHPSGPSPVPRPAPAPPGGRQAPMPPRGGPGAPPPPGMRPPPGAPGGGGGMYPPLIPTRPGPGGPPPNMAPPR

SEQ ID NO: 7015 - protein, 210 aa, Caenorhabditis elegans
MTAAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLADAKSLTNPNTAIFLIGNKADLEDQRDVPYEEAKAFAEENGLTFLECSAKTGSNVEDAFLETAKQIYQNIQDGSLDLNAADTGVQPKQNLPRAAENNGKKDCNC

SEQ ID NO: 7016 - protein, 380 aa, Caenorhabditis elegans
MSLLWSLKHFDAYRKPMDDFRVKTLSGGLVTLIATIAIVLLIVLETKQFLSTEVLEHLFVDSTTSDERVHIEFDITFTKLPCNFITVDVMDVSSEAQENINDDIYRLRLDPEGRNISESAQKIEINQNKTSVETTDVIQEVKCGSCYGAAADGICCNTCDDVKSAYAVKGWQVNIEEVEQCKNDKWVKEFNEHKNEGCRVYGTVKVAKVAGNFHLAPGDPHQAMRSHVHDLHNLDPVKFDASHTVNHVSFGKSFPGKNYPLDGKVNTDNRGGIMYQYYVKVVPTRYDYLDGRVDQSHQFSVTTHKKDLGFRQSGLPGFFLQYEFSPLMVQYEEFRQSFASFLVSLCAIVGGVFAMAQLVDITIYHSSRYMKSRIAGGKLT

SEQ ID NO: 7017 - protein, 163 aa, Caenorhabditis elegans
MARKWLEERITGGGDNFQKETFHLAVSLVDLALPMFNIDKMRFQLVGSTSMMITKIRGNLPTNRVPDILLMERFLIGKFEFVVAKPTPSWLGSCFAKRINLTKKMRNDVKLLELSPIDAHFLRCRPSDAAQSHRINNSTKFIFSFFMFNKQNFWQCFSFCINI

SEQ ID NO: 7018 - protein, 667 aa, Caenorhabditis elegans
MSRWIQPGDNVDITNERKKATFDTERMSAWIHGGTEVMKRRREILDFVKSVDDFKDPVPTEFMSREERILNNARKVVAMTNNTDQIDGSDFFGEGMYYQALTMGRDLHAMSLHYVMFIPTLQGQTDDDQLDEWLTKTISRAVVGTYAQTELGHGTNLSKLETTATYDPATEEFVMNSPTITAAKWWPGGLGKSSNYAVVVAQLYTKGECKGPHPFIVQLRDEDTHYPLKGIRLGDIGPKLGINGNDNGFLLFDKVRIPRKALLMRYAKVNPDGTYIAPAHSKLGYGTMVFVRSIMIKDQSTQLAAAATIATRYAAVRRQGEITPGKGEVQIIDYQTQQFRVFPQLARAFAFMAAATEIRDLYMTVTEQLTHGNTELLAELHVLSSGLKSLVSWDTAQGIEQCRLACGGHGYSQASGFPEIYGYAVGGCTYEGENIVMLLQVARFLMKAAEGVRKGTANLADIGAYIGKPGRKTSRLTTHHHYTDADIVEDLEHVARKQVFRAYDRLKKAQEHLRPEDAWNSVSVELAKASRWHVRLYLVKNLLHKVSIAPQDLKIVLFDVARLYAYDIITSSIGAFLEDGYMSSNQMNEVKEGIYKCLSNMRPNAVGLVDCWDYDDKELKSVLGRRDGNVYPALLQWAQNSQLNRSEVLPAYEKYLGPMMKDARSKL

SEQ ID NO: 7019 - protein, 1785 aa, Caenorhabditis elegans
MSTKPEPENPDSGTPKTLSVDDDDIVVIEDQNTPKYREAALRRSNSSSSDFDEKWEPELDEEDFCENDADVLAEPISSKSRKKSRRSDSSEFVPSEESDDDEEYEVLEKSRKKGRKSGSSSRSSSDDFIESDDNEDYKSAGLLDDNDSKNFKARIDKLKPEATSELVDTRMVTSEEYGKSSKPWKVNAGVWNKLHKFQQEGVEWLQKKTDHRSGGILADEMGLGKTIQSVVFLRSIQETARTHYKTTGLDTALIVCHVSIIAQWIKELNQWFPKARVFLLHSHCSTGRQEDYVGSIFRKLQRRRKEYPDGAIILTTYSLFTKLKKPIVKHLWQVVILDEGHYIRNENTKCSIAMRKLMTTQRFILTGTPFQNRLSEFWKLVDFVHPGRLSDSATFHRNFTHIINAGANLNCSPEAAAKAYECLVALHIAVKPLILRRLQEDHKEVLQLPEKQEIVLSCELSKRQRRLYMEYGNSHQVNEIIERRLKAFVGINHLTNICNHPGIYRSLSPASPKFGSIKDSGKVEMTFKLFDDWFKSPTNRVILFTQRRTVITMMEYFLAEKGIKCVSLTGADSAAARPKIIKKFEDDVSIKVFLMTTRAGGLGLNLTCANKVIIFDPDWNPQADNQAKNRIYRMGQTNDVAIYRLVSNGTIEDLKFFKQVQKENLAARLLHNAEIDQFVPNNTLADLFRLKPKGLEGSEIGVYLDGEIAREGSKKQKRDKVEKKAAKKRMKNKLAGFEDKKLLLSLFDDDKLVAMREHSISLQNSSSMNRIEKMKMRKSIDDAVGSLLHTEGRLAHTWKQVFHKQLRKTLKKSINGDYFVEEEQLDSYWNTVHSGFRANDDQRELDRLVKLATDMLQFFNGVPGAKEDSIHRIFVKDSDRKDPTQMFFIQEIISTLAKYDDASDTWILRDKYRSADVLSPVKKKNKRRSDDNDEVDAKRARKSREWSDSSGPSNMTEKWTVYRDPINSTQNRDNKDTNGIASDDTNGDQEKWDSALKYRQAKAFWMRHTGQLNISARNANKNRANASERNEQRPDKNNDAIVIKPTNTSNDRKSLKRRPDALPDPPIEKRHKQTTVDSDDDVMIIERTPEKTSAGLSSALIVCPEAKLSEWMLAIRHQFDYARIFVLHKASTTGHETDYVEKIFQDLKETKKIPFGAVLLTTFAEFGKHEKAIVDHQWQLVYLDQGLFEMTRQMRNQIEGMKKLKTPNRFIFTDTSVRDRLEELWWNVDFVFPGRLSDYKTFQTNFQNVIEIGCRLDATPEEASTAYECIVALHVALKPLILSRLIKNPNDWFCRREISKKEVEHIKVRIFVKQYFEQTLFFQDIICPLSKRQRRCLKIYKRSDEVQGILRQSSAACVGLKKLTDICDHPGIHKGVTPETKKFGSIEDSGKVRIVFQLLDMWLGTPGAKVVIFTQRRQVAVMLEHFMKQKRIAYCSFLKAKNAYDRENVVNYFENTTDVQILLAPSIMFKLGMQLKKANKVIIFDPEWNPDSDVKHTREMSFLTKKVEDVTVVRLVSEGTVEDSSYFKKLWESGLASRLLSDPKFEPFVPRTTLEEFLTVRPKIKAGKNDMPVVKSHMKNRLLEYEDKQLLSSIIDTTRLDTIRTHFTSFQYHSTTSDRIKSRDVVNRAVRSIIQIDSRLARYWRQMYHQIVDEPTLDPPNPEFYVEPMQIDPYWEAVHPMVPRTSDREELNFLVAMAVDVRSHMLKCYGETEKKLRELFVRNADRSNPIRMFFIYDIFWTFAKFHENWQLWIIRPDLTVNPEEWGPEAMKTRWLRHWIDQYLCC

SEQ ID NO: 7020 - protein, 399 aa, Caenorhabditis elegans
MIDPNNMTTVIEKTTEIVNSVLTSNESDGVLEQTSTLISVLATQSAPLQCFSCHPKLYFIVFGLVFMIIICAGVIGNIFIVFVILMDRKLMSSSVNQFLLNLAIADLGNLIFCSPDAILVLIDRGWLLPNFACHLLRFLQEYFLYASVLLQMAIGVERFLAICSPMRMQRFSTKTTISVLAGVWCVAACFASPYFLYQGIVFHKLYFCFWKGISHKTRTYFKYCELIVLYAIPLVFLTTLYSIMCRVLWGNEDNHNIANHSQQEAILKLRRSVVKMLIISMLLYFLCYTPIQVLFMLEKILDHSVQLPQWLRLLLNVLSVMSSSTNPIVYIICCRHFRLRLRDVAAGISSFCCWLLPSFSKSEYECVDESMTAKLSRSPYVSFRSSRRQNSRANLSTLL

SEQ ID NO: 7021 - protein, 1398 aa, Caenorhabditis elegans
MGTLTRTLQDSDVEFNPYKKCKLFFQLALLIATNEVRRAGIHSSGPLFCIWMLFAVAAVPEFYQWMTTGSQPELVARIDFFRYVAYLTYFPLVVAEFVLHFVSDPFPMPRGYQNLKCPEENANFISRQLLLWFTQIISLGYERTLVADDVFEMDSQMDQEYLKARWKTEWLKQTEKAREKQVKLDDKRERARTGSEKAPLLGTFNNYGAVNLDDKDRVIVQPSVIVTLWQIMKWEILGGSFIKFLSDLLQFANPTFLNYLILFIETPNAPLINGIGLAVGLFLAGQIKSLFMNTYFIAMTRVGAKIQTMLSCAVYEKSLLLSNTARRERTVGEMVNILSIDVDRFRMITPQIQQYWSSPFQIIICMVLLSQTIGVAVWAGIVVMISIVPINICVSMITKRWQLRLMKYKDERIRLINEVLNGIKVVKLSAWETAMEETIERVRDKELKMIKQSALLKTFADCLNVGAPVFVALSSFTVFVLIDPKNVLTPNIAFVSLSLFNLLRGPLMMAAELVAQTVQLVVSNKRVRTFLCEKEVDTAAIDKEIRGELYTNTVEIHSGSFAWDSAEARILSDIEFLAGSKELVTVVGSVGSGKSSLLLAALGEMEKVCGYVGVRGSVAYLSQQPWILNQSLKKNVLMQADLNDVLYKKVIESCALKEDLKQLPDGDDTEIGEKGINLSGGQKARIALARAVYQSKDVYFLDDPLSAVDAHVGKHIFDNVIGPNGMLSHTTRILVTNCTSFLQESGKIIVMKGETRYESSGEESGGEENSDILPGSIASGSRMSRLSRLSKISRKKSKSSIVEKKKPDALITKEEAAIGRVNPGVYLLYFKAMGIVTYVLPYAIAVVLNVSFALGRSLWLTAWSDANIDINHPDTMSVGARLGVYAGFGITEVIFLFFSLVLLLIGGVAASKNLHKPLLHNVLRNPLSYFDITPIGRIINRLAKDMEVVDLRLSSSFRFLVMALINMTVLIVSYTTPLFIAIIIPVFIIYFFVLKYSIKSTRQLQRIASLTRSPIFSNFSETLQGISTVRAFQWSDEFVRRNDEHLNTHVKCSYYSQMANRWLSIRLELLGNIVIFSAAILAIIGKESGITAGMLGLSVSYSLNITFMLNMFVRQINEVETNVVSVERIDEYSKTKSEAEWRLDNNNLPSNWPTGGAVNIEDYSCRYRDELDLVLKQISLNILPGQKVGVCGRTGAGKSSLALALFRIVEAADGNISIDQTITSHIGLHDLREKLTIIPQENVLFANTLRFNIDPKGQFTDQQLWLALENSNLKAHVELLPHKLESPVAEGGENFSVGQRQLLCLTRALLRKSKVLVLDEATAGIDNRTDTMVQATIREKFADSTIITIAHRLHTIIDYDRIIVMDAGRIVEDGIPGELLKNRNSQFYGLAKSAKIVN

SEQ ID NO: 7022 - protein, 467 aa, Caenorhabditis elegans
MGSIDLAAKGEENNNNVILKEHHEQVSVKHKKREFKEKTFVVRESLLTSEFRNGHMKIIYNCFTAAFLLFFLRAMIDDILVHKMPFHHTWLIWWNFQNFIPTMAVWTGMFLSTIGVYYAYEHWSTIPSKNTDLASNLPFVTAYVTYLAAFFYFPLKFLYESDLKCACSFIITCETTRIAMKVHSFIRENWDRAMKRKIGGTIDAWPTMEQFLYYQFCPSFIYRDSYPRTEKRDMKAAGLYFLECLAVIEFVNLTFTQWVFPWLHVQDYTSLSFSTIALSLFTGIIPGIICMTSLFYGLLHCWLNCFSEMMQFADRQFYLNWWHSSNMAEYYRNWNLVVHDWLYAYVFRDLAAYNPGRKGQRAAQMAVFFLSAVFHEYWFGVAFRCFYPVMFVLYFIFGGTFFAVSRLITNRSAWNTALWFNLLIGTGMFIAFYGQEWYARRGHCAPYSNAVVDLLFPRHWNCHPPTS

SEQ ID NO: 7023 - protein, 614 aa, Caenorhabditis elegans
MKHSVNAMAGGHGAARYNSTDLPKLPAPQPIKTLKHFLDFAQALQSKKEFQETKQIVNDFVVKDLPKLQELLQKRADALPNWLTPWWLNIAYLAARTPLPVVTSPGVMFPKFDYNTEEGQLEYAAKISQAAVHFYLRAKNNQLKPDMAGKSPLDMSQYQFLFGTTRVPKVGVDEIRYGCDYKEKLQHILVIRNGHLFRVQVLDSNEQPLSIFAITQQLAKVVSESQTPNPHPVGIVSSDSRDKWANVYSSLKKDNNNAKSLEAVEKSLFVVCLDKASEPPVGYTEKDEQSRQALHGGGSKVNSSNRWFDKTIQFVIGTNGYTGMTYEHTPAEGPPVGALMDFICDQFDANTFITEGTPSNSPVQRLDISTDEEINKRIAKSSKNMDSIAEDLDIVAFTFKPYGKNFPKSSKISPDSFIQMAYQLAFYRIHSSLPPTYETATLRKFTEGRTENIRSPNTAAASFVKKMVSKPPTPVSEIYDALVHATNSHKKYTMDCMDAAGMDRHLLAWKLIATENNLPTPEIFGSNIYQQLNHFQVSTSQVPTRHFIQMCFGPSALDCYGICYNPQETELHFMISTFKSYGSTSSKKFAKELQKALIDMKSVINKATKEMSKL

SEQ ID NO: 7024 - protein, 501 aa, Caenorhabditis elegans
MLPILLVFLFSALSQCSRLAEEEEQMLIRHFTKEGEVSTMDQLRDTIGPFRDPLNFSHMNYSTLTDHIHNLHRKFPNLTHIYSAGQSVQGRELWVLVVSRYPIEHRKLIPEFKYVANMHGNEVTGRVFLVSLAHTLLENYNSNLWIRQLVDSTRIHLMPSMNPDGYEHASEGDQAGVTGRQNANGKDLNRNFPSRFPNYFPTSEIQPETIAIMNWTRQIPFALSANLHGGTTLVNYPFDDFPTRTRQSHYAPSPDNALFVRLAYTYARGHERMWKKGPRCLDDDLNISVDPQNGIINGADWYIVSGGMQDWNYLNTNCFEVTVEMNCEKFPQTKKLRYLWEENKYALLKFIDLIHGFANFTRFSRAIHGLVIDADTGEGIVNATVSIDERAKIVVSYGEGEFWRLANMGKYDLTFDHSDYYPVTQTVHVTPQDRSPYIEVRLQRIIPRSRPVLIPTKSVPNKDEYNVDNSNNKDLRIVTMSSSVCHFSVFMIILSLASLFL

SEQ ID NO: 7025 - protein, 382 aa, Caenorhabditis elegans
MWRRVFVFSCIFLYVLATLPDFGIPGYSCDANVMKKSKKVPTNVNSVRPADIKLIMALGDSLTVGGLFSSQAANGAGAEDPVAVVLQYRGLAFQAGGDKTLEEHVTIPNILKKYNPDVFGYSNGIGSPNVWEIARLNVAMPGANAKDLPGQARQLVQLLQQHTEVVNMKEDWKLLNIFIGGNDICGYCRKPVEDSPYNCAQDIKQAVQIIYDNVPRVIVSLTGMLHLEMLRQTDTGHWFCQRLHHDECGCESNKNFTDADIRQACYDYNKYEKQIETDGTFEKNDFTYVVQPMFQDTLIPPMENGKPTQKFFAPDCFHFSQWGHALVSTYLWNNILQPVGSKSTVSNMSVPLQTLACPDAACPFIRTPKNSQDCSQYMTPHA

SEQ ID NO: 7026 - protein, 374 aa, Caenorhabditis elegans
MEKLKEGGRQITAGGSAGLVEVCLMYPLDVVKTRLQLGQQDKGMMDCVVKTLKNEGIGGFYKGILPPILAETPKRATKFFTFEQYKIAFTHSEIPLPVTMSFAGLFSGLTEAIVICPFEVVKVRLQADRNSSVKEQRSTASMAREIYRNEGFGTSGLYRGLGATLGRHGAWNMVYFGLYHSCREVIPDAKVGYESRVGGKTAIAVRQIEFDFRQFAGLPICRKFLFSANCQFAICRKCSEGFFIRRKLKPKKTQEISFKLLIASGYFPPKGFFLQQNPTSNLIGRIALGFTAGSLASIFNIPFDVAKSRIQGPQPDPFTRKYSGTMQTISLVYKEEGFGALYKGLLPKVMRLGPGGAVMLIVYDEVYSWLQKNT

SEQ ID NO: 7027 - protein, 422 aa, Caenorhabditis elegans
MQKTFEEYERFFTTEKDMIPATIFTAPKKKFLQADSKFYEKRRVWILVISQHLVDNNLRSEDVRRFFHLESPDDDENNVDLGPSERKTATANDFDYLTTIGKGSFGRVYQVRHKETKKIYAMKILSKEHIRKKNEVKHVMAERNVLINNFKHPFLVSLHFSFQNKEKLYFVLDHLNGGELFSHLQREKHFSESRSRFYAAEIACALGYLHEKNIIYRDLKPENLLLDDKGYLVLTDFGLCKEDMQGSKTTSTFCGTPEYLAPEIILKKPYDKTVDWWCLGSVLYEMIFGLPPFYSKDHNEMYDKIINQPLRLKHNISVPCSELITGLLQKDRSKRLGHRNDFRDIRDHPFFLPVDWDKLLNRELKAPFIPKVKNAMDTSNISKEFVEIQIDPSSLAPQQLAVTHRDHDFENFTFVDTNRVLV

SEQ ID NO: 7028 - protein, 581 aa, Caenorhabditis elegans
MTDPDSYRSSITSRPSFNRTVTSSSQNYGAPGSGNRVLKIVTETHSSSVSSGLSPYGQNAASTIRDNREREKKEIMELNDRLASYIEKVRFLDAQNRKLDADLKMLQGRFGKSTGSVKVMYEMEITTATNVVKQTGKDHGETEKEIRKLQDQLDELRKKFEEAQRGRAEDRLKIDDLLVTLSNLEAEINLLKRRIALLEEEVARLKKENFRLTSELQRVRIELDQETLLRIDNQNKVKTILEEIDFMKRGFETELKELQAQAARDTTSENREYFKNELANAMRDIRAEYDQIMNGNRNDMESWYQLRVQEINTQSNRQNAENNYQKEEVKRLRNQTSELRQKLSDLESRNLLLEKQIEDLNYQLEDDQRSYEAALNDKDAQIRKLREECQALMVELQMLLDTKQTLDGELKVYRQMLEGNSEGNGLRQLVEKVVRTSAINEEADTETMRVVKGEHSSRTSYQRSAKGNVAIKETSPEGKFVILENTHRAKEEPLGDWKLKRKIDGKREIVFTFPSDYILHPFQSVKIFARGQGIANPPEVLIFEGDETFGVGANVQTILYNNKGEERATHIQRQSQQTTSS

SEQ ID NO: 7029 - protein, 672 aa, Caenorhabditis elegans
MADPDSYRSSITSRPAFNRTVTSSTQNYGTPASGNRVLKIVTETHTSSVASGLSPYGQGAASTIRDDREREKKEITELNDRLASYIGKVRFLAAQNRKLEADLNVLQSRFGKSTGSVKIMYEMEITTATNVVKETGKDHEEAEKEIGKIKDQLDELRKKFEEAQKGRAEDRLKIDELLVTLSNLEAEINLLKRRIALLEEEVARLKKENFRLTSELQRVRSELDQETLLRIDNQNKVTTILEEIDFMKRGFETELKDLQAQAARDTTSENREYFKNELMNSIRDIRAEYDRFMAGNRNDLESWSQIRVQEINTQTNRQNAEINHKRDEVKRLHSQVSELKSKHAELAARNGLLEKQLEDLNYQLEDDQRSYEAALNDKDAQVRKLREECQALLVELQMLLDTKQTLDGELKVYRRMLEGNSEENGLRQLVEKVVRTSAINEEVDTETMRVVKGEHSSRTSYQRSAKGNVSIKVRKIFIIVNTISKTEKVLIGWKIIHYLQNSFCLNRKLQDVSDFEVEIEVSPEGKFVILENTHRDKEEPLGDWKLKRKIDGKREIVFTFPSDYILHPVQTVKAACQTVKKTVYFQIFARGNGVANPPEVLVFEGDDTFGAGANVQTILYNNSGEVTQAKISKVFRIFFCRNAQHTCNAKANRLQLHKSNLARITIREISPS

SEQ ID NO: 7030 - protein, 672 aa, Caenorhabditis elegans; identical to SEQ ID NO: 7029

SEQ ID NO: 7031 - protein, 620 aa, Caenorhabditis elegans
MRNSLLFFIFLPSTILAVDLIHLHDGSPLFGEEVLSQTGKPLTRFQGIPFAEPPVGNLRFKKPKPKQPWRIPLNATTPPNSCIQSEDTYFGDFYGSTMWNANTKLSEDCLYLNVYVPGKVDPNKKLAVMVWVYGGGFWSGTATLDVYDGRILTVEENVILVAMNYRVSIFGFLYMNRPEAPGNMGMWDQLLAMKWVHKNIDLFGGDLSRITLFGESAGAASVSIHMLSPKSAPYFHRAIIQSGSATSPWAIEPRDVALARAVILYNAMKCGNMSLINPDYDRILDCFQRADADALRENEWAPVREFGDFPWVPVVDGDFLLENAQTSLKQGNFKKTQLLAGSNRDESIYFLTYQLPDIFPVADFFTKTDFIKDRQLWIKGVKDLLPRQILKCQLTLAAVLHEYEPQDLPVTPRDWINAMDKMLGDYHFTCSVNEMALAHTKHGGDTYYYYFTHRASQQTWPEWMGVLHGYEINFIFGEPLNQKRFNYTDEERELSNRFMRYWANFAKTGDPNKNEDGSFTQDVWPKYNSVSMEYMNMTVESSYPSMKRIGHGPRRKECAFWKAYLPNLMAAVADVGDPYLVWKQQMDKWQNEYITDWQYHFEQYKRYQTYRQSDSETCGG

SEQ ID NO: 7032 - protein, 1759 aa, Caenorhabditis elegans
MKQRAALGPVLRLAILALLAVSYVQSQATCRDCSNRGCFCVGEKGSMGAPGPQGPPGTQGIRGFPGPEGLAGPKGLKGAQGPPGPVGIKGDRGAVGVPGFPGNDGGNGRPGEPGPPGAPGWDGCNGTDGAPGIPGRPGPPGMPGFPGPPGMDGLKGEPAIGYAGAPGEKGDGGMPGMPGLPGPSGRDGYPGEKGDRGDTGNAGPRGPPGEAGSPGNPGIGSIGPKGDPGDIGAMGPAGPPGPIASTMSKGTIIGPKGDLGEKGEKGEPGEGGQRGYPGNGGLSGQPGLPGMKGEKGLSGPAGPRGKEGRPGNAGPPGFKGDRGLDGLGGIPGLPGQKGEAGYPGRDGPKGNSGPPGPPGGGTFNDGAPGPPGLPGRPGNPGPPGTDGYPGAPGPAGPIGNTGGPGLPGYPGNEGLPGPKGDKGDGGIPGAPGVSGPSGIPGLPGPKGEPGYRGTPGQSIPGLPGKDGKPGLDGAPGRKGENGLPGVRGPPGDSLNGLPGAPGQRGAPGPNGYDGRDGVNGLPGAPGTKGDRGGTCSACAPGTKGEKGLPGYSGQPGPQGDRGLPGMPGPVGDAGDDGLPGPAGRPGSPGPPGQDGFPGLPGQKGEPTQLTLRPGPPGYPGLKGENGFPGQPGVDGLPGPSGPVGPPGAPGYPGEKGDAGLPGLSGKPGQDGLPGLPGNKGEAGYGQPGQPGFPGAKGDGGLPGLPGTPGLQGMPGEPAPENQVNPAPPGQPGLPGLPGTKGEGGYPGRPGEVGQPGFPGLPGMKGDSGLPGPPGLPGHPGVPGDKGFGGVPGLPGIPGPKGDVGNPGLPGLNGQKGEPGVGVPGQPGSPGFPGLKGDAGLPGLPGTPGLEGQRGFPGAPGLKGGDGLPGLSGQPGYPGEKGDAGLPGVPGREGSPGFPGQDGLPGVPGMKGEDGLPGLPGVTGLKGDLGAPGQSGAPGLPGAPGYPGMKGNAGIPGVPGFKGDGGLPGLPGLNGPKGEPGVPGMPGTPGMKGNGGLPGLPGRDGLSGVPGMKGDRGFNGLPGEKGEAGPAARDGQKGDAGLPGQPGLRGPQGPSGLPGVPGFKGETGLPGYGQPGQPGEKGLPGIPGKAGRQGAPGSPGQDGLPGFPGMKGESGYPGQDGLPGRDGLPGVPGQKGDLGQSGQPGLSGAPGLDGQPGVPGIRGDKGQGGLPGIPGDRGMDGYPGQKGENGYPGQPGLPGLGGEKGFAGTPGFPGLKGSPGYPGQDGLPGIPGLKGDSGFPGQPGQEGLPGLSGEKGMGGLPGMPGQPGQSIAGPVGPPGAPGLQGKDGFPGLPGQKGESGLSGLPGAPGLKGESGMPGFPGAKGDLGANGIPGKRGEDGLPGVPGRDGQPGIPGLKGEVGGAGLPGQPGFPGIPGLKGEGGLPGFPGAKGEAGFPGTPGVPGYAGEKGDGGLPGLPGRDGLPGADGPVGPPGPSGPQNLVEPGEKGLPGLPGAPGLRGEKGMPGLDGPPGNDGPPGLPGQRGNDGYPGAPGLSGEKGMGGLPGFPGLDGQPGGPGAPGLPGAPGAAGPAYRDGFVLVKHSQTTEVPRCPEGQTKLWDGYSLLYIEGNEKSHNQDLGHAGSCLQRFSTMPFLFCDFNNVCNYASRNDKSYWLSTSEAIPMMPVNEREIEPYISRCAVCEAPANTIAVHSQTIQIPNCPAGWSSLWIGYSFAMHTGAGAEGGGQSLSSPGSCLEDFRATPFIECNGARGSCHYFANKFSFWLTTIDNDSEFKVPESQTLKSGNLRTRVSRCQVCVKSTDGRH

SEQ ID NO: 7033 - protein, 245 aa, Burkholderia cepacia
LQSKVAAITGAAGGLGTGIAKRLAGLGASVALLEPGIERLVSLASELTDSGATVLNVACNVTDAASTRYAAAQVLSSFGRIDVLVNNAGVLARPSALESISLEDWDRSLAVNLTGALLCTASFGAAMLEAGAGSIVNIASIAAYSPNTSVAYSVSKAGLLALTRHTAVEWAPRGIRANSVSPGFIRTPLSEVHYANPDLLQLRTQATPVRRLGTVDDVAAIVGFLASPASAFINGEDIVADGGFL

SEQ ID NO: 7034 - protein, 265 aa, Burkholderia cepacia
MKFQDRICVVTGGASGIGAAICRAFDAQGAKLAVLDVDRDSGETFARSLRGAVFIECDVADAASVKRAFERIAQRWDRTDVLVNNAGIVGREEYGRVQTRRVQQIEDVRSGRKPGPLRATVSLTDEQWRRMIDIHLNGTFYCTREALLQMERLGQGAIVNMSSIAGLDGGFGNPHYAAAKAGILGFTRAVAKEAIQQGIRVNAVAPGFVDSPLRRSLSEALQQLQIAATPMGRAATGDEIASLVLFLASDDASYLVGETISPNGG

SEQ ID NO: 7035 - protein, 605 aa, Burkholderia cepacia
IEAPAWVKNRKLVDWVQRVAAMTKPDRIVWCDGSQEEYDRLCAQMVEAGTLKKLNPAKRPNSYLAWSDPSDVARVEDRTFICSQQREDAGPTNNWVAPAEMRSTLGGLFEGAMRGRTMYVVPFSMGPLGSPIAHIGVELSDSPYVVTNMRIMTRMGRKVYDVLGEDGEFVPCVHSVGAPLAAGEKDVPWPCNATKYIVHFPESREIWSYGSGYGGNALLGKKCFALRIASTMGRDEGWLAEHMLILGVTSPEGRKHHVAAAFPSACGKTNFAMLIPPEGLNGWKISTIGDDIAWIKPGKDGRLYAINPEAGYFGVAPGTSEKTNFNAMATLKENVIFTNVALTDDGDVWWEGMTDEPPAHLIDWQGKDWTPAGAKQSGRKAAHPNARFTAPASQCPSIDADWENPAGVAIDAFIFGGRRSTTVPLVTEARNWVEGVYMAATMGSETTAAAAGQQGVVRRDPFAMLPFCGYNMSDYFGHWLKTGERLEQLGAKLPKIFCVNWFRKGADGKFVWPGFGENMRVLSWMVGRVEGSAQGAEHAFGVSPHYEDIDWSGLNFSREQFEQVISVDDAAWRDELALHAELFDTLQHGLPPALTQAKRTLEGKL

SEQ ID NO: 7036 - protein, 647 aa, Burkholderia cepacia; identical to SEQ ID NO: 4281

SEQ ID NO: 7037 - protein, 458 aa, Burkholderia cepacia; identical to SEQ ID NO: 4282

SEQ ID NO: 7038 - protein, 451 aa, Burkholderia cepacia
DEARALSYTDLETRTRTLAGRLLTHGAKPGEALAISMNRSLDAVLLLLAAIRAGLSPCVLEPRLADGEARARVAATAAAWLVYDDDNAALAGSFDLPGCTPLAFDALCMATPADALTLPEIAPDTPALLLFTSGSTGRPKVVQLTQAALLNNALGVIDMSALNSEDRLLHVMPIYHTNGVNNQLFAPLLAGSTVLFCSRFRAADMPALLNSYRPTIITGVPTMYSRMLSQSFDTEALAGLRMARCGSAPITETLHREVEAKLGCPLVVSYGLSEATCTSTLNPPQARRIGSVGKVLAGQTVELRAPDGSMSATPGVEGEICIGGANLMSGYLGAPDATARAVTDNWLRTGDLGRFDDDGYLNITGRIKDVIIRGGENLSPLLIESAIVGVTAVSACCVVGMAERDLGEVPVAFVVADEAASGLSVELIQNAVRERISRIFVPHEVFFANTL

SEQ ID NO: 7039 - protein, 254 aa, Burkholderia cepacia; identical to SEQ ID NO: 4284
  unsure (1)..(254): unsure at all Xaa locations

SEQ ID NO: 7040 - protein, 468 aa, Burkholderia cepacia
NANPKHVADPTRLRNQNLIGGQWKAALSGQSIAVENPANEEIIAQVPRGQQEDIDEAVKVARATFESAAWRKIRPIDRGRILENIARKVEEHAEELSWLESLDTGKAISFARVIDLPSTVDVFRYMGGWCSKLGGTTPPISFDGKEYHAYTRREPVGVVGAITPWNYPLALGSWKIASALAAGCTMVLKPTELTPLSTLRLAELCLEAGLPEGALNVVNGYGHEAGEALARHPDIDKITFTGSTVVGKKIVEYALGNMKRVTLELGGKSPSIVFDDADLDQVGLGAALAVFFNSGQICFAASRLFVQASVYDRVVEAVAAVASQFKVGNGQDTDTMLGPLVSRKQQERVLGYVQSGIEQGASLIYGGQKIGDKGYFLQPTVFADADQSMKIAQEEIFGPVVSIIRFKDEVEAIRLANDTTYGLAANIWTRDIKKAHRVAHRLQAGSVWINCHGVIDPAAPFGGFKQSG

SEQ ID NO: 7041 - protein, 250 aa, Burkholderia cepacia
MRLEGKVAIITGAATGIGNAIARAYVAEGAKVVIADLKGAEAAASELGAGIALGIYANVADPDSTRQMAAAAVERFGKIDVLVNNAGIFTGLSGVPMEGITVEDWDKLYAVNVKGPWLCTSAVSAAMREGGGGKIINIASVIAHVGVPFMLHYVSSKGAVAAMTRAMAREFAATKAGITVNAISPGYTHSANAVANTQQHEQFEGVAAQMRTIGRPQVPEDIAGAALWLASDEASYVNGQNIIVDGGIFM

SEQ ID NO: 7042 - protein, 646 aa, Burkholderia cepacia
MRLFLCEKPSQGKDIGRILGATQRGEGCLNGSGVTVTWCIGHLVEAAAPEAYDEQLKRWSIEQLPIIPQNWRVEVKPKTATQFKVVKALLAKATQLVIATDADREGELIAREIIELCGYRGPIERLWLSALNDASIRAALGKLRPSAETLPMYYSALARSRADWLVGMNLSRLFTVLGRQAGYDGVLSVGRVQTPTLKLVVDRDREIAAFVSVPYWAIDVSLSASGQSFTAQWVPPDAYTDDTGRCLQQPVAQRAAQQIRGAGSAQVVSVETERVREGPPLLFDLGTLQEVCSKQLGLDVQETLEIAQALYETHKATTYPRSDSGYLPESMFAEVSTVLDSLLRTDPSLRPIMDQLDRSQRSRAWNDGKVTAHHGIIPTLEPANLSAMSEKELAVYRLIRAHYLAQFLPHHEFDRTVANLACGQQKLAATGKQVVVKGWPLVLTEPQPDEDGDAAARSQVLPALREGLACLVADVDLKALKTLPPRPYTQGELVKSMKGVAKLVTDPRLKQKFRDTVGIGTEATRANIISGLIARGYIVKKGRAIRASDAAFTLIDAVPAAIADPGTTAVWEQALDMIEAGQLTLDVFIGKQAAWISQLIAQYSIASLSIKVPQGPACPQCGAPTRQRSGKSGPFWSCSRYPDCKG

SEQ ID NO: 7043 - protein, 525 aa, Burkholderia cepacia
MKTVQHAAYEILRRHGLTTIFGNPGSNELPFLKHFPSDFRYILGLHEGVVTGMADGYAQATGNPAFVNLHSAAGTGNAMGALANAWNSHTPLVVTSGQQVRSTIGMEPLLANVDAVNLPRPLVKWSTEPASAEDVPRSFAQAIHIARTPATGPVYLSIPYDDWDQPAPEYAHYLAAREVQHAGLPSEAILQALADRLQRATNPVLVLGPDVDAQHANESAVALAERLKMPAWMAPSAPRCSFPTTHACFRGVLPAGIASISRLLDGHDLILVVGAPVFRYHQYEPGALLPAGAELVSITCDVLEAARAPMGDAIVADIALTLEALAARAEPAARPMPVAVARPAAAAETPGPLAPERVFDIVDAIAPRDAIYVNESTSTTNLMWQRLRMTSQGSYYFAAAGGLGFAMPAAAGIQLAQPGRRVIGIIGDGSANYGITALWTAAQYSIPTIFIIMKNGTYGALRWFAGVLGVEDVPGLYVPGIDFCALARGYGVEALHADSGASLTVALERALSSSRPTLIEVETLA

SEQ ID NO: 7044 - protein, 502 aa, Burkholderia cepacia
LTTMIIESGHLTLAQLRRIAHFSETVQLCPSTFAAIDASAQAVENIVRKGKPVYGVNTGFGRLASTHIPLEQLDLLQRNLVLSHAVGVGEPMSRSVVRLMIVLKVSSLARGHSGIRREVIAALVTLLNADVLPVIPVKGSVGASGDLAPLAHMSAVLLGVGEVTIGERRASANEGLHAAGLEPFTLRAKEGLALLNGTQASTALALFNMFAIEDLFCTALVAGALSVDAAAASVVPFDARIHALRGHQGQIDSAAAYRALLEGSEINLSHSDCDKVQDPYSLRCQPQVMGACLHQMRHSAEVLLCEANSVSDNPLIFPDTCDVLSGGNFHAEPVAFAADNLALAVAEIGALAERRIALLIDTTLSGLPPFLVRDSGLNSGFMIAHVTAAALASENKTLAHPASVDSLPTSANQEDHVSMATFAARKLGDMASNTAHILAIELLAATQGIDLREPHRTSMRLQSVTEAVRRDVGHYHSDRHFSPDIAAIAAQVLNGEIARHSP

SEQ ID NO: 7045 - protein, 249 aa, Burkholderia cepacia; identical to SEQ ID NO: 4289

SEQ ID NO: 7046 - protein, 366 aa, Burkholderia cepacia; identical to SEQ ID NO: 4290

SEQ ID NO: 7047 - protein, 423 aa, Burkholderia cepacia; identical to SEQ ID NO: 4291

SEQ ID NO: 7048 - protein, 375 aa, Burkholderia cepacia; identical to SEQ ID NO: 4292

SEQ ID NO: 7049 - protein, 327 aa, Burkholderia cepacia; identical to SEQ ID NO: 4293

SEQ ID NO: 7050 - protein, 584 aa, Burkholderia cepacia; identical to SEQ ID NO: 4294

SEQ ID NO: 7051 - protein, 234 aa, Burkholderia cepacia; identical to SEQ ID NO: 4295

SEQ ID NO: 7052 - protein, 425 aa, Burkholderia cepacia; identical to SEQ ID NO: 4296

SEQ ID NO: 7053 - protein, 416 aa, Burkholderia cepacia
RFHYGWLTVAVVFLVLLAAAGTRATPSVMMVPLEHQFGWSRATISLAISVNIALYGLMGPFAAAAMQRFGVRPTLLAALGTMAAGVALSSLMTHPWQMVLIWGVMVGGSTGVAALSLSATVVTRWFTTRRGLVMGILTASSATGQLVFLPMLAAIAEHDGWRQVVWTVAIAAAIVIPLVAFLLPERPSDMKLRPYGEPHDTPINGTVTRQNPLAIAFGTLAMASKTRDFWLLFFSFFICGASTNGYVGTHLIAMCGDYGMTEVQGASLLAAMGIFDLFGTTLSGWLSDRFNSRVLLFWYYGLRGLSLMYLPHAFGIDFFGLPLFAVFYGLDWIATVPPTVRLATDVYGKEAAPVVFGWVVAGHQLGAAFAALGAGMLRASLGTYTVASMISGGLCLVAAVIVLRINRPAKVPEPQA

SEQ ID NO: 7054 - protein, 288 aa, Burkholderia cepacia; identical to SEQ ID NO: 4298

SEQ ID NO: 7055 - protein, 686 aa, Burkholderia cepacia
PATSPRTLLDKLWQSHVVAETPNGPTLLYVDRHLVYEVTSPQAFEAIRLSGRKPWRPETVLAVADHNVPTIAAERTSMDAIADPLSRIQVAQLDKNCKEFGIKSYGIRNPQQGIIHVVGPELGATLPGMTVVAGDSHTSTHGAFAALAFGVGTSEVEHVLATQCLSVGKMKSMLVNVEGVLPVGVTAKDVILAIIRRTGTAGGTGYAMEFAGSTIRTLSMEGRMTLCNMAIEAGARVGLIGVDDVTIDYVKGRPFAPAEAHWDAAVAYWRTLVSDADARFDKIVNIDATQLRPMVTWGTSPEMVVTVDDAVPNPLDDPDPVRRATMAGALTYMGLEPGTSLKSISLDKIFIGSCTNARIEDLRAAAAIVKGRHVAPTVQLALVVPGSGLVKAQAEAEGLDAIFKEAGFEWREPGCSMCLGMNDDRLRPGERCASTSNRNFEGRQGPGGRSHLVSPAMAAAAAIAGHFVDVSPRRLLVQPFTKLEALVVPLDRVNVDTDAIIPKQFMKSVQRNGFGINLFDEWRYFDHGEPGQDPSTRRLNPDFVLNQPRFAGAEILLTRDNFGCGSSREHAAWALWDFGIRALIAPGFADIFYGNCFKNGMLPIKLDERIVQQLFDLVGRTPGLRLAIDLEAQRIQPPAGDAIPFDVEPERKRRLLNGLDDVALTLQQTDQIRAYERNRRAHEPWL

SEQ ID NO: 7056 - protein, 354 aa, Burkholderia cepacia
LSRYWSDIVHRLTPYVPGEQPVVTHPVKLNTNENPYPPSPRVLEAIRQELGDAAESLRRYPDPTAQKLRETVAAYHGIRAEQVFAGNGSDEVLALTFQALLKHDKPLLFPDVTYSFYPTYARLFEVDYRTIPLDDSFTIHVDDYMSPNGGILFPNPNAPTGRPLPLADIERLVASSPDSVVVIDEAYVDFGAQSAIGLIDRYPNLLVVQTVSKSRSLAGMRVGFAFGNPDLIGALNRVKDSFNSYPLDRLAQAAAAAAYEDDAWFRDTCAKVVASRERLAAGLTALGFEVLPSAANLLFARHEGYDAATLALRLRDKEIFVRHFKAPRIDQHLRISVGTDAECDILLDALRDIF

SEQ ID NO: 7057 - protein, 213 aa, Burkholderia cepacia
MKLYSYFRSSASYRVRIALNVKNLPYEYVPVHLVREGGEQLKPEYRKVNVDCVVPTLVEGNDVMPQSLAIIEYLEETHPEPPLLPKAPVDRAYVRALALQVACEIHPLNNLRVLKYLKHTLGVDDYAKDAWYRHWVEAGFATFEAHLAGDSRTGKLCFGDTPTIADTCLIPQVFNAQRFKVDTAKFPTIQRIYDHAMQLDAFARAAPDVQPDA

SEQ ID NO: 7058 - protein, 630 aa, Burkholderia cepacia
MVELEIDGKKVEVPEGSMVIQAAHKVDTYIPHFCYHKKLSIAANCRMCLVDVEKMPKAVPACATPVSAGMIVRTKSDKAVKGQQAVMEFLLINHPLDCPICDQGGECQLQDLAVGYGKSASRYSEEKRVVFHKNVGPLISMEEMSRCIHCTRCVRFGQEVAGVMELGMLGRGEHSEITSFVGKTVDSELSGNMIDLCPVGALTSKPFRYSARTWELSRRKSVSPHDSVGANLVVQVKNNRVMRVLPFENESINECWISDKDRFSYEGLNSPERLTQPMLKQGGKWVETDWQTALEYVVKGLKGIKGDHGANALAALGSAHSSVEELFLLKQLAQAVGTPNVDFRLRQSDFSAPVNGAPWLGTAIADLSNVDAALVIGSDLRRDHPLFAARLRQAAKGGAKLTLVQATNDDALIPQAQRVVAAPSAWLDALAGIAGAVSEAGGVALPEAFAGTQPSDADKQVAKSLATGERRLVLLGNGAVRHPDFAVIQAAAQWIADATGATQGFLTEAANTVGAHLVNALPGEGGLNAREVFEQPRKGYVLLNVEPEFDTANPAQALAALKQAEMVVVLSPFQTGADYADVLLPIAPFTETAGTFVNAEGTVQTFNGVVRPLGDTRPAWKVLRVLGSLL

SEQ ID NO: 7059 - protein, 154 aa, Burkholderia cepacia
MPATIRAATPADTGAIFALTYELAEFESLTHVFVATEEGLHDALFGARPSIEALVAENESRIVGYALFFHNYSSFVGKRGLYLEDVYVQPSQRGSGLGTALLRRLAALAVERQCGRFEWTVLDWNRQAISFYEKMGATVMPDWRVVRLTGNALE

SEQ ID NO: 7060 - protein, 259 aa, Burkholderia cepacia
LKDKVVLITGGSKGIGLACARAFALEGAKVAIVSRDPANLARAYEQLKHEGLHVHRTRADLHEPHSAADIVEEVSTAVGPIDVLINSAGAARRYDPETLDAEAFRATMEAKYFPYIYPQQEVLRRMAERAKSGSGGEPGTIVNIIGMGGKIASDIHIAGGAANAALMLATVGLAHYYARYGIRINAINPGATLTERVEEAVKLEATQQGIGSAEALARGQARVPLGRFAKPEEIADVALFLASRRASYVTGAIVPMDGG

SEQ ID NO: 7061 - protein, 322 aa, Burkholderia cepacia
SRVLGTGSYLPPNRVTNQDLAKRLAEQGIETSDEWIVARTGIHARYFAEPDVTTSDLAFIASQRAIEAADIDPQSIDLIIVATSTPDFVFPSTACLLQNKLGIRNHGAAFDVQAVCSGFAYAVATADSFIRSGQHRTALVIGAETFSRILDFKDRTTCVLFGDGAGAVILQASDEPGVLASALHADGSHSNILCTPGNVNGGVVSGSAFLHMDGQAVFKLAVNVLEKVAVEALEKANLSAEQIDWLIPHQANIRIMQSTCRKLGLPQERMIVTVGEHGNTSAASIPLALDVAVRDGRIKRGQNVLIEGVGGGFTWGASVIRY

SEQ ID NO: 7062 - protein, 306 aa, Burkholderia cepacia
KFAFVFPGQGSQSVGMLNAFADQAVVRETVQEASDALNQDLGKLIAEGPAEDLNLTTNTQPVMLTASYAMYRAWLQAGGPKPAIVAGHSLGEYTALVAAGAIAFRDAVPLVRFRAQAMQTAVPVGEGAMAAILGLDDDTVRAVCAEASVAGVVEAVNFNAPAQVVIAGNKAAVEKACEVAKAKGAKRALPLPVSAPFHSSLLKPASDQLREYLASVDVQVPAIPVINNVDVAVVNEPAAIKDALVRQAAGAVRWVESVQAMSAQGVTHVIECGPGKVLAGLTKRIDGNLVGASIFDPASLEETLKL

SEQ ID NO: 7063 - protein, 244 aa, Burkholderia cepacia
LDKQIAIVTGASRGIGRAIALELARQGATVIGTATSESGAAAISEAFNAAGASGRGAVLNVNDAAAAEALIDGTVKEFGALHVLVNNAGITQDQLAMRMKDDDWDAVIDTNLKSVFRLSRAVLRPMMKAKGGRIINITSVVGSAGNPGQVNYAAAKAGVAGMTRALAREIGSRGITVNCVAPGFIDTDMTRTLPEEQQTALKTQIPLGRLGSPEDIAHAVAFLASPQAGYITGTTLHVNGGMYM

SEQ ID NO: 7064 - protein, 72 aa, Burkholderia cepacia
MDNIEQRVKKIVAEQLGVAEAEIKNEASFVNDLGADSLDTVELVMALEDEFGMEIPDEEAEKITTVQQAIDY

SEQ ID NO: 7065 - protein, 411 aa, Burkholderia cepacia; identical to SEQ ID NO: 4309

SEQ ID NO: 7066 - protein, 353 aa, Burkholderia cepacia; identical to SEQ ID NO: 4310

SEQ ID NO: 7067 - protein, 421 aa, Burkholderia cepacia; identical to SEQ ID NO: 4311
  unsure (1)..(421): unsure at all Xaa locations

SEQ ID NO: 7068 - protein, 341 aa, Burkholderia cepacia
RKAIITGVSGQDGAYLTKLLLDKGYHVTGTYRRTSSVNFWRMRELGVLDHPNLRLVEHDLTDLGSTLRLLEGAQADELYNLAAQSFVGVSFDQPVTTAEVTGIGALNLLEGIRILNPKTRYYQASTSEMFGLVQAVPQREDTPFYPRSPYGVAKLFAHWSTINYRESYGLFASSGILFNHESPLRGREFVTRKITDTVAKIKLGKQDVLELGNMSARRDWGFALEYVEGMWRMLQADEPDTFVLATGRTETVRDFVRMAFAAAGYQLEWSGKEERETGIDVATGKTLVRVNPKFYRPAEVDLLIGCADKAHEKLGWKPATTLEQLCHMMVHADLGRNEHHE

SEQ ID NO: 7069 - protein, 1394 aa, Burkholderia cepacia
MKALLDLFKQVQQPEVFDAIKIGLASPDKIRSWSFGEVKKPETINYRTFKPERDGLFCAKIFGPIKDYECLCGKYKRLKHRGVICEKCGVEVTLAKVRRERMGHIELASPVAHIWFLKSLPSRLGMVLDMTLRDIERVLYFEAYVVIDPGMTPLKARQIMTEEDYYNKVEEYGDEFRAEMGAEGVRELLRAINIDEQVEMLRTELKNTGSEAKIKKYAKRLKVLEAFQRSGIKPDWMVLEVLPVLPPELRPLVPLDGGRFATSDLNDLYRRVINRNNRLKRLLELKAPEIIVRNEKRMLQEAVDSLLDNGRRGKAMTGANKRPLKSLADMIKGKGGRFRQNLLGKRVDYSGRSVIVVGPTLKLHQCGLPKLMALELFKPFIFNKLEVMGVATTIKAAKKEVENQTPVVWDILEEVIREHPVMLNRAPTLHRLGIQAFEPVLIEGKAIQLHPLVCAAFNADFDGDQMAVHVPLSLEAQMEARTLMLASNNILFPANGDPSIVPSQDIVLGLYYATREAVNAKGEGLTFTGVSEALRAYENKEVELASRVNVRITEMVHNEDKSDGAPAFVPKISLYATTVGRAILSEILPPGLPFSVLNKPLKKKEISRLINTAFRKCGLRETVIFADQLMQSGFRLATRAGISICVDDMLVPPQKETIVGDAAKKVKEYDRQYMSGLVTSQERYNNVVDIWSATSEAVGKAMMEQLSTEPVTDRDGNETRQESFNSIYMMADSGARGSAVQIRQLAGMRGLMAKPDGSIIETPITANFREGLNVLQYFISTHGARKGLADTALKTANSGYLTRRLVDVTQDLVVVEDDCGTSNGVAMKALVEGGEVVEALRDRILGRVTVADVVNPESQETLYETGTLLDEDAVEEIERLGIDEVRVRTPLTCETRYGLCAACYGRDLGRGSSVNVGEAVGVIAAQSIGEPGTQLTMRTFHIGGAASRAAVASSVEAKSNGTVRFTATMRYVTNAKGEQIVISRSGEAMITDDHGRERERHKVPYGATLLQLDGAQIKAGTQLATWDPMTRPIITEYGGTVKFENVEEGVTVAKQIDDVTGLSTLVVIDVKRRGSQASKTVRPQVKLLDANGEEVKIPNTEHSVQIGFQVGALITVKDGQQVQVGEVLARIPTESQKTRDITGGLPRVAELFEARSPKDAGILAEVTGTTSFGKDTKGKQRLVITDLEGNQHEFLIAKEKQVLVHDGQVVNKGEMIVDGPADPHDILRLQGVEALSRYIVDEVQDVYRLQGVKINDKHIEVIVRQMLRRVQITDNGDTRFIPGEQVERSDMLDENDRMIAEDKRPATYENVLLGITKASLSTDSFISAASFQETTRVLTEAAIMGKRDDLRGLKENVIVGRLIPAGTGLAFHKARKSKELSDRERFDQIAAEES

SEQ ID NO: 7070 - protein, 525 aa, Burkholderia cepacia; identical to SEQ ID NO: 4314

SEQ ID NO: 7071 - protein, 239 aa, Burkholderia cepacia
  unsure (1)..(239): unsure at all Xaa locations
VVDEGRLRYVTICRESRANALSVAMLGSLADAIASAGRVSAIDAIVLRSTGVNFCAGADMGELRTHRRQQYDALRTLIAALDKRAVPLLCVMQGRALGAGCVLSALADVVIASDEATQGFPEMRFGMYPSLVHAVLVQKLPEPLVYALCVGARVLSAHDAWSLGLVTEVLPADDFTKCARDRVEFYVARTAAVRYGREMMDQSAREMLLARVAKAEHIIDRNLADPEVEAMLSSYRKXR

SEQ ID NO: 7072 - protein, 163 aa, Burkholderia cepacia; identical to SEQ ID NO: 4316

SEQ ID NO: 7073 - protein, 299 aa, Burkholderia cepacia
LSGNAMPRCGGIATMMRLPNVGSAEGFDACFVGVPFDLGTSNRTGARFGPRQIRSESVLLRPYNMATRAAPFDSLRVADLGDVAINPYNLHDSIARIETAYDEILQHDCKPITLGGDHTIALPILRAMHRKHGKVGLIHVDAHADVNDTMMGEKIAHGTPFRRAVEEGLLDCGRVVQIGLRGTGYAAEDFDWCRDQGFEVVQAEACWNQSLAPLMARVRERMGDGPVYITFDIDGIDPAFAPGTGTPEIAGLTVPQALEIIRGSRGLNIVGCDLVEVAPPYDPFGTTALLGANLAFELL

SEQ ID NO: 7074 - protein, 316 aa, Burkholderia cepacia
CRNVMVAKPSEETPVTATLLAEVMQTVGLPAGAFNLVHGFGPNSAGEFITTHPGINAITFTGESKTGTAIMHAAAEGVKPVSFELGGKNAAIIFADCDFDKTVAGMTRAAFLNSGQVCLCSERIFVERPIYDRFVKALAERAKQIKLGDPTDEATCMGPVISAAHRDKVLSYYALAREEGAEFITGGGTPSFGNQLDGGFWVEPTLLAGLPDDARCVTEEIFGPIGHVTPFDSEAEVIQRANATPYGLAATIWTSNVNKAHRVAQSMNVGVAWVNAWFLRDLRTPFGGSGLSGIGREGGLHSLNFYSELTNVCIHV

SEQ ID NO: 7075 - protein, 286 aa, Burkholderia cepacia
WKGVFPAVTTKLKDDGSLDHEAIKSGLNRLIENGVGGVVMMGMVGENAQLTADEKRTVLKLAVETVAGRVPVISGLAETSTALAVQFVQDAEAIGVQGLMVFPGLTYRSDDRETVEFYRTIARSTRLGLMIYNNPRGYGVDMRPDLMDQLKDEANVVAIKEETYDTTRVTDLLKRFGDRFAVFCGVDDLVLESAALGVTGWVSGMANAMPKESVELLNLAVAGDFVKARELYRALIDLFHLDVHVKLVQYIKLAENMTAGYPENVKAPRLKLEGEERQKVVAIVEQ

SEQ ID NO: 7076 - protein, 430 aa, Burkholderia cepacia
VADAIAAARHAFRSWSLTTPQQRADILDAAGTRILQRKEELGTLLAREEGKRLPEAIGEVGRAGNIFKFFAGEALRIGGEVVSSVRPGMTVEVTREPLGVIGMITPWNFPIAIPAWKIAPALAYGNTVVIKPAEAVPACATELVKILEESGLPAGVVNLLLGPGRVVGEALVASPDIDAISFTGSESTGRAIAVKCVTSGKKVQLEMGGKNPLVVIDDADLDVAVEAALDGSFFSTGQRCTASSRLIVTSAIHGQFVAALQRKASELVVGHALDKATQIGPVLDDRQLQQNLKYLKIAAEEGGQVLGGERVERPTRGYFMRPALVIGTDNTMRINREEVFGPVASVIKVADYEEALAVSNDTPYGLAAGICTTSLKYASHFRRHAEAGMVMVNAPTAGVDYHVPFGGRKRSSYGPREQGTYAREFYTVVK

SEQ ID NO: 7077 - protein, 236 aa, Burkholderia cepacia
LAWIAGVGASAGLGAALARRFAREGLNVTVTGRSRERLDTVVAEIQHAGGQALALPGDVTSESDLAAIARQLAERGTLEVAIFNAAGATRAPTLDLSAEQFEAAWRVTTLGGFLFARAALPPLLAAGRGSLLFTGATASLRGRPPFAAFASAKAGLRSLTQSLAREFGPQNIHVAHVVVDGGIDGERLRTSAPQRAAERGPDGLLNPDEIADSYWRLHQQGRSAWSQEIDLRPFNE

SEQ ID NO: 7078 - protein, 298 aa, Burkholderia cepacia
VAVVGTGVIGASWAACFLSRGLQVAATDPSSGARQRLEHAVMQHWPTLVTAGLASGASLGNLTFHDSLDAALEGAQFVQENGPERIDAKRELFAAIDAATASDVVIASSSSGLLISDVQTACRHPERVVLGHPFNPPHLIPLVEVIGGRLTSETAIRAAIDFYRAIGKRPINPQKEISGHIANRLQAALWREAFHLVSIGAATVQDIDDAIAYGPGLRWAVMGPFANLHLSGGAEGMRHLLEHLGAPIENWWAQLGTPAMTPDLKRMVIDGVDAALAGRKDSDLAAQRDLIILDVLRA

SEQ ID NO: 7079 - protein, 146 aa, Burkholderia cepacia
MLIQFLKQQTPAELARLRQMLTSIPVVAAASRRQRIALIGLRGAGKSTLGALLAKHLDVPFVELDRMIEQEAGIAIGEVITLYGQAGMRRLERRCIEKIIETHPEVVVATGGGIVAEAATYELLLRTFRTMWLKSAARDSLRARHG

SEQ ID NO: 7080 - protein, 476 aa, Burkholderia cepacia; identical to SEQ ID NO: 4324

SEQ ID NO: 7081 - protein, 252 aa, Burkholderia cepacia
MRLERKRTLITAAASGMGAAGTRLFAEHGARVAALDRDGAALQRVVDDVKSRGGEARGFVVDLTHRQATLDTVREAVEWLGGIDVLWNHAGMPAPSNIEDFEFEQYERSINLNVTSAVVISSAILPWMTAQKSGSIIFTSSTSGLVGSALSPLYSAFKSGIVGLTKGLAVRYAAQNVRVNALCPGPVSTPMLHNDFIAGDARFDKEENLKRVISVVPMGRMGEPVEIAHAALWLASDESSFVTGVALPIDGG

SEQ ID NO: 7082 - protein, 435 aa, Burkholderia cepacia
VLNPATGKVAASAPAASVQQLERAITAANRAFAGWRDTPFAERRAIVLKIIDIIAANQGELSRLLTLEQGKPLAAAAGEVSATIDYFRYFTTLSLAPEVRQDNETRYVEVRRDPLGVVAAIIPWNFPLLLAAFKLPAALLAGNTVVLKPAPTTPLATLHLGRLIAGAVPAGVVNIVSGGDELGPVLTSHPGIRKVSFTGSTETGKKVMASAATHLARVTLELGGNDPAILLDKVDLEHTATAIFASAFGNSGQVCRAIKRVYVPRPIYEPFCAALAERARAAVVGDGLTDGVQFGPVQNAAQFERLKELHADAQQRGTVMPGGGPVKGPGYFFRPTIVKDIASDSRLVVEEQFGPILPVIAYDELEEAVEMANNSQYGLAASVWSTDSQAAFAVADRIVAGTVWINKHTDRMPDLPIAGARQSGMGVELGEEGLH

SEQ ID NO: 7083 - protein, 493 aa, Burkholderia cepacia; identical to SEQ ID NO: 4327

SEQ ID NO: 7084 - protein, 529 aa, Burkholderia cepacia
FDYIIVGAGSAGCVLANRLSADPSVKVALIEAGPSDRRFPTNIKSSMPAGMLFLLPHSKYNWQYTFTGGSGVNGRSLLCPRGKLMGGTSSVNGMVYIRGHRLDYDDWAALGNDGWSYQEVLPFFKKHENNTQGEAPFHGVGGEVEVSVPENPNILSRTFIEAAREVGLPMNADANGTSQDGIGFNHVNHKYGRRYSSSRAFLHPILHRRNLHVLTDTLVERILFSGDRATGISILQGAAPTTLNATREVILSGGAINSPQLLMLSGIGPHAELARLGIETRVDLPGVGENLQDHPTVQVSRSNPSAESYALTLRAWPRVLGTPFAYLFAKKGMLATHGAEAGGFVRTLPELDRPDIQLTFVATIKKSVYKMPRTHGMMLMVHLMRPRTRGRIRLTSSSIQDKPELHPRFLDDPEDLQTLLRGVHQARRILGTKAFAPYVGEEVTPGAQYMSDEDLIKAIRAQVGTAYHPVGTCKMGPASDLMAVVDNELRVRGVRGLRVVDASIMPNIVGGNTNAPAMMIGERAASFIL

SEQ ID NO: 7085 - protein, 244 aa, Burkholderia cepacia; identical to SEQ ID NO: 4329

SEQ ID NO: 7086 - protein, 473 aa, Burkholderia cepacia; identical to SEQ ID NO: 4330

SEQ ID NO: 7087 - protein, 352 aa, Burkholderia cepacia; identical to SEQ ID NO: 4331

SEQ ID NO: 7088 - protein, 410 aa, Burkholderia cepacia; identical to SEQ ID NO: 4332

SEQ ID NO: 7089 - protein, 671 aa, Burkholderia cepacia; identical to SEQ ID NO: 4333

SEQ ID NO: 7090 - protein, 141 aa, Burkholderia cepacia; identical to SEQ ID NO: 4334

SEQ ID NO: 7091 - protein, 585 aa, Burkholderia cepacia
  unsure (1)..(585): unsure at all Xaa locations
PIYETKNLVVDLYTENNVIRAVDECSFSLFAGETLAVVGESGSGKTVMTLGPLGLLPEGIAVHMRGTAATSRGDLLRFGGRRRASVRGNDFGVVFQDPLSALNPMRRIGPQLAEQACRFAGITASGTKADAVSNLRRVGIADPEDRYWRYPHEFSGGMRQRAMIALALASRPKILLADEPTTALDATVQAQIISLLKQIQAEDGLAILLITHDIGVVAGMADRVAVMYAGRIVEEGAVTDVLKNPVHPYTQGLLSSVPDLDTPIGEKLTEIPGTPPDLSRLEAGCRFAPRCFAAQPSCSLARPTLSSVSITAPTHXSRLLRDAAXIPGGYRVNASNTIAVSDLMVHFPTSRGVTVRAVDGVNLQVQQGEFHGIVGESGCGKTSLARTIAGLQRPTGGSVLIDGRELNDWRGDRLAFSRHVQFIFQDPLASLSRRQTIQESLEEPLRIHGIGPASERRRRVAQLLQLVSLPEACLDRLPRALSGGQRQRVAIARALALDPRILICDEPLSALDVSIRAQILNLFADLQKKLDLSIVLIAHDLAIVRLVCTRVSVMYLGKIVETGPAHDLFAQPRHPYTRALLDAAP

SEQ ID NO: 7092 - protein, 771 aa, Burkholderia cepacia; identical to SEQ ID NO: 4337

SEQ ID NO: 7093 - protein, 671 aa, Burkholderia cepacia
KILIANRGEIACRVAATCKRLGIASVAVYSDADANAKHVAACDEAVHIGGSSAAESYLRVERIIEAARATGAQAVHPGYGFLSENEDFAQACEAAGIVFIGPPVEAIAAMGSKAAAKALMHAAAVPLVPGYHGDDQDAQLLHREANAIGYPVLLKASAGGGGKGMRVVERSEDFAAALASCKREAASSFGNDRVLIEKYLTRPRHVEVQVFADRHGGAVYLFDRDCSVQRRHQKVLEEAPAPGLSAEIKREMGEAAVAAARAVNYVGAGTVEFIMTSTGEFYFMEMNTRLQVEHPVTEMVTGQDLVEWQLRVAADQPLPLTQEQLKIDGHAIEARIYAEHPARGFLPSTGTLKHLRMPEGVEFAIDASGLGEPGRKAPVRIDSGVREGDTITPFYDPMIAKLIVHGATREEALARLSRALHACEVVGPHTNVEFLQSIVASEPFATGDLDTGLIERHHDALFAPRKKPYKEALALACAALLTREGGTAHGASPWDALSHWRLNGGYTQTLGWRDIDSGGESAGLFTVTFARDGGTQTLEHDGVREDFKWSDGSGPHEFRATIVDARATGRVFVDGDTFHVFCLGEALAFEWQNLLAHAADAEGGEGRLTAPMPGKVIAVLVEPGTVVEKGTPLIVMEAMKMEHTIGAPAAGTVSEVLYAVGDQVADGAQLL

SEQ ID NO: 7094 - protein, 414 aa, Burkholderia cepacia
FRRRPPGRIRTSRRLYSGRPPTNSGDTAMSNLPGLQFPLGEEIEMLRDSIAGFAAKEIAPRAAEIDRTDQFPMDLWRKFGDLGVLGMTVSEEYGGANMGYTAHMIAMEEISRASASVGLSYGAHSNLCVNQIHRNGTEAQKQKYLPKLVSGEHVGALAMSEPNAGSDVVSMKLRAEKKGAHYVLNGTKMWITNGPDCDTLVVYAKTDPEANSRGITAFIVEKGMKGFSVAQKLDKLGMRGSHTGELVFQDVEVPEENILGQLNGGAKVLMSGLDYERAVLAGGPTGIMVAVMDAVVPYIHDRKQFGQPIGEFQLIQGKVADLYTTLQACRAYLYAVGRQLDTLGKEHVRQVRKDCAGVILYTAEKATWMAGEAIQILGGNGYINEYPVGRLWRDAKLYEIGAGTSEIRRMLIGR

SEQ ID NO: 7095 - protein, 273 aa, Burkholderia cepacia
RCTKTYDSRHALGIFGLNNGERPMSRIFITGSADGLGQMAARLLVDAGHQVVLHARSAARAEHALQAVPQAETALVADLSSIAATAELAQQVNRLGRFDAVIHNAAVGYQEPRRIATVDGLSHVFAVNTLAPYILSALIGKPKRLVYLSSALHRSGDASLDDLAWERRPWRGTAAYSDSKLHDALLAFALARRWPQVLSNALEPGWVATKMGGPGAPDDLLAAPKTQVWLAVSDEPAATVSGAYFYHMKPRETHPAVHNVAVQERLLEACAGF

SEQ ID NO: 7096 - protein, 566 aa, Burkholderia cepacia
KKLINEVSAVVPDMLDGLAALNPHLSLLQGSTIIVRADAEAAAARGEVALISGGGSGHEPAHGGYVGPGMLSAAVAGEVFTSPSTDAVLDAIRAVAGAAGALLIVKNYTGDRFNFGLAAEIARAEGIPTEMVIVADDVALTASGDHAGRRGLAGTVLVHKIAGAAAASGRPLAEVAQIARDVAASLGTMGVALTACTVPAAGKPGFELADGEVEWGLGIHGEPGVERGALEPAAAVVDKLLEKIVGDLSLQAGERVALLVNNLGGTPSSELNIVAGAALRYLAERGIRTERAWAGTFLSALEMAGISLSLLRVDDQRLGWLDAAAQTSAWPALGGRIARTSARPAPAEPDRASGATLSREATLRRVIEAVCACLLKAEPTLTDMDQRVGDGDLGISLSRGARAIIQELDGYPAETTPGAVLRNMSATLRRVVGGTSGPLYAVMLLRAALALEQSGGATPKQWAAAFSAGVDGLMALGGAQPGDRTMVDALKPAADALQAALARSDALDAALKAAVDAATEGAAQTASMHPRRGRSSYVGERALGHADPGAHAVALWLAAIREALAE

SEQ ID NO: 7097 - protein, 310 aa, Burkholderia cepacia; identical to SEQ ID NO: 4342

SEQ ID NO: 7098 - protein, 356 aa, Burkholderia cepacia
NPLGTDGFEFIEYTAPDPKALGKLFEQMGFTAIARHRHKDVTLYRQGEINFIVNAEPDSFAQRFARLHGPSICAIAFRVQDAAKAYQQALEKGAWGFDNKTGPMELNIPAIKGIGDSLIYFVDRWRGKNGAEPNSVGNIDIYDVDFEPIPGANPNPVGHGLTYIDHLTHNVHRGRMQEWAEFYERLFNFREVRYFDIEGKVTGVKSKAMTSPCGKIRIPINEEGSDTAGQIQEYLDAYRGEGIQHIALGTNDIYRTVDGLRAANISLLDTIDTYYELVDRRVPNHGEPLDELRKRKILIDGAPEDLLLQIFTENQIGPIFFEIIQRKGNQGFGEGNFKALFESIELDQIRRGVVQD

SEQ ID NO: 7099 - protein, 433 aa, Burkholderia cepacia
RVLIANRGEVAVRIVRAAKSVGLQTVGIHTPEEANALHVRDSDIAVALAGVGTAAYLDIASIIAAAVRTNCSFIHPGYGFLSESAAFARACEQAGVTFIGPSPDTLDVFGDKASTRELAIRLDVPVLPATAGLADDASALSFMQSLAAPVIVKAVAGGGGRGMRIVTDPTDLPAALSRCRSEAERGFGRDDVYVERYLPRSRHIEVQVIGDGSSVVHLGTRDCSLQSRHQKVIEIAPAPWLPVEIEEALLEHALQLARAVQYRGAGTMEFLIDVDNPSHYYFIEGNPRLQVEHGITELVTGLDIVALQFAIARGRSLADEGITQDNVVTSGVAVEARVTLTTPGTIARFVSPGKGRVDSGAYDGLAVGSGFDPLLAKVMVHEPDYPRCICALADSLGELVVEGPATNRDGLLSLLADPRVRAGDITTTLIDDL

SEQ ID NO: 7100 - protein, 497 aa, Burkholderia cepacia
DTVLTYSECVMRGDELARAFLGLGLERPARVALVLPNSAEFVISLYACARIGITAVPISTWSKPSELRRILRDARVDLVLARDAFPGHAIAESLQRLVQTIHRWMRSRSMNGQGDRGLPVRFPNCFRMVLAAMIADGRLSRVLPAHTDADLVVLYTSGSTGAPKGVILPQSSVALNGVAIAGRMGFGGNDRIFSYFPLFFSGGLCNALTGAISCGAELVTQSRFDPAGALSLIRSRRCTGRNVWHDGLEPVAAVEGFRPGDFSRMRRGLHVDPELYRRLSLAVDEGINMYGMTETATAFTCGDWREPADVRQSTHGKPFDGSDLRICNPDETSPLGVGVEGEICVRGYNLMRGYTDGSHVERIDDDGFFHTGDIGFVDPAGYLHFVGRRKTLIKVKGLTVQPEEVEATLLRHPAISKAVVVGEGGGHESKGVVALIVLHEGDRWDMQALRTYCQEELSSYKVPRLLVVDANRFPLSASLKIDRIGAATLLKQIAAEV

SEQ ID NO: 7101 - protein, 458 aa, Burkholderia cepacia; identical to SEQ ID NO: 4346

SEQ ID NO: 7102 - protein, 534 aa, Burkholderia cepacia
TPIGDLLVRAASRHPDRDAVVFPDDRYTYAEVLRRAMLVARGLLSLGVRPRDHVGILCTNGIEFIEGLFGVALAGAVAAPINARYKVNELKYIASNADLVAILTTGDADAYVDFPDVFVQAFPELSSSEALGLDLESAPRLRNVILLSGSERPGFISRERLLELAARVSEEDVHVARSRVRLRDIGLLLYTSGTTANPKGCLLSHEAVTRGPVERATIRFGLKVADVTWGAGPLFHIGSLSPFLGSIGAAGTYVTDAFFDAGRALDLLIREKPTVMFPWFPAIMQALMNHEKWDPAKLSSVRSILLIGPRPLLDKVQAALPQVELVASCGMTETAGIYAVSDVSETVEQRATGHGRPCSGIEARIVSLSDGSEVTDSTPGEILLRGYCVMEGYYRDPANTRKALDAEGWLHTGDLYSRTPDGRLMFHDRIKDMLKVGGENVAPAEIETFLCTHPSVVMASVVGIADARLDEVPVAFVELAAGNTLEAEFLISFCRGQLASFKIPRRIHFVDTGTWPMSTTKIDKRQLRERAAKM

SEQ ID NO: 7103 - protein, 395 aa, Burkholderia cepacia
VESIIQHIEEKGDEAVREYSRKFDNWDPGDFRLSRPEIETARKQLSAREIEDIAFAQTQVRNFARIQRDSMRDVETETLPGVVLGHKHIPMNAVGCYIPGGKYPLLASAHMSVLTAKVAGVARVVSTAPPYQGKPHPAIVTAMDMAGADEILVLGGIQAVVAMAVGTPTVAPVDMLVGPGNMFVAEAKRQLYGRVGIDLFAGPTETLVIADESVDGELCAVDLLGQAEHGATSPSILLTNSEKLARDTLAEIERQLKILPTASIAAQSWADCGEVIVCDTYEEMLQVADDIASEHVQVMTEDPDFFLNNMTNYGALFLGPRTNVSFGDKVIGTNHTLPTNRSARYTGGLWVGKFLKTCTYQRVTTNEASAIIGEYCSRLCHMENFAGHGEQANIR

SEQ ID NO: 7104 - protein, 243 aa, Burkholderia cepacia
LASRRALVTGGSSGIGLAAAAALGRAGAHVTVAARRRAELEVACEALRATGVACEALVLDVTDSASVDREVNSRVPFDILVNSAGMNRPKPLTDLTDDDIDAVLRLNVKAAFYLARAVSRRLVDANLGGSIINISSQMGHVGSARRSLYCASKHAVEGMTKALAWELGAARIRVNSLCPTFIETPMTAPMFVQPGFREWVCERIALGRVGEMHEIMGPVVFLASDASSLMTGSALMLDGGWTA

SEQ ID NO: 7105 - protein, 486 aa, Burkholderia cepacia
IGIVGTGAMGRGIAQIAALAGLTVRLYDTNPAAIGAARDYLAETFAKLTAKGKLDQARSLAALANVSGAQAIGELAGCDLVVEAIVEKLDVKQALFRELETVVSGRCILASNTSSLSITAIAAGCSDPSRVAGYHFFNPVPLMKVVEVIDGLRSDPAAGDALMDLARRMGHTPVRAKDMPGFIVNHAGRGMNTEGLRVAGEGVASFADIDCIMREQAGFRLGPFELLDLTALDVSHPVMESIYHQFYEEPRFTPSPITGTRLAGGLLGRKTGEGFYRYEDGKQQVPAEAPAPTGLPASVWVSKRYPQAHDAVVQLVEKAGVTLDNGITPESNSLIVVTPFGHDATTAAVDEALDATRVVALDALFPLVGAQRRTLMTTPATTRAARDMAHALFAADGVPVTVIRDSTGFVAQRVVATIVNIGCDIAQKQIATPEDIDLAVTLGLGYPRGPLALGDALGSTTILAILRNMFSVLGDPRYRPSPWLAR

SEQ ID NO: 7106 - protein, 373 aa, Burkholderia cepacia; identical to SEQ ID NO: 4352

SEQ ID NO: 7107 - protein, 398 aa, Burkholderia cepacia
MNLDYSPADSAFRADIRAWLEANLPPGTERQGTQSQAAFPRRLRKLHKLLGMRGWSVVAWPKEYGGPDWDATQRHIWDEECARIGAPSVLPFGVSMVAPVLMKYGNEAQKRHYLPRILDGTDWWCQGYSEPGSGSDLASLRTRAERAGDHYVVNGQKTWTTLGQYADMMFCLVRTDSGAKKQEGISFLLIDMKTPGITVRPIITLDEDHEVNEVFFEDVKVPIENLVGEENRGWTYAKYLLGHERTGIARVGQSKRELVFLKRLALNQKKNGKPLLQDPVFAAKVANLEIELMALEVTVQRVVANETGGRGPGPEASMLKIKGTEVQQALTELMFEAVGPLAAPFDIPFLEGEREHSLAGDDDAAPLAAYYFNFRKTSIYGGSNEIQKNIIAQMILGL

SEQ ID NO: 7108 - protein, 386 aa, Burkholderia cepacia; identical to SEQ ID NO: 4354
  unsure (1)..(386): unsure at all Xaa locations

SEQ ID NO: 7109 - protein, 323 aa, Burkholderia cepacia
RTGMNAKARESIPATLIPGDGIGPEVTQATVRVLEALGAPFKWDIQQAGMAGIDECGDALPQATLDSIRETKLALKGPLTTPIGGGFRSANVRLREAFELHANIRPVRTIVPGRYDDIDIVLVRENIQGLYVAHEHYIPIGDDPRAVAVLTGMNTREGGRRIARCAFDYALRHGRRKITVVHKANVLKALTGIFLEAAREVAADYAGRVALDDRIVDACAMQLVLNPWQFDMLLCTNLFGDILSDQLAGLVGGLGLAPGANIGKDTALFEAVHGSAPDIAGRGIANPVSQLLAAGLMLDHVGLDEDAKRLRRAIADTLNEDKV

SEQ ID NO: 7110 - protein, 479 aa, Burkholderia cepacia; identical to SEQ ID NO: 4356

SEQ ID NO: 7111 - protein, 420 aa, Burkholderia cepacia
VVGATVFFDAFDALSIALVLPVLSTRWHLTSMSIGILIASGYVGQAIGALLFGSVAERIGRIKTISLTIVIFAFASLASAFAPNYAWLCAMRVIGGIGLGGEGPAALAYISEIAPVERRGAFILSFQFMYAAGFVAASLMGAWIVPRFGWQSIFIVGSLPIILLPVLRRLCPESPRWFASRGRLEESDAALWEIEKRVSKNGKVTLSDVAPTAGPVLNRDSSVRELFSPVYRKRTINLWILWAATYFVVYGMTNWLPTLLKTVYHLPLQETLNIALLSATLGLCGNIACVALIDRIGPKHWFIGAFAGAAALFSLWLAMGDGKLVPFLILGLAAFVLSVTVSFGLFLYTAEIYPTRMRGIGAGFASFWLRVASVLAPMVIGYLLPRHGISGVFAVFAGVSAIGFLASLIGMIKTKGLRLE

SEQ ID NO: 7112 - protein, 251 aa, Burkholderia cepacia
PVCVITGSASGIGAATALRFAQAGWSVAIGNFDDSTRDAASTVEALCRDAGAQTLIFDADVGKDADCRHAVDMVASRWQRIDALINCAGTTRVIPHNAFDQIDDFEFERVYRVNLIGLYQMTRAAVPLLRESASATRSTSVVNVSSLAGLNGTGSSIAYAASKGAVNTLTLSLARNLAPHIRVNALAPGMVDDGLLLRVLDAAAYDGVLSRMTESAPLKRVSRPAEIAELAWFLTAHAPAITGQVIAAENG

SEQ ID NO: 7113 - protein, 515 aa, Burkholderia cepacia; identical to SEQ ID NO: 4359

SEQ ID NO: 7114 - protein, 520 aa, Burkholderia cepacia; identical to SEQ ID NO: 4360

SEQ ID NO: 7115 - protein, 471 aa, Burkholderia cepacia
LFIDEIHTLIGAGAASGGTLDASNLLKPALSSGTLKCIGATTFTEYRGIFEKDAALSRRFQKVDVTEPTVEQTVAILRGLKSRFEEHHGVKYSSGALSAAAELSARFITDRHLPDKAIDVIDEAGAAQRILPKSKQKKTIGKNEIEEIISKIARVPPQSVSQDDRSKLQTLDRDLKSVVFGQDPAIDALSAAIKMARAGLGKLDKPIGAFLFSGPTGVGKTEVAKQLAFTLGIELIRFDMSEYMERHAVSRLIGAPPGYVGFDQGGLLTEAVTKKPHCVLLLDEIEKAHPDIYNVLLQVMDHGTLTDNNGRKADFRNVIIIMTTNAGAEAMGKSVIGFTNRRETGDEMVDIKRMFTPEFRNRLDAVISFRSLDEEIIMRVVDKFLMQLEDQLHEKKVDALFTDALRKHLAKHGFDPLMGARPMQRLIQDTIRRALADELLFGKLMNGGRVTVDVDAEDKVQLTFDEHPAPR

SEQ ID NO: 7116 - protein, 523 aa, Burkholderia cepacia; identical to SEQ ID NO: 4362

SEQ ID NO: 7117 - protein, 510 aa, Burkholderia cepacia; identical to SEQ ID NO: 4363

SEQ ID NO: 7118 - protein, 225 aa, Burkholderia cepacia; identical to SEQ ID NO: 4364

SEQ ID NO: 7119 - protein, 260 aa, Burkholderia cepacia; identical to SEQ ID NO: 4365

SEQ ID NO: 7120 - protein, 476 aa, Burkholderia cepacia
MSKEFDVVVIGAGPGGYIAAIRAAQLGKTVACIEKWKNPAGALKLGGTCLNVGCIPSKALLASSEEFENASHHLADHGISVENVKVDIAKMMARKEGIVEKMTKGIEFLFRKNKITWLKGHGKFTGKTDAGVQIEVSGEGETETVTAKNVIIATGSKARHLPNIPVDNRIVADNEGALSFESTPKKLAVIGAGVIGLELGSVWRRLGAEVTVLEALPEFLGAADQALAKEAAKQFKKQGLDIHVGVKVGEVKTTDSGVTIAYTDKDGNAQTLEADRLIVSIGRVPNTDNLGLEAIGLKANERGFIDVDEHCATAVPNVYAIGDVVRGPMLAHKAEDEGVLVAEIIDGQKPHIDYNCIPWVIYTEPEIAWVGKTEQQLKAEGREIKTGQFPFMANGRALGINKADGFVKMIADAKTDELLGVHIISANASDLIAEAVVAMEFKAASEDIGRICHPHPSLSEVMREAALAVDKRALNM

SEQ ID NO: 7121 - protein, 427 aa, Burkholderia cepacia; identical to SEQ ID NO: 4367

SEQ ID NO: 7122 - protein, 953 aa, Burkholderia cepacia
MMKQFQSNSYLFGGNAPYVEEMYEAYLDNPASVPENWRSYFDALQNVPASDGSNANDVAHGPIVESFAQRAKANAFIPRGAGGGEDLATARKQVYVQSLIGAYRFLGSQWANLDPLKRRERPAIPELEPAFYDFTEADMDQEFSATNLYFGFERASLREIVKALRDTYCGTIGAEYMYISDPEQKRWWKEKLESIRSTPNFSNEKKKHILNRLTAAEGLERFLHTKYVGQKRFSLEGGESFIASMDEVVRHGGANGVQEIVIGMAHRGRLNVLVNTLGKMPADLFAEFEGKHVDDLPAGDVKYHKGFSSDVSTEGGPVHLSLAFNPSHLEIVNPVVEGSAKARMDRRGDDSGLQVLPVQIHGDAAFAGQGVVMETLNLAQTRGYGTHGTLHIVINNQIGFTTSDPRDSRSTLYCSDVVKMIEAPVLHVNGDDPEAVVLATQLAIDFRMQFHKDVVVDIVCFRKLGHNEQDTPAVTQPLMYKTIAKHPGTRALYAEKLVQQGVITAADADEYVKAYRKAMDEGHHTVDPVLSNYKSKYAVDWVPFLNRKWTDAADTAVPLAELKRLAERITTIPENFKVHPLVERVINDRRAMGRGEAKLDWGMGEHLAFASLVASGYAVRLTGQDSGRGTFTHRHAVLHDQNRERWNDGTYVPLQNIAEGQAKFTVIDSVLSEEAVLGFEYGYSTAEPNTFVAWEAQFGDFVNGAQVVIDQFISSGEVKWGRVSGLTMLLPHGYEGQGPEHSSARIERFLQLCADHNMQVVQPTTPAQIFHLLRRQMIRLFRKPLIVATPKSLLRHKEAVSDLSELAKGAFQPILGEIDEAIDAKKVKRVVVCSGRVYYDLLAHRRESKSNDVAIIRIEQLYPFAHKQFEAEMKKYDNATEVVWVQDEPQNQGPWFYIEHHLKDGMKEGQKLAYSGRPASASPAVGYYAKHYEQQKALVEGAFGRLKSASIAK

SEQ ID NO: 7123 - protein, 692 aa, Burkholderia cepacia
MRIDKLTTKFQEALADAQSLAVGHDNQYIEPVHVLSALVAQQDGSARSLLSRAGVHVQALQTALGDAITRLPQVQGTDGNVQIGRDLTGLLNQADKEAQKLNDTFIASEMFLLAVADDKGEAGRLARQHGLSRKSLESAIAAVRGGSQVHSQDAESQREALKKYTVDLTERARAGKLDPVIGRDDEIRRSIQILQRRTKNNPVLIGEPGVGKTAIVEGLAQRIVNGEVPETLKGKRVLSLDMAALLAGAKYRGEFEERLKAVLNDIAKDEGQTIVFIDEIHTMVGAGKAEGAMDAGNMLKPALSRGELHCVGATTLDEYRKYIEKDAALERRFQKVLVDEPTVEATIAILRGLQEKYELHHGVDITDPAIVAAAELSHRYITDRFLPDKAIDLIDEAASKIKMEIDSKPEEMDRLDRRLIQLKIEREAVKKEKDEASQKRLQLIEEEIERLNREYSDLDEIWTAEKAAVQGSAQLKEEIEKTRAEITRLQREGKLEKVAELQYGKLPGLEAQLKEVTKAEASEQNNPTRPRLLRTQVGAEEIAEVVSRATGIPVSRMMQGEREKLLQIEEKLHARVVGQDEAISAVADAIRRSRAGLSDPNRPYGSFLFLGPTGVGKTELCKALASFLFDSEDHLIRIDMSEFMEKHSVARLIGPPGYVLEGELTSVLNEAYCYESRAHRRYGVMLRRETAQ

SEQ ID NO: 7124 - protein, 443 aa, Burkholderia cepacia
  unsure (1)..(443): unsure at all Xaa locations
MEPIKVGLLGFGTXAAAPSRYCAAIRKKSNAARGRGIEIARIAVRNPAKATAVLGAEAGTVALTDDFNAVVDDPSIDIVAEMIGGTGVARDLVLRAIRNRKHVVTANKALLAVHGTEIFRSGARQRRDGVVRAAVAGGIPIIKALREGLTANRIQYIAGIINGTTNYILSEMRDRGLDFATALKAAQDLGYAEADPTFDIEGVDAAHKATIMSAIAFGVPVQFDKAYVEGISKLAAIDIRYAEELGYRIKLLGIARRTDKGIELRVHPTLIPEKRLLANVEGAMNAVVVHGDAVGTTLYYGKGAGAEPTASAVVADLVDVTRLHTADPEHRVPHLAFQPDSLSNTPILPIDEVTSGYYLRLRVADVTGVLADITRILADTGISIDALLQKESEQVDANGKGETDIILITHETVEKNVNAAIKTIEALKTVVSQVTKLRMEALN

SEQ ID NO: 7125 - protein, 340 aa, Burkholderia cepacia; identical to SEQ ID NO: 4371

SEQ ID NO: 7126 - protein, 399 aa, Burkholderia cepacia; identical to SEQ ID NO: 4372

SEQ ID NO: 7127 - protein, 391 aa, Burkholderia cepacia
MTDAVIVSTARTGLAKSWRGGFNMTHGATLGGHVTQAAVERAKLDPARVEDVIMGCANPEGATGMNIARQIALRAGLPVSVPGMTVNRFCSSGLQTIALAAQRVIAGEGDVYVAGGVESISCVQNEMNHHMLTEGWLSENKPEIYWSMLQTAENVAKRYSISKERQDEYGVRSQQRAAAALEAGRFKDEIVPLTVLAGVTDKAGGRLFTKEVTVSGDEGIRADTTLEGVSKIRTALPGGVITAGNASQFSDGASACVVMNAKVAEREGLQPLGIFRGFAVAGCEPDEMGIGPVFAVPKLLRQAGLKVEDIDLWELNEAFAVQVLYCADKLGIPQDRLNVNGGAIAVGHPYGVSGARLTGHALIEGKRRGAKLVVVTMCIGGGQGAAGLFEV

SEQ ID NO: 7128 - protein, 190 aa, Burkholderia cepacia
MARGKFITFEGIDGAGKTTHLSWFRERLEQKVASTGRSVVMTREPGGTPLGEQIREIVLHQKMDLETEALLMFALRRQHLAEVIEPALARGDWVLSDRFTDATFAYQGGGRGLPRDKLETLERWVQGGFQPDLTVLFDLDPEVASERRSAARDPDRFESESEAFFSRTRAEYLRRAEEAPYRFAIIDSAQ

SEQ ID NO: 7129 - protein, 458 aa, Burkholderia cepacia; identical to SEQ ID NO: 4375

SEQ ID NO: 7130 - protein, 323 aa, Burkholderia cepacia; identical to SEQ ID NO: 4376

SEQ ID NO: 7131 - protein, 896 aa, Burkholderia cepacia; identical to SEQ ID NO: 4377

SEQ ID NO: 7132 - protein, 653 aa, Burkholderia cepacia
IQPLPDQLISQIAAGEVVERPASVVKELLENALDAGAQSLRILLDEGGVKRISITDDGCGIPENELALALMRHATSKIRSLAELEAVATLGFRGEALASIASVAQMTITSRTADAAHAVRVDAQTGVLSPAAGTQGTTIEVRELYFNTPARRKFLKSEQTELGHCLEQIRRAALARPDVAISVLHNGKAVEHWNASEPPVRVAKILGDTFATAHLPLDESAGPLAVYGCAGLPTASRGRADQQYFFVNGRFVRDKLLTHAVRAAYEDVLHGERYPSYVLFLDLPPEAVDVNVHPSKIEVRFRDSRSIHQFVFHAVQRALARHAGASPETTAGGHAAHLAPSVSGPASFGATPLGGAGVGGVGFGAGNGAGGIGGGLGGASGGGFGSSSQQPGNTWMRQARMTQGTLPVAQPLAFYDALFGRKDTNAGTAEGATLFEARDSAAEAPSPYNASAPYPAPAFHAADEQPLGFALGQIHGIYVLAQNAHGLVIVDMHAAHERILYEQFKNALADRTIAVQPLLIPQSMQADPVEIGTVEEERDTLDALGFDLAVLSPTTLAIRAVPALLKDADLQALARAVLSDLHAFGGSRVLTERQHELLGTLACHHAVRANRRLTLDEMNALLRQMEATERADQCNHGRPTWYQLTLSDLDRLF

SEQ ID NO: 7133 - protein, 246 aa, Burkholderia cepacia; identical to SEQ ID NO: 4379

SEQ ID NO: 7134 - protein, 246 aa, Burkholderia cepacia; identical to SEQ ID NO: 4380

SEQ ID NO: 7135 - protein, 392 aa, Burkholderia cepacia; identical to SEQ ID NO: 4381

SEQ ID NO: 7136 - protein, 211 aa, Burkholderia cepacia
LTSERVRERMVERLRANGVTDQRVLNAMSVVPRHMFVDPGLAAQAYEDAALPIGHHQTISKPSVVARMIELAAAGRALNNVLEIGTGCGYQAAVLSQVAREVYSIERIRPLSERAKTNLRPLRIPNIRLHYGDGRLGLPSAAPFDAIVIAAAGLDVPQALLEQLAIGGRLVAPVGSQEGQSQVLTLVERLGPAQWRESRLDRVFFVPLKSG

SEQ ID NO: 7137 - protein, 242 aa, Burkholderia cepacia; identical to SEQ ID NO: 4382

SEQ ID NO: 7138 - protein, 496 aa, Burkholderia cepacia; identical to SEQ ID NO: 4383
  unsure (1)..(496): unsure at all Xaa locations

SEQ ID NO: 7139 - protein, 372 aa, Burkholderia cepacia
TDDQRMIRDAARDLSTGRLAPYAADWDREGSLPDEVVSQLGELGFLGMIVPPELGGSYTDYVAYALAIEEIAAGCASCATLVSVHNSVGCGPVLQYGSEAQKDRWLGKLASGEAIGAFCLTEPQAGSEANNLRTRAELHNGRWVLNGSKQFVTNAARAGVAIVFAVTDPTAGKRGLSAFIVPTDTPGFNVGPPEKKLGIRASDTCPVALENCAIPEANLLGSRGEGLKIALSNLEGGRIGIAAQALGIARAAFEVARSYAHERVQFGEPLVRHQSVANLLADMATRLNAARFLVHHAARLRTLGKPCLSEASQAKLYASEMAEEVCSHAIQIHGGYGYLNDYPVERHYRDARITQIYEGTSEVQRMVIARQL

SEQ ID NO: 7140 - protein, 535 aa, Burkholderia cepacia
DARDLLVRHRTDYERAYQEFAWPKLDTFNWALDYFDEMARGNDSPALWIVDDPASAGTRLTFAQMAERSSRVANFLREQGVARGDRLLLMLPNRVELWEVMLAAMKLGAVVLPATTQLSSDDVCERVEVGAVRFVIVDGSEVGKFDGIEATVKRIVVGTRAAVTQGWIDLPWPMKRARPSNRTARRNASDPLLLYFTSGTTSRPKLVEHTHQSYPVGHLSTMYWIGLRPGDVHWNISSPGWAKHAWSCFFAPWNAGACVFVYDYTRFVPKDTLNVLVQCGVTTLCAPPTVWRMLVQEPLASYPVKLREIVGAGEPLNPEIIERVRHAWGTTIRDGFGQTETTCQIGNSPGQPVVAGSMGRPLPGYRIELVDADDHAASEGEIALSLAHRPTGLMTGYANNPQATEYAMRNGLYHTSDVALRREDGYFVYVGRADDVFKSSDYRLSPFELESVLIEHEAIAEAAVVPSADAVRLSVPKAFVIVRHGYQIGPELAREVFRFSREKLAPYKRIRRLQFSDLPKTISGKIRRVELRRRE

SEQ ID NO: 7141 - protein, 301 aa, Burkholderia cepacia; identical to SEQ ID NO: 4386

SEQ ID NO: 7142 - protein, 529 aa, Burkholderia cepacia
PSWSSLQTHYEKIRDAHMRDWFAPENDPAPTRAERFAFAGGGLAADFSKNRITDETLKLLVQLAREAGVEKRRDAMFAGAVVNPTEGRAALHTALRATDPKAPFYDQVQAERARMAAFADQVRSGEWKGYTGKRIRYVVNIGIGGSDLGPKMVVHALHHLATPEITTHFVSNVDGADLYNVMQQIDPEETLAIIVSKTFTTLETMTNARSLRDWFVEKGCPESALAKHFVGVSANPAEVVKFGIAKENVFEMWDWVGGRYSLWSAVGLSIMIAVGPQQFGELLAGANEMDQHFRDAPLEKNLPVLLGMIGIWYRNFFGSQSYLVAPYSEALHFLPSYLQQLEMESNGKSARLDGVMVDYPTAAVTWGEPGTNGQHAFFQMLHQGPTIVPIDFIAVLTPEHPLVSHHPKLLANCFAQSEALMLGRTLEEAKKVAGADKPELAPHLVFPGNRPTSTLLVDALTARSLGALIALYEHKVLVQASVWDINPFDQWGVELGKILGKVVEADLTAPSVDEKKHDSSTSALIARAR

SEQ ID NO: 7143 - protein, 209 aa, Burkholderia cepacia; identical to SEQ ID NO: 4388

SEQ ID NO: 7144 - protein, 366 aa, Burkholderia cepacia; identical to SEQ ID NO: 4389

SEQ ID NO: 7145 - protein, 485 aa, Burkholderia cepacia
MPAQASFRIDRRKNMSQFANYIDGQWVDGASVSRNVNPSNLDDVIGEFAQADAEQTQRAIRAARNAFAQWSLSTPQQRFDLLDQAGSTILARKAELGRLLAREEGKTLPEAIGEVGRAGQIFKFFAGEALRIGGEIVPSVRPGMTVEVTREPLGVIGLITPWNFPIAIPAWKIAPALAYGNTVVVKPADLVPASTWELVRIIAEAGAPAGVINLVMGQGAVVGEALVSSPQVDAVSFTGSVATGRAIGAKCFASGKKFQLEMGGKNPMVVLDDADLDVAVEACINGGFYSTGQRCTASSRFIVTEGIHDRFIDAMKARMQALKVGDALADGTHIGPVVDDKQLQQDERYIAIAREEGGTIFGGERIERDTRGYFLAPALITDTTPDMRINREEVFGPVASVIKVKDYNEALAVANDTEFGLSAGICTTSLKYSSHFRRHVQAGMVMVNTATAGVDYHVPFGGRKGSSYGPREQGSYAREFYTTVK

SEQ ID NO: 7146 - protein, 271 aa, Burkholderia cepacia
AELGEGPLWQAGENAVYFVDIKGRQIHRLTVTTGQTQTWKAPGQPGFIAPLAGHGFVCGLPGGLYRFDAGSGQFSKLKDVEVHLPGNRLNDGFVDASGHLWFGSMDDGEEQPSGTLYRVNHAGEAVAQDDGYVITNGPASSPDARTLYHGDTMRRVVYAFDLGEDGTLSRKRIFAAISGDGYPDGMAVDADGFLWVALFGGWRIERFSPDGKRVEQVPFPCANVTKLAFGGDDLQTVYASTAWKGLSPVARQQQPDAGGLFSFRSPVPGQP

SEQ ID NO: 7147 - protein, 241 aa, Burkholderia cepacia
KTVVITGGGSGIGAAMVEAFARQGARVFFLDVAEDDSLALQQSLSDAPHPPLFRRCDLRSVDAIHSAFAGIVEIAGPIEVLVNNAGNDDRHEVDAITPAYWDERMAVNLRHQFFCAQAAAAGMRKIGRGVILNLGSVSWHLALPNLAIYMSAKAGIEGLTRGLARDLGAAGIRVNCIIPGAVRTPRQMQLWQSPESEAKLVASQCLRLRIEPEHVARMALFLASDDASRCSGRDYFVDAGW

SEQ ID NO: 7148 - protein, 705 aa, Burkholderia cepacia; identical to SEQ ID NO: 4393
  unsure (1)..(705): unsure at all Xaa locations

SEQ ID NO: 7149 - protein, 399 aa, Burkholderia cepacia
VHSEAGRLRTVMVCAPGLAHRRLTPANCGALLFDDVIWVDKAIEDHQTFTRLLRERGIEVLEFHHLLAEVCLNTTARDWILNRRIVEEEVGTGMLRELRLWLEDMPAQQLADVLIGGVAKAELPFDARGLFGGYLERSEFVIQPLVNLMFQRDPSAWIYGGVTLHPMFWPARRKETLLLAAVYAFHPRFAGKVRTWWGGPDTNFGVETLEGGDVMPIGNGVVLIGMGERSSPQAVTQVARALFAGNGARRVIACQLPKARSSMHLDTVFSFLDVDFVSVYPDVADDIRCTSLYPGDDLGQIRYERHEDKFLAVVSGALGVGSLRVLTTGGDTYETEREQWDDGNNVLALDRRVVLAYDRNTYTNRKMRQAGVEVIEIPGGELGRGRGGSHCLSCPIERD

SEQ ID NO: 7150 - protein, 332 aa, Burkholderia cepacia; identical to SEQ ID NO: 4395

SEQ ID NO: 7151 - protein, 257 aa, Burkholderia cepacia; identical to SEQ ID NO: 4396

SEQ ID NO: 7152 - protein, 687 aa, Burkholderia cepacia
NPLLDFSDLPRFGQIRPEHVTPALDVLLADASAAVERAAQPITPASWADVVEPVERATEPLSRAWSVVGHLNAVADTPELRAVYGENLPRVTEFWSSVGQNLALYEKYKALHASSDFESLTGERKKILGNALRDFRLSGAELPEDQKPHFAELQERQAALSKAFSDHVLDATNAYAYIVEAGAEAQLAGLPEDVIEAAREATEREGKTGYKFTLHFPSYFPVMQYSENRPMREAMYRAYVTRASELGPQYGNGKPEWDNTAVLAEQLKLRAEEAHMLGYNNFAEVSLAPKMAESPAQVMSFLEDLATRARPHAEQDWKELREFAANELGMSELQPWDMTFAAERLRQKRYSFSENEVKQYFPEDTVFKGLFKVTETLFGVRIRRDKADVWHPDVRFFRVENQDGGLVAQFYLDLYAREGKRGGAWMDDARGRHRHTHGGVQTPVAYLTCNFSAPVGGKPACFTHDEVITLFHEFGHGLHHMLTRVDELGVSGINGVEWDAVELPSQFMENFCWEWDVLSDMTSHVETARPLPRELFDKMLAAKNFQSGLGTLRQIVFSMFDMQLHTDFDASGTKSVTELASEINERFHVVPQAPFSRWPNTFSHIFAGGYAAGYYSYKWAEVLSADAYAAFEEAAQSASGSVLDQATGMRYRKEILEVGGSRPAMESFKAFRGREPNIDALLRHNGM

SEQ ID NO: 7153 - protein, 280 aa, Burkholderia cepacia
MTAKLIDGLALSKTLRADVAARAAALTARGHQPGLAVVLVGDNPASEVYVRNKVKACHDNGLGSSFDRYPADLPEAELLARIDELNRDPRIHGILVQLPLPPHIDSHKVIEAIAPEKDVDGFHVANAGALMTGQPLFRPCTPYGVMKMLAAYEIPLQGANAVVIGRSNIVGKPMALLLLEAGATVTICHSKTRDLAAHTRNADVVVAATGLRNILTADMVKPGAAVIDVGMNRDEAGKLCGDVDFAGVKEVAGYITPVPGGVGPMTITMLLVNTIEAAER

SEQ ID NO: 7154 - protein, 286 aa, Burkholderia cepacia
  unsure (1)..(286): unsure at all Xaa locations
IQKVGVVGAGTMGNGIAQVCAVAGLQVAMIDISGAAVTDGLATIESSLERLVRKDKLSAADRAAALARVSGNTDYAALKGAGLIIEAATENPGIKLRILRQIDEAAEDDAIIATNTSSISITLLAAVLKQPERFIGMHFFNPVPMMALLEVIRGLQTSDETHAKTLAFAQTIGKTAITARNSPGFAVNRILVPMINEAIFTLQEGLATADDIDTGMRLGCNHPIGPLALADLIGLDTLLAVMQVFYEGFNDPKYRPAPLLREMVAAGRLGRKSGRGFHSYAXRAPL

SEQ ID NO: 7155 - protein, 380 aa, Burkholderia cepacia
ILMKRTCFDAGMEQFRDSARKFFAGEIAPHRERWREASVVDREAFRKAGEMGYLCMWIDECHGGLGLKDLRYEQILIEENIFHGDRGFFFWLHSRLVAPYLEHFGTDEQKQRYFPGIRSGEQILAIAMTEPDAGSDLAGMKTRAEETGDYWVLNGSKTYISNGLNADVVLVAARTHPTKAHGLTLFLVERGMEGFERGRNLRKMGLKSQDTAELFFHDVKIPKSHVLGQVHAGFQHLMRGLAEERLLAAIFNVASARLAMHLTCDFVRERKVFGKPLSSFQNTRFKLAALDTEIEVAQSWVDRLVAEHNADQLDAVDAARAKLFTSELNGRMVDEGVQQHGGAGYMDEYEICRLYQDERIHRILAGTSEIMKEIVARSIL

SEQ ID NO: 7156 - protein, 400 aa, Burkholderia cepacia; identical to SEQ ID NO: 4401

SEQ ID NO: 7157 - protein, 489 aa, Burkholderia cepacia
SIAVVCGEERLTWRELDIRTNQVANAIRALGFDKGDKIALFMPNSLALFELFWGVVKAGCVVVCLNTMLEGSALARITNSSDARAMFAGGSSRTLVDEVRDRLEGIAPEHFYSVDSPGDGWNSAQTLFDAAPSTPPQVTILPSDSMTIIYSSGTTGVPKGIEHTHFGRLNYPHGFAMGLAINRYSVAVCATPIYASGTWITMFPTMYRGGTVVLLPQYSPEAFIDAVRRERGTHSFLVPTQYIGLLQQPLQNYDLGSLKALVTAGQSLLPATYAALLRAFPHAGIYEVYGMTEGFSTLAIPEDVARGKTGSVGKPSFLDDVRIIDEQGRELPPGETGEIVAYGPGMMKGYYNRPDMTEAATWISPAGRTYMRSGDLGQMDEDGFLYVNGRLKDMIKSGGINIYAADLEQVVIEHPAVHEVAVIGVPHEKWSETPVAVVLLKPGASAEPDVLMRWVNQRLSKYQRLSLLLIRDELPRAIYGKVQKQALRE

SEQ ID NO: 7158 - protein, 245 aa, Burkholderia cepacia
IVTGGGGGIGGATVLRLLRTGANVLAIDISSRRLNGVKEEAAALPGRMEVLKADITAEQPVEQAVKLALELFGDLHGVANVAGGMPDYTGTDMDRPLESISLDYFHRMFALNVDSAFLMSKAATPHFRKKQYGKIVNVASLAAFANRPELGNAAYNPAKKAVIGLAETLSLLLGPDGIRVNTIAPGLVMSDKAKGALGDEYTQRHLKQVPLGRLATTSDLAEGIAFFLEPASDGITGETLRVAAG

SEQ ID NO: 7159 - protein, 241 aa, Burkholderia cepacia; identical to SEQ ID NO: 4403

SEQ ID NO: 7160 - protein, 237 aa, Burkholderia cepacia
NELTDTLIAITGGGSGLGEACAELLAPRVAELALIDRDPDSLASVRARLSGLCEISVHACDIANSDDVSTTFNRIERESRVVSTLINCAGMNVKDRHFGELTPDGWNQVIAVNLSGMYYCCQAVLSGMRRQQRGTIINVSSWAGRHAGFFTGPAYNASKRGVLALTESINLEEGINNVRATAVVPEAMATPMIRKIPNPPSEEAIAKMMRPLDVARMIDLIISLPQEMCVNEVVMSP

SEQ ID NO: 7161 - protein, 487 aa, Burkholderia cepacia
RMTYQQLGERVEALAARLIRTGVKRGEKVGVLMGNRPEWVISALAITSIGAVLVSLNSWATARELAYLLSHSGCRHLIATRRYLKYDYAVMLRDMDPAIRGRLATVIGVDADLPDGWLPFDDAADVARVEAGDAVRAAGEQVGSDDIAFLLYTSGSTSAPKGVQLAHGALIVNGWHIGERQRIVPGDRLWLAVSLFWALGCVNAMMNLLTHGGCIVLQEAFDAGEALHLIEAERCTVFYGTPNMAQALYDHPERERHDLGSLRTGGTLGSPEQIARVIKLGVSRVCNIYGLTETYGNSHVTSADDDEALRLVSCGQPLPGVEQRIVDANGIDLPPGEIGEIRVKGRVIDGYYGNEELTKASFDEQGYFRTGDLGYVDSQGYLYYRGRSKEMIKTGGINVSPADVESVLSAHPAIYLAYVVGVPDPVRDEEIGALVVLENGASMASDEILQYCSRISPLQGSPRLRFVSEGELPMTTTGKVQKNRLAE

SEQ ID NO: 7162 - protein, 241 aa, Burkholderia cepacia; identical to SEQ ID NO: 4406

SEQ ID NO: 7163 - protein, 827 aa, Burkholderia cepacia
MTLSRRAFIKQTAAATAASAAGVVLPGVDALAASDSLTWSKAPCRFCGTGCGVSVGVKNGKVVATQGDPQAEVNRGLNCVKGYFLSKIMYGQDRLTTPLLRMKDGKYAKDGEFAPVSWDQAFDVMADHFKRTLKEKGPTAVGMFGSGQWTVWEGYAAVKLMKAGFRSNNLDPNARHCMASAVTGFMRTFGMDEPMGCYDDIEQADTFVLWGSNMSEMHPILWTRITDRRLSTPTTRVVVLSTFEHRSFDLADQTIIFTPQSDLAILNYIANYIIRNGNVNRDFVNRHTVFKQGNADIGYGLRPDNPLQKTARNAGDPNGSQPITFDEFAKFVSKYDAAYVTKLSGVPQNKLDQLARLYADPKVKVMSFWTMGFNQHTRGTWANNMVYNLHLLTGKIATPGNSPFSLTGQPSACGTAREVGTFSHRLPADMVVTNPKHREEAEHIWKLPAGTIPDKPGYHAVLQNRMLRDGKLNAYWVQVNNNVQAAANINGEALPGYRNPQAFVVVSDVYPTVTAVAADLILPSAMWVEKEGAYGNAERRTQFWHQLVDAPAGARSDLWQLVEFSKRFKVEEVWPADLLAKKPEYRGKTLYDVLYRNGQVDRFALTETDSHYRNDEAKAFGFYIQKGLFEEYASFGRGHGHDLAPFDAYHKARGLRWPVVNGKETRWRYKEGSDPYVKTGTGWQFYGNPDGRAVIYALPYEPPPEVPDKEYPFWLATGRVLEHWHSGSMTRRVPELYRAFPNAVCFMHPDDAKAMGVRRGVEVKVMSRRGYILTRVETRGRDKPPRGLVFVPWFDSSQLINKVTLDATDPISLQTDYKKCAVKIVKV

SEQ ID NO: 7164 - protein, 343 aa, Burkholderia cepacia; identical to SEQ ID NO: 4408

SEQ ID NO: 7165 - protein, 924 aa, Burkholderia cepacia
TTCYMCACRCGIRVHLREGEVRYIDGNPEHPLNQGVICAKGASGIMKQYSPARLTQPLMRKPDAERGSAQFEPVSWEYAFDVLEKRLGAIRATDPKKFALFTGRDQMQALTGLFAKQFGTPNYAAHGGFCSANMAAGMIYTIGGSFWEFGGPDLDSAKLFFMIGTAEDHHSNPLKIAISKFKRAGGRFIAINPVRTGYAAIADEWVPIKPGTDGALFMAFLHELIAADAWDHEFVRRYTNAAELVDLDEASENFGLFVRDPERPVGNPLFPQNHLWWDADAARAVPHHTPGVNPALDGRFTLDDGTPVTPSFALLRERVADCTPEWAAAITGIAADTIRRLAGEMIQTSRDHRITLPIRWTDAWGETHETVTGNPVAFHAMRGLAAHSNGFQSIRALAVLMSLLGTIDRPGGFRHKSPFPRAVPPSAKPPNSPDAVKPNTPLATGPLGWPAAPEDLFIDDQGGPVRIDKAFSWEYPLAVHGVMHSVITNAWRGDPYPIDTLMIFMANMAWNSSMNTMKVREMLADRHANGEYKIPFLVVCDAFQSEMTAFADLILPDTTYLERHDAMSMLDRPISEFDGPVDSVRVPVVPPTGECKPFQEVLIELASRLKLPAFTTADGERRFRDYPDFVVNFTTTPDSGVGFLIGWRGKDGDKALVGEPNPKQWEQYAKNNCVFHYPLPETLQYMRNCNGPYLEWAVRNGFRKFGEPILIQLYSDVMQKFRLAAQGRTSGRQPPDHLRARVEKYFDPLPFWYAPLENTATDLVRFPLAAVTQRPMAMYHSWDSQNAWLRQIHGENYLYMNPLMAAENGIADGSWIYAESQWGRVRCMARFSETVEPGTVWTWNAIGKASGAWNLGPGANESQRGFLLNHLITDELPGRDDDAASRMSNSDPVTGQAAWYDVRVRIYPAEADARHTLPQFAAMP

SEQ ID NO: 7166 - protein, 296 aa, Burkholderia cepacia
  unsure (1)..(296): unsure at all Xaa locations
KVTKAVFPVAGLGTRFLPATKASPKEMLPIVDKPLIQYAVEEAMAAGITEMIFVTGRSKRAIEDHFDKSYEVEAELEARGKDKLLQLVRSIKPSHVDCFYVRQPEALGLGHAVLCAEKLVGDSPFAVILADDLLYGSPPVMTQMIEVFDHYHSSVIGVEEIPAQDTKSYGIVDGKEWEQSIIKMSGIVEKPEPSAAPSNLGVVGRYVLKPRIFKHLRTIKPGAGGELQLTDAIESLLADEQVLAYKYRGTRFDCGSKIGYLKATVEFAVRHPEVGVEFREYLEEYLSLLPMXTGVK

SEQ ID NO: 7167 - protein, 472 aa, Burkholderia cepacia
MKTYEQLYIDGKWIAPCGTGTIDVIDSGTEEIMGRIPEGVEADAESAIAAARVAFDAWAATPAAERGEYLRKVAANLKARTDELAGLIAGEVGMPLKLARAIQVGSPVYNWGAYAKLASEFQYEERVGNSLVVREPVGVVAAITPWNYPLNQVTLKVAAALAAGCTVVLKPSEIAPLTAFVLAEAIHEAGLPAGVFNLVSGYGPVVGEVLASHPSVDMVSFTGSTRAGKRVSELASATVKRVALELGGKSASVILDDADFAAAVKGTVSACFLNSGQTCSAHTRMLVPEARYDEARVLAKQAAETYVAGDPRNETSRLGPLASAAQQARVQQYIAKGIEEGAELVTGGVGLPDGLSKGFFVKPTVFGRVHPKATIAQEEIFGPVLSILTYKDEEEAVRIANDSPYGLGGAVWAGSDERAVGIARRIRTGQVDINGGTWNMAAPFGGFKQSGFGRENGVYGLEEYFELKSMQF

SEQ ID NO: 7168 - protein, 353 aa, Burkholderia cepacia; identical to SEQ ID NO: 4412

SEQ ID NO: 7169 - protein, 804 aa, Burkholderia cepacia
KLGTTLYRSIESATAFCKLRGNPYIELVHWLHQLLQQPDSDLHRLVRHCGIERETLDRDMARALAALPAGASSISDFSHHVELAVERAWVLATLSFNDRRIRSAWLVAALVQTPELRRVLLSISPAFGKLSVVGLDEALPAYMENSPEAAEAPYDNSNFSTAVPGEASHALPAQSKGSPLEQFCTDLTVRAHSGEIDPVVGRELEIRTMIDVLLRRRQNNPLLTGEAGVGKTAVVEGLACAIATGNVPPRLVGVRLLSLDVGALLAGASMKGEFELRLRGVLEAALKSAVPVILFVDEIHTLIGAGGQAGTGDAANLLKPALARGAIRMIGATTWAEYKRHIEKDAALTRRFQVLQVRQPQEPAAIDMVRGLANTFSRHHGVVVRDQAIRAAVRLSHRYIPSRQLPDKAISLLDTACARVALSQHAPPRELQDARQRVLAARVESELLVAESRIGLDTASALAAARTRIGELVAVEERIEARWKAQLAAAQALLAARDAALGADHGAPHTGANSDACASPDSLKDLERALTQLQGDAPLVFPEVSEAIVAEVVSDWTGIPVGRMVTDEVAAVQSLPATLEARVIGQPDALRQIGERVQTARAGLTDPKKPLGVFLLAGPSGVGKTETALALAEALYGGEQNLITVNMSEYQEAHTVSGLKGAPPGYVGYGEGGVLTEAVRRRPYSVVLLDEIEKAHRDVHEMFFQVFDKGYMEDGDGRYIDFRNTTILLTSNAGSELIASLCADAPLPPDAEGLREALTPALLNAFPAAFLGRVTVVPYRPLAHESLARIVRLHLDRVVTRMAQ

SEQ ID NO: 7170 - protein, 246 aa, Burkholderia cepacia; identical to SEQ ID NO: 4414

SEQ ID NO: 7171 - protein, 326 aa, Burkholderia cepacia; identical to SEQ ID NO: 4415

SEQ ID NO: 7172 - protein, 415 aa, Burkholderia cepacia
AFDYVDGVLHAEGVSAVSLAEQFGTPLYVYSRAALTAAWNAYAGACAGRRASVHVAVKANSNLAVLNVFARLGAGFDIVSGGELARVLAAGGKAENTVFSGVGKNANEMREALAAGVKCFNVESIPELDRLNAVAAEMGKKAPVSLRVNPDVDAKTHPYISTGLKSNKFGVAFEDARATYQAAAGMANLEVVGIDCHIGSQITEAAPYLDAVDKVLELVEQIEQDGLKIRHIDVGGGLGITYDDETPPEIGEFVRTVLDRIEARGHGHREVYFEPGRSLVGNAGVLLTRVEFLKPGAEKNFAIVDAAMNDLARPAMYEAYHAIDPVVKRDVPAHVYDVVGPVCESGDWLGRERLLAVEPGDLLAIRSAGAYGFVMSSNYNTRPRAAEVMVDGTQVHVARAREEVRQLFVGETILP

SEQ ID NO: 7173 - protein, 165 aa, Burkholderia cepacia
NVFFVGLMGAGKTTVGRAIARRLDRPFFDSDHEIEARTGARIPVIFELEGEAGFREREANVISELTARENIVLATGGGAVLRPENREALRNRGVVIYLRANPHDLWLRTRRDKNRPLLQTEDPKARLEALYEVRDPLYRECAHFVIETGRPSVNGLVNMVLMQLE

SEQ ID NO: 7174 - protein, 350 aa, Burkholderia cepacia
MITVNVELGERAYPIHIGADLIGQTALFAPHIAGSSVTIVTNTTVDPLYGDKLRAVLAPLGKQVSTVVLPDGEAYKNLETLNLIFDALLGARADRKTTLIALGGGVIGDMTGFAAACYMRGVPFIQVPTTLLSQVDSSVGGKTGINHPLGKNMIGAFYQPQAVIADIGALHTLPARELAAGVAEVIKTGAIADAGFFNWIEANIEALNRCEPAALAEAVKRSCEIKASVVAQDEREGGLRAILNFGHTFGHAIEAGLGYGEWLHGEAVGCGMVMAADLSVRMGYLDEAARKRLVDVIVAAHLPTRAPALGDSRYVELMRVDKKAEAGAIKFILLKRFGETLITQAPDAEV

SEQ ID NO: 7175 - protein, 1241 aa, Burkholderia cepacia
MHLLRTTPGGFVDDTQGVIRIDQQPADIVVLSSADTTLSLLASVFPRLGEGFPSVRLANVTYLRQPASVDFYVEDVLQHARVVVVDHLGGEAYWPYGIEQVVALAGRKQQMLAMFSGDLQEDPNLLARSTAGADLCHQLWRYLREGGPQNAEAFLRCIAHRAFGWGREPAPPRALPAATLYHPGRDTPTIADWQTRWQQNAPVAAILFYKAHLQAANTAVFDALIDALESQGLNPLPIAITSLKDALSREVVQSLCAEHDVSLVLNTTAFAASAIDDPEPLALAGDAPVFQVILSGGNREDWIKDNQGLNSRDIAMHIALPEVDGRIITRAISFKGLAYRCPHTQVDVVRYQPDAERVGFLAELSRRWCRLRSLDNADKKLALILANYPMSEGRIGNGVGLDTPASVVGILSMLRDEGYRLADLPANGDALLQKLTEGVTNDPVVRDLRPALQSLALDDYLAHFNALPAEARQALNARWGTPEQDPTLRRGRFMIAGWRCGQVFVGIQPSRSREQGDYASYHDAELVPPHAYLAFYFWLRHQFGIDAIVHVGKHGNLEWLPGKSVALSNACWPDLILGPMPHLYPFIVNDPGEGSQAKRRAQAVIIDHLMPPLTRAESYGPLQDLERQVDEYYEALMVDPRRSKLLRRTILATIVEHRLHEELSLAEPDGQDAEDALLTRVDAWLCELKEAQIRDGLHTFGQSPGGVQRRDTLLALGRFPVGDGQGGKAGLIDALARDLRMDHLFDPLSVDWSAVWDGPRPDVLERVSDAPWRHCGDTRERLELLAASLLRGVCGDRPDASAMPVADGLPQTERVIGRLRADVLPRLDACGPQEMLQLKRGLEGRFVPPGPSGSPSRGRPDVLPTGRNFYSVDTRAIPTQAAWSLGLKSAQQLIERHLQEKGDYPRAIGLSVWGTATMRTGGDDIAQALALLGVRPKWAPGSHRVTDFEIMPIEVFDRPRIDVTLRVSGFFRDAFANVMHLFDAAVQAVAELDEPEDLNPIRARVLRERDALIARGMDAAEARKRAGWRVFSARPGAYGAGLQDMIDSQQWQTDADLANAYQAWGGYAYTQKSAGEEARHAFGARLAALDVVLQNQDNREHDLLDSNDYYQFQGGMVAAVRHLAGNQPSVYHADHSNPAAPRVRTLHEEIARVIRSRVVNPKWLDGVKRHGYKGAAEIAATVDYLYGYDATARVIADHQYALVTDAYLNDADTREFLQRHNPHALHSICERLLEAMQRGLW

SEQ ID NO: 7176 - protein, 646 aa, Burkholderia cepacia
RAVCPHDCPDTCAMRVTVEAGRAIKVVADPEHPPTQGALCTKVSRYAERVHHPQRLTRPMKRVGRKGEGRFEPIGWDEAFQLAARRLSEIAHRAPEAILPYSYAGTMGLIQGDSIAQRFFHKLGASQLDRTICAAAGTAGLKYTYGASLGMLTEFFDESELILIWGSNPIASNLHFWTRAQQAKRRGARLIAIDPYRSLTAEKCHQHIALKPGTDSALALGMINVLIRENLLDHAYIEAHTSGFEALKARALSYPPSRAAEICGIDERVIVDLARLYGGTRKAAIRMNYGLQRVRGGGNAVRAIACLPSLTGAWRERAGGVLLSSGGWAPVDSYALQRPDLMPGWPTRTSRVINMNGIGDALLHKGDAAFGPKVEAIVVYNSNPVAVAPDSERVAAGFAREDLFTIVLEHFQTDTADYADLLLPATTQLEHLDVHKSYGHTHVMVNLPAIAPVGEALPNTEIFRGIARHMGLDEPALFESDETVAQAAFRWQDRTLEGVDWETLKKTGWAKLNLPDAPFAEGGFQTPSGKCEFYSERLAQRGLDPLPDYLPPYESADGAPELAARYPLAMISPPARNFLNSTFVNIESLRSTEGEPHLDMHPADAQSRDIVDGDQVRIFNDRGSMQARVRVTDKAREGLVVGLSIW

SEQ ID NO: 7177 - protein, 379 aa, Burkholderia cepacia
DLHTRIVRAEDQLTPGFESFSMPVTRASTVVFPDLATMRALDWKNDAQWRYGLHATPTSLALAQRLATIEGGNHALLQPSGLSSISNVYFGLVKAGDDVLIPDNVYSPNRDHGDWLARDFGVSVRYYNPMIGAGIADLIRPNTRLIWLEAPGSVTMEVADVPAITAVARAHNVVTAIDNTWSAGLGFRPFDHGVDISVQALTKYQSGGGDVLMGATITVDRELHLKLKAARMRMGIGVSSDDCSLILRSLPTMQLRFEQHDRAALGLARWLKTRPEIATVLHPALPDCPGHEFFERDFTGAGGLFSVVFDGRYSPAQIDTFCESLELFSLGWSWGGAHSLAMPYDVASMRTAGQWPHRGTLVRFYIGLETEADLRADIE

SEQ ID NO: 7178 - protein, 418 aa, Burkholderia cepacia
RHDGEYRWFDVRVVAMRDAEGNISKWFGSCTDIHSQREAIEERERLLASEQAARQIAEEANRAKDRFLAMLSHELRTPLTPVLAGASVLEMIPELPDQARASVRMIRRNVELEARLIDDLLDLTRVANGKLRLSLETVDVHDVMDSVLELFRSEIQVKQQDVHVHKNARHHYVLADRARLQQMLWNLIRNAAKFTPDGGHIYVRTRDERMHVQIAVEDTGIGIEPDQIGKLFNAFEQGNQNMTRQFGGLGLGLAITKALTDVHGGTVTAQSPGAHCGATFTITLPTATAPEVTSPVVVPDQVHPAGLLTILLIEDHVDTAEVMAQLIRSLGHEVTTVGRVDDALAATQSADFDLVISDVGLPDGTGLDFIKVFREHSDAPAVALTGFGTDEDVRRCLSAGFTSHLTKPVNFGQLETMI

SEQ ID NO: 7179 - protein, 278 aa, Burkholderia cepacia; identical to SEQ ID NO: 4422

SEQ ID NO: 7180 - protein, 758 aa, Burkholderia cepacia
ISAHTAELDIGGMTCASCAMRVEKALAKVPGVVSASVNLATETATVDLNGAAAGPDALIAAVRKAGYEAALVAPPDTPASANESAPADRKRDQTRRELAAVLASAVLTLPLIGPMVGEWFGFHAMLSPWLQFALASVVQFVFGARFYRAAFRAVRAGAGNMDLLVALGTSAAYGISVYELATHPGDMMHLYFEASAVVITLVRFGKWLEARAKRQTTDAIRALNALRPDRARIRVGAGERDVPLAQVRVGTIVIVRPGERVPVDGTVLEGRTHIDESLITGESLPVPKQVADAVTAGSINGEGAIAVTTTAIGAETTLARIIRLVESAQAEKAPIQRLVDRVSEIFVPAILAIAALTLAGWLIAGAAGETAILNAVAVLVIACPCALGLATPAAIMAGTGVAARRGVLIKDAEALETAHRVTIVAFDKTGTLTLGQPSVTAFEPIGGISRDEALALAAAVQRNSDHPLARAVVKAYEAEAAATAAAAEAADMPAAIGEAVASPTRTRALHASAARAVAGRGVEADVDGRTLALGSGRWLGELGIELPPEFAARARELEAAGNTVSWLMQRAPLAPVALALIAFGDTVKPTARAAVERLAQMGITSVLVTGDNRGSAASVARALGIDEFHADVLPEDKARVIRDLKIRSAGIVAMAGDGINDAPALAAADIGIAMATGTDVAMHAAGITLMRGDPALVADAIDISRRTWRKIRQNLFWAFVYNLIGIPLAAFGLLNPMLAGAAMAFSSVSVVTNALLLR

SEQ ID NO: 7181 - protein, 342 aa, Burkholderia cepacia
  unsure (1)..(342): unsure at all Xaa locations
MQSRCFARELAGPQRRPGRXKPMTXIVSFRGVRKTYDGETLVVKQLDLDIYQGEFLTLLGPSGSGKTTCLMMLAGFEFPTGGEIWLDGTLLNTVPPHKRNIGMVFQNYALFPHLTVEQNVAYPLTVRKISAQERAHRTNNALKMVRMESFAKRYPAQLSGGQQQRIALARALVFEPKLVLMDEPLGALDKQLREHMQYELKSLHEKLGVTFVYVTHDQGEALTMSDRVAVFDKGIVQQLDTVDRLYESPCNEFVANFIGDSNRLRGTIANVDGEYCEFRLSDGTRLTGRNIGGARAGTPAVACIRPERMKLANGLSRPGANALAGEARGLIYFGDHVRMRCG

SEQ ID NO: 7182 - protein, 250 aa, Burkholderia cepacia
MRFIRSLLLLIYFVLFTVPYATACFIAFPFMRADKRYWMAAGWCRATLHTVRWLNGIRYRIEGMENLPDGPAVLLSKHQSAWETLAFPALMPRPLCYVFKRELLYVPFFGWALGLLKMVHIDRKEGKYAFESVIKQGKARMAEGAWVIMFPEGTRTRTGTQGKYKTGGARFAIATGAPVVPIAHNAGRVWPRNSFLKYAGIVTVSIGKPIETTGLTPDEVNTRVERWIEAEMRRIDPTAYRAAESSSAAA

SEQ ID NO: 7183 - protein, 146 aa, Burkholderia cepacia; identical to SEQ ID NO: 4425

SEQ ID NO: 7184 - protein, 787 aa, Burkholderia cepacia
VVPFEQLRMTDVEIVGGKNASLGEMISQLAEAGVRVPTGFATTALAFRDFLQHNNLTERIAKRLETLDVDDVKSLAEAGKEIRQWIVEAPLQPQLEADIRAGFDTLQNSSPEELSFAVRSSATAEDLPDASFAGQQESYLNVVGIDDVLDRMKHVFASLYNDRAISYRVHKGFTHAEVALSAGVQRMVRSDVGAAGVMFTLDTESGFKDAVFITSSYGLGETVVQGAVNPDEFYVYKTTLAQGKYPIIRRSIGSKLIKMEFTKAGEEGRVKTVDVSHEQRNRFSITDEDVIELAKYAVIIEKHYERPMDIEWGKDGRDGKIFILQARPETVKSQAAGKAEQRFKLKGQSNVLATGRAIGQKIGAGPVRVIHDPSEMDRVQPGDVLVADMTDPNWEPVMKRASAIVTNRGGRTCHAAIIARELGVPAVVGCGDATDVLKEGALVTVSCAEGDEGKIYDGLLETEITEVQRGELPPIPVKIMMNVGNPQLAFDFSQLPNAGVGLARLEFIINNNIGVHPKAILEYPNIDQDLKKAVESVARGHASPRAFYVDKLTEGIATIAAAFYPKPVIVRLSDFKSNEYKKLIGGSRYEPDEENPMLGFRGASRYIADDFAEAFQMECIALKKVREEMGLDNVEIMVPFVRTLKQAERVVGLLAKYGLKRGENGLRLIMMCEVPSNAILAEEFLQFFDGFSIGSNDLTQLTLGLDRDSGMELLAVDFDERDPAVKFLLKRAIDTCLRLDKYVGICGQGPSDHPDFAQWLTDEGIKSISLNPDTIIETWQQLAKSTK

SEQ ID NO: 7185 - protein, 249 aa, Burkholderia cepacia
LTGKRGLVVGIANEHSIATGCATLFRAAGAELAVTYLNDKAEPFVRPVAQTLQSPLVMPCDVRVPGQLEAVFERITKEWGRLDFVLHSIAFAPADDLHASLVDCSAEGFALAMDVSCHSFIRMTRLALPLMPDGGSLMTVSFLGAERAVDHYNVMGPVKAALESSVRYLAVDLAARRVHVHAISAGAVKTRAASGIDHFDALLDDVRSHTPAKHLVTIEEIGRVATVLASEAGMTLTGSTIYADAGFHI

SEQ ID NO: 7186 - protein, 240 aa, Burkholderia cepacia; identical to SEQ ID NO: 4428

SEQ ID NO: 7187 - protein, 495 aa, Burkholderia cepacia; identical to SEQ ID NO: 4429

SEQ ID NO: 7188 - protein, 376 aa, Burkholderia cepacia; identical to SEQ ID NO: 4430

SEQ ID NO: 7189 - protein, 381 aa, Burkholderia cepacia; identical to SEQ ID NO: 4431

SEQ ID NO: 7190 - protein, 447 aa, Burkholderia cepacia
QDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRAAVQ

SEQ ID NO: 7191 - protein, 352 aa, Burkholderia cepacia
KLLNDTFLRALLRQPTDYTPIWLMRQAGRYLPEYNATRARAGSFLGLAKNPAFATEVTLQPLERYPLDAAILFSDILTVPDAMGLGLEFVTGEGPKFARPVRTEDDVARLAVPDIDATLRYVTDAVREIRTALTDAQGRQRVPLIGFSGSPWTLACYMVEGGGSADFRTVKSMLYARPDLMHRILDVNARAVAAYLNAQIEAGAQAVMIFDTWGGALADGVYQRFSLHYIQQVVSQLKRDHDGEKVPVITFTKGGGLWLDEIAETGVDAVGLDWTVNLSKARERVGGKVALQGNIDPSVLFAPPAAIRMEARAVLDSFGNHPGHVFNLGHGISQFTPPEHVAELVDEVHRHS

SEQ ID NO: 7192 - protein, 1309 aa, Burkholderia cepacia
MASTTLGVKVDDLLRSRLKDAATRLERTPHWLIKQAIFAYLEKIEHGQLPPELSGVAGSADLTEGAAVEHEEDGGSHPFLDFAQNVQPQSVLRAAITAAYRRPEPECLPFLLGQARLPANLAGDVQTMAGKLVETLRTKSKGGGVEGLIHEFSLSSQEGVALMCLAEALLRIPDRATRDALIRDKISKGDWKSHMGQAPSMFVNAATWGLMITGKLVTTNSETSLSSALTRLIGKGGEPLIRKGVDMAMRLMGEQFVTGENISEALANSRKYEARGFRYSYDMLGEAATTEADAQRYYASYEQAIHAIGKAAGGRGIYEGPGISIKLSALHARYSRSQQERTMSELLPRVRSLAILARRYDIGLNIDAEEADRLEISLDLLEALCFDPELAGWNGIGFVVQAYQKRCPFVIEYLIDLARRSRHRIMVRLVKGAYWDTEIKRAQVDGLEGYPVYTRKIYTDVSYLACAKKLLSAPDAVYPQFATHNAHTLSAIYHLAGNNYYPGQYEFQCLHGMGEPLYEEVTGRDKLNRPCRVYAPVGTHETLLAYLVRRLLENGANTSFVNRIADETVAIKDLIADPVDEASKIVPLGAPHAKIPLPRNLYGSERLNSMGLDLSNEHRLASLSSALLASAHHPWRAAPMLEDNEIAVGLARDVRNPADHRDLVGTVVETTPEHVSAALAHAVAAAPIWQATPVDARADCLARAADLLEAQMHTLMGLVVREAGKSLANAVAEIREAIDFLRYYSTQIREEFSNDTHRPLGPVVCISPWNFPLAIFMGQVAAALAAGNTVLAKPAEQTPLIAAQAVRILREAGVPAGAVQLLPGNGETVGAALVADPRTRAVMFTGSTEVARLINKTLSSRLDPDGKPIPLIAETGGQNAMIVDSSALAEQVVADVLQSSFDSAGQRCSALRVLCLQDDVADRTLEMLTGAMRELAVGNPDRLSVDVGPVIDLDAKRGIDAHVAAMREKGRKVEQLPMPDGCAQGTFVPPTLIELDSIDELKREVFGPVLHVVRYRRSQLDKLLEQIRATGYGLTLGIHTRIDETIAHVISRAHVGNIYVNRNVIGAVVGVQPFGGEGLSGTGPKAGGALYLQRLLATRPAGLPKSLARALVVDVPRAAENGDNPSAVLTAYRDWLITEREPQLAARCDGYLSHVPAGATAVLSGPTGERNTYTLGARGTVLCIASTASGARVQFAAALATGNRALFEGAAGEQLVSQLPASLKSHASVKKSADTPFDAVLFEGDSDELLALVKEVAKRPGPIVSVQGVAARALESGDEDYALERLLTERSVSVNTAAAGGNANLMTIG

SEQ ID NO: 7193 - protein, 539 aa, Burkholderia cepacia
TGARLVVDALLTHGVERVFCVPGESFLAVLDSLHDETERIQTIVCRHEAAAANMAEAVGKLTGRPGVAIVTRGPGATHASIGVHTAFQDSTPMILLIGQCAREHLDREAFQEIDYRRMFGQMAKWVAQIDDPKRIPEYLSHAFHTATSGRPGPVVLSLPEDVLSDACNAVAGAPAYQRVAASPSTAQIEKLRGLLEGAQRPMVIAGGSGWTPAACADFQRFVENWQLPVGLAFRFQDTLDNEHPNYAGDVGLGINPALTQRIREADLLLAIGPRLGEATTNGYTLLDIPKTKQTLVHVHQGAEELGRVYAADLPIVSGMPELAAMLAELEPSSEQLAWSGAASEAHRAYLDWRKPRRIPGDVQMGEVIQQLRAHLPDDAILTNGAGNYATWLHRHFSYRHYRSQLAPTSGAMGYGVPAAIAAKSMYPQRAVVALAGDGCFMMSAQELATAMQYDLHVLFIVLNNSQFGTIRMHQERHYPDRVHGTGLTNPDFAAFARSFGAHGETVERTEDFLPALKRSIEAKRAAVIEIRMPQEASTP

SEQ ID NO: 7194 - protein, 119 aa, Burkholderia cepacia
SIPADLKYTESHEWVRTEADGTLTVGITDHAQEALGDIVFFEVQELGKTVSAGDTVAVIESVKAASDIYAPVSGEIIEANSAVADTPDLVNSTPYESWLFKIKPAADAALDRLIDADAY

SEQ ID NO: 7195 - protein, 690 aa, Burkholderia cepacia
LNPAQNEAVRYLDGPCLVLAGAGSGKTRVITQKIAHLIEAKGFEPRHIAAVTFTNKAALEMRERVGKLLEGKTLTTPGKEGRKVPVNQLTVCTFHSLGVQILRQEAEHVGLKPQFSIMDSDDCFGMIQEQVGSTDKGFIRKIQSIISLWKNGMIMPEQAIAIAANEDEHQAAIVYRNYVATLHAYQAVDFDDLIRLPAELFAKNEQVRDRWQNKLRYLLIDEYQDTNACQYELVKLLAGKRAAFTAVGDDDQAIYGWRGATLENLGQLSKDFPKLHLIKLEQNYRSTVRILTAANNVIANNPKLFEKKLWSEHGMGDTITVTPCNDEEHEAESVVFRLSAHKFERRANFRDYAILYRGNFQARIFEQVLRRERIPYVLSGGQSFFDKAEIKDICAYLRLIANANDDPAFIRAITTPRRGVGNTTLEALGSFAGQAKVSLFEAVYMGGIEARLSPRQIEPMRVFCDFMQRLTDRAEKDAAGTLLDELMDAIHYEAYLYDAFDERQAQSKWQNVLEFMEWLKRKGTKAEPTGAAANEATGYDTADGLGDTGKSLLGLIQTVALMSMLEGREEDPDAVRLSTVHASKGLEYPHVFLVGVEEGIMPHRGGPDDEPIDDARIEEERRLMYVAITRAQRSLHLNWCKKRKRARETVVCEPSRFIPEMLLDDAPPPTPEEAPMSPKDRLASLKALLQ

SEQ ID NO: 7196 - protein, 247 aa, Burkholderia cepacia
QPMQALPAVLSPGETAFFFDFDGTLVELAPTPDGVLVQPRVIDLLSELRSLTNGAVAVVSGRGIDSIDSFLGIPDLPIAGLHGAERRDANGDTQRIGFHDERLLRMEQVLAQVVNENPGMLLEIKGAAVALHYRNAPDREPVAREATSRLVADYAGAYVLQPGKMVYEIKPKDVDKGRALRAFLDEPPFVGRQPVFAGDDLTDEKGFAVVNERGGLSIKVGPGETMARTRIDSVPALLDWLASIVAA

SEQ ID NO: 7197 - protein, 458 aa, Burkholderia cepacia
MGRLIIVSNRVAPISEGGPAAGGLAVGVYDALKETGGMWFGWSGDVLSSGQPQIKVEERGPVTFATIALMRRDYDQYYRGFSNATLWPAFHYRADLLQYDRHDFEGYWRVNAWLAQQLVPLLREDDVIWVHDYHLIPFAQALRAAGVKNRIGFFLHIPFPASQVLLAVPPHRELVEALCSFDLLGFQTAPDLRAFCDYIVNEANGTADPSASGPLTIHAFGRTLRAAAYPIGVYPDEIAELAKAGERGKPVRTMKATLHSRKLIMSVDRLDYSKGLVERFRAFERLLEHSTAQRNKVSFLQIAPPTRADMHAYQDIRLQLEGESGRINGRFAELDWTPILYIHKQYERSVLAALFRTAHVGYVTPLRDGMNLVAKEYVSAQDPENPGVLVLSRFAGAAQELDGALIVNPVDIDGMAEALARALDMPLAERQARHRDMMVQLRENNVSVWRDNFMRDLQ

SEQ ID NO: 7198 - protein, 476 aa, Burkholderia cepacia; identical to SEQ ID NO: 4439

SEQ ID NO: 7199 - protein, 567 aa, Burkholderia cepacia
FRHWAQQPWRIVVITALVLLSALADVLTPMFAGHLVDAIASGAASNAVAWRAAVTAFCVLGALGLGATLLRQGVYFNIIRLTLRMMSEIAANAFHRVQRFSTDWHANSFAGSTVRKITRGMWALDLLNDTLLIALFPSLVMLVGATVLLGWRWPMMGAVVGIGSLLYIAVTAAMSLGFVAPAARLANAWDTRMGGALADAVSCNGVVKAFGAEDREEALLARVIGKWRHRTRRTWMRGTINGGVQGGMLVAIQAAILGAALLLWARGEASVGDITFALTMFFMLQGYLRDVGMHIRNLQRSVNDMEELVSLESQPLGIEDPPGAGPIAIGKGEIRFEHVTFHYGTNGQPLYDNFSVRIAPGERVGLVGHSGSGKTTFIKLIQRLYDISEGRITIDGQDIAKVRQASLRSQIAIVQQEPVLFHRSLAENIAYARPGASRAEIEHAARLASAHDFIAALPNGYDTLVGERGVKLSGGERQRVAIARAFLADAPILILDEATSSLDSESEVLIQQAMERLMMGRTTLVVAHRLSTVRALDRLLVLDKGKVIEEGSHEALIRLENGLYRRL

SEQ ID NO: 7200 - protein, 254 aa, Burkholderia cepacia
VPAFDDNYIWVVSDGHSAVVVDPGEAAPVQAYLAKRGWRLSAILLTHHHQDHVGGVADLLNGQAVPVYGPAGEAIEHLTHRLKNGDHVSIAAPALELSVLDVPGHTSGHIAYFQAADPRGTPHVFCGDTLFACGCGRLFEGTPKQMLASLDALAALPGATEVHCAHEYTLSNIRFALACEPANAELQAWRDKAGELRARGVPTLPTTIAHERAVNPFLRAGNPAVQASLREQLHEKVPDRLTAFTLMREWKNRF

SEQ ID NO: 7201 - protein, 371 aa, Burkholderia cepacia
PALLALADGTVFRGYSIGAPGHTIGEVVFNTAITGYQEILTDPSYARQIVTLTYPHIGNVGVNAEDVEAAKVHAAGLIIRDLPVLASNFRMERTLQQYLQDEGVVAIAGLDTRMLTRVLRDKGAQNGAILAGSDDEARAIELARSFPGLSGMDLAKVVSTKESYEWTQTEWRLGSGYGTQNAPKYRVVAFDYGVKYNILRMLAERGCHVTVLPAEASAADALALNPDGVFLSNGPGDPEPCDYAIRATKELIDRGIPTFGICLGHQIMGLAVGAKTMKMKTGHHGANHPVKDLDDGRVVITSQNHGFAVDADTLPANARVTHVSLFDGTLQGFTLTDKPAFCFQGHPEASPGPHDIAYLFDRFTALMDTKK

SEQ ID NO: 7202 - protein, 1083 aa, Burkholderia cepacia; identical to SEQ ID NO: 4443

SEQ ID NO: 7203 - protein, 631 aa, Burkholderia cepacia
NNMFSKAAVWLVIALVLFTVFKQFDKPRVQEGVSYSQFMDDAKNGKVKNVIVQGRNLTVTPADGQKYQIVSPGDIWMVGDLMKYGVQVSGKADDEPNALVSALYYLGPTILIIGFWFYMMRQMQGGGKGGAFSFGKSRARLIDENNNAINFTDVAGCDEAKEEVSELVDFLRDPQKFQKLGGRIPRGVLLVGPPGTGKTLLARAIAGEAKVPFFSISGSDFVEMFVGVGAARVRDMFEQAKKHAPCIVFIDEIDAVGRHRGAGMGGGNDEREQTLNQMLVEMDGFEANSGVIVIAATNRSDVLDKALLRPGRFDRQVYVGLPDIRGREHIMKVHLRKVPISNDVDAAVIARGTPGFSGADLANLVNEAALFAARRGKRIVEMTDFEDAKDKIFMGPERKSAVIREESKRATAYHESGHAVIAKLLPKADPVHKVTIIPRGRALGVTWQLPEHDNETYSKDYLLDRLAILFGGRVAEELFLNLISTGASDDFNKATQTARAMVARFGMTDALGPMVYVDDENDATPFGRGFTRTISEATQQKVDAEIRRVLDEQYNLAKRLLDENRDKVEAMTAALMEWETIDADQINDIMAGRPPRRRRVRRRRQPTPRRAAARVPRSSPVAQRRRPDRRP

SEQ ID NO: 7204 - protein, 303 aa, Burkholderia cepacia; identical to SEQ ID NO: 4445

SEQ ID NO: 7205 - protein, 350 aa, Burkholderia cepacia; identical to SEQ ID NO: 4446

SEQ ID NO: 7206 - protein, 181 aa, Burkholderia cepacia
WHGASLMSAARGAVIWMTGLSGAGKSTLANALHLRLKEAGQAAIVLDGDVLRRGLNADLGFTPEDRTENLRRVAHVAALFMQQGFVVIAAVISPEHRHRRAAREIVGEGFVEVFVNAPLQVCEARDAKGLYARARRGEIAHFTGISDPFEAPLAADLVIETDRMPVNEGVDRLLAHLVTMG

SEQ ID NO: 7207 - protein, 483 aa, Burkholderia cepacia
VMSESATVFKNLIAGEWTESVSGKTFANINPADTRDVVGQFQASVVADAQAAIQAASSAFAQWRRTPVTARARIVNKAADWLESHADTFAQELTREEGKPLAQSRDEILRSAQVLRFYAVEAQSFTGETFPSDDPEQHVYTQREPLGVVTVITPWNFPISIPARKIAPALMAGNTVIFKPSSDAPLIGYRLAEAFAQAGIPAGVLNFITGRASDIGAAITESPVVRAISFTGSTAAGEHIHRSVPITTRTQMELGGKNPLIVMDDADLDRAVDLAVKGGLSLSGQACTGTSRILVMESVRETFTAKLVERVKSLKIGSGVTPGMDLGPLANRKQLESVLGYVASGKEQSTHLIGGEQLTGEGFEHGYYVTPAVFSDVPESARIYREEIFGPVLAITSVTGYDDAIAKANDTEYGLSAAIATSNPRYMHRFADEIEAGTVKINRTTTGNVINAPFGGLKRSSTSTFRESGRAGLEFYTQIKTVY

SEQ ID NO: 7208 - protein, 362 aa, Burkholderia cepacia
ESNLDMIGFIRDYLGELGVGSELFYNAGRTKANLFATIGPRERGGIVLSGHTDVVPVDGQAWTVDAFRLTERDGRLYGRGTADMKGFIASVLAAVPVFLERELKLPVHLAFSYDEEVGCLGVRPMLAELERRPHKPALCLIGEPTELKPVLGHKGKLAMRCHVKGAACHSAYAPYGVNAIQYAARMIGHLEEIGEQLARPEHHDERFDPPFSTVQTGVIKGGHALNIVPAECEFDFEVRALPGFDAHQVADELQTYAEAELLPKMRAVKSDTDIRFQSLSAYPGLATSPDSEAARLVALLSGSTEFGTVAFGTEGGLFDQAGIPTVVCGPGSMDQGHKPDEFVSVEQLRQCDAMLIRLADHL

SEQ ID NO: 7209 - protein, 755 aa, Burkholderia cepacia
VVIIDEDFRSENISGSGIRALAEAIEKEGAEVLGLTSYGDLTSFAQQSSRASCFILSIDDDELLPYVDNVVVEGETPELAAAIVALRAFVTEVRRRNADIPIFLYGETRTSRHLPNDILRELHGFIHMFEDTPEFVARHIIRETKVYLDSLAPPFFKELVQYAEEGSYSWHCPGHSGGVAFLKSPLGQMFHQFFGENMLRADVCNAVDELGQLLDHTGPVAASERNAARIFSADHVFFVTNGTSTSNKIVWHGTVAPGDIVLVDRNCHKSILHAITMTGAIPVFLTPTRNNFGIIGPIPRSEFEPENIKKKILANPFAREALAKNPDLKPRILTITQSTYDGVIYNVEMIKEMLGDWLDTLHFDEAWLPHAEFHEFYQDMHAIGAGRPRIGAMVFATHSTHKLLAGISQASQIVVQDSKNSRFDKHRFNEAYLMHTSTSPQYAIIASCDVAAAMMEAPGGTALVEESIAEALDFRRAMSKVDAEYGDDWFFKVWGPDQFAEEGIGSREDWMLRPNDPWHGFGPLADGFNMLDPIKATIVTPGLDMDGGFGESGIPAAIVTKYLAEHGIIVEKTGLYSFFIMFTIGITKGRWNSMVTELQQFKDDYDNNQPLWRVLPEFVSHHPMYERVGLRDLCEQIHSVYRANDIARLTTEMYLSSMEPAMKPSDAFAKLAHREIDRVPIDELEGRVTSILLTPYPPGIPLLIPGERFNRTIVNYLRFAREFNERFPGFHTDIHGLVGETINGRIEYFVDCVRA

SEQ ID NO: 7210 - protein, 482 aa, Burkholderia cepacia
SRWLQVFDQTRDAISVLLPLLLIGGMVWFMRREMRGGARLLDRAPALRFDDVIGASEAKAALADIRSYLSDPKQFTSMGVRAPCGILMVGGPGVGKTRLAQALAGECGANFISITGSYFSAKYYGVGIQKVKHLFELARKNAPTVIFIDEADGLAKRTDTGSGPVEAESNRIINQLLAEMDGFASNEGVIIVAATNHPDNLDEALRRPGRFDRTVQVRLPDREDRAKIFRFYAAKLKSKSADIDYDQLARLTTGLSPATVAMVVNQAGLVARKSGDTEIASKHFMEAIKIARIGDVSGAERALSEDERTRIAVHEAGHGLVAALLGTGVLEEVTILPRGGALGVALITKAQDKHLYRESEIRNEIQVLLGGRNAEIISFSEASSGAASDLQEASRISLDMVSKFGFNADGNLFSLAALPSQYAGLQMKGAIEHANVLLKELNESCHALLHAYEPVLRAIADELLEQETVPGETVYRLIREHK

SEQ ID NO: 7211 - protein, 819 aa, Burkholderia cepacia
KLPYTSRVLAENLVRRCDPVTLVASLKQIIERKRELDFPWFPARVVCHDILGQTALVDLAGLRDAIAAQGGDPAMVNPVVPTQLVVDHSLAVECGGFDPDAFAKNRAIEDRRNEDRFDFINWTRRAFRNVDVIPPGNGILHQINLERMSPVVQVKDGVAFPDTLVGTDSHTPMVDALGVIAVGVGGLEAESVMLGRASYMRLPDIVGVELTGKPGEGITATDVVLSLTEFLRKEKVVGAYLEFFGAGTANLTLGDRATIANMSPEFGATAAMFYIDEQTIKYLKLTGRDDELVKLVETYAKETGLWADSLKHAEYERVLKFDLSTVVRTLAGPSNPHRRLPVSELAARGISGKVENEPGLMPDGAVIIAAITSCTNTNNPRNMIAAGLLARNANRRGLTRKPWAKTSLAPGSKAVTLYLEEAGLLHDLEQLGFGVVAYACTSCNGMSGALDPAIQKEIVDRDLYATAVLSGNRNFDGRIHPYAKQAFLASPPLVVAYAIAGTIRFDIEKDVLGIDADGHAVTLKDIWPSDAEIDAIVASSVKPEQFRKVYEPMFAVTVDTGEKASPLYDWRPMSTYIRRPPYWEGALAGERTLKGMRPLAVLGDNITTDHLSPSNAILPDSASGEYLAKMGLPEEDFNSYATHRGDHLTAQRATFANPTLKNEMVLEDGKVKAGSLARIEPEGKVTRMWEAIETYMERKQPLIVIAGADYGQGSSRDWAAKGVRLAGTEAIVAEGFERIHRTNLVGMGVLPLEFKPGVNRLTLGIDGTETFDVIGERKPRTDLTLVIHRKNGERVEVPVTCRLDTAEEVSIYEAGGVLQ

SEQ ID NO: 7212 - protein, 388 aa, Burkholderia cepacia; identical to SEQ ID NO: 4452

SEQ ID NO: 7213 - protein, 468 aa, Burkholderia cepacia
SGNGESFESINPIDGSVAATLAQASESDVDDAVRAARQALETPAWRDMKVHERGKLLHRFADLIDQNAETLAQIQTRDNGKTISESRFQSKSAADMFRYFAAVCETTESSVIPSRGNYFCFSSFEPVGVVAAIAPWNSPITLEAQKLAPALAAGNAIVLKSSEVTPCIGLQYGRLAMEAGFPPGILNVVTGFGASVGRALVAHPGVDMVTFTGGTKSGREIAKVAGERLIPCILELGGKSPNIVFDDADIEQAVTGMLFGIFSNAGQSCIAGSRILIQEGIYDAFVARLTSATRALKVGSPYDADTAVAPVSSFHHRDHIEHFVERALSQGAVALCGGSRPSGGILDKGAYVQPTLLEVTDERSSVAHEEIFGPVACVMKFQDEEDLYRIANNTAYGLACGIWTADYKKAFRAARRIKAGTVWVNTYKIAEVNVPFGGFKQSGLGRECGIEGMREYMLEKSTYLNLAD

SEQ ID NO: 7214 - protein, 432 aa, Burkholderia cepacia
  unsure (1)..(432): unsure at all Xaa locations
GDAHEADEXLTYQTGFGNEFSTEAISGALPIGQNNPQKPAFGLYAEQLSGTSFTTARATNLRTWMYRIRPSVLQGTYRLIRKDSNALAPLDVAPLPEAQRWNPQPLPDTPVDFVDGLNTLAISGDPATLSGAAVHLYAATIDMDRKAFVNTDGEMLIIPQQGTLCLITELGMLTAKPREIAVIPRGLKFAVHLPDGPSRGYVCENHGSAFRLPDLGLIGASGLANRRDFLTPVARFEDSDAAHELIAKTGGQLWSTTLDHSPFDVVAWHGNVAPYKYDLDRFQSIGSISFDHPDPSIYTVLTSPSDTPGTANADFCALTTRWAVAEHTFRPPYFHRNVMSEFMGLICGAHDAKAGGFVPGGASIHNAFTPHGPDAETYRRARDTTLEPHKITESIAFMFETRLPLRLTAWAVQTPQRQHDYQQCWSALAKQF

SEQ ID NO: 7215 - protein, 368 aa, Burkholderia cepacia
ESLTQQAGDVGAVVMGPRSSGGVAMDKPQAIKFTGGTTGFPKGVIQPLRAWNTNIATQIHELGLKPDDRYLVAAPLSHGTSTYLLPLLGVGGALIIPPEQAKAAALLDAADAHGATILFAPPTLIVALAEEQRRSPRLLRRLRYLVYGGAPMRAEQIRDAQSVFGPVLCTTFGQTEAPQIITFLPPAEMNGDTLTSVGRPSLLTRVAIMNKDGEPVETGQQGEIAVRGDLVMSGYLKAEDETRKTLVDGWLRTGDAGVFDERGYLFLRDRIRDVIITGGFNVYPSDVEAVLSAHPAVADCSVVGVPDAKWGEAVHAAVQLRSGMQVDTADLVALVRRELGPVKTPRHVHLFESLPRSAVGKVLKTEVR

SEQ ID NO: 7216 - protein, 325 aa, Burkholderia cepacia
GLDKLVRREVPRPVPKAGEIVVEVNAVSLNYRDAEVAENGMGNALSFPFTPASDMAGRIVAVGEGVTRFAVGDRVISAYIPGWIDGVPLSWTVAPTQGGPIPGVLAQYVAAPAEWCVRAPRTLSAVEASTLPVAALTAWMALVELGNLHAGQTVVVQGTGGVSLFAVQLAAAHGARVIVTSGSDEKIARAIALGARHGINRNTTPDWQHAVLELTGGRGADHILEMTGGDNVERSLQAVVQGGRISVIGLLDSDRLSLPILSLLASRASIVGIAVGPRRALEDLVRAVDLLGIRPVIDATYAYSQVPEAFVHLRRGAFGKIVVQL

SEQ ID NO: 7217 - protein, 458 aa, Burkholderia cepacia; identical to SEQ ID NO: 4457

SEQ ID NO: 7218 - protein, 532 aa, Burkholderia cepacia
YDYIIVGAGSAGCVLANRLSESPSNKVLLVEAGAGDRHPYIGIPKGIAKLRMHPKYSWRLPTEPTLGRAQGEFWPRGRVIGGTSSINGMFYIRGQPEDYDEWETLGAKGWGWKDIAPCFRKMEDHELGETPLRGVGGPLHVTLPYHEHPPLNEAFLQAGEQIGLPRKEDLNQGDQAGIGYYPVNMWKNRRWSAADAHLRPALKRPNLTVLKGVHVDRVLFDGLRAVGIAARIGDARKEFRSRGEIILSAGTLKSPQILQLSGVGPGDVLRAAGVPIVADRADVGRNMLEHLSMTVVNRLVGTAGENREYRGWRLAKNALKYYVRRNGVLSYSTFPIGGFARSSPELERADIQFFLGGLSFEMGGLKSVAARVQTGKLPGLTCFAYFMKPESRGSVAISSADPDAPAVIRPNWLDTENDRQAAIRVVRFMRRIVHAPALKSYVGDEVMPGPATSDDDDALLAAYTRFGSTANHAVGTCRMGGDAASVVDGRLRVRGVENLRVVDCSVIPTPISGNTNGPVMALAWRAADLILQ

SEQ ID NO: 7219 - protein, 420 aa, Burkholderia cepacia
LLCVIGFGLFLEFFDLYTGGAIVGVLLKQGWSTLQLNALFGTLTFAGLTVGAMMAGIIGDRYGRRLAYQINLVVFGIASFAAAVAPDMYWLSAIRFMMGLGIGAEAVISYGMLGEFVPPGFRGRMLAFLSVFGNSAVFVGSLVNLWVIPHLGWRYVFVIAGILAITLWIVRRSIPESPRWLETKGRIDEAEVVLQRIERSVARGGELPSYAHEVPAPTPQVSIGVLFTPPILVRTLVGSAILVCIGFSIYGLINWLPTFFIQQGFDIVKSLTWTTVITLGGPVGSLLGVAVSDRVGRRPAIIASCVVTAVCGLIYQQVDSAFALMGVGFLLVCSIYVLVAVGQGAYVPELFSTSYRLRGTGVCMTAGRLASAGCQFFILWLFTKGGVLMVVGSVVAAQLLLAFAVWAIRIETRGKRLEDL

SEQ ID NO: 7220 - protein, 256 aa, Burkholderia cepacia
RFDNKVVMVSGCGSSLPGWGTGKAIAALLARQGAQVVGLDVNEQALADTRAVIEGEGGKLKALLCDVTDPASIDRVVRETIDAYGRIDVLVNNVGVSAPGGVVDMTEEIWDRQFDINLKSVFLMCKAVLPLMDRQRGGNVVNVSSLSALRYSGKPQIAYSASKAALIQFTRMAALMHSEHNVRLNCVIPGLITTPLVQRLAQQFGGGDYESYLKRRNAQVPLAQEGDAWDVANATAFLASDEARYITATEILVDGG

SEQ ID NO: 7221 - protein, 261 aa, Burkholderia cepacia
AGRLQGKVALVTGAGCIGPGWGNGRAIAVRFAEEGAHVIAVDRDLASMDATLELVRAAGGSVTPCLCDVTDSASVERLVADSVARCGRVDILVNNVGAPSPGGPVALDEAQWAMQLELNLTTAFLMCKYVLPVMEQQGGGAIVNIASTSGIRWTGAAQVGYAAAKAGMIQMGRVVAVEYAAKNVRVNSVVPGLLHTPMVDTKIAHNQAGGDVELLLRKRQARIPMPFMGDGRDTANAALFLASDEARFVTGTEIVVDGGMS

SEQ ID NO: 7222 - protein, 592 aa, Burkholderia cepacia
SYTAPIKDMLFVMKELAGLEHIATLPGFEDANLDTAQAVLEESAKLCSEVLAPLNVEGDRNPSSWKDGVVTATPGFREAFRQFGEGGWQGVQHPVHYEGQGLPKLIATACIEMLNASNLSFALCPLLTDGAIEALLTAGSEEQKQTYVPRLISGEWTGTMNLTEPQAGSDLALVRTRAEPQGDGSFKLFGTKIFITWGEHDMAKNIAHLVLARTPNAPEGVKGISLFIVPKFLVNEDGSLGERNDVHCVSIEHKLGIKASPTAVLQFGDHGGATGHLIGEENRGLEYMFIMMNAARFAVGMQGIGVSDRAYQKAVAYAKDRVQSRPVDGSAKQPVAIIQHPDVRRMLATMRGLTEASRALAYVAAAHCDIAHRHADEATRAQHQAIYEYLVPIVKGWSTELSIDVTSLGVQVHGGMGFIEETGAAQYYRDARILPIYEGTTAIQANDLIGRKTVRDGGKVAKSLLAGVAETVEALGAQQGPAFASMKKYLAQGHRSLSAVVEFVVANTKSDPNAVFAGSVPYLKLAGIVLGGWQMARALLVAAEKRDEDPSFYGAKIATAQFYAEHVLPLASALEASIVSAKGGESVLALSE

SEQ ID NO: 7223 - protein, 275 aa, Burkholderia cepacia; identical to SEQ ID NO: 4463

SEQ ID NO: 7224 - protein, 460 aa, Burkholderia cepacia
MKITIIGTGYVGLVTGACLAEIGHDVFCLDVDPRKIEILNNGGVPIHEPGLQEMIARTRAARRITFSTDVEAGVAHGDVQFIAVGTPPDEDGSADLQYVLEAARNIGRTMNGFKVIVDKSTVPVGTAQRVRAVVEEELAKRGLAGSAQHGFSVVSNPEFLKEGAAVDDFMRPDRIVIGLDEDEAGSRARELMKRLYAPFNRNHERTLYMDVRSAEFTKYAANAMLATRISFMNEMSNLADRVGADIEAVRRGIGSDPRIGYHFLYAGCGYGGSCFPKDVQALIRTASESGHNLRILEAVEEVNDRQKDVLVHKITSKLGNDLSGRTFAVWGLAFKPNTDDMREAPSRRLIAELLARGAHVRAYDPVAVTEARRVFAIDLHDAPEQFARLTFATTQDETLTGADALVIVTEWKEFKSPDFVHLKSVLKSPLIFDGRNLYEPDAMTELGIDYHSIGRPYAQP

SEQ ID NO: 7225 - protein, 424 aa, Burkholderia cepacia
LWRKNFLLGAATASYQIEGAVNEDGRLPSIWDTFSAIPGKVLAGDTGAVACDHYHRWEADVDMLAGLGFEGYRLSIAWPRVMDTAGVPNRKGLEFYKRLLARLKEKGIATFVTLYHWDLPQHLEDRGGWLNRDTAYRFADYADLMSRELAGSVDGWMTLNEPWCSAYLGYGNGHHAPGLADARYATQAMHHLLLAHGLAMPVLRANDPASQKGVVANIGRGTANSGSAADQRAAHLFEVQHNAWILDPLLEGRYPRDLFELWPGTEPLVLDGDMQTVAAPLDFLGINYYFRTNVASDGAHGFREVPLQGVERTQMGWEVYPDGLRDLLIGFKATYRNLPPIYITENGMASDDKVIDGRVDDMQRISFLKRHLAAVDEAIKAGVEIRGYFLWSLMDNFEWAFGYERRFGVVHVDYATQKRTVKRS

SEQ ID NO: 7226 - protein, 494 aa, Burkholderia cepacia
IRILSEVETFLARQHRQYIDGQAVAAMDTVATDIINPSNRKVVASVRQATPAQVQHAVASAHEAFTGVWQQTSAARRGELLNRLADLMQAHREELAQIESLSSGKLIGLSRAFEIDYSIAFLRYYAGWATKIHGQTMNLSLPSSNGEQYTGFTLRQPIGVVAGIVPWNFSIMIAVWKFGSALACGCTAVIKPSEFTPLTMLRVAELALEAGIPPGVLNIVNGNGRTVGTALIAHPKVAKVTFTGSVPTGVGVGVAAMQAGLKHVTLELGGKNPAGFLRDFPVERTVDGIIEAAYLHQGEVCASAERFYVHRSRIDDVLEALHHTLATLKIGSALDESAQFGPLANAAHFAKVMAFFEKARAQDGEIVHGGTVAPGDGFFVQPTAIPARSQADTIMTEETFGPVASFLAYDDEEEMLHYMNDTHFGLTASIWTNDLSKALRFVPRVEAGTVWVNMHNYIDPAMPFGGVKSSGIGREFGEAFIEYFTELKSVIVRY

SEQ ID NO: 7227 - protein, 538 aa, Burkholderia cepacia; identical to SEQ ID NO: 4467

SEQ ID NO: 7228 - protein, 292 aa, Burkholderia cepacia; identical to SEQ ID NO: 4468

SEQ ID NO: 7229 - protein, 266 aa, Burkholderia cepacia; identical to SEQ ID NO: 4469

SEQ ID NO: 7230 - protein, 314 aa, Burkholderia cepacia
PPHTLVIASRESRLAMWQAEHVRCALHKLYPSCDVKILGMTTRGDQILDRTLSKVGGKGLFVKELEAALADGRADLAVHSLKDVPMALPEGFALSTIMEREDPRDALVSNTYDSLAALPEGAVVGTSSLRREAMLRMRYPHLEVRPLRGNLDTRLAKLDRGDYAAIILAAAGLKRLGLGERIRALLDPEDSLPAAGQGALGIEIRADRAELAAWLAPLHHEHTAAAVEAERMVSRALGGSCEVPLAAYATWHDGALHLRGIVATPDGQRVLSAQASAPATSVEQAIALGQEVAGALEQQGAMEIVRALGAANGA

SEQ ID NO: 7231 - protein, 927 aa, Burkholderia cepacia
LFQDIRYLGRLLGDVLREQEGDAVFDVVETIRQTAVRFRREDDSAAAQTLDKKLRSLSPEQTVSVVRAFSYFSHLANIAEDRHRNRRHRIHELAGSTSQPGTIAHSLERLVEAGAAATPVLQEFFNNALIVPVLTAHPTEVQRKSILDAQHDVARLLAERDQQLTDRERAHNEAMLRARVTSLWQTRMLRDSRLSVADEIENALSYYRATFLEEIPALYADIEEALAEHGLEARLPPFFQMGSWIGGDRDGNPNVTAETLENAITRQAAVIFEHYMEQVHKLGAELSVSNLLAGASDALKELAAVSPDQSPHRTDEPYRRALIGMYTRLAASARVRLGEGSVPVRSAGRGAAPVRAKPYADSAEFVRDLHVLIDSLAEHHGAPLAAPRLSPLARAAEVFGFHLASIDLRQSSDVHEAVITELLRRAGVEENYAELPEADKLNVLLSELAQPRPLRLPFAEYSDLVKSELGVLEEARVTREKFGARAVRNYIISHTETVSDLVEVMLLQKETGLLRGCLGNANDPAQAGLMVIPLFETIPDLRNAPHIMRDLIALPGVDALIEHQGNEQEVMLGYSDSNKDGGFLTSNWELYRAELALVSLFNERGVTLRLFHGRGGTVGRGGGPTYQAILSQPPGTVDGQIRLTEQGEVIASKFGNPEIGRRNLETVVAATLEASLLPHGIAPAQLPAFEETMQQLSDAAMASYRALVYETPGFKEYFFESTPISEIAELNIGSRPASRKLQDPKQRKIEDLRAIPWGFSWGQCRLLLTGWYGFGSAVAAHLDSAPSDAERTRRLALLKKMHKTWPFFANLLSNMDMVLAKTDLAVASRYAALVSDKKLRKHVFERIVAEWERTSKVLSEITGKSERLAENPLLARSIKNRFPYLDPLNHLQVELLKRHRAGDTNARVRRGIHLSINGIAAGLRNTG

SEQ ID NO: 7232 - protein, 453 aa, Burkholderia cepacia
WSARFSEPMSELVKRYTSSVFFDKRLALVDIEGSLAHASMLAAQKIIAADDLTAIQRGMAQIKGEIERGEFEWQLDLEDVHLNIEARLTALIGDAGKRLHTGRSRNDQVATDIRLWLRGEIDRIGGLLTELRTALLDMAEKNAATIMPGFTHLQVAQPVTFGHHLLAYVEMFSRDAERMIDCRKRVNRLPLGAAALAGTSYPIDRYAVAKTLGFDGICANSLDAVSDRDFAIEFTAASALVMTHISRFSEELVLWMSPRVGFIDLADRFCTGSSIMPQKKNPDVPELARGKTGRVNGHLIALLTLMKGQPLAYNKDNQEDKEPLFDTVDTVADTLRIFAEMVAGISVKPQAMRDAALQGFSTATDLADYLVKRGLPFRDAHEAVALAVRVCADRGCDLADLTLEEMRKELSNVAHLIGEDVFSYLTLEGSVASRNHPGGTAPEQVLAAVKAAR

SEQ ID NO: 7233 - protein, 242 aa, Burkholderia cepacia
ETSKVAIVTGASRGIGASIAKRLAADGLTVVVNYSGSDAAAAAVVEQIEEASGRARSAKADISDAAAVRRMFEAAETAYGGVDVLVNNAGIIGLKPIASMDDETFDRIVKVNLKGTFNTLREAANRLRPGGRIVNFSTSVVGLYQPTYAIYAATKAGVEAMTHVLSKELRGRNITVNAVAPGPTATELFFDGKTPEVIDHLTRLAPLERLGQPEDIANAVAFLAGPDGAWINGQVLRANGGI

SEQ ID NO: 7234 - protein, 217 aa, Burkholderia cepacia; identical to SEQ ID NO: 4475

SEQ ID NO: 7235 - protein, 289 aa, Burkholderia cepacia
DLSGKTILITGGHSGIGLRSTRVLAAAGARIIVGARDIAKGAYRPGRHQGVELLGLDLSDPASITRFSTQVLKVHEKIDVLMNNAGIMALPKLIKDSRGYELQFSTNHLGHFQLTALLWDALKKAGGARVVTLSSYGHRYSPVDFDDPNFGSRRYDKWKAYGQSKTANAPFSVELGRLGQPFGIRAFPVHPGRTPSTALKRSLTFKELLAMPLLLFSKVYVKNIQEGAATQVWAALSSQLDGKDGVYCAGCDISPAVTPDSPLANTVRDYAVDPDLARKLWVLSEKLVG

SEQ ID NO: 7236 - protein, 280 aa, Burkholderia cepacia; identical to SEQ ID NO: 4477

SEQ ID NO: 7237 - protein, 273 aa, Burkholderia cepacia; identical to SEQ ID NO: 4478

SEQ ID NO: 7238 - protein, 474 aa, Burkholderia cepacia
FIDGEYRDAEGGRTFDCLSPIDGKLLAKVADSGAADVDAAVSAARRAFDSGVWSGLNPRQRKAILLRWAASIREHMDELALLETLDAGKPIADTTSVDVPGAAYCVEWFAEAIDKVGGEVAPADHHLVGLVTREPIGVVAAVVPWNFPILMASWKFGPALAAGNSVVLKPSEKSPLTAIRLAQLALDAGIPAGVFNVVPGAGEPGKLLALHQDVDCLAFTGSTNVGKLIMQYAGQSNLKRVWLELGGKSPNIVMPDCPDMDRAANAAAGAIFYNMGEMCTAGSRLLVHRDIKDVFLDKLIAAARSYTPGNPLDPNTSMGAIVDKVQLERVLGYIEAGRAEAKLLLGGARVKEETGGFYIEPTIFEIPASGAKVAREEIFGPVLSVITFDTVEEAIRIANDSEYGLAAAVWTSNLTIAHEVSRKLRAGTVWVNCYDEGGDMNFPFGGYKQSGNGRDKSLHALEKYTELKSTLVRL

SEQ ID NO: 7239 - protein, 436 aa, Burkholderia cepacia
IHPFSDMGALNRTGSRVIVKAQGVYLWDSDGNKVIDGMAGLWCVNVGYGRKELADAAYRQMMELPYYNTFFKTTHPPVIELSALLAELAPEPFNHFFYCNSGSEGNDTVLRIVHHYWATQGKHAKKFVISRKNGYHGSTIAGGTLGGMGYMHEQMPSKVENIVHIDQPYFFGEAQGNLTPEEFALARAQQLEAKILEIGADNVAAFIGEPFQGAGGVIFPASTYWPEIQRICRKYDILLVADEVIGGFGRTGEWFAHQYFGFEPDLITLAKGLTSGYIPMGAVGLHDRVAKAIIENGDFNHGLTYSGHPVAAAVAVANLKLLRDEKIVERVKTDTGPYFQKKLRDTLGNHPIIGEISGAGLVAGLQLAQDPKTRKRFANGGDVGTICRDFCFNGNLIMRATGDRMLLSPPLVINKLEIDEIVSKAKKAIDATAQQL

SEQ ID NO: 7240 - protein, 357 aa, Burkholderia cepacia; identical to SEQ ID NO: 4481

SEQ ID NO: 7241 - protein, 212 aa, Burkholderia cepacia; identical to SEQ ID NO: 4482

SEQ ID NO: 7242 - protein, 184 aa, Burkholderia cepacia; identical to SEQ ID NO: 4483

SEQ ID NO: 7243 - protein, 245 aa, Burkholderia cepacia
KAVLITGGSRGIGRATARLLGARGWSVGVNYARNLAAAQDTAAEVERAGGRALTIAGDVASEADVLAMFDALQQKFGRLDALVNNAGIVAPSSQLADMDLARLKRMFDVNVLGAYLCAREAARRMSTDRGGAGGVIVNVSSAASRLGSPNEYVDYAGSKGAVDTMTLGLARELGPRGVRVNAVRPGLIDTEIHASGGKPERAAQLGGTTPLGRPGTAGEVAETIVWLLSDAASYVTGALLDVSGG

SEQ ID NO: 7244 - protein, 288 aa, Burkholderia cepacia; identical to SEQ ID NO: 4485

SEQ ID NO: 7245 - protein, 247 aa, Burkholderia cepacia
MNASISQQVAIVTGASRGIGAAVAQRLANDGFAVAINYASSSTEADALVAKLTAAGAKAVAVKADVSNAGDVRRLFEITEQQLGKVDVLVNNAGVLKTTPLADTSDALYDQTFDINVRGTFNTLREAAARMNDGGRIVNFSSTTLALNMPGYAIYNATKAAVEAFTHVFAKELRGRNITVNAVAPGPIATSLFLDGKTEEQIQTFAKMPPLQRLGQPDDIASVVAFLAGPDAGWVNGQILRANGGLA

SEQ ID NO: 7246 - protein, 292 aa, Burkholderia cepacia; identical to SEQ ID NO: 4487

SEQ ID NO: 7247 - protein, 518 aa, Burkholderia cepacia; identical to SEQ ID NO: 4488
  unsure (1)..(518): unsure at all Xaa locations

SEQ ID NO: 7248 - protein, 529 aa, Burkholderia cepacia
FDYIIVGAGTAGCVLANRLSEDPDVQVLLLEAGGKDDYHWIHVPVGYLYCIGNPRTDWLYKTQAEAGLNGRALSYPRGRVLGGSSSINGMIYMRGQREDYDEWARVTNDSSWSWNSVLPVFRRSEDHYAGASESHGAGGPWRVEKQRLKWKILEEFSRAAQEAGIPATDDFNRGDNTGVGYFDVNQKRGIRWNASKAFLRPALKRPNLTVITGAHTQRVVFEGRRCTGVEYRGNDTDYLAKARCEVILSSGAVNSPQLLELSGIGNGARLQNLGIEVVNDLRGVGENLQDHLQLRMAYKVDGVRTLNTASAHWWGKLMIGLQYALFQSGPMSMSPSQLGAFARSDPNDRSLTRPDLEYHVQPLSLDRFGEPLHRFNAFTASVCQLRPTSRGSIHIESANASAPPLIAPNYLSTDYDRHVAANALRLTRRIAAAPALARYRPQEILPGTQYQTEEELQQAAGAVGTTIFHPVGTCRMGTTDDPGAVVDNRLRVIGVDGLRVVDASVMPTITSGNTNSPTLMIAERASDMI

SEQ ID NO: 7249 - protein, 479 aa, Burkholderia cepacia
LTHFINGKTVEGTSGRFGDVFNPAQGSVSARVPLASVAEVDAAVAAAKDAFAAWSETAPIKRARVLFRFKELLDRHHDELAELITREHGKVFSDAKGEVMRGIEIVEFACGIPNLLKTDFTDQIGGGIDNWNLRQPLGVVAGITPFNFPMMVPCWMFPVAIACGNTFVLKPSERDPSCSNRLAELLKEAGLPDGVFNVVHGDKVAVDALLVHPDVSALSFVGSTPIAEYIYTEGTKHGKRVQALGGAKNHLVVMPDANLDQAVDALIGAAYGSAGERCMAISVAVAVGHIADELVERLTPRVKSLKILNGMESDAEMGPLVTAVHREKVVGYIDSGVAAGATLVVDGRGHQVSGHEKGFFLGGTLFDNVSTDMKIYREEIFGPVLCVVRVPDFASAVELINANEFANGVSLFTSDGGVARAFSRQIQIGMVGINVPIPVPMAWHSFGGWKKSLFGDHHAYGEEGVRFYTRYKSIMQRWP

SEQ ID NO: 7250 - protein, 587 aa, Burkholderia cepacia
SLDVLLEKYAKGDEQSADDVFKRVARGVAEAEPPALRESVEALFVDNLRHGALGAGRIMSAAGTGIAATLINCFVQPVGDAIQGVDEEGLPGIYVALLQAAETMRRGGGVGYNFSAIRPKGARVHTTSSSASGPCSYMDVFDASCRTVESAGSRRGAQMAVLDCNHPDLLEFIEAKHSKGRWNNFNVSVGVTDEFMRAVEEDQPWQLVHRAEPSPAQRAADDVRQREDGLWVYSERPAREIWDRIMRSTYDVAEPGIVFISRMNEDNNLRAVETIRATNPCGEQPLPAYGCCNLGPLNLTRFVIDPFAQIKGRKPSFDWDGLAKRTRTQVRFLDNVLDVTLWPLPQQYEESRAKRRIGVGFTGLGDTLVMLGLRYNSQEGRDFAVGIAQLMRDEAYRASVELARERGAFPLFDAARYLETGTFASRLPEDIKQAIRRDGIRNSHLLSIAPTGTVSLAFADNASNGIEPAFSWTYTRMKVMADGSRESFDVEDYAYRLYRELGGDVNRLPDYFVSALEMSARDHLDMMAAVQPYVDTSISKTVNVPADYPFEAFESLYLDAWKNGLKGLATYRPNETLGAVLSVSPPQ

SEQ ID NO: 7251 - protein, 417 aa, Burkholderia cepacia
VLANENRKVTQEESQRQAELLMQEIEAHRKTDAALQRASAAAESANRAKSRYVTGLSHELRTPLNSILGYAQLLLQGTDELPPARRNAVATIYRSGEHLLALVDGLLDVARIEAGKLQLNVTEISLPDFVAQLAAMLEPQATDKGLQFEFQTSGRMADVVRIDEKRVRQILINLIGNAIRFTSHGSVKVRASYAWEAITFEITDTGPGMPASELERLFLPFERGAAAREHDHGAGLGLTICRLLTELMGGNLEVQSEVGKGTRFIVKLFAPEVRAPQLLASGPLNVKGYDGPRRTVLVVDDLAEQRRIVVQTLAPLGFNVVEAASGPEALQWLGTASADLIVMDVSMPDMDGFEASRLIRDNHLSAAPVLILSANAFADDRDKGAAAGCDDYLAKPLYIPLLLDKLAALLQLHWIVE

SEQ ID NO: 7252 - protein, 413 aa, Burkholderia cepacia
MAVNFPSIDPAQLHPVAGVSLGWAEANIRKPNRKDVLVISVGEGATVGGVFTQNRFCAAPVTVCRENLDRVRAGGKPIRALVINTGNANAGTGEPGLVAARETCAELARLADITPEQVLPFSTGVILEPLPVDRLKAGLPAALANRKEANWYDAAQAIMTTDTLPKATSRQVTIEGHTVTLTGISKGAGMIRPNMATMLGFLAFDAAVAQPVLDALVRHVADRSFNCITIDGDTSTNDSFILIASGKSSLPAITSTDSPAYAALRDAVTEVAQTLAQLIVRDGEGATKFMTVHVEGGSSVGECRQIAYAIGHSPLVKTAFYASDPNLGRILAAIGYAGVDDLDVGKIDLYLDDVLVATAGGRNPAYREEDGQRVMKKSEIGIRVVLGRGDAQATIWTCDLSHDYVSINADYRS

SEQ ID NO: 7253 - protein, 310 aa, Burkholderia cepacia
AEDMQQVNRVIRHRLASDVMLINQISEYIISAGGKRLRPALLLLVAGALGETTGHRHELAAVVEFIHTATLLHDDVVDESDLRRGRQTANALFGNAASVLVGDFLYSRSFQMMVGVGKMRVMEILSEATNIISEGEVLQLLNMHDADVDEARYMQVIRYKTAKLFEAAAQLGAVLAGSDAKTEAAAAEFGRRIGTAFQIMDDWLDYTGTAESMGKNAGDDLREGKPTLPLIYLIERGTPEQSALAREAIEQGGTDRFDTIFEAITRSGALDHTLECAKQEAQAAAAAISSFPDSIFKDSLLELCSYSTAR

SEQ ID NO: 7254 - protein, 164 aa, Burkholderia cepacia
IVSADDVNASISGMAAAIRDEMSEDFPLVLSVMGGAAVFTGMLLPHLDFPLEFDYIHLTRYRNTTKGGNEMQWRVAPAESVKDRVVLVLDDILDEGETMAAIRDRILAMGAKRFLSAVLCEKIIPKAKPLRPDYCGFEVPDRYVFGCGMDAKGYWRNLPTIRAL

SEQ ID NO: 7255 - protein, 913 aa, Burkholderia cepacia
  unsure (1)..(913): unsure at all Xaa locations
VXGLTDLARPLARHKAHKRSRRKRPFADYKVIRRNGSVVSFEPSKIAIAVTKAFLAVNGGQGAASARVRELVEQLTQNVVRALVRSRPNGGTFHIEDIQDQVELALMRGGEHNVARAYVLYREKRTQARGHDDQIVANTPGLNVTDNGVTRPLDMAALRGIIELACSNLGDAVSADPIIAETVKNLYDGVPMSQVYDSAILAARTMIEKDPAYSQVTARILLHTIRREILEEEVTQTEMGERYAEYFPQFIKRGVQAELLDDKLLQFDLKRLGAALDNNRDLQFGYLGLQTLYDRYFLHHDGVRIEMPQAFFMRVAMGLSLNEIDREARAIEFYNVLSTFDFMSSTPTLFNSGTRRSQLSSCYLTTVDDDLDGIYEALKENALLSKFAGGLGNDWTRVRALGSHIKGTNGKSQGVVPFLKVVNDTAVAVNQGGKRKGAVCAYLETWHLDIEEFLELRKNTGDDRRRTHDMNTANWIPDLFMKRVMEGGDWTLFSPSTCPDLHDKFGAEFETAYTAYEDKVARGEIKLFKKIPAAQLWRKMLGMLFETGHPWITFKDPCNVRSPQQHVGVVHSSNLCTEITLNTSDAEIAVCNLGSVNLVAHLKEQADGTLVLDHDKLKRTVSVAMRMLDNVIDINYYAVAKARNSNLKHRPVGMGIMGFQDCLHLLRTPYASEEAVRFADTSMEAVCYYAYYASTELAQERGRYSSYRGSLWDRGILPQDSVKLLAEARGGYVEVDSSESMDWTELRSRIAQYGMRNSNCVAIAPTATISNIIGVSACIEPTFQNLYVKSNLSGEFTVVNDYLVRDLKARGLWDEVMVADLKYFDGTLSRIDRIPADLRAIYATAFEVDPKWLVEAASRRQKWIDQAQSLNIYMGGASGKKLDEIYKLAWVRGLKTTYYLRTMAATHVEKSTV

SEQ ID NO: 7256 - protein, 336 aa, Burkholderia cepacia
RVNVADKRIINGQTDVNQLVPFKYKWAWEKYLAGCANHWMPQEVNMSRDIALWKDPNGLTEDERRIVKRNLGFFVTADSLAANNIVLGTYRHITAPECRQFLLRQAFEEAIHTHAYQYIVESLGLDEGEIFNAYHEVSSIRAKDEFLIPYIHVLTDPAFKTGTLEADQTLLRSLIVFACVMEGLFFYVGFTQILALGRQNKMTGAAEQYQYILRDESMHCNFGIDLINQIKLENPQLWTAEFRAEIREIFQQAVELEYRYAEDTMPRGVLGLNASMFKSYLRFICNRRCQQIGLDPLYPNEENPFPWMSEMIDLKKERNFFETRVIEYQTGGALTW

SEQ ID NO: 7257 - protein, 312 aa, Burkholderia cepacia; identical to SEQ ID NO: 4498

SEQ ID NO: 7258 - protein, 449 aa, Burkholderia cepacia
MFEKILIANRGEIALRIQRACRELGVKTVVVYSEADKEAKYVKLADEAVCIGPAPSNLSYLNMPALISAAEVTDAEAIHPGYGFLSENADFAERVEQSGFTFIGPRPETIRMMGDKVTAKQTMIKTGVPCVPGSEGALPEDPKEIVKIARQVGYPVIIKAAGGGGGRGMRVVHTEAALVNAVNMTREEAGRAFGNPQVYMEKFLENPRHIEIQVLADSFKNAVWLGERDCSMQRRHQKVIEEAPAPGIARRLIDRIGDRCADACKKMGYLGAGTFEFLYENGEFYFIEMNTRVQVEHPVTELITGVDIVQEQIRIAAGEKLAFRQRDIVFKGHAIECRINAEDPFKFIPSPGRLTSWHMPGGPGIRVDSHAYNGYFVPPNYDSMIGKLIAYGATREQAIKRMRIALSEMVVEGIQTNIPLHRELMLDAKFVEGGTSIHYLENRLAAKQQ

SEQ ID NO: 7259 - protein, 144 aa, Burkholderia cepacia; identical to SEQ ID NO: 4500

SEQ ID NO: 7260 - protein, 547 aa, Burkholderia cepacia
  unsure (1)..(547): unsure at all Xaa locations
YDYIVVGGGSSGCVVATRLVEAGFEVLLLEAGPVDKDIYIHMPAGMRNAQKYSWNYMSEANPGSGVPPIHIHQGRVLGGGSSVNGMVYVRGSAHDYDDWDRIYGCTGWSHNDVLPYFIRSEGNEVVSGPKHGTDGNLWVSEHRYRHPLTMAYLRAAQELGYPYITDMSGATEQEGVGFWQCTIHEGKRGSTARAYLQRVIKSDLLTVVTGATARKVQIENGRACGVRYARNGNSVTDAVATREVILTAGAFETPKLLMLSGIGPAQHLNEFGIGTIADSPQVGKNFQDHLMVSITAETPGIPSFLREGEGLRKIANGLEWLTFNHDGVVSSNVLEGGGYFDINDDGRIDTQLFVFPFYEGKRDGNWTKADQIPDGMALKVGHVYPESRGEVLLGGPRPDDKIRLKGNYLSADGDLDLQVKAFKLGLKFFDAPSLKKITRNVAPKFSDDHEIADYVRKNCTTIFHPTSTCRMGNSPQSSVVDLTLRVWGIANLRIADASVMPHIVSGNTNAPTIMIAERAAEMIIHASSHSXNRAAGSERTDSRSESL

SEQ ID NO: 7261 - protein, 474 aa, Burkholderia cepacia
DKLYIDGQWVAASTGKEFSVISPDTESVYVRVGEASEADIEKAVSAARKAFDHGPWPRLSHAERGAYLRAMAEKLRARSHDMAAIWPHEMGVTYAFAQSFMPRIAGIYDFYANLGDTFAFEERHATSSGIGNGLLVREPVGVVGAIIPWNAPAMIIAYKLAPALIAGCTVILKSSPEAPGMALIIAEVAEEVGLPPGVVNVVTADRQASDALVRNAAVDKISFTGSSAVGKHIGSVLAQRVGRYTLELGGKSAAIVLDDYDLETAAKALATAASQMTCQVCASLTRIIVTKNRHDRLLEALASAYSSVKVGSPFDPATQMGPVATLRQRERVETYIAKGMQAGFTLAAGGKRPVHLPRGFYLEPTVFGNVSNRSELAQEEIFGPVLAVIPADSEEQAVEIANDSIYGLSGAVFTNDVDRAYSVARRVRTGSVAHNGFRNDFGIAFGGFKQSGIGREGGVEGLMPYLETKTVLLE

SEQ ID NO: 7262 - protein, 245 aa, Burkholderia cepacia
QVAVVSGGAHGIGLGIVERLLQLGAKVVASDIDRDGLAVSRERLAKSFGTSIAVQAADLSKERGAQALHRAVAKRFGPAQILVNCAGGGVIRPFLEHTPETLKATIDRNLWTVIWCSRVFLPDMIGAKYGRIVNIGADSVRNGLPAHAGYNAAKGGMHGLTTGLAREFALNGITVNTVAPCAVNTEVWAKVKKSNPRLAQAFVDVIPMGRVGEIEEVASMVGYLALPEAAFVTGQVISVNGGSAM

SEQ ID NO: 7263 - protein, 210 aa, Burkholderia cepacia
LICDCDGVLIDSEAVAARMLVRELETRWPGTDVEPVVLPLLGLRIEKVLQGTAAQLGKSLTPDDIDAIRRAVEAAAMQAPMVEGIEAALAQVPLTKGCASNSFRPYVESVLARTGLVRFFGDRLFCADAVPNPKPAPDVYLAAARGLGLAPSRCLVVEDSVTGVTAASAAGMTVLGFIGGGHASDAQIDKLHAAGARHVFDDMQQLPELV

SEQ ID NO: 7264 - protein, 478 aa, Burkholderia cepacia; identical to SEQ ID NO: 4506

SEQ ID NO: 7265 - protein, 292 aa, Burkholderia cepacia; identical to SEQ ID NO: 4507

SEQ ID NO: 7266 - protein, 150 aa, Burkholderia cepacia
EVATLGGGCFWCLEAVYLGVEGVNAVESGYAGGEARHPTYEDVCDGETGHAEVVKVDFDPAKISYREILDIFFAIHDPTQLNRQGNDVGTQYRSVIFTHSDAQREIALQAIREIGEQQIYDGQIVTQVLPLNDNYWPAEDYHQNYFAHHP

SEQ ID NO: 7267 - protein, 489 aa, Burkholderia cepacia; identical to SEQ ID NO: 4509

SEQ ID NO: 7268 - protein, 105 aa, Burkholderia cepacia; identical to SEQ ID NO: 4510

SEQ ID NO: 7269 - protein, 540 aa, Burkholderia cepacia
MSAKDVKFHDSARSRIVKGVNVLADAVKVTLGPKGRNVLIERSFGAPTITKDGVSVAKEIELKDRFENMGAQVVKQVASKTADVAGDGTTTATVLAQSIVQEGMKHVAAGMNPMDLKRGIDKAVAAVLDELHRLSKPIKTSREIAQVGAISANADEAIGKIIADAMDKVGKEGVITVEDGKSLENELEVVEGMQFDRGYLSPYFINDPDKQVAHLDDPLILLHDKKISSIRDLLPVLEAAAKAGKPLLIIAEDVEGEALTTLVVNSMRGVLKVAAVKAPGFGDRRKALLEDIAILTGATVISEETGKQLEKATLEELGRAKRVEVQKENTIIIDGAGDQTRIDARVKAIRAQIEEATSDYDREKLQERVAKLAGGVAVIKVGAATEVEMKEKKDRVDDALHATRAAVEEGIVPGGGVALLRARSAISSLTGANADQDAGIRIVLRALEAPLRVIAANAGDEPSVVVAKVLSGKGNYGYNAATGEYGDLVETGVVDPTKVTRTALQNAASIAGLILTTDATVAEAPKEEKAVPAPAPELEY

SEQ ID NO: 7270 - protein, 364 aa, Burkholderia cepacia; identical to SEQ ID NO: 4512

SEQ ID NO: 7271 - protein, 425 aa, Burkholderia cepacia; identical to SEQ ID NO: 4513

SEQ ID NO: 7272 - protein, 389 aa, Burkholderia cepacia; identical to SEQ ID NO: 4514

SEQ ID NO: 7273 - protein, 254 aa, Burkholderia cepacia
QIMSFLTLTDVTKSFGDLHAVADVNLSVEKGEFVSLLGPSGCGKTTTLQMIAGFVETTRGRITLDGRDITHMKPNRRGLGIVFQSYALFPHMSVADNVGFGLEMRNIDKAERKERIREALALVRLDTLAHRFPRELSGGQRQRVAIARAIVIAPPVLLLDEPMSNLDAKLREDMQFELRGIQRKIGTTTIMVTHDQSEALSISDRVVVMEAGRITQIDTPYEAYERPENRFVSQFIGKANMLPGIVVAREGDAI

SEQ ID NO: 7274 - protein, 256 aa, Burkholderia cepacia; identical to SEQ ID NO: 4515

SEQ ID NO: 7275 - protein, 746 aa, Burkholderia cepacia; identical to SEQ ID NO: 4516

SEQ ID NO: 7276 - protein, 249 aa, Burkholderia cepacia
IRDNVFLITGGASGLGAATARLLVENGGKVVLADLNVDAGEALAKELGGVFVKCDVSREDDATQAVEAATKLGTLRGLVNCAGVAPAIKTIGKDGPHPLDSFTRTISINLIGTFNMIRLAAAAMSKNEPNANGERGVIINTASVAAYDGQIGQAAYAASKSGVVGMTLPIARDLSRNAIRVMTIAPGIFETPMLLGMPQEVQDALGAMVPFPPRLGKPAEYAMLAKQIFDNPMLNGEVIRLDGAIRMQP

SEQ ID NO: 7277 - protein, 257 aa, Burkholderia cepacia
RNDMLRVITANLNGIRSAAKKGFFDWFGEQKADVLCVQEIKCSQDDMTPEFMAPHDFTGYFQHAVKKGYSGAGVYTRHEPDEVVIGFGSEEFDPEGRYVELRFGKLSVISVYVPSGSSGDERQQAKYRFMDEFMPHLAELAQEREVIVCGDVNIVHKEIDIKNWKSNQKNSGCLPEERAWLTKLFDEVGYVDVFRTLDQRPEQYTWWSNRGQAYAKNVGWRIDYQIATPGIASKAKRTDVFRDIKFSDHAPLTVDYD

SEQ ID NO: 7278 - protein, 282 aa, Burkholderia cepacia
KAEILAEALPYIRQYHGKTVVIKYGGNAMTEERLKQGFARDVILLKLVGINPVIVHGGGPQIDQALKKIGKQGTFIQGMRVTDEETMEVVEWVLGGEVQQDIVTLINHFGGHAVGLTGKDGGLIHARKMLMPDRDNPGQYVDIGQVGEVEAINPAVVKALQDDAFIPVISPIGFGEDGLSYNINADLVAGKLAVVLNAEKLVMMTNIPGVMDKEGNLLTDLSAREIDGLFADGTISGGMLPKISSALDAAKSGVRSVHIIDGRIEHSVLLEILTEQPFGTMI

SEQ ID NO: 7279 - protein, 285 aa, Burkholderia cepacia
MKLKFTKMHGAGNDFVVLDGYTQPVNLTPAQVRALADRHFGVGADQLLLVEKPTVAGVDFRYRIFNCDGGEVEHCGNGARCFVKFVRERGLTDQRSVRVQVQKGTITLTMQENGEVLVDMGTPVFDPERVPFATKGLEGRREGADTLWPLDVSGTTRWISVVSMGNPHAVQVVGDVEAFPVLAEGPVIERHARFPQRVNAGFMQIVGRNEIRLRVYERGAGETLACGTGACAAVAAGIRRGLLDSPVRVHTHGGDLTISWDSTREGEPLLMAGPAVTVFEGEIEL

SEQ ID NO: 7280 - protein, 383 aa, Burkholderia cepacia; identical to SEQ ID NO: 4521

SEQ ID NO: 7281 - protein, 520 aa, Burkholderia cepacia; identical to SEQ ID NO: 4522

SEQ ID NO: 7282 - protein, 516 aa, Burkholderia cepacia; identical to SEQ ID NO: 4523

SEQ ID NO: 7283 - protein, 705 aa, Burkholderia cepacia
  unsure (1)..(705): unsure at all Xaa locations
MTSRNRRDFLRSAAHAAGSATALSMLPLGIRNALAIPANNKTGTIRDVEHIVVLMQENRSFDHYFGTLKGVRGFGDTRAINLPNGKPVWYQPLAADIGYVLPFRPSAPNLGLQFLQDLAHDWTSTHAAWNGGRYDQWVPAKSATTMAYLTREDIPFHYQLADAFTICDAYHCSLMGPTDPNRYYMWSGWVGNDGSGGGPVIDNSELGYGWSTYPEVLQSAGISWKIYQDIGTGLDANGSWGWTQNPYIGNYGDNSLLYFNQYRNAQPGNPLYDNARTGTNAAKGDGYFDILKRDVQNNALPQVSWIVAPEAYSEHPNWPANYGAWYIDQVLQILTSNPEVWSKTVLLVNYDENDGFFDHMAPPFAPSSSANGLSTVDTTNEIYTGDAKTPSGPYGLGPRVPMLVVSPWSKGGYVCSELFDHTSVIRFIEKRFGHDHNLGESNITPWRRAVCGDLMSAFNFSNPNDAIPALPSTSGYVPADQNRHPDYVPLPPALQAVPKQEPGVRPARALPYELFVRVHGEGAANTLTMRFVNTGRAGAVFLVYAAHSLDAPRTYTVEAGKRLQDPLPLNADGSYDYTVYGPNGFLRRFAGKPVSRSWWHGSDIARPEVAEGYDVSNGNLQLRLENVGSARCQFTIVNAYDPGNAIKHSVRGGDTEQLYLDLRNAHGWYDLAITVDTDPLFARRFAGHVETGKSSMSDPALGAXT

SEQ ID NO: 7284 - protein, 533 aa, Burkholderia cepacia
YESLTANFAWQIPARYNIGVDVCDKWADGSGRLALIYEDPEGTATRYTFDELKALSDRFANALLAAGAQRGDRIGIFLSQSVETAIAHLAAYKAGMVAVPLFALFGVDAIEHRLGDSGAVALITDHGGVQKVDEIRAALPSLRNVFSVDIDRDNGDPHAPVRSFWHALKSAPAGFTPVDTGADDPAVIIYTSGTTGKPKGALHGHRVLPGHLPGVEMSQQGFPAHATLIWTPADWAWIGGLFDVLLPSWHHGVPVLARRFAKFDGEAAFDLMARHAVSHTFLPPTALKMMRGVERPERWSLALRSVASGGESLGEELIGWGRKALGVTINEFYGQTECNVVVSSCAALFEPRFGAIGRAVPGHHVAIVDMDGNELPPGAIGDIAVAAPDPVMFLGYWGNEAATREKFRGKFLVTGDLGTCDADGFIRFVGRGDDVITSAGYRIGPASIEDSLLRHPAVSMAVVIGAPDRERTEIVMAFVVLNPGFAGDAALVREIQQHVKTRLAAHEYPREIRFVDSLPLTATGKVIRKALRE

SEQ ID NO: 7285 - protein, 266 aa, Burkholderia cepacia
RSVFREGLFAGKVIIVTGAGSGLGRCTAHELASLGATLALVGRSEDKLKAVQAELAEDHQRTSAGHKTYSCDIRNEQQVRETIASIIADLGRVDGLFNCAGGQFPAKLEKISLNGWDAVVRNNLHGTFLMSRECYTQWMEHHGGTIVNMLADIWGGMPGMGHSGAARAGVWNFTETAACEWGHAGVRVNAVAPGWIASAGMDSYNEDYQALLRTLRHKVPLQRFGTESELAGAAVFLLSEASAFINGTVIRVDGGVPNARHSWPLP

SEQ ID NO: 7286 - protein, 402 aa, Burkholderia cepacia; identical to SEQ ID NO: 4527

SEQ ID NO: 7287 - protein, 349 aa, Burkholderia cepacia; identical to SEQ ID NO: 4528

SEQ ID NO: 7288 - protein, 493 aa, Burkholderia cepacia; identical to SEQ ID NO: 4530

SEQ ID NO: 7289 - protein, 280 aa, Burkholderia cepacia; identical to SEQ ID NO: 4531

SEQ ID NO: 7290 - protein, 252 aa, Burkholderia cepacia; identical to SEQ ID NO: 4532

SEQ ID NO: 7291 - protein, 433 aa, Burkholderia cepacia; identical to SEQ ID NO: 4533

SEQ ID NO: 7292 - protein, 245 aa, Burkholderia cepacia
LILITGGGRGVGAATARLAAAQGYDVAISFVSDESAALAVAADVEAAGRRALAVRADSADPEQVARLFAAIDRTFGRIDVLVNNAAIIAKQSRLEDLEFARMQRIFAVNSIGPILCAQQAVKRMSHRYNGRGGVVINISSASARLGSPNEYVDYAASKGALETFTTGFAKEVARDGIRVNCIRPGHIYTDMHASGGEPGRVDRVRDSIPMGRGGQPEEVARAILWLASAEASFITGTFLDVTGGK

SEQ ID NO: 7293 - protein, 251 aa, Burkholderia cepacia; identical to SEQ ID NO: 4535

SEQ ID NO: 7294 - protein, 242 aa, Burkholderia cepacia; identical to SEQ ID NO: 4536

SEQ ID NO: 7295 - protein, 1167 aa, Burkholderia cepacia
LTSIKLAGFKSFVDPTHFQVPGQLVGVVGPNGCGKSNIIDAVRWVLGESRASELRGESMQDVIFNGSTARKPGSRASVELVFDNADGRAAGQWGQYAEIAVKRVLTRDGTSSYYINNLPARRRDIQDIFLGTGLGPRAYAIIGQGMIARLIEAKPEELRVFLEEAAGVSKYKERRRETENRLHDTRENLTRVEDIVRELGANLEKLEAQAVVATRYKELQADGEEKQRLLWLLRKNEAGGEQERQQRAIEQAQIDLEAHTAKLREVEAQLETLRVAHYSASDAMQGAQGALYEANSEVSRLEAEIKFIVESRNRVQAQIAALNAQREQWQSQAQKAQDDLADAEEQLAVAEEKATLVEDEAAAKHDAMPALEARWRDAQTELNAERGGIAQTEQALKLEAAHQRNADQQLQQLQARHERLKSEAGGLDAPDEAQLEDLRMQLAEHEEILHDAQTRLADAQETLPRLDGERRAAQERVQAESSQIHQLDARLAALKQLQENVQTEGKIQPWLRKARAERPAASVEETACRSRLGSRARSRAARAARRARSVEPRLGQGLRHRRAARQARFLRAACRRSACRHAACAAAAAVLVRIDDAGIRAVLNDWLGLSFVADDLQQALAMRSQLPEGGSFVVKAGHVVTRVGVQLYAADSEQAGMLARQQEIENLARQVRAQALLADEAKAAAIRAEAAHTQAAQALTDVRQQAERATQRVHALQMDVLKLTQAHERYTQRSTQIREELAEITAQIEEQRAMRAESEANFERHDGELAELQARFEDHQLAFEALDEELTAARGQARDLDRAATDARFAARNMANRIDELKRSIQVAHEQSERVAASLEDARAELETINEQTAHTGLQDALDIRAVKEEALHAARLELDDLTAKLRAADETRLTAERALQPLRDRINELQLKEQAARLNGEQFIEQLAAAGVDEAQLQAKLTPDMKPSYLQGEVTRINNAITALGPVNMAALDELKAATERKSFLDAQSTDLNSAIETLEDAIRKIDAETRTLLQGTFDQVNQHFGELFPRLFGGGQAKLIMTGDEILDAGVQVMAQPPGKKNSTIHLLSGGEKALTATALVFAMFQLNPAPFCLLDEVDAPLDDANTERFANLVRAMSDKTQFLFISHNKIAMEMAQQLIGVTMQEQGVSRIVAVDMETAAGFAQ

SEQ ID NO: 7296 - protein, 401 aa, Burkholderia cepacia; identical to SEQ ID NO: 4538

SEQ ID NO: 7297 - protein, 78 aa, Burkholderia cepacia; identical to SEQ ID NO: 4539

SEQ ID NO: 7298 - protein, 472 aa, Burkholderia cepacia
  unsure (1)..(472): unsure at all Xaa locations
SFASLGLSADVVSALTAAGYQNPTPVQQRAIPAGIAGRDLMVSSPTGSGKTAAFMLPAIERFSQLQKTQAGQPREPRPADGARTRRPQPVARPTMLVLTPTRELAMQVTTAAATYGKHLKRLRTVSILGGVAYGQQLMLLAKNPEILVATPGRLIDHLERGRIDLSQLQILVLDEADRMLDMGFIEDIETIVAATPATRQTMLFSATLDGKITSLTGRLLKDPERIEIVQRMEQRTNIAQTVHYVDDRDHKDRLLDHLLRDSGLDQAIVFTATKIDADQLAGRLADAGFESAALHGDLPQGARNRTIRALRERRVRVLVATDVAARGIDIPGITHVFNYDLPKFAEDYVHRIGRTGRAGRSGIAVSLVHHAEQGALKRIERFVRTPLAVNVVEGFEPRKSAPSGNGRPGFGGRGRPGGGNGGGRRFGSGSGKPAGNGGAARSGTGSNGRRLGRQVGWRRFAXRRLRRRFARR

SEQ ID NO: 7299 - protein, 320 aa, Burkholderia cepacia; identical to SEQ ID NO: 4541

SEQ ID NO: 7300 - protein, 404 aa, Burkholderia cepacia
IMPIVFITYSLAYLDRANFGFASAAGINQDLGISKGLSSLIGALFFLGYFFFQIPGAIYAERRSVKKLVFWSLVLWGGCAALTGMVSNIPSLMVIRFVLGVVEAAVMPAMLIFISNWFTKSERSRANTFLILGNPVTVLWMSVVSGYLVHSFGWRHMFIAEGAPAIIWAVIWWFIVQDKPQQVSWLTQQQKDDLAETLRAEQGRDQAGAQLQRGLQNARGIKLCAQYFCWSIGVYGFVLWLPSILKNGSTLGMVETGWLSALPYLAATIAMLAASWASDKLNRRKVFVWPFLLVGAVAFAASYALGSTHFWLSYALLVIAGAAMYAPYGPFFAIVPELLPKNVAGGAMALINSMGALGSFVGSYVVGYLNGATGSPAASYAFMSVALVAAVILTLVVKPQPQAL

SEQ ID NO: 7301 - protein, 461 aa, Burkholderia cepacia
RETIGATQVLTDPHDTAPYLTDWRRRYTGAACAVLCPATPDEVAALVKLAVEHRIALVPQGGNTGLAGGATPDASGAQAVISLRRLNRVRDIDPHNNTITVEAGVILAEVQKHAEEAGRLFPLSLAAEGSCTIGGNLATNAGGTGVLRYGNTRELCLGLEVVTPQGELWDGLRGLRKDNTGYDLRDLFIGAEGTLGIITAAVLKLHPQPAARVTALAALASPHAALDFLSLTQRVAGPLLTGFELMSDFCLRLVGRHFEQMRYPFAEPHAQVVLLELSDSESEEHARELFERLMETALEGGLVQDAVVAENLGQSRAFWNLREHIPLAQAEEGLNIKHDIAVPISRIGHFIEETDAAIAQAVPGARMVTFGHLGDGNLHYNVQAPEGVGAKAFLQQYQAAINQIVYDSVHRHRGSISAEHGLGQLKIDEAMHYKQDVEVQLMRAVKRALDPLNLMNPGKVL

SEQ ID NO: 7302 - protein, 422 aa, Burkholderia cepacia
FDTLALHAGAAPDPTTGARATPIYQTTSFSFRDSDHAAALFNMERAGHVYSRISNPTVAVFEERVAALENGAGAIGTASGQAALHLAIATLMGAGSHIVASSALYGGSHNLLHYTLRRFGIETTFVKPGDLDAWRAALRPNTRLLFGETLGNPGLDVLDIAAVAQIAHEHRVPLLVDSTFTTPYLLKPFEHGADFVYHSATKFLGGHGTTIGGVLVDGGTFDFDASGRFPEFTEPYDGFHGMVFAEESTVAPFLLRARREGLRDFGACLHPQAAWQLLQGIETLPLRMERHVANTRRVVEFLAGHAAVGAVAYPELPTHPDHALAKRLLPRGAGAVFSFDLRGDRAAGRSFIEALSLFSHLANVGDARSLVIHPASTTHFRMDAAALAAAGIAEGTIRLSIGLEDPDDLIDDLKRALKAAQK

SEQ ID NO: 7303 - protein, 353 aa, Burkholderia cepacia
SGNTLGTLFTVTTFGESHGPAIGCVIDGCPPGLALNEADIQLELDRRKPGTSRHVTQRQEEDKVEILSGVFEGQTTGAPIALLIRNTDQRSKDYGNIADTFRPGHADYTYWQKYGIRDYRGGGRSSARLTAPTVAAGAVAKKWLREKFGTEIRGYMAALGEIDVPFVDWAHVRENPFFVPNQQIVPQLEAYMDALRKEGDSIGARINVVASGVPVGLGEPLFDRLDADIAHAMMGINAVKGVEIGAGFASVAQRGSVHGDELTPEGFVGNHAGGVLGGISTGQDITVSIAIKPTSSIRTPRRSIDKAGQPAVVETFGRHDPCVGIRATPIAESMLALVLIDHALRHRAQCGDV

SEQ ID NO: 7304 - protein, 253 aa, Burkholderia cepacia
NLEGKVALITGASSGLGKRFAQVLSQAGAKVVLASRRTERLKELRAEIEASGGAAHVVSLDVTDYQSIKSAVAHAETEAGTIDILVNNSGVSTTQKLSEVTPADFEYVFDTNTRGAFFVAQEVAKRMIMRGNNAQNPSYRIINIASMAGLRVLPQIGLYSISKAAVVHMTKAMALEWGKHGINVNAICPGYIDTEINHHHWSTEQGQKLVSMLPRHRVGKPDDLDGLLLLLAADESQFINGSVIAADDGFGLS

SEQ ID NO: 7305 - protein, 331 aa, Burkholderia cepacia
IVADAQKAFAEATDVTTLENEKARFLGKSGALTELLKGLGKLDPETRKTEGARINLVKQQVEAALTARRQALAEALLNQRLAAEAIDVTLPGRGTGAGSLHPVMRTWERVEQIFRTIGFDVADGPEIETDWYNFTSLNSPENHPARSMQDTFYVDGKDADGRQLLLRTHTSPMQVRYARTNTPPIKVIVPGRTYRVDSDATHSPMFNQVEGLWIDENISFADLKGVYTDFLEKFFERDDIQVRFRPSYFPFTEPSAEIDMLFETGKNAGKWLEISGSGQVHPTVIRNMGLDPERYIGFAFGSGLERLTMLRYGVQDLRLFFENDLRFLRQF

SEQ ID NO: 7306 - protein, 516 aa, Burkholderia cepacia
NLIDLIQSAARRTPDAESLVCGDVRLTYRQLLQSSRAFGQVLSSLGVAPGGRVAIFLDKRMETVVSMLGACAAGCVFVPVNPLLKPEQVAHVLRDSGARCLVTTALRVRALAAEGVAPVTDLILVDEPDQVTPDQPTAVRVHRWPDCISSPDDALVPAPAVTCIDTDLAALLYTSGSTGLAKGVMLSHRNLLEGAWSVAEYLRLDPSDRVLAVLPLSFDAGLSQLTSAWSAGATAVLLNYLTAHDAVLACEREHITAITGVPPLWMQLTGATWSDAARNTLRYFANTGGRLPLPVLQKLRALFPHATPFLMYGLTEAFRSTFLDPAEVDRRPDSIGKAVPNARVLVVREDGTPCNPDEAGELVHVGACVTLGYWNDAVRTAQRYRPSPEAKPGGAPRDMAVWSGDLVRCDSEGFLYFIARNDAQIKSSGYRISPEEIEETVHSSGLVVEAVALGVPDDELGEAVVLLVVLAGDSDIDELRNWCTQRLPRYMVPRHIASYPDIPRNANGKFDRAALR

SEQ ID NO: 7307 - protein, 301 aa, Burkholderia cepacia; identical to SEQ ID NO: 4550

SEQ ID NO: 7308 - protein, 413 aa, Burkholderia cepacia
QRKNNATPRGVGVMCPFYADTALNAELWDVEGRRYIDFAAGIAVLNTGHRHPKVMAAVREQLDRFTHTCWQVVPYPSYVELAEQLNRLAPGDFQKKASLFSTGAEAVENAIKIARAFTGRAAVIAFSGSFHGRTMMGMALTGKVAPYKVGFGPFPGEVYHAPYPNTLHGVTTTNALDSVRALFKTDVDPLRVAAIIFEPVQGEGGFYEAPADFVKGLRDICDQHGILLIADEVQTGFARTGKLFAMQHHAVAADLTTVAKSLAGGLPLSGVIGRADVMDAAAPGGLGGTYAGNPLSVAAALAVLDVIESENLCERATQLGNRLKSHLTSMRESLPHIAEIRGPGAMIAAEFFEPGTLIPDADFAKRFQARALELGLILLVCGVHSNVIRFLFPLTIEEAVFEEALVLIETAMK

SEQ ID NO: 7309 - protein, 475 aa, Burkholderia cepacia
SLFRQECYIAGEWIESDPMARIDVVNPANGLKIGTVPRATLADVRTCIDAAERALPAWSGKTGKERAAILRRWYELMLQHQEDLAVIMTCEQGKPLAESRGEIVYAASFLEWFAEEAKRVYGDTIPTPASDRRIVVLKQPIGVCAAITPWNFPAAMLTRKIGPALAAGCTMVLKPASQTPFSALALCVLAERAGVPAGVLSCVTGKASMIGDEFCRNPAVRKLSFTGSTEIGKLLLQQCASTVKKTSMELGGNAPFIVFDDADLDAAVVGAIAAKFRNAGQTCVCVNRFLVQDTVHDAFVEKLSTAIAALKVGDGLDAGTRIGPLIDSKAVEKAREHVDDAIARGATVVTGGSGHALGGNYFEPTLLTGASKDMKIFREETFGPVAPVFRFRTEEEAIQLANDTEFGLASYFYGRDIGRVWRVAEALEYGMVGINEGLISTEVAPFGGVKESGLGREGSKYGIEDYLEVKYLCMG

SEQ ID NO: 7310 - protein, 485 aa, Burkholderia cepacia
MADQVEVFSMYIDGEFVQAEGGRTLDSINPWSGSVWAKVPDATAADVNRAVEAAHRAFTSGPWPKMTPTERAVLLQKLADKLVEHKERLGYVETQDTGKLLKETTWQAGHTARAYTYFAGLADKLQGDIPPSGASMLNLVLHEPVGVVAAIIPWNSQLQLSAYKIAPALATGNTIVVKASEDASTPLLTLAKLVHEVGFPPGVINFVSGGANPCAITLTSHPLVRRIAFTGGADTARRLIPNSAHNIAKLSLELGGKSPVIVFDDADLDSCVNGIVAGIFGASGQSCAAGSRLLAHESIHDVLVERLVERCKTIRVGDPFDAATNMGPLATARQVDRIETLLASSVEQGARVVSGGKRIGGLPFNQCFEPTIALCDRSDYPIVQEELFGPVLSVLKFRDDDEAVALANDSKYAFAGGIFSRDFARAMRTARVVNAGRLWINTYRVTGVNVPFGGFKQSGYGREAGIDALKDYTETKAVMIEVGGE

SEQ ID NO: 7311 - protein, 541 aa, Burkholderia cepacia
YDYVVVGAGSAGCAVAARLAEDLSVTVALLEAGPHDHHMSVWVPIGLASTVQKAGPRNYAYYTERQPGLDGRPSFQPRGRGLGGSSSINGMVYIRGHRNDYDEWAGMGCTGWGFDDVLPYFRRSECNQRHAGRTDDPWHGGDGPLHVSDLRSPNPFSHRFVNAALQAGLPLNTDFNGAEQEGAGLYQVTQFNGERWNAARAYLHNGNAKDANLNGGRPNLDVLPDTQVLRLVVEDKRARGVRVVRAGIEQTVRARREVVLSCGAFNSPQLLMASGIGPAGHLRSHGIEVIQDLPGVGENLQDHLDVIVNKQVKSNDLYGYSAGGFLRLASGIWRYRRDRSGMVSSNFAEAGAFVKTRPDLAVPDVQLAFVLALLGNRTVAKRSKLGHGYSCHAYILRPQSRGHVRLRSADMRDAPSIDPRFLSAEADMDALVAGVRIVRRIFAQPALAEAGGQELLTDDFGPDDSNEEAIRAFVRSRADSVFHPVGTCKMGIDSMAVVDPSLRVRGIEGLRVADASIMPTLIGGNTNAPAIMIGEKAADLI

SEQ ID NO: 7312 - protein, 485 aa, Burkholderia cepacia
PHELDTPRRTQGNAMKTLNTFYIGGHWVEPSAGSTQTDIVNPATETLTGHLAMGTAQDADRAIAAARAAFPAWSESSRAERVALLERIIECYRARLDDIAEAVRIEIGAPITLCKHLQAAIGLSQLEAALETLRHFEFETRHDKSYVRREAVGVAALITPWNWPLNQIAAKVAPALAAGCTIVLKPSEIAPLDAVIFAEIMHAAGTPPGVFNMIFGEGRVVGARLSSHPGVDMVSITGSTRAGVEVAVSAAPTVKRVAQELGGKSPLLILDDADLQQAVTSGVMQCMANSGQTCVAPTRMLVPRERYDDAIAIAAAVANGIVVGDPADPATRMGPISNRAQYEKVQHMIRAGIEEGARVIAGGPGRPEGLAQGFYARPTVFADVRNDMMIAREEIFGPVLVMIPYDGEEHAITIANDTQYGLAGYIATRDPERARRVAARLRVGSVRINGAMLDITVPFGGYKTSGNGREYGREGLAEFLECKSV

SEQ ID NO: 7313 - protein, 375 aa, Burkholderia cepacia; identical to SEQ ID NO: 4556

SEQ ID NO: 7314 - protein, 399 aa, Burkholderia cepacia; identical to SEQ ID NO: 4557

SEQ ID NO: 7315 - protein, 271 aa, Burkholderia cepacia
KLDGKVALVTGSGRGIGRAIAEKLASEGARLVINDLDADPAHETVEALKKMGAEAVACVGNVGAPDFADRFINTAMSTYKGIDIIVNNAGYTWDDVIQKMTDEQWYAIIDCHMTAPFRILRAAYPHVKALHAADKEAGRDVYRKIVNISSTSALNGNAGQMNYSSAKAGVIGMTRALSREWGRFNVNVNCVAFGLIHTRMTTADAHAGATVKIEGRDIRVGLNPELLKTHAQRNPLGRGGTPEEAAGGVYLFCSPESNYITGQTIAVAGNL

SEQ ID NO: 7316 - protein, 509 aa, Burkholderia cepacia
TSMYLTQGLHRSLQQNPDRVAISFKGRTRTFREFADRVARLAAALREIGMTADDRVGMLALNSDRYLEYVMGVWWGGGVLNPVNIRWSAAEIAYSLDDCDTRILIVDDHFADIAREVCALARTAPLLIHAGDGAAPTGMLSFDTLIAAAAPMPDAGRGGADLACIMYTGGTTGFPKGVMQTHLNIWSSCIMRIAESAPLPDTAVLHAAPFFHVAGLGRALVQFIAGEAHVVIPAFDAGAVLKAIGEERVSDTLLVPTMIQAVLNHPDFARTDLTSLKRLTYGASPIPETLLDRLIEALPGIQLAHSYGMTEACPSISANSPSNHDEAGRRSGLYRSIGRGLPGLMVKVVDSDGAEVPRGTVGEIVVRGPNVMAGYWKKPEETAQAVRDGWLHTGDGAYMDAQGYLYIVDRIKDMIVSGGENVYSRRVESVIARHPAVAACAVIGIPHDTWGEAVHAVVVCKPGATLAEEEIREHCRQVIAGYKCPKSVEFRVQLPLSGAGKVLKREIRA

SEQ ID NO: 7317 - protein, 367 aa, Burkholderia cepacia
EDFRAEVKHFLDGHLPPAPADVRARSWMGFDADFSRRLAARGWIGLTLPASYGGAGMDAFRRFVLVEELLAAGAPVAAHWIADRQSGPLILRYGTGAQKDFYLPRICAASAFFCIGMSEPDSGSDLASVRTRAVRCDGGWRLTGRKIWTTNAQHCQYMIALVRSSGVPEDRQKGLSQFIVDLSLPGVEVRPIVDLTGDAHFSEVTFDNVFLADDALIGDEGAGWQQVTAELAFERSGPERLYSSVVLLDCWRAQLRRHGASDADLALLGSFATQLATLRCLSIAVTARLAHGESPVVEAALVKDIGTEFEQAIPAQLEAAISADPAQTIDPELFRTVAYLSQISPTFSLRGGTREVLRGMIARGLGL

SEQ ID NO: 7318 - protein, 468 aa, Burkholderia cepacia
KYLGDHAGLTPDKAAAINSTSGEVLTYRELDERSNRFAQCLYAAGLRRGDHIAMVLENNMRCFEVCWAALRSGLMITPVNRYLTAAEAAAIIEDSHAQVVVSSYAMRELAAGLTGMMPTCRLRLMVDGTISGWDSYEALTGRYPATRLADEWLGAMMIYSSGTTGRPKGIIRAQPQGRVTEGSGSARRPQFERYGFDAQTVYLSPAPLYHTAPLGYGIETQFGGGTVVFMEKFEPLEALQAIERYRVTHSQWVPTMLIRLLKLGPAVRNAFDLSSHRVAIHAAAPCPQEVKRQMIDWWGPIIEEYYSSTEGNGVTTLNTEEWLAHPGSVGRALLGVIHICDDDGNELPVGETGTVYFERDQLPFRYHNDPDKTRAAQHPRHPAWTAVGDIGHVDADGYLYLTDRKAFMIISGGVNIYPQAIEDALAVHPDVQDAAVIGVPDAEMGEQVKAIVEPAPGVAPSDALAERL

SEQ ID NO: 7319 - protein, 295 aa, Burkholderia cepacia
LCKDRVVVITGAGRGLGREYALEFARQGAKVVVNDLGGKGDGSGAASGPALDVVAEIEALGGEAVANFDDVADWNGAKNMIDTAISAFGGLDVLVNNAGILRDRTLANMSEEDWDSVIRVHMRGTFAPSRHAAAYWRDEAKAGRERVARLINTSSSSGLYCNPGQANYGAAKAGIAAMSVIAARELERYGVTVNAIYPTAMSRLTEDIFAKRRDEFTAGAAPGFDPLDAGNVAPLVAWLGSSASSGITGRVFGVRGGRITVAEGWHAGPRIEKDGRWDVAELGALIPGLVEQAAP

SEQ ID NO: 7320 - protein, 389 aa, Burkholderia cepacia; identical to SEQ ID NO: 4562

SEQ ID NO: 7321 - protein, 417 aa, Burkholderia cepacia; identical to SEQ ID NO: 4563

SEQ ID NO: 7322 - protein, 304 aa, Burkholderia cepacia
LNNRFVLEECLGVGGMGTVYKALDLRKLEASDRKPYLAIKVLNVQFRGNPNSLVALQREARKAQVLAHRNIITVYDFDRDGPIVYLTMEYLSGKPLSQLLRTPGYQGMPVRAALPIVRGMSSALAYAHERGFVHCDFKPANVFLTTNAEVKVIDFGIARVFQRPEEESDATVFDPGSLGALTPAYASPEMIEHREPDPRDDIYALGCITYELLTGHHPFDRLSATQARNADFKPQRPANLDAKQWRALRAALSFDRNTRMPSVERFIAEFDNEARAEKSGTLAKVGLASFAVVVPRQSAYSRSA

SEQ ID NO: 7323 - protein, 672 aa, Burkholderia cepacia
APRTLFDKLWDSHTIANLPGGADLLQVDRNLMHELTGVEAVRVLEARHLPVSNPELTFATLDHVISTRPGREAGDADWSTTMVDTLREQAAQHAIPLFDIGTEGRQGIVHVIGPELGLSLPGTLIVCADSHTCTHGALGALAFGIGSTELVHVLATQTVRQKKPKTMRIRFKGSVAEGVTAKDMILYVIGALGAGAGTGYAVEFAGEAVEALSMEARLTLCNLTIELGAKFGLVAPDETTFAYLRGRPYAPQGASFEAALEDWRRLPTDDGAHFEREVEIDAAAIAVQVTWGTSPEHVIAIDAAVPDPGNESDPARREALQRALDYMGVHAGQHLDELAVDRVFIGSCTNSRIEDLQAAARIVAGHHVAEGVTAWVVPGSLSVAREAEAQGLAQIFRTAGFEWREPGCSMCVGANGDVVGRGERCVSTSNRNFVGRQGPGARTHLASPAVAAASALAGHIAAPVSYAGAASMKAFTMVKGPAASLPRNNVDTDLIIRIERISQLVRGQLGPWLFETLRYREGGPEQGEREDFVLNQPAFRHACILLGGVNFGCGSSREMAVWALEEFGIRCVIAPSFGDIFFANCLQNGLLPICLDAASIGTLAAVAADGTPLEVDLRTLQIRADGLEPMPFEFDAARRAVLLEGLDEVDQTLRLADDIDAFRRTDRAKRAW

SEQ ID NO: 7324 - protein, 258 aa, Burkholderia cepacia; identical to SEQ ID NO: 4567

SEQ ID NO: 7325 - protein, 409 aa, Burkholderia cepacia
RRSAPAGIPMNDAFICDAIRTPIGRYGGALKDVRADDLGAVPIRALIDRNPGVDWRALDDVIYGCANQAGEDNRNVARMSALLAGLPTEAPGATINRLCGSGMDAVGTAARAIKAGEARLMIAGGVESMTRAPFVMGKATGAFSRQAEIYDTTIGWRFINPLMKRQYGVDSMPETAENVAVEFSVSRADQDMFALASQQKAARAQQDGTLAQEIVGVEIAQKKGDPVRVLLDEHPRETSLESLGKLKGVVRPDGSVTAGNASGVNDGACALLLANQQAADQYGLRRRARVVGMATAGVGPRIMGIGPAPATQKLLKQLGMTLEQFDVIELNEAFASQGLAVLRTLGLRDDDPRVNPNGGAIALGHPLGASGARLITTALYQLERINGRFALCTMCIGVGQGIALVIERL

SEQ ID NO: 7326 - protein, 208 aa, Burkholderia cepacia; identical to SEQ ID NO: 4569

SEQ ID NO: 7327 - protein, 329 aa, Burkholderia cepacia
  unsure (1)..(329): unsure at all Xaa locations
RSPRNSASRLPLWHQTTSARRSAVTSCGRVERRKAAPPALALNAVPTPXATQRLLRHFPAMTSASRTRSNPSQASLFGDAASEPTSATSTTPQKSGASAPPPTLEAQFDALPPAWRAHLKPFIESDAYAPLCRFVDGERAAGKTVYPADVFRALRLTSPDEVKVVILGQDPYHGEDRGTPQAHGLAFSVAPNVRTPPSLRNIFKEIAASLGHETPRHGCLDTWAKQGVLLLNTVLTVERDSAASHAKRGWEKCTDTLIHELAMRHDGLVFMLWGAHAQAKRALLGGKSHCVLEAPHPSPLSAHRGFLGCGHFAKANEYLAQHGREPIDW

SEQ ID NO: 7328 - protein, 410 aa, Burkholderia cepacia; identical to SEQ ID NO: 4571

SEQ ID NO: 7329 - protein, 525 aa, Burkholderia cepacia; identical to SEQ ID NO: 4572

SEQ ID NO: 7330 - protein, 379 aa, Burkholderia cepacia
MAKRDYYEVLGVAKNASDDEIKKAYRKLAMKHHPDRNPGNKDAEGHFKEVKEAYEMLSDSQKRAAYDQYGHAGVDPNMGGAGAQGFGGFADAFGDIFGDIFGQAAGGAARGGGGRAGPQVYRGADLRYSMEITLEQAAHGYDTQIRVPSWVSCEVCHGSGAKPGTKPETCPTCSGSGSVRMSQGFFSIQQTCPKCHGTGTYIPDPCGHCHGAGKVKETKTLEVKIPAGIDDGMRIRSAGNGEPGINGGPSGDLYVEIHIKQHSVFERDGDDLHCQMPIPFTTAALGGEIEVPTLAGRASFTVPEGTQSGKTFRLRGKGIKGLRSSIAGDLYVHVQVETPVKLTEPQRDLLKQFEKALVEGGSRHSPQSKSWFDRVKSFF

SEQ ID NO: 7331 - protein, 653 aa, Burkholderia cepacia
MGKIIGIDLGTTNSCVAIMEGNSVKVIENSEGARTTPSIIAYMEDGEILVGAPAKRQSVTNPKNTLYAVKRLIGRRFEEKEVQKDIGLMPYKIIKADNGDAWVEVRDQKLAPPQISAEVLRKMKKTAEDYLGEPVTEAVITVPAYFNDSQRQATKDAGRIAGLEVKRIINEPTAAALAFGLDKNEKGDRKIAVYDLGGGTFDVSIIEIADVDGEKQFEVLSTNGDTFLGGEDFDQRIIDYIIGEFKKEQGVDLSKDVLALQRLKESAEKAKIELSSSQQTEINLPYITADASGPKHLNLKITRAKLEALVEELIERTIEPCRVAIKDAGVKVGEIDDVILVGGMTRMPKVQEKVKEFFGKDPRRDVNPDEAVAVGAAIQGQVLSGDRKDVLLLDVTPLSLGIETLGGVMTKMINKNTTIPTKHSQVYSTADDNQGAVTIKVFQGEREMAAGNKLLGEFNLEGIPPAPRGTPQIEVSFDIDANGILHVGAKDKATGKENRITIKANSGLSEAEIEKMVKDAEANAEEDHKLRELADARNQGDALVHSTKKALTEYGDKLEAGEKEKIESALKDLEETLKSGSSDKAAIEAKIEVVATASQKMGEKMYADMQAAQGAEAAAAGAAGAGGAGASAGGASQQQDDVVDAEFKEVKKD

SEQ ID NO: 7332 - protein, 308 aa, Burkholderia cepacia
RVAVLLINLGTPDAPTPRAVRRYLAQFLSDPRVVEIPALLWQIILRLLILPFRGSASAKKYAAVWMPEGSPLRVYTEKQVEGLRHLLQLNDYTVLVDYAMRYGTPGIPAMLNQLKLAGAERVLLMPMYPQYSSSTTATAFDDAFSALKRMRNQPEIRTVRQYADHPAYIAALAAQVHQYWHQHGRPDFAAGDKLVLSFHGVPKRTLDLGDPYHEQCQQTGALLMQALELTPVECRITFQSRFGKAEWLQPYTAPTLKELGAAGVRRADVFCPGFTADCLETIEEIGMEVRDEFLHAGGKDFHRIPCLN

SEQ ID NO: 7333 - protein, 347 aa, Burkholderia cepacia; identical to SEQ ID NO: 4576

SEQ ID NO: 7334 - protein, 438 aa, Burkholderia cepacia
VSVSEAVRVHHGRDESPFDPQLPDAVVFARTTEDVQNVVKLCGQYNVPVIPYGNGSSLEGHLLAVQGGVSIDLSEMNRVLSINAEDLTVTVEPGISRKQLNEALRDTGLFFPIDPGADASIGGMSATRASGTNAVRYGTMRENVLGLTVVLADGRVIKTGTRARKSSAGYDLTRLFVGSEGTLGVITEITVRLYPQPEAVSAAVCTFPSMGDAVRAVIETIQIGVPIARVEFVDSLAIRSINRHSNLTLREAPTLFFEFHGTEAGVKEQAELVQEVAAQNAGEGFEWATRPEDRSRLWNARHNAYFAMLQLKPGCRAVTTDVCVPISRLAECVEETEQDLKASPLPCPIVGHVGDGNFHVAILIDPNKPEELVEAERLNHRIVERALRMDGTCTGEHGVGLHKMGFLLEEHGEVAVDTMRSIKHALDPHNLMNPGKIF

SEQ ID NO: 7335 - protein, 479 aa, Burkholderia cepacia
VVQALMAVLPTHCLLYREEDTVAYECDGLAAYRRLPLAVALPETESQVQRIVQICHRLDVPIVPRGAGTGLSGGAMPIRHGVVVSLARLRKIVEVDSYARTATVQPGVRNLSISEAAAPYGLYYAPDPSSQIACTIGGNVSENSGGVHCLKYGLTVHNVLRVRAVTMEGEIVEFGSLAPDAPGLDLLAVLIGSEGMFAIVTEVTVKLIPKPQTAQVIMASFDDVVKGGDAVAGIIAAGIIPAGLEMMDKPATRAVEEFVNAGYDLDAAAILLCESDGTPDEVADEIVRMTAVLREHGATRIQISRSENERLRFWSGRKNAFPAAGRISPDYYCMDGTVPRRSIGPLLTRIEAMEKIYNLRCINVFHAGDGNMHPLILFNGNDRDEWHRAEAFGCDILEACVELGGTVTGEHGVGIEKINSMCVQFSPEERDAFHAVKRAFDAPGLLNPDKGIPTRARCAEYGKMHVRGGLLPHPDLPRF

SEQ ID NO: 7336 - protein, 269 aa, Burkholderia cepacia; identical to SEQ ID NO: 4579

SEQ ID NO: 7337 - protein, 475 aa, Burkholderia cepacia; identical to SEQ ID NO: 4580

SEQ ID NO: 7338 - protein, 259 aa, Burkholderia cepacia
RLRDRVALVTGAGCIGPGWGNGRAIAVRFAEEGAHVVAIDRNLASMDETLELIRQAGGKVTPYECDVTDSAAVERLVADIVARSGRIDVLVNNVGAPAPGGPVQLSEAQWGEQLELNLTTTFLMCHHVLPVMEGQAGGSIVNIASTSGIRWTGAAQVGYAAAKAGVIQFARVVAVEYASKNIRANSVVPGLLYTPMVDTTIARNQTGGDLELLLRKRKARIPLPFMGDGRDTANAALFLASDEARFITGTEIVVDGGMS

SEQ ID NO: 7339 - protein, 154 aa, Burkholderia cepacia; identical to SEQ ID NO: 4582

SEQ ID NO: 7340 - protein, 440 aa, Burkholderia cepacia
MSVFTSKVVRNLFGTDAMRTIFSDDTRVANYLKIEVALAKVEAGLGVIPQDAWRDIEQKSHSFEIDWERFRIDVEAVGYPVMPFVTQLAEHCGESGEYLHWGSTTRDITDTSFVLQLREALGVLAADLDKVRRKLREMTARHRSTLMIARTHGKHALPSTFGFRCAVWYSEVERQCERLAALRAEPFVGQFGGAIGTLAAVGPRGLEVQSALMAELGLGTAEIAWFASRDRVSEVVFRIASIAQSMASIAKSLVIMTRDELAEASEGGGEQRGTSSAMPHKHNTVVPELVIVHGKMATQQVAIVMESMVQDFERDWQGHFETIAVPQTFQHAHAAVTQMHTVLSGLILHEDRMRANLDVTRGQVMAESVMMALAPKLGRKNAHHAISRLCNQALAEDRPLGEVLRADPQVAQYLGEHELADALDPAGYIGLATQVVDNVL

SEQ ID NO: 7341 - protein, 376 aa, Burkholderia cepacia
ELTDAQRQLQQSARRLALEAIAPHAAQTDRSEQYPWHTVEALREQRLMGMTLPPEYGGKGASYFDTVLVIEELSKVCAASGRIMVESNMGAIGAIMKYGSDAQKQLAARLVLAGDKPAICITEPQAGSAASDMQTRAERRGDTWHLSGCKHWITGGGVSKLHFVFARAIEDGKDTGIAGFIVVGPDVPGMTIQRIPAMGIRGVPEARIEFDDMRVRHDMKVTPPGRTEAGFAGLMNAYNAQRVGAATVALGIAQGAFDLALDYAKRREQFGRPIAEFQGLQWMLADMSIQLEAARLMVWKAAASGSEFPSMFAAAQAKIAAGEAAIKVTNDALQIHGAVGYGRDLPLERMVRDARMFTISGGTAQILRTQVAGTLL

SEQ ID NO: 7342 - protein, 469 aa, Burkholderia cepacia; identical to SEQ ID NO: 4585

SEQ ID NO: 7343 - protein, 247 aa, Burkholderia cepacia; identical to SEQ ID NO: 4586

SEQ ID NO: 7344 - protein, 300 aa, Burkholderia cepacia
SMSAIEIRNVKKRYKDLQALKGVSLTVEEGEFFGLLGPNGAGKTTLISILAGLARADEGSIAVRGHDVVSDFRAARRALGVVPQELVFDPFFTVRETLRIQSGYYGLRNNDAWIDEIMANLDLTDKADANMRALSGGMKRRVLVAQALVHRPPVIVLDEPTAGVDVELRQTLWKFISRLNREGHTIVLTTHYLEEAESLCDRIAMLRRGEVVALERTSTLLQRFAGMQLFLRFSQGVLPADLRVLEVESGTGNGNGRQHLLRLASYDDVEKILAQCRAAGCTFEEIEVRKADLEDVFVQV

SEQ ID NO: 7345 - protein, 406 aa, Burkholderia cepacia
DEAIERSVAQILNDVKARGDAAVLEYTSRFDRVEAKSVDALELPMSELEAALEGLEPKRRAALEAAAARVRGYHEKQKIECGSHSWRYTEADGTVLGQKVTPLDRAGIYVPGGKAAYPSSVLMNAIPARVAGVREIVMVVPTPDGVKNPLVLAAALLGGVDRVFTIGGAQAVGALAYGTATIPAVDKICGPGNAYVASAKRRVFGTVGIDMIAGPSEILVLCDGTTDPRWVAMDLFSQAEHDELAQSILLCPDDAFIGRVKDAIDELLPTMPRRDVISASLEGRGALIKVRDMAEACAIANDIAPEHLEISALEPQQWGQLIRHAGAIFLGRYTSESLGDYCAGPNHVLPTSRTARFSSPLGVYDFFKRSSVIEVSAEGAQTLGEIAAELAYGEGLQAHARSAEYR

SEQ ID NO: 7346 - protein, 346 aa, Burkholderia cepacia
IIRRDVLAMTSYPVPDATGYIKLDAMENPFPLPPVLAAHLGEHLAGVALNRYPAPRPDALIEKIKRVMQVPPGCDVLLGNGSDEIISMVSVACAQPGAKVLAPVPGFVMYQMSAKLANLEFVGVPLKADFTLDTEAMLAAIAEHQPAIIYLAYPNNPTGTLFDDADMERIIAAASKSLVVIDEAYQPFAQQSWLPRADAFDNVVVMRTVSKLGLAGIRLGYLVGKPGWLTEFDKVRPPYNTNVLTQAAADFLLDHVDVLDSQAAQLREERTKLAHAIAQLPGAEVFPSAGNFLLVRVPDASVLFETLLAARVLIKNVSKMHPLLANCVRLTVGSPEENAQLLAALK

SEQ ID NO: 7347 - protein, 194 aa, Burkholderia cepacia; identical to SEQ ID NO: 4590

SEQ ID NO: 7348 - protein, 257 aa, Burkholderia cepacia
  unsure (1)..(257): unsure at all Xaa locations
LAKRIIPCLDVTAGRVVKGVNFVELRDAGDPVEIARRYDDQGADELTFLDITATSDQRDLILPIIEAVASQVFIPLTVGGGVRAVEDVRRLLNAGADKISMNSSAVANPQLVKDATDKYGSQCIVVAIDAKRVSAEGEVPRWEVFTHGGRKATGLDAVEWARKMAELGAGEILLTSMDRDGTKSGFDLALTRAVSDAVPIPVIASGGVGNLQHLADGIKEGHADAVLAASIFHYGEHTVGEAKRFMADQGISVRLXR

SEQ ID NO: 7349 - protein, 236 aa, Burkholderia cepacia; identical to SEQ ID NO: 4592
  unsure (1)..(236): unsure at all Xaa locations

SEQ ID NO: 7350 - protein, 627 aa, Burkholderia cepacia
QETMSFQAEVKQLLHLMIHSLYSNKEIFLRELISNASDAADKLRFEAIENSALYENDPNLRIRVSYDKDARTITIDDNGIGMSRDEAIANLGTIARSGTKEFFGKLSGDQQKDAALIGQFGVGFYSGFIVADRITVETRRAGLPASEGVRWESAGEGDFAVEQIERAARGTTITLHLRADEDELLSSHRLKSIIQKYSDHVALPILMKKEEWDAEKSAMVTKDEDETVNQASALWTRSKSDITDEQYKQFYQHLSHDHQDPLTWTHNRVEGRSEYTQLLYVPTHAPFDMFNRDHRGGLKLYVKRVFIMDDAEQLLPAYLRFVKGVVDSADLPLNVSREILQESRDVKAIREGVTKRVLSMLEDLANSDNEADKEKYAGFWKEFGQVLKEGIGEDFANRERIAKLLRFASTHTDTPEQTVSLADYVARMKPEQTKIYYVTADTWQAATHSPHLEVFRKKGVEVLLLTDRVDEWILSFLTEFEGKPLQSVARGDLDLGALNDEEKEAQEKVSEEFKPLVEKMKEALKDKAKDVRLTFRLTDSPSCLVADDGEMSGYLQRMLKAAGQQAPSFHPILEVNPEHALVKGLHADSANFDDWCHLLFDQALLAEGGALEDPASFVKRTNALLLA

SEQ ID NO: 7351 - protein, 313 aa, Burkholderia cepacia
MTTALDQLKQYTTVVADTGDFQQLAQYKPQDATTNPSLILKAVQKDDYKPLLEKTVKAHASKPVGAIIDQLLIAFGTEILKIIPGRVSTEVDARLSFDTEGSIAKGRELIALYKEHGIGRERVLIKLASTWEGIRAAEVLQKEGIHCNMTLLFSLAQAAACAEAGAQLISPFVGRIYDWYKKNAGSAWDEAKDGGANDPGVKSVRRIYAYYKKFGYKTEVMGASFRTPGQILELAGCDLLTISPDLLQKLHESTEKVERKLSPDIAKESDIERVPVDESSFRFLVNDEAMATEKLAEGIRAFAADAIKLEKLI

SEQ ID NO: 7352 - protein, 378 aa, Burkholderia cepacia
RVMLLGAGELGKEVIIALQRLGVEVIAVDRYPNAPGHQVAHRAHVIDMTDRAALRALVEQERPHLIVPEIEAIATDELAAIESAGLAEVIPTARATQLTMNREGIRRLAAEELGLPTSPYAFADSLDELRAGIAKVGYPCVVKPVMSSSGKGQSVLRGDADVEPAWQYAMAGGRVNHGRVIVEGFIDFEYEITQLTVRAINPASGEVSTYFCDPIGHVQVAGDYVESWQPQPMSPLALERSREVAHKVTAALGGRGLFGVELFVRGDDVWFSEVSPRPHDTGLVTLCSQRFSEFELHARAILGLPVDTSLRAPGASAVIYGGLDEAGIAFEGVAAALAVPNADLRLFGKPESFVKRRMGVALATGETTDEARSRAKQA

SEQ ID NO: 7353 - protein, 457 aa, Burkholderia cepacia
AANTDLEVTDKFSGEVATRVAMADAAAIDQAIGHAVDAMPALRAFPPFKRQAVLEHCVKRFRERYDELALALCIEAGKPINDSKGEVTRLIDTFKVAAEEAVRIDGEIVNLEISPRAKGYHGYVKRVPIGPCSFISPFNFPLNLTAHKVAPAIAAGVPFVLKPASRTPVGALIMGEILAETDLPKGAFSILPAHRDGADLFTTDERFKLLSFTGSPAVGWELKKKAGKKKVILELGGNAAAIVDGDQGEKLDYVVDRLAFGAFYQSGQSCIGVQRILVHAKVYDALREKLIARTKSLVMGDPKDEKTFVGPMISESESRRLAGWMESAVQAGAKIVAGGKVEGAMFEATLLEGVQRDTDLYRKEAFGPVAILERFDDFGAALATVNDSDFGLQAGVFTDSLAHAHRAWDELEVGGVVINDVPSFRVDNMPYGGVKDSGLGREGVRYAIEDMTEMRLM

SEQ ID NO: 7354 - protein, 465 aa, Burkholderia cepacia; identical to SEQ ID NO: 4597

SEQ ID NO: 7355 - protein, 640 aa, Burkholderia cepacia
SLDTAITRATDAILAAQKPDGHWVYELEADATIPAEYVLLVHYLGETPNVELEQKIARYLRRIQLPDGGWPLFTDGAPDVSASVKAYFALKMIGDPADAEHMVRAREAILANGGAEAVNVFTRILLALFGVVSWRAVPMMPVEIMLLPMWFPFHLSKVSYWARTVIVPLLVLNAKRPLARNPRRVRIDELFRGAPVNTGPRDRAPHQHAGWFRFFSGVDMLLRAVDGLFPKATRERAVRAAVAFVDERLNGEDGLGAIFPAMANSVMMYDVLGYPADHPNRAIARQSIEKLLVIKDDEAYCQPCLSPVWDTSLVAHALLETGEARAEQAAERGLAWLRPLQILDVRGDWISRRPNVRPGGWAFQYNNDYYPDVDDTAVVVMAMHRSAALTHSEVDREAIARAREWVVGMQSSDGGWGAFEPENTQYYLNNIPFSDHGALLDPPTADVSGRCLSMLAQLGELPQGSEPAQRAFAYMLKEQEPDGSWYGRWGLNYIYGTWTALCSLNAAGMPHDDPRMKRAAKWLLSIQNEDGGWGEGGESYKLDYHGYERAPSTASQTAWALMGLMAAGEVNHEAVARGVAYLQREQREHGLWDETRFTATGFPRVFYLRYHGYRKFFPLWALARFRHLKRHGLTRVAVGM

SEQ ID NO: 7356 - protein, 79 aa, Burkholderia cepacia; identical to SEQ ID NO: 4599

SEQ ID NO: 7357 - protein, 275 aa, Burkholderia cepacia; identical to SEQ ID NO: 4600

SEQ ID NO: 7358 - protein, 429 aa, Burkholderia cepacia
  unsure (1)..(429): unsure at all Xaa locations
RLDRLPIGRFHWRLLGLIGGGLFLTXFEVYVAGGVVGFLVKTGWANMHSAAMFVSASVAGMALGTWLAGVLGDRFGRRFTYQFNLLLFGLASFAAAVVSSMDQLIVARFVMGIGLGAEVVVSYGTLVEYIPPAHRGRWSSGLSLCGNAALFVAALVGYFVIPDLGWRWLFGGVGVAALIIWYMRKAVPESPRWLESQGRFEEADRILDDIEQELAYVGQPGEAAVPAYAVVPDLPRRMLVPRFIIGIMMSVAGNAAFYGLIVWLPTFFFRQGFTVGSSLGYSMVMSAGGPAGALVGMAIADRVRRKRAIIVLSIVAALLGLVYPLCKTPLSVLVTGFLLVSALYAFVAVAWASYLPELFPTRIRLRASAVCNVTGRLAAIAMPFAVVQLYAKFGVFGVVGALGGILLAQAAVIALLGIDTNNVSLEELT

SEQ ID NO: 7359 - protein, 372 aa, Burkholderia cepacia
TDEQRMIRDAARDFATQCLAPHAAKWDRDGDIPQNIVSQLGELGLMGMTVPAEWGGTYTDYVAYALAVEEIAAGCAACATMMSVHNSVGCSPILNFGTDEQKSLYLADLASGRAIGAFCLTEPQAGSEAHNLRTRAVLRDGTWVLNGSKQFVTNGRRAAVAIVFAVTDPDAGKRGISAFIVPTHTPGFKVGKPEKKLGIRASDTCPVTLEDCAVPESTLLGRRGEGLKIALSNLEGGRIGIAAQAIGIARAAFDAARSYAAQRIQFGKPIREHQSVANMLADMITRLNAARLLVHHAARLRSAGLPCLSEASQAKLYASEVAEEVCSQAIQIHGGYGYLEDYPVERHYRDARITQIYEGTSEVQRMVIARQL

SEQ ID NO: 7360 - protein, 588 aa, Burkholderia cepacia; identical to SEQ ID NO: 4603
  unsure (1)..(588): unsure at all Xaa locations

SEQ ID NO: 7361 - protein, 175 aa, Burkholderia cepacia; identical to SEQ ID NO: 4604
  unsure (1)..(175): unsure at all Xaa locations

SEQ ID NO: 7362 - protein, 331 aa, Burkholderia cepacia
MARKITFSQAINEALSQEMARDETVIVMGEDNAGGAGSPGEQDAWGGVLGVTKGLFHKYPGRVLDTPLSEGGYIGAAVGAAACGMRPVAELMFIDFMGVCFDQIFNQAAKFRYMFGGKAVTPVVIRAMQGAGLRAAAQHSQMLTSLFTHIPGLKVVCPSTPYDAKGLLIQAIRDNDPVIFCEHKLLYSREGDVPEESYAIPFGEANVVRDGDDATIVTYGRMVHYATEAAEKLAKDGIEVEVIDLRTTSPLDEDTILESANRTGRVVVVDEANPRCSMATDISALIAQRAFRSLKAPIEMVTAPHTPTPFAGVLEDMYIPSARQIADAVLK

SEQ ID NO: 7363 - protein, 325 aa, Burkholderia cepacia
VSTELSKDELLKAYRMMRTIREFEERLHVEFATGEIPGFVHLYAGEEASAVGTMLHLNDADYVATTHRGHGHCIAKGVDVRGMMAEIYGRKTGVCHGKGGSMHIADLSKGMLGANGIVGAGGPLICGAALAAKYKKSGGVGVCFFGDGASNQGVIFESMNLASVWRLPAIFVAENNGYAEATSSTWSVATDNIADRASGFGMPGVIVDGFDFFAVHEALGEAIERARHGGGPTLVEVKFSRYFGHFEGDAQTYRAPGEVQKLRDEKDCLKRFEERVVRAGMLSADQLRGVDAEVKTLIDTAVTEAKAAPLPTAEDLLSDVYVSYP

SEQ ID NO: 7364 - protein, 567 aa, Burkholderia cepacia
ASATRPTALAMSVAVAVSLVFGSAAAADDYPAVTYERLTAAQSDPGWLTYYRTYNGQAHSPLKQIDTANVKNLKQVWSYKFPADLQQGFEATPIVNGRYLFVTTPKDNVYAFDAATGKQLWKFEPKLGAESFKTACCDVINRGVALYGKNVYVAMLSGDVVALDAQTGALAWRKQMFEPGLGYAFSLAPLALDGALVVGSAGGEYGARGFIAALNPDNGNVLWKRFTVPAAGEKGADTWPNGMQEHGGAPAWLTGTYDAASKTLYWGVGNPGPWLADLRPGDNLYSDSLLALDPKTGDLKWHYQYTKHDTWDYDGVNTPVLATIRYQDKEYDAIIHADRNGFFHAIDRGTGKLIYAKPFVTATSVTGYTADGAPIQDASKYPKAGTTIETCPSFLGGKNWWSISYDPDKHIAVVPALHACMSLSGKSVNYMEGLPYLGEGFEIKPEPGSKGYGELQAINVDTGKKVWSHWSKLPWNGGVATTAGGLAFSGSLDGHLYAFDETTGKVLWQSPKLASGIVAQPSVFEVDGKEYVAILAGYGGANPIWGGPMAKAAEKVPRGGTLYVFAL

SEQ ID NO: 7365 - protein, 493 aa, Burkholderia cepacia; identical to SEQ ID NO: 4608

SEQ ID NO: 7366 - protein, 463 aa, Burkholderia cepacia
QFYIDGGWVEPTSPVWFDIVDPSTETPFEKLALGNAQDVDRAVAAARRAFASWSATSVADRVALLKRIVTIYERRYDEFAELMRREMGAPITFARNGQAARGPAHLNALIDVLERFEFEEQRGSTRIVLEPIGVCGLITPWNWPVNQIVVKIAPALAAGCTMVLKPSEYSPLSALLFADVLDEAGVPAGVFNLVNGDGPGVGSAIASHPDIDMVSFTGSTRAGVLVAQSAAETVKRVAQELGGKSANILLDDVDLDQAVTRGVAACFTNSGQSCSIPTRMLVPRHLMNDAAQIAKRAAQAYRLGPTDDPATQLGPLVNANQFKRVQALIQIGIDEGARLVTGGTGRPDGIDTGYYARPTVFADVTPQMTIAREEIFGPVLSMIPYDSEEQAIDIANGTDYGLAAYVQSADLARARKVGRALRAGGVHLNYPPADFGAPFGGYKRSGNGREWGEAGLREYLETK

SEQ ID NO: 7367 - protein, 223 aa, Burkholderia cepacia; identical to SEQ ID NO: 4610

SEQ ID NO: 7368 - protein, 476 aa, Burkholderia cepacia; identical to SEQ ID NO: 4611

SEQ ID NO: 7369 - protein, 248 aa, Burkholderia cepacia; identical to SEQ ID NO: 4612

SEQ ID NO: 7370 - protein, 245 aa, Burkholderia cepacia
LVDRTVLITGGATGIGASFVEHFAAQGARVAFFDIDTSAGEALADELGDSKHKPLFLPCDLTDIDALQKAIADVKAALGPIQVLVNNAANDKRHTIGEVTRESFDAGIAVNIRHQFFAAQAVMDDMKAANGGSIINLGSISWMLKNGGYPVYVMSKAAVQGLTRGLARDLGQFNIRVNTLVPGWVMTGKQKRLWLDDAGRRSIKEGQCIDAELEPADLARMALFLAADDSRMITAQDLIVDGGWA

SEQ ID NO: 7371 - protein, 506 aa, Burkholderia cepacia; identical to SEQ ID NO: 4614

SEQ ID NO: 7372 - protein, 364 aa, Burkholderia cepacia
FSQLSLPPATLANLTQLGYVEMTPIQAASLPIALAGHDLIAQAKTGSGKTAAFSLALLARLDVRNFAVQAMVLCPTRELADQVTQEIRRLARAEENIKVLTLCGGTPMRPQTASLEHGAHIVVGTPGRIMDHLERGSLPLQSLNTLVLDEADRMLDMGFFDDIATVVKQCPKERQTLLFSATYPEGIVKLSQQFLRNPKEVKLAERHDNTKIRQRFYEVTEDERLHAVGLLLNHYRPVSTLAFCNTKQQCRDLLDVLRAQGFHALALHGELDQRERDQVLIQFANRSCSVLVATDVAARGLDIAQLEAVINVDVTPDPEVHVHRIGRTGRADQEGWALSLASMNEMGRVGSLEQAQKRDVEWHK

SEQ ID NO: 7373 - protein, 385 aa, Burkholderia cepacia; identical to SEQ ID NO: 4616

SEQ ID NO: 7374 - protein, 532 aa, Burkholderia cepacia
DFVVVGAGSAGCVLANRLSEGGRYSVCLLEAGPADRFMWIHIPIGYGKTMFHPVYNWGFYTDPDPNMHNRRLYWPRGRTLGGSSSINGLIYVRGQKDDYDHWARLGNRGWGWQDCLPYFRRLEHNELGEGPTRGVDGPLWASTIKQRHELVDAFIAASNSLGVETVEDFNTGDQEGVGYYQLTTRRGFRCSTAVAYLKPARQRRNLRVETDAMASKILFEGTRACGVQYRQHGELREVRADREVILTAGALQSPQLLQLSGVGPAALLREFGIPVVANRAGVGENLQDHLQIRLIYEVTKPITTNDLLRSWTGRARMGLQWALMRGGPLAVGINQGGMFCRALPEESATPDIQFHFSTLSADSAGGNVHDFPGCTYSICQLRPQSRGVVRIRSVDPREAPSIQPNYLDTDLDRRTTIAGVRFARRVAAAEPMAALMKRELRPGAHAQTDDELLDFCREYGQTIFHPSGTAKMGTAGDPLAVVDERLRVYGTQGLRVVDCSIMPTLVSGNTNVPIVMVAEKASDMILHDASGV

SEQ ID NO: 7375 - protein, 524 aa, Burkholderia cepacia; identical to SEQ ID NO: 4618

SEQ ID NO: 7376 - protein, 402 aa, Burkholderia cepacia; identical to SEQ ID NO: 4619

SEQ ID NO: 7377 - protein, 694 aa, Burkholderia cepacia
ECGYACLAMVLSHLGRATEVRELSAFRPISANGLSLMDLYDVATEFGLAVQAYRFDVADLPSVKRGSILHFGGAHFVVFEKCGHGYVQVVDPASGRRRVSMDTFVASVSGYLLECSATPAMPRIRAKSQVPGALARVRALNPALRKQLAKVMFVALGSQFAILAMPYLGNLVLDYVVSADNMNLLGVLVLTFAGIFAVGALSQYVETRLVELLHQLTQINMTEGLLGHLLRNPMSWFEKRHVGDVFARIKAQDEISVHATRTVTSMCIDIAVGSLALVLMLVQSRMLTAVAVGMFVVYLAVALGMFARMRDNHALVLETSARCDDALIETIRAASLIKLAQGETRRTALFMIKYKEYVSALLASNRLTSARDAILKLVQYADTIAITWFAARLMLAGTVSVGVFYSFLIYKSLMSERFAHAVNGAFAYFMLSVPTARVADIVECEEERYTPLADCNRVTEMRKFERVEVRNVTFRYGVSDQPVLRDVSIDIRHGDKIAITGPSGAGKSTLFKLLSASEPLQEGQIALNGIAWPNLTVDEIRRHAAHMRQGDLILHGSIAENITLFAASIDEDRVHALLEDVGLLQDVMRLPMRTRTVISDTIANISAGQRQRLLLARALYQGRSLLLLDEPTSNLDPASVQHVAALLRRLDCTVVVITHDRSLAAAFDVRYRLMDGALVPEMPDHPHRLREPAH

SEQ ID NO: 7378 - protein, 227 aa, Burkholderia cepacia
DDGDLEAAQAELADVVSEVLAGGGRPLVLGGGHEVAWGTYSGLRLHQQREAENEATLLISRKLLIINFDAHFDLRQKRPANSGTPFDQIALDCAERGVPFNYACFGISDLSNTASLFAHAERLGVHYVFDVDMQETQLPQRLNELQKLLDAADDVYLTIDLDVLPAATAPGVSAPAALGVPLSVIEAMVLRVRASGKLRVADIAEYNPTLDQDRRTARVAARLAYRL

SEQ ID NO: 7379 - protein, 484 aa, Burkholderia cepacia
RIDHLINGKSGAAKDYFETVNPATQEVLAEVARGGAEEVDAAVRAAKDAFPAWAARPAAERAKLVRKLGELIAKNVPEISETETKDTGQTISQTRKQLVPRAADNFSYFAEMCTRVDGHTYPTDTHLNYTLFHPVGVCALISPWNVPFMTATWKVAPCLAFGNTAVLKMSELSPLTAAMLGNLALEAGIPAGVLNVVHGFGKETGEPLVAHPDVHAVSFTGSTATGNRIVQTAGLKKFSMELGGKSPFVIFDDADFERALDAAVFMIFSNNGERCTAGSRILVQRGIYARFAERFIERAKRLSVGDPLSDSTIVGPMISQGHLAKVRSYIELGPKEGATLACGGLDLPELPDALRKGNFVQPTVFVDVDNRMRIAQEEIFGPVACLIPFDDEADAIELANDISYGLSSYIWTENTGRALRVAAAVAAGMCFVNSQNVRDLRQPFGGTKASGVGREGGTWSYEVFLEPKNVCVSLGSHHIPRWGV

SEQ ID NO: 7380 - protein, 491 aa, Burkholderia cepacia
QLGHYIGGAPAAPTSGRFKDVFNPATGKVTGSVALASVEEVDAAVQAAKAAFPAWSETAPLKRARILFRFKELLNQHHDELAMLITREHGKVFTDAQGEVVRGIEVVEFACGIPNLLKTDFTDQIGGGIDNWNLRQALGVVAGITPFNFPVMVPMWMFPVALACGNTFVLKPSERDPSASLRIAELLKEAGLPDGVFNVVNGDKVAVDALIDHPDVAALSFVGSTPIAEYIHTEASKRGKRVQALGGAKNHLVVMPDADLDQAVDALIGAAYGSAGERCMAISVAVAVGNVADQLIEKLVPRVKSLVIRNGENLDAEMGPLVTAEHKAKVAGYIASGEAEGAKLIVDGRAHPVASEEGFFIGGTLFDNVGTQMKIYKEEIFGPVLAVVRVPDFASAVELINAHEFGNGVSLFTSDGGVARAFGRQIQVGMVGINVPIPVPMAWHSFGGWKRSLFGDHHAYGEEGVRFYTRYKSIMQRWPDSIAKGAEFTMP

SEQ ID NO: 7381 - protein, 360 aa, Burkholderia cepacia; identical to SEQ ID NO: 4623

SEQ ID NO: 7382 - protein, 245 aa, Burkholderia cepacia
KVALIAGGAKNLGGLIARDLAAQGARAIAIHYNSAGSRAQADATVEAIRAAGAEAVAFQADLTRAGAVEKLFADAAAAIGKPDIAINTVGKVLKKPFVEISEAEYDEMTAVNSKTAFFFLKEAGKHVNDNGKIVTLVTSLLGAFTPFYAAYAGTKAPVEHYTRAAAREYGTRGISVTAVGPGPMDTPFFYPAEGEDAVAYHKTAAALSSFSRTGLTDIQDVVPFIRHLVSDGWWITGQTILVNGG

SEQ ID NO: 7383 - protein, 302 aa, Burkholderia cepacia
GRVVILGIYVTDLTFRAGRMPQIGETIAGSAFAMGPGGKGSNQAVAAARAGADVVFCTRIGNDAFGAIARATWAAEGITARASVIEGVSTGAAHIFVDDNTGMNAIIVASGAAGTMEPADVDAIEADIAAARVFVTQLEQPLEAARRGLEVARRHGVITVFNPAPALPLDDGIFPLCDYITPNETEATALTGVPIANADDARRAADVLLAKGVGTVIVTLGEGGALLHSAAQSILVPAYHCGRVVETAGAGDGFTGGFAAALARGDDAMTALRFGCALAGISVTRPGTAPSMPTLDEVNQVL

SEQ ID NO: 7384 - protein, 454 aa, Burkholderia cepacia
FIGGAWHAPAAGERFASHAPATGERLADIAQGDAADIDAAVAAARAAQPGWFALGGAGRARHLYALARMVQRHSRLFAVLEALDNGKPIRETRDIDVPLVARHFLHHAGWAQLQESEFADYAPLGVVGQIVPWNFPLLMLAWKIAPAIATGNCVVLKPAEYTPLTALLFAELAHRAGLPAGVLNVVTGDGRTGAALVEHPQVDKIAFTGSTEVGRLIRSATAGSGKSLTLELGGKSPFIVFDDADLDGAVEGVVDAIWFNQGQVCCAGSRLLVQEGVEARFIAKLKRRMATLRVGTSLDKSIDLGAIVDPVQLERIQSLVETGRREGCSVWQSPETTMPSGGCFYPPTLVTGVAPASTLAQEEIFGPVLVTMSFRTPDEAIALANNSRYGLAASVWSETIGRALDVAPRLACGVVWINATNLFDAAVGFGGYRESGYGREGGREGIYEYLKPRA

SEQ ID NO: 7385 - protein, 296 aa, Burkholderia cepacia
LPIVDVSGLFSDDIDRRLATARELDRAAREAGFFYVTGHQVSRGQQGALIEQAKRFFAAGHDWKMRYYIGNSSAHRGYVPEGEEVFAGGKRDRKEAFDTGRELPADDPDVIAGTPMLGSNSWPEQPGFREAVGGYYEASFELGRALFRGFSLALGLPEQHFERYLRKPPSQLRLIHYPLDPSAEDRPGIGAHTDYECFTILLPTAPGLEVMNGRGEWIDAPPVGNAFVVNIGDMLEVWTGGTYVATSHRVRKVREERYSFPLFFACDYHTVVAPLPQFATPEAVAKYPPVSAGDHL

SEQ ID NO: 7386 - protein, 212 aa, Burkholderia cepacia; identical to SEQ ID NO: 4628

SEQ ID NO: 7387 - protein, 390 aa, Burkholderia cepacia
QFHWEDPLLLDQQLTEDERMVRDAAAAYAQDKLQPRVLEAFRHEKTDIEIFREMGELGLLGPTIPEQYGGPGLNYVAYGLIAREVERVDSGYRSMMSVQSSLVMVPIHAFGSEAQKQKYLPKLATGEWIGCFGLTEPNHGSDPGSMVTRAKKVDGGYSLSGSKMWITNSPIADVFVVWAKLEENGKDAIRGFILEKGWRGLSAPTIHSKVGLRASITGEIVLDEVFVPEENRFPEVSGLRGPFTCLNSARYGIAWGALGAAEACWHTARQYVLDRKQFGRPLAANQLIQKKLADMQTEITLGLQGVLRLGRMKDEGTAAVEITSIMKRNSCGKALDIARLARDMLGGNGISDEFGVARHLVNLEVVNTYEGTHDIHALILGRAQTGIQAF

SEQ ID NO: 7388 - protein, 425 aa, Burkholderia cepacia
YQSGFANEFATEALPGALPEGRNSPQRVAYGLYAEQVSGTAFTAPRAHNRRSWLYRIRPAAVHKPFTPLPSERLVANFAEVPPTPPNQLRWDPLPMPAEPTDFIDGWVTMAGNGAAESMSGCAIHLYAANRSMQDRFFYSADGELLIVPQEGRLDIATEMGRLEVEPFEIVVIPRGVRFAVSLPDGAARGYICENFGALLRLPDLGPIGSNGLANPRDFLTPHAAYEDREGDFELVAKLNGNLWRADIGHSPLDVVAWHGNYAPYKYDLRRFNTIGSISFDHPDPSIFLVLQSQSDTPGVDAIDFVIFPPRWLAAEDTFRPPWFHRNVASEFMGLVHGVYDAKAEGFVPGGGSLHNCMSGHGPDADTFEKASHIDTSKPAKVGDTMAFMFETRTLIKPTRFALETAQLQAHYYECWQGLKKHFNP

SEQ ID NO: 7389 - protein, 532 aa, Burkholderia cepacia
EDRTMGRILADKAQRIPDRTFLIWQDRRYTYAELETITNRYANGFIAHGIGYGDHVAVMLPNCPEFFWVVWGLSKIGAVAVPINTAAKGELMRYFLDKSDSVCFVVDEEWSERVAAIRSEVPQIRQYFIHGGNGVPSLPDNAESTVHALSELESDDASQPPLDRVAYDDTQLIMFTSGTTGPSKGVQCPHSQGHAVGRALTVDFGYREDDVLYTCLPLFHGNAAYYSCYAALWADAAIALAPRFSATRFWDDIRRTGATQFNTLGAMTNIIWKLPPGPHERETKLRLCMAVPVPKEIYSEFQERFGVVLTSVFAMTENFAMTRFTPSDPAEKAGSAGKPRGECELRIVADDGTDLPAGGVGEIYMLPLKPGSMMKGYYRMPKETAREFDNGWFKTGDRGYLDEDGYLFFMDRKKEAIRRRGENISAYEVELILCRHPAIHEVAAIPVASELSEDDVMVYVVLKPGESMTHADVVHFSAEHMSYFMVPRFVEFIDKLPKTASEKLEKYKLKLDADARRAQLWDREREGIEVRR

SEQ ID NO: 7390 - protein, 662 aa, Burkholderia cepacia
MFESILIANRGEIACRIARTSRRLGIRVIAVYSDADRGARHVREADVAVRIGPADATRSYLDADAIIRAALETGASAIHPGYGFLSESTQLVNRCAEHGIAWIGPRGDVIERMGSKIESKRIAADAGVPCVPGYHGDNQKLEHLLEQARAIGAPLLIKASAGGGGKGMRRVDDLDDFAAQLSMAKQEALRAFGDDRVLIEKLILRPRHLEVQLAGDRHGNLVHLFERECSIQRNYQKVFEEAPAPRLAPAVREKLLDAALKLGNAIGYDSLGTVEFVLAEDADTPYFLEMNTRLQVEHPVTEMVTGLDLVELQIRIAAGEPLPMQQDAVAVTGWAVEARINCEDPAHGHRPEFGTVARYSEPALAGVRVDSGIESGSEIAPHYDSMIAKVIGYGATRTQAVERLRAGLGAFEAAGIGTNQSLLCAIADHSLFRAGRLTTGFLAEAFPGGWHDDPADFRYAVCAAVLHRLAARAAPGPDYWHRQSGHRFMAAAGRRAAARMRVALDGDEQPVSVERDGEHWLVKTGDEAALDLQVRALAEDQLLLLPMHGVPRRYTLTADGAHLFVNHVGTRWRVLVVSEVEALARVAAQAGVQGSEVASEMPGAVTAIHVAPGDQVAAGDVLVVMEAMKLIFPLVAPRDGTIAVVRCALNEIVPRGHVLVQL

SEQ ID NO: 7391 - protein, 376 aa, Burkholderia cepacia
FSEEHSMLRDVIRRFIAKEVLPFADQWEINGYVPRELLRKMGEQGFLGIRQSEAFGGAAMNVLGTVVLAEELGRSTFGGFAITVLVHTDMASPHLQHAGNPAQLERLMPDLVAGRKIAAVAMTEAGAGSDLASMRTTARLDGDHYVLNGAKMFITNGVHGDIYFVAAKTGGPGRSHGGISMFIVEKGMPGFSVARPLSKQGWLSSDTAELVFDECRVPVQNLLGEENKGFYSLVRNLQNERITLGAQALGEASRAIEITLDYVTQRTAFGQTLWEKQAIRQKMAMLLAKVEAARQLLYNTAWRDAQGQTVVAEVSMIKALCGELVNEVMYACQQFHGGFGYMREAPIERMVRDARVQSIGGGATEVMLEEVAKRMV

SEQ ID NO: 7392 - protein, 588 aa, Burkholderia cepacia; identical to SEQ ID NO: 4634

SEQ ID NO: 7393 - protein, 434 aa, Burkholderia cepacia
PSMSNPPPAVRRVAIIGGNRIPFARSNTAYATASNQDMLTFTLQGLIDRYNLHGERLGEVAAGAVIKHSRDFNLTRESVLSTTLAKETPAYDVQQACGTGLEAAILVANKIALGQIEVGIAGGVDTTSDAPIGVNERMRKILLEANRGRSTGQRVGALSKLRPGMFFKPLLPRNGEPRTGLSMGEHCELMAKRWNISREAQDVLAYDSHRKLTAAYARGFVNDLMTPYRGLAQDNNLRADLTLEKLASLKPVFDRDAGTLTAGNSTPLTDGASAVLLASEDWAARHGLPVLAYLSWSETAAVDFFDRKEGLLMAPVYAVPRMLARAGLTLQDFDLYEIHEAFAAQVLCTLAAWQDDEYCRTQLGLPGAPGAIDRAKLNVNGSSLATGHPFAATGGRIVAGLAKMLAQLDKPAGTARGLISICAAGGQGVVAILE

SEQ ID NO: 7394 - protein, 561 aa, Burkholderia cepacia
IWYASYPADVPHDIDVAQYESVVQFFDECIARFRERVAYVSVGANMTYGELGRKASAFAAYLQSLGVKPGERVAIMLPNTFQYPVSLFGVLKAGGVVVNVNPLYTVRELAHQLKDSGAQTIIMFENFAKTVEDALPGTKVQNVIVTGLGDLLADGLNLKGRLLNFMLRHVKKMVPAYNLPKAVPLLEALSIGYSRPLTPVRPTHADIAFLQYTGGTTGVAKGAMLTHKNIIANLLQAKAWSEGQLTGDVETVLTPLPLYHIYSLTVNALIFMGLGGRNILIANPRDMKRVMMIIRHEKFTGMTAVNTLYNAFLENEEFCKRDFSDLKLAMAGGMATQKSVAERFKAVTGKPIIEGYGLTECSPIVSMNPVDLANMRDFEGSIGLPAPSTHVRFRKDDGSWANIGEAGELCVKGPQVMKGYWNRPEETAKVIDGDGWLATGDIGVMDSRGFIRLIDRKKDMILVSGFNVYPNEVEDVIATHPDVREVAAIGVPDAAQGERVKVFIVRRNPSLTAEQVIAHCRKNLTGYKVPKLVEFRDELPQTNVGKILRRALRDEELAKQK

SEQ ID NO: 7395 - protein, 311 aa, Burkholderia cepacia
KLIDIYRTMVLVREVELSLSRLFADSEVPGFIHLSLGQEAVSAGVASVLEVQDTLATTHRGHGHVLARGIDVGGFFKEIMGRVGGLCKGRGGSMHVADLALGVLGANGIVGAGIPIALGSAVAHHVRKTRGVAVAFFGDGAMAEGVLHETMNMAALWKAPLLLVCENNGWSEFSPTERQFAARLEALAGAFGIAYKRVDGDDAVAVSEASGIAAAAARSGAGPFVLECVTHRVRGHYEGDPQKYRDPTELDGLAGKDPLKRMHTHLESAGVSASEIDQIGRAVLTRVEAAIEAARADALPDFDEASRDVYT

SEQ ID NO: 7396 - protein, 309 aa, Burkholderia cepacia; identical to SEQ ID NO: 4638

SEQ ID NO: 7397 - protein, 423 aa, Burkholderia cepacia
LLVPKLGLTMTEGTLIEWMISPGDRFDADQGLYVIESDKAANEVSAEGSGVLLEVTAELGMPLSVGSVIGYWDDDPQAATNHAVRAEPSAHAAAASASSPDSNAANAAPSAQTSRPPAAMNGQSGQSGQSGARGISTPLARRLARERGIDLTNLAGSGPRGRIRARDVELAPANSPASAPDVPLPATASRAAQVAQAATVRAATSIEKTIARRLVTSKQTIPHFYLSVEAEISAVQRLRSQLNDAQSNRRFTVNHFVVAAVGRALALVPEANRVWDDSGITSFAATDVGVAVHTERGLLVPVLRDVGRQALGEVARHASEAIGRAQAGQLNAAEMAGGAITVSNAGMHDVTLMTSIINPGQSMILGVGSVRQVFRPDAHGQPALKNEVGLVLSVDHRVLDGVTALKFLRQVVAAIERPASLLV

SEQ ID NO: 7398 - protein, 464 aa, Burkholderia cepacia
MDDHYDVIVIGGGPGGYVAALRAAQLGRRTALCERDQLGGICLNWGCIPTKALLHTADTLRTVRKAAHLGIGIDDPVVDFTRVMARSREVAQKLNRGVSHLLRKAGVTVLAGTAAFAADRSVRVHGADGALRTLQARHTIVATGAAARQLPALPWDGERIWTYREALAATAVPKSLLVVGAGAIGMEFAGFYAAMGTEVTVVEVAPRILPASDADVSEFVARACERDGIRLRTGCSVVHSAAHAEGVRVMFRSENAEEQREFERVLVAVGLDGNTEGLGLEHTRVAFERGLIIADAAGATSDPVVHAVGDVTGAPMLAHKASHQAIACVERIAEVNRGERHASPKIPGCVYSHPQTASVGLTEDEARRTGRALRVGRFPLDANGKAIALGDPSGFVKTIFDAASGELLGAHIVGPEAPELIHGFTLAATLEATESELIETVFPHPTLSEAMHESVLAAFGRPLH

SEQ ID NO: 7399 - protein, 390 aa, Burkholderia cepacia; identical to SEQ ID NO: 4641

SEQ ID NO: 7400 - protein, 481 aa, Burkholderia cepacia
ARTNPSRTALMYGNQSISYGDLQRRVEATAGMLKGTRIRRGDIVALLMKNSAAFVEIMLAVSQAGAVILPINYRLGPDEVAYILQHSGAKLLFHDEEFEVPPGLVHSQAVTGAAQSDTSVLAAGHEPCTEAYPSRPDDLYRLMYTSGTTDRPKGVMHSYGNVAWKSFDHIAALGITKDDRLLVVGPLYHVGACDLPGLAVLAQGGMLRIMRDFDAQAVLEAIERERLTGAWLAPVMLSRILALPERYRFDLGSLRWVVGGGERTPEQRIREFGSLFTGARYIDAYGLTESCSGDTLMEQGRELDKIGSTGRALAHVQLAIMSDDGRMLAPGMQGEICVRGPKVTQGYWKDPEKTARSFVDGWFRTGDVGYMDEEGFLYLTDRKKDMIISGGENIASSEVERVIYQLAEVAEAAVIGAPDPRWGEQVTAVVVLRAGATLTLDALRTHCEGRLGGFKTPRQLILRDALPRNPSGKVLKRVLRD

SEQ ID NO: 7401 - protein, 242 aa, Burkholderia cepacia
AEFNGAIAVVTGAGSGIGRACAELLSRSGANVIVADRDIEAATRVARATGGKTLVLDVGEDASVTAAANEVRARYGVADVLVNCAGVLQRTLPPGELAQREWDVVSRIDLRGTYLCCAAFGAPMADRRRGSIVNIASVAGMRSGPLHAYGPAKAGVISLTETLAGEWGPKGVRVNCVSPGFTQTPALERGFTTHTLKADVLRDAAALGHIVSANEIAEAVVFLASERASAITGVNLPVDAGY

SEQ ID NO: 7402 - protein, 456 aa, Burkholderia cepacia
MSRLVVVSNRTVDPRKTAAGGLAVAVRESLQRTGGLWFGWSGKIYDESDEMTSRRGVHVQTLGNVTLATVDLSQQDHDNYYLGYANGVLWPVFHYRLDLADFDTRFAAGYRRVNQLFAEKLLPLLRPDDIIWVHDYHLIPLAAELRAIGCGNRIGFFLHIPMPPPMIMAAIPEHEWLMRSLFAYDLVGFQGQIDVEHFTHYAESEANARQVGPQQLRAFNRTLRLGAYPIGIDVEEFVSLANGKEAREMFTRMRDEYSRRRLLLGVDRLDYSKGLPQRIHAFRELLAHYPENRDSATLIQIASPSRESVAAYDDLRRQMDSLCGAINGDYGELDWMPVRYIHRHVARKRLPGLYRASKVALVTPLRDGMNLVAKEFIAAQDPSDPGMLVLSRFAGAAEQLKEALLVNPYDTQGTAHAIQRALTMPLDERRNRHAALMKRIREHDVHWWSSSFLDTL

SEQ ID NO: 7403 - protein, 378 aa, Burkholderia cepacia
MTEERRLIQASARQFAREVVLPLANRLDPLKEDIPMSLRERMAGLGYFGILIPEEYGGLGLGVSEYCLITEELSRAWMSVGSIIRNLGLMVVQGMTDGQRQRWLPRMACGEFLGALAMSEPNAGSDVAALTTRAIPDGDGWRITGSKCWCTFADGADYIVVIARTARVTDVARRHQGLSAFLIEKPRGALPAGVIGSPMPKIGYYGWKTWELSFDDVYVGPETLIGEPGRAFYYVAHGLETARAHTAARSIGLAQGALEDALDYATQRVQFGHPIGDFQALRFRLADMATRVETARQLLRSVCEQIDSGVRCEKEAAMAKYYAAEISETVTSDALQIHGGAGYTTHFAVERYWRDARLTKIFEGTSEIQLRIISDHLL

SEQ ID NO: 7404 - protein, 235 aa, Burkholderia cepacia
ALVTGGARGLGLEIAQQLATLGAHVIIGARDTAKAEAVATELRNLGHAVSALKLDVTSDEDRQAAYAEIDRAHGRLDILINNAGILLDSPDGGTPATRQPSEALPNVVRDTFEANFFAPVFLTQTLLPLIRRSSAGRIVNVSSIRGSLAHLSDPCSPVYPIRALGYDTSKAALNAFTILIAAELRDTPIKINAVHPGWLRTSMGGERANMSAEDGAHAVVKYASLGEDGPTGGFF

SEQ ID NO: 7405 - protein, 245 aa, Burkholderia cepacia; identical to SEQ ID NO: 4647

SEQ ID NO: 7406 - protein, 243 aa, Burkholderia cepacia
LQGKVVVLTGAGGGIASAIVDRFARSGSRIVLLELRTSSLADAEQRLAAAGIESVSIECDVADESSVKNAAGRTVEHFGRCDVLINNAATLAPATSIEKLLVADWDRTLAINLRGVFLTTKYLGALMLNQGSGSIVNIASIAATAPNASPQYGASKAAVLAFTRHTAVEWGPRGIRANAVSPGFIRTPLSESNYAEPEMLARRSNMVPSRRLGLPGDIAEAVAFLAGDGASFINGQELAVDGG

SEQ ID NO: 7407 - protein, 428 aa, Burkholderia cepacia
RSLRAVWHPCTQMKHHERLPLVPVARGQGAWLYDRAGHRYLDAISSWWVNLFGHANPRINAALKDQLDTLEHAMLAGCTHEPAIELAERLSALTGNTLGHAFFASDGASAVEIALKMSFHSWRNRGFADKQEFVCIANSYHGETIGALGVTDVALFKDAYDPLIRHAHVVASPDARLAQAGETAADVARRALDHVRSLFEARATKIAALIVEPLVQCAAGMAMHDASYIAGLRTLCDQYGVHLIADEIAVGCGRTGTFFACEQAGIWPDFICLSKGISGGYLPLSIVLSRDEIFEAFYHDDTARGFLHSHSYTGNPLACRAALATLDLFAADNVIAVNAQKSAKLKAALAPLAEHEQVRNLRQCGTIFAFDALIDDAQQARTFSRRFFENALRRELLLRPIGTTVYLMPPYILDDEELALLASRTRET

SEQ ID NO: 7408 - protein, 362 aa, Burkholderia cepacia
RRRRTADTPCAAHMTVDGRAIIGFASNDYLGLAAHPQLIAAIAEGAQRYGAGSGGSHLLGGHSRAHAQLEDDLAEFVGGFVENARALYFSTGYMANLATLTALAGRGTTLFSDALNHASLIDGARLSRADVQIYPHCDTDALSAMLEASDADVKVIVSDTVFSMDGDIAPLPRLLELAEQHGAWLIVDDAHGFGVLGPQGRGAIAQAALRSPNLISIGTLGKAAGVSGAFVAAHETVIEWLVQRARPYIFTTASVPAAAHAVSASLRIIGGEEGDARRAHLQQLIGRTRAMLKATPWLPVDSHTAVQPLIIGANDATLEIAATLDRAGLWVPAIRPPTVPTGTSRLRISLSAAHSQADLDRL

SEQ ID NO: 7409 - protein, 297 aa, Burkholderia cepacia; identical to SEQ ID NO: 4651

SEQ ID NO: 7410 - protein, 466 aa, Burkholderia cepacia
AASGRRFAVTDPATGNLIADVADSGPADARAATDAAAKALPAWRALLASERAAILHRWHALIVANRDALGALISLEQGKPLTEGRGEVGYGASYVAWFADEATRIYGDLIPQQQRGKRMSAVKEPIGVVAAITPWNFPLAMIARKIAPALAAGCTVVAKPAEDTPLTAIALVMLAHEAGVPDGVLNLISASRAAAAETVGDWLADSRVRKITFTGSTPVGKHLARESAGTLKKLSLELGGNAPFIVFDDADLDAAVNGLLAAKFRNGGQTCVCPNRVYVQHGVYEHFAALLRARVAELRVGPASDPTSQIGPMINVRAVDKIARHVDDAVEHGAVVLTGGRRLTELGPHYYAPTVLGNASASMALCGEETFGPVVPLFPFDTEQDAVQAANDTPFGLASYFYSENMRRIERVSRALEAGIVGINEGALASEAAPFGGVKESGYGREGSKYGLDDYLSIKYLCQGGL

SEQ ID NO: 7411 - protein, 356 aa, Burkholderia cepacia; identical to SEQ ID NO: 4653

SEQ ID NO: 7412 - protein, 450 aa, Burkholderia cepacia
QIAVHRPSDGALLGHVPDATDATVDHAVSNALAAWKTSGWGTRSPRERAKVLRRWADLIDRDAVSLAQLETVSSTRPVAESYASDVPFTAEAIRFFAELADKLGGDIAATRRDSLGFVASEPYGVIGAITPWNFPLSMCSWKCGPALAAGNAVVLKPSEMTPFSTLRLAELAIEAGMPPGIFNVVNGRGATTGAALTRHPGISKMSFTGSTRTGAAIMSDAAMHGTKPVTLELGGKSPQLVFEHVRDLDFTAGCIARGFTANGGQACVAGTRLIVHKRIAEPLVGAIQRQLQSIKPGPLWDSRTTYSPIISPAQARRIETLIDQSRDSGAEVIFGGGFFDGTDEGFFHRPTLLANVTDATPAVREELFGPVLTVQTFDDEDEGIALAGHPIYGLAAGIHSSDIGQALRAMRRIAAGTIWINRYGRSGDMIIPTGGFGQSGIGKDLGREAM

SEQ ID NO: 7413 - protein, 442 aa, Burkholderia cepacia
DRKHLIHPVINYRAHEARGATVLESGQGAYLRDIDGNELLDAFSGLWCVNVGYGQQSIVEAATRQMTKLPYATTYFHFSSEPAIELADKLVALAPASLQHVYFTLGGSDAVDSAIRFITHYFNATGRPSKKQMIALERGYHGSSSVGAGLTALPAFHRNFDLPLPHQHHLPSPYAYRQTHGDDAQALIAASVAALEAKVAALGTDNVAAFFCEPIQGSGGVIVPPVGWLKAMRDACRRLDILFVADEVITGFGRTGPLFACEAEQVEPDLMTVAKGLTSGYAPMGAVLMSDEIYQGIAGDARDTAIVGHGQTYSAHPVSAAIGLEVLRLYQEGGLLANGQAQAPRFAAGLDALLGHPLVGDSRHRGLLGALELVADKDSRARFDPALKLPDRIAAAAYRNRLVFRAFGDSILGFAPALCFGEAEFEQMFGRLKRTLDEVLDE

SEQ ID NO: 7414 - protein, 252 aa, Burkholderia cepacia
GAAQGIGASVARSFAQNGCFVYVTDINDELGRTVATSIGDCAAYLPLDVREEGDWQRVTTHVLEKHGRLDVLVNNAGITGFEARVVPHDPEHASLEEWRAVHRTNLDGVFLGCKYAIRAMRRHGQGSIINISSRSGLVGIPGAAAYASSKAAVRNHTKTVALYCAGQNLEVRCNSIHPAAILTPIWEPMLGTDAGREERMAALVRDTPLRRFGTPEEVAALALLLASDEATYITGSEFNIDGGLLAGSAATP

SEQ ID NO: 7415 - protein, 331 aa, Burkholderia cepacia; identical to SEQ ID NO: 4657

SEQ ID NO: 7416 - protein, 343 aa, Burkholderia cepacia
MKALVYHGPGKKSLDERPMPQLASATDAIVKVTRTTICGTDLHILKGDVPTCQPGRILGHEGVGIVQQVGAAVSSLKEGDHVLISCISACGKCDYCRRGMYSHCTTGGWILGNRIDGTQAEYVRIPHAETSLYPIPAGADEEALVMLSDILPTGFECGVLNGKVQPGSAVAIVGAGPIGLASLLTAQFYSPAQIIMIDRDERRLEVASRFGATACIDSRVAEPVVEVMKLTGHVGVDCAIEAVGVPDTFELCQALVAPGGVIANIGVHGVKADLHLESLWDRNISITTRLVDTVSTPMLLKTVQSGRIDPARLITHHFQLDDVLNAYDTFGRAADSHALKVII

SEQ ID NO: 7417 - protein, 611 aa, Burkholderia cepacia
FWARLAREHLTWRRPFTKVLNDADAPFYRWFEDGELNASYNCLDRNLANGLAEKTAIVFESDDGNVTHVTYQALYHRVCRLANALRARGVKKGDRVAIYMPMSVEGVVAMLACARIGAPHSVVFGGFSAKSLHERIVDIGACAIITADEQVRGGKTLPLKTIVDEALAMAGTAGIRTVAIYRRTGGQIPWIAGRDTWLHELEAAQPDTCEPEWVGAEHPLFVLYTSGSTGTPKGVQHSTGGYLLWAAVTMKWTFDIKPADVFWCTADIGWITGHTYICYGPTAVGATQVIFEGVPTYPNAGRFWDMIQRHKVSIFYTAPTAIRSLIKSADADHSVHPDSFDLSSLRLLGTVGEPINPSAWTWYAQHVGGGRCPVLDTFWQTETGGHMISPLPGVTPLVPGSCTLPLPGIDAAIVDETGQEVPNGNGGVLVIRKPWPSMIRTIWGNPERFRQGYFPEELGGKLYLAGDGAIRDRDTGYFTITGRIDDVLNVSGHRLGTMEIESALAAHPLVAEAAVVGRPDETAGEAIVAFVVLKAERPSGADAKRVADELRAWVGKEIGPIAKPKDIRFGDAMPKTRSGKVVRRLLRSVAKGEVIVQDTSTVENPAVISQF

SEQ ID NO: 7418 - protein, 337 aa, Burkholderia cepacia
MKAAVVHEFGAPLRIEEVPVPQVGRGQILVNIKASGVCHTDLHAADGDWPVKPTLPFIPGHEGVGYVAAVGEGVKHVKEGDRVGVPWLYTACGHCEHCLGGWETLCQEQQNTGYSVNGAYAEYVVADPNFVGHLPAAVSFEDIAPILCAGVTVYKGIRMTDARPGQWITISGIGGLGHVAVQYAIAMGLRVVAVDISEDKLALARELGATLAFNASECDPAAAIQKEIGGTHGVLVTAVSRSAFAQALGMVRRGGTVALNGLPPGDFPLPIFSTVLNGITVRGSIVGTRQDLQESLEFAAQGRVRARIHLDRLDNINHVLAELKSGKVDGRIVLNLD

SEQ ID NO: 7419 - protein, 332 aa, Burkholderia cepacia; identical to SEQ ID NO: 4660

SEQ ID NO: 7420 - protein, 403 aa, Burkholderia cepacia; identical to SEQ ID NO: 4661

SEQ ID NO: 7421 - protein, 459 aa, Burkholderia cepacia; identical to SEQ ID NO: 4662

SEQ ID NO: 7422 - protein, 883 aa, Burkholderia cepacia
QTGDHPGRGHSGRPQKATRCLRLSLRAAHAAQRQVSPLESLFRGGLFEGLLDSGMDGSGPRTRRHAPRRPVSKGVDLQQHFSDQAKEILQRAAERAVQFGRHEVDTEHVLYELVESEAVQRILSALKISASDLQKHIEANAPKGHATSKAPQGEISVSPRLKSALERAVIASREFGQNYVGPEHILTGLAEVTDSFAGDLLMKYGLSSHQLRQQTLKQAGQEEAAQAPSNTPQLDKYSRDVTRLAREGKLDPVIGRSKETETLVEVLARRKKNNPVLIGEPGVGKTAIVEGLAQRMISGDVPETLREKRLIELNVNSLVAGSKYRGEFEERVRQVMDEIAAHKDQLVLFVDEVHTIVGAGQGGGEGGLDIANVFKPPMARGELNLIGATTLAEYQKYIEKDAALERRFQPVLVGEPSVEQTIGILRGLRDRLEAHHKVTILDEACVAAAELSDRYVTGRFLPDKAVDLIDQAAAREHLSSTSRPAEVLELESEIAQIRREQEYAASHKQFERATALGEQLSGKQTRLDDATQAWKRRVSTSTAEVTRTLVAEIVAKMTGIPVADLTQEEKTRLLQMEDRLHRRVIGQEEAISAVSDAVRRSRAGLQARHQPLAVFLFLGPTGVGKTELAKALAEVVFGDEDAIVRIDMSEYMERHAVARLIGAPPGYVGYDEGGQLTERVRRRPHSVILLDEIEKAHPDVYNVLLQVFDDGRLTDGKGRVIDFANTLIIATSNLASDVIMGTPRKRPGFIAADNDLAADKGARKDRQPDGVREGVMTVLRSHFRPEFLNRIDEIIIFESLNADQIRSIVRLQLDKVAHIAKSQDIDIVFDDSIVDQLAKEAYRPEYGARELRRRIRQVIENPLAKQMLDGAVREGNRVVCRFD

SEQ ID NO: 7423 - protein, 595 aa, Burkholderia cepacia
VVLLLLAQIFLYRQPTEAIAYSDFHRLLVARQLDNLEIGSDQITGSVRMPGAAPLLPASAASGLAANGEPWRFLTVRVSDDHLIEDLANSGVRYTGVADRIGLAAVLGWIVPILMLAAVWSVFMRRGGGGLRDFSGIGKSRPRVYVAQDTDVTFDDIAGIDEAKAELKQIVEFLRNAERYRRLGGKIPKGVLIVGAPGTGKTLLAKAVAGEAGVPFFSISGSAFVEMFVGVGAARVRDLFEQAQKKAPCIVFIDELDALGKVRGAGVTSGNDEREQTLNQLLVEMDGFQPNSGVIILAATNRPEILDPALLRPGRFDRHIAIDRPDLNGRRQILQVHVKKVTLAADVDLAEIASRTPGFAGADLANVVNEAALHAAELDKSAVGMVDFDEAIDRAMTGMERRSRVMNEQEKITIAYHEAGHALVALSRPHCDPVKKVSIIPRGVAALGYTQQVPTEDRYVLRKSELLDRLDAYLGGRVAEEIVFGDVSTGAENDLDRATALVRHMVTRYGMSERLGLFTFDSSDPGVGYPSAGGRGERFSESTAKLVDDEVRRELAEAHERVTRTLADSRAQLDRIARRLLECEVLDQATLLQLM

SEQ ID NO: 7424 - protein, 285 aa, Burkholderia cepacia; identical to SEQ ID NO: 4665
  unsure (1)..(285): unsure at all Xaa locations

SEQ ID NO: 7425 - protein, 530 aa, Burkholderia cepacia
LERREANYIPVTPIDFIVRAAEVYGDRLAVVHGEIRRNWRETYERSRRLASALQRAGIERGDTVAALLPNIPPMIEAHFGVPMAGAVLNTLNTRLDISSLLFMLRHGEAKALIVDTEYGEFAHRASLEFPDLRVISVADAMPANADQFIRATDYEAFLQSGDPEFAWTMPADEWDAIALNYTSGTTGDPKGVVYHHRGAYLNAVSNILEWDMPKHAVYLWTLPLFHCNGWCFPWTVAARAGVNVCLRKFDAKTVFDLIRNEGITHYCGAPIVQSALANAPAEWRDGINHRVSTMVAGAAPAPAVIAKMKEIGFDLTHVYGLTETYGPAAVCAKQEAWETLDDSARAELNARQGVRYHLQAAVTVLDPQTLALVPNDGETIGEIMFRGNICMKGYLKNERATEAAFEGGWFHTGDLGVRMPDGYIRIRDRSKDIIISGGENISSIELEDTLYRHPAVAVAAVVAMADPKWGEVPCAFVELKEGAQVSAEEIIAHCRLFLAGYKLPKAVRFGELPKTSTGKIQKFELRARIK

SEQ ID NO: 7426 - protein, 212 aa, Burkholderia cepacia; identical to SEQ ID NO: 4667

SEQ ID NO: 7427 - protein, 204 aa, Burkholderia cepacia; identical to SEQ ID NO: 4668

SEQ ID NO: 7428 - protein, 619 aa, Burkholderia cepacia
NGTTMYDLLKTIDDPAALRRLDRRQLQPLADELRAFVLDSVSQTGGHLSSNLGTVELTIALHYVFDTPHDRIVWDVGHQTYPHKILTGRRDQMHTLRQLGGISGFPKRDESEYDTFGTAHSSTSISAALGMAVASKLKGDNRMGIAVIGDGAMTAGMAFEAMNNAGVEDDVPLLVILNDNDMSISPPVGALNRHLARLMSGRFYAAARAGVERVLRVAPPMLDLARKLEEHAKGMIVPATLFEEFGFNYIGPIDGHDLDSLIPTLQNIKELRGPQFLHVVTKKGQGYKLAEADPVLYHGPGKFNPAEGIKPAATPSKKTYTQVFGEWLCDAAELDARVIGITPAMREGSGMVEFEKRFPDRYFDVGIAEQHAVTFAGGLAAEGMKPVVAIYSTFLQRAYDQLIHDVALQNLPVVFAIDRAGLVGADGATHAGAYDLAFLRCIPNMTVMAASDENECRQMLYTALQQPNPTAVRYPRGAGTGVATIKQMTALPLGKGEIRRETSQPAGKRIAILAFGTMVAPSLAAAEQLDATVANMRFVKPLDADLVRQLAETHDAIVTVEEGCVMGGAGSACVEALLASGVTRPVLQLGLPDRFIDHGDPAKLLAACGLDAVGITKSI

SEQ ID NO: 7429 - protein, 294 aa, Burkholderia cepacia; identical to SEQ ID NO: 4670

SEQ ID NO: 7430 - protein, 281 aa, Burkholderia cepacia
LISAANLAERLAAAPGSVFVIDCRFDLADPEAGEKAYLAGHLPGAHYLHLDRDLSGPKNGQNGRHPLPDRARLVETLESRGLKQGQQVVAYDAQGGMYAARAWWLLRWLGHDAVALLDGGLQAWEAGGYPLTQDAPAQNTGDFKAGAPLSVTVDAQTVERNLGSKERVVVDARAADRYRGENETLDRVGGHIPGALNRFFKDNLTADNRFKPAHTLREEFHALLAGTPPEHVILQCGSGVTACVNALAMEVAGLHGAALYAGSWSEWSSDPKRPVATGPNP

SEQ ID NO: 7431 - protein, 263 aa, Burkholderia cepacia
VNIDLSGKTAIVSASTAGIGFAIATGIAASGARTIINGRKQDAVDHAIEAVRKSAPQAELQGFAGDLGTPQGCDALIKAVPQADILVNNLGVFGPGDIFSTADDDWERYFQVNVMSGVRLTRHYLKGMMERKWGRVVFISSESALNIPPDMLAYGFSKTAQLSIARGIAKHAAGSGVTVNAVLPGPTLSDGLRAMVEETARQQGKTVEQVATEFVREHRGSSIIQRAATTEEVANMVVYVCSPQASATTGAALRVDGGVIDTI

SEQ ID NO: 7432 - protein, 565 aa, Burkholderia cepacia
HSSAATGGVAKARTHRRGKPAALSDDPLWYKDAIIYQVHIKSFFDANNDGVGDFPGLIAKLDYIAELGVNAIWLLPFYPSPRRDDGYDIADYRNVHPDYGNLSDVKRFIQEAHARGIRVITELVINHTSDQHPWFQRARRAKPGSNHRNYYVWSNTDQKYLETRIIFIDSEPSNWTHDPVAGAYYWHRFYSHQPDLNFDNPAVLREVLQVMRFWLDMGIDGLRLDAVPYLVEREGTNNENLPETHAVLKKIRATIDAEYPNRMLLAEANQWPEDVKEYFGDEDECHMAFHFPLMPRIYMSIASEDRFPITDIMRQTPDLAETNQWAIFLRNHDELTLEMVTDSERDYLWNTYASDRRARLNLGIRRRLAPLMERDRRRIELINSLLLSMPGTPVIYYGDELGMGDNIHLGDRDGVRTPMQWSSDRNGGFSRADPEQLVLPPVMGSLYGFDAVNVEAQSRDPHSLLNWTRRMLATRRAKQTFGRGTIRFLKPENRKILAYLREMPGEPPILCVANLSRAPQAVELDLSEFDGSVPIEMTADSVFPPIGQLTYLLTFPPYGFLWFML

SEQ ID NO: 7433 - protein, 663 aa, Burkholderia cepacia
LLPGSPYPLGASWDGLGVNFAVFSANAQKIELCLFDPTGRKELRRFTLPECTDEVWHGYLPNAHPGTAYGFRAHGPYQPQHGHRFNPHKLLLDPYARKLVGQFRWSDALFGYRVHSNRADLSIDRRDSAPAMPKCVVIDEAFDWSHDKRPNVPWGETIVYETHVRGASMLRADLRQHERGTFAALASPEFIDHLLKLGVTAVELLPVHAFLNDRFLVERGLRNYWGYNSAAFFAPEPSYLSTHRLDEMRIAVRQLHAAGIEVILDVVYNHTCEGNEMGPTVSWRGLDNASYYRLIPGDERHHINDTGCGNTVNLPHPRVLQMVMDSLRYWSTAFNMDGFRFDLGVTLGREQHGFDPGSGFFDALRQDPILSQRKLISEPWDIGPGGYQLGNHPPGFGEWNDRFRDTVRRFWRGDAGLRPDLAARLTGSADLFNRRFRKPWASVNFVTSHDGFTLADVTAYEQKHNEANREDNNDGHNENCSRNWGVEGESDDPAILATRKRVARSLIATLLMALGTPMVLAGDESLRTQHGNNNAYCQDNELSWLDWARAESPDGRQMTAFVARVIALRKQHPLLRETRFLFGDREVLPGLFDVGWFDERGDPLTIEAWQDPEGRAFTLRRAGPGLNGETEVLLMMLNANEKTLRFTPPAPHLEWHVLLDTAE

SEQ ID NO: 7434 - protein, 402 aa, Burkholderia cepacia
TLETRTNMDDSLNFDTLAVRSGTVRSDFNEHSEAIFLTSSFVFASAADAAEKFRNSEDNYTYSRFTNPTVSMFQDRLAALEGGEACMATASGMAAIMSVVMSALQAGDHLVSSQALFGSTLGMFSQIFSKFGITTTFVDPTDLDAWKNAVRPETKMFFLETPSNPLTEVADIEAIGKIAKASNALFVVDNCFCSPALQQPLKLGADVVMHSATKFLDGQGRVLGGALVGSKQFIMEKVFPFVRSAGPTLSAFNAWVLLKGMETLSLRVEKQSANALEIARWLETHPAVNRVFYPGLESHPQHALAMRQQKAGGAILSFELKGDTPEQMRANAWRVIDNTKICSITGNLGDTRTTITHPATTTHGRVTSEARAAAGISEGLIRLAVGLENAGDIRGDLERGLA

SEQ ID NO: 7435 - protein, 215 aa, Burkholderia cepacia; identical to SEQ ID NO: 4676

SEQ ID NO: 7436 - protein, 369 aa, Burkholderia cepacia
VGLVGWRGMVGSVLMQRMQQEGDFDLIEPVFFSTSNAGGNAPSFAKNETKLKDATSIEDLKKCEAIISCQGGDYTNEVFPKLRAAGWNGYWIDAASSLRMKDDAVIILDPVNLDVIKNALVKGQKNFIGGNCTVSLMLMALGGLFRENLVDWMTAMTYQAASGAGAQNMRELLQQMGTLYGAAKEDLADPSSAILDIDRRVLSAMNSDRMPTGNFGVPLAGSLIPWIDKDLGNGMSKEEWKGGAETNKILGKPAMGTPGSIPVDGLCVRIGAMRCHSQALTIKLNKDVPLDEVNSILASGNDWVKVVPNEREASMRDLSPAVVTGTLTVPVGRVRKLAMGGEYLSAFTVGDQLLWGAAEPLRRMLRIVL

SEQ ID NO: 7437 - protein, 740 aa, Burkholderia cepacia
  unsure (1)..(740): unsure at all Xaa locations
ERRVLHAVTVQKDHLSVRGRSCXAAGWRISANLALSDHNVPTTDRSHGIADPISRLQVDTLDSNCDAYGITQFKMNDLRQGIVHIIGPEQGATLPGMTIVCGDSHTSTHGAFGALAHGIGTSEVEHVLATQTLLQKKSKNMLVKVEGALPRGCTAKDIVLAIIGKIGTAGGTGYAIEFGGSTIRALSMEGRMTVCNMAIEAGARAGMVAVDDTTIEYLKGRPFSPEGVEWNHAVEYWKQFKSDDGAQFDRVVELNAAEIVPQVTWGTSPEMVTAVDGRVPDPDREKDPVKRDALERALKYMALEPNAPIESIKPDKIFIGSCTNARIEDIRAAAYVVKKLGRRVAPNIRLAMVVPGSGLVKAQAEREGLDKVFTDAGFEWREPGCSMCLAMNADRLEPGERCASTSNRNFEGRQGAGGRTHLVSPAMAAAAAIEGHFVDIRKLGXTRMMKNMNRTTLLRRFALGSLAGLLLGLAGCNTVHGFGEDMSHLGNSISNHADKXAVFDFCRPAQSGFFXSLRASPGLETGASVMEKFIVHTGVVAPLDRENVDTDAIIPKQFLKSIKRTGFGPNAFDEWRYLDHGEPGQDNSQRPLNPDFVLNQPRYQGASVLLARKNFGCGSSREHAPWALEQYGFRALIAPSFADIFYNNCFKNGVLPIVLTEQQVDHLFNETYAFNGFKLTVDLEAQVVRTADGGTEYPFEVAAFRKYCLLNGFDDIGLTLRHADKIRQFEAERIAKQPWL

SEQ ID NO: 7438 - protein, 553 aa, Burkholderia cepacia; identical to SEQ ID NO: 4679

SEQ ID NO: 7439 - protein, 335 aa, Burkholderia cepacia
MQAAVVEQFGKPLVLKELAIPTPGPGQVLVKTEACGVCHTDLHATNGDWPLKPGLPFTPGHEGIGIVAALGAGVTAVKEGDRIGVPWLYSACGHCEYCLAAREPVCAEAQFGGYTKNGGFAEYIVADPNYVAHIPAGLAAREAAPLICAGITSYKGIKETQARPGEWVVISGVGGLGHLGIQYAKAMGLQVCAVDIDDGKLAHAKRLGADAVVNANDGDPIAAVIRATGGGAHGVLITAPSLGAFKQGVGMTRKCGTCVLVGLPPGEFPTPLFDVVANCITIRGSFVGNRRDMAEALAFAADGKVRADIELQPLSAINNVFQRLGHGDVPSRVVL

SEQ ID NO: 7440 - protein, 450 aa, Burkholderia cepacia
YQSVNPNTGKTLKSFDELNDQQLEKALSTAQSCFHVWKKTSYAQRAAIISRAAGLMRANVDEFAKLATLEMGKRIDEARGEVNFSADILDYYARHAEAFLAPTKLHPKVGEAHMETSPFGVLFCVEPWNFPYYQLARVAGPQLMAGNVLVVKHAGCVPQCAIAFEKLLIDAGAPVGAYTNLLISHKQAERIIDDPRIQGVALTGSVAAGRSIAARAGQNLKKTSMELGGSDAFIVLDDADLEKTIPWAVWGRMYNAGQTCCAAKRFIVLDSIADRFLEKFKAALNELKPGDPMDEKTTHGPLSTEAALTQLLKQVDDAVAKGATLVMGGKRIDRPGSFMQTTILTDIKPDNPAFRDEFFGPVVSFFRVKDEAAAIALANDSDFGLGGSVFTADAARGKRVASGVDTGMMFINNIDWSDAELPFGGIKYSGYGRELGNMGIQEFVNTKLVR

SEQ ID NO: 7441 - protein, 458 aa, Burkholderia cepacia
GYTEAEALGMTVSDMLPPGARQDHLDFIRYAAHNEALHSYETQRVTKGGRVVDIWITLSILSDDQGHAVAIATTERELTDRSLSNAQLRERAERLAQADRRKNEFLAMLGHELRNPLAALCSSGDLLASETIDPRQKSWAVGVIQRQGRSMTQLVNEMLDLTRITSGSIELRRQAVTLKAVIQSAVEVCQPIIDERHHTLSVSLPDEPVLMYVDPTRLSQVVENIVINAARYTEPGGHISLTATRTGRRLSLRVKDNGRGIPASMLSTLFDMFVQGPVPYGQLHNGLGVGLSVVRRLVELHGGSVRAISDGRTGSEFIVDLPLGMIPPGVEQAGTPQEPVNAGPRKILIIDDNADASEALAMLLAAEGHVVETRLDGPGGLEAASTFRPDVVLLDIGLPGMDGYEVAKQLRDSVATYDTMLIAVTGYGQPGDQLRSAEAGLDYHLVKPVDINALTRLL

SEQ ID NO: 7442 - protein, 508 aa, Burkholderia cepacia
IRHNARFHGIKTAVVCGDDRLNWREFHLRTNKVANALVRAGLQKGDRVCFFMQNSMAAFELIWGTIKAGGVVSPLNVMMAADSLPAMIDNAAPRFIFVDSELAGAVDAVRGAVRNKPDIFYAESGAVEGWQSYVELVEAGSEAEYFPDLKLSDTMTVLYSSGTTGVPKGSEHTHAARHFYSLGCGPALRMDPYSVALCATPLYTNGTWITLLPALYLGGTVVLARKLTPQAWLELVARERITHAFLVPTQCIGIVERASPEYDVSSLQGILYGGAPMTSQTAAAMAKTFPNTRMYEIYGMSEGWCTLAYPEDRAHGRSSTVGKPVFGGDICVIDPEGRELPPGEQGELAGWSAGLMKGYLGDPQRTADIVWKGPHGRTYLRSGDIGYMDTEGFFFVNGRVKDMIISGGINVFASDIEEVFMQHPAVAEAAAIGIPHDKWGETPIVMVILRQGHQIDAVALKEWGNHRLGKFQRVSEVKFVDDFPRANYGKILKRVLREPYWEGRERSI

SEQ ID NO: 7443 - protein, 386 aa, Burkholderia cepacia; identical to SEQ ID NO: 4684

SEQ ID NO: 7444 - protein, 436 aa, Burkholderia cepacia; identical to SEQ ID NO: 4685

SEQ ID NO: 7445 - protein, 141 aa, Burkholderia cepacia; identical to SEQ ID NO: 4686

SEQ ID NO: 7446 - protein, 288 aa, Burkholderia cepacia
GSIPAIITPMLEDGSLDLPAFRKLIDWHVAEGTNALVVVGTSGESATLSVEEHVLMVKTAVEHTAGRIPVIAGSGGNSTTEAIELTQRAKEVGADATLQVVPYYNKPTQEGIYRHFAKIAETVDLPVILYNVPGRTVADMSNETILRLAQVPGIIGVKEATGNIDRAAHLIKFAPSHFGIYSGDDPTAIALMLLGGHGNISVTANVVPRAMSELCKAALAADVKTAREIHLKLLSLHKNLFVESNPIPAKWALQQLGRVQGGIRLPLTPLDPQYHEVVRGALREAGLL

SEQ ID NO: 7447 - protein, 427 aa, Burkholderia cepacia
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSTEFTDYLANLADKFPIVSIEDGMHESDWAGWKTLTDKLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 7448 - protein, 623 aa, Burkholderia cepacia; identical to SEQ ID NO: 4689

SEQ ID NO: 7449 - protein, 383 aa, Burkholderia cepacia; identical to SEQ ID NO: 4690

SEQ ID NO: 7450 - protein, 451 aa, Burkholderia cepacia
MAYASINPNSGETLKRFDPLTDAQLEQSLASAQACSQTWKQTTYAQRAGILNKAAALLRTHVDEFAKLATLEMGKRINEARGEVNFSADILAYYAKHAEAFLAPIRLEPKIGEAHMESSPFGVLFCVEPWNFPYYQLARVAGPQLMAGNVLVVKHAACVPQCAIAFEKLLIDAGAPKGAYTNLLISHEQAQRVIDDPRIKGVALTGSAAAGKSVAARAGQNLKKTSMELGGSDAFIVLDDADLEKTIPWAVWGRMYNGGQTCCAAKRFIVLDSIADRFLEKFKAALSELRPGDPMDEKTTHGPLSSESALVQLLKQVDDAVANGATLLMGGKRIDRPGSFMEITILTDIKPDNPAFRDEFFGPVVSFFRVKDEAAAIALANDSDFGLGGSVFTEDIVRGKRVASSVETGMMFINNIDWSDAELPFGGIKDSGYGRELGNMGIQEFVNKKLV

SEQ ID NO: 7451 - protein, 471 aa, Burkholderia cepacia
PDETGCAWHDTRMTYGELDALADGVARALVRRGLKVGERVAILAANRAEYVAALLGIMRAGMVAVPVNFRFPPALSTFVIRDSGARLVFCDAARLARLPGRSADSRIRFDGGRQFRLFRRTRPVRDFRAYPDTPAMFLYTSGSTGKPKGVMLSHGSHLWVARTRARAQPPEAHRFLVAAPMYHMNALTLVLMSLYGHGTVVLLPQFTARMYITAIERYRVTWLTSVPPMIAMMLREKELLERTDLSSARFIRMGSAPVSESLLAQIGEVLPNAKLTNVYGTTEGGPIVFGPHPQGIEPPLLSVGYPHPEVSVKLLDAPPTGVATGVLAVKSPAVMLGYHNRPDLPLPVTADGFYITGDVFHRDEQGFYAFVGRADDMFVSGGENIFPGEVEQMLETHPDIVQACVVPVADDIKGTKPVAFVVRRAGASLTEEEAKQYALTHAPAYQHPRRVWFVDALPLASTNKIDRAALK

SEQ ID NO: 7452 - protein, 193 aa, Burkholderia cepacia
AVDHVSFRIRSGEIFGFLGSNGCGKSTTMKMLTGLLPASEGSAKLFGREVDPNDIDTRTRVGYMSQAFSLYGELTVQQNLVLHAQLFHVPPQQIAARVDEMVSRFGLGEVRDALPDSLPLGMRQRLSLAVAMVHKPELLILDEPTSGVDPVARDNFWQLMIELARRDRVTIFISTHFMNEAERCDRISLMHAG

SEQ ID NO: 7453 - protein, 225 aa, Burkholderia cepacia
YAKTIALDNLTLDFPAGRMTGLIGPDGVGKSSLLALAAGARAVQEGTVEVLGGDMRSRRHRALVCPRIAYMPQGLGKNLYPTLTVEENLQFFARLFGHDAAERRRRIDSLTRSTGLKPFLARPAGKLSGGMKQKLALCCALIHDPDLLILDEPTTGVDPLARAQFWNLIASIRKGRPGMSVIVATAYMDEAQRFDSLVAMDAGRILATGEPRALLEQTNSTRWKR

SEQ ID NO: 7454 - protein, 266 aa, Burkholderia cepacia
LEGRVAIVTGSSSGNGRAIALALAREGAHVVCSDLKKSALKGGYEKDIETDTDAVIAQQGGKTAFIAADASKAADVQKIVDHAVSTFGRLDIIVNNAGVFTGLHSIIDETEEQYDFTMNVNAKGVWLGCKYAITQFMKQEPLTTSTGVQVRGRIVNIASIGGLVGLALEPAYCASKGAVVNLTRELALDFAPERINVNAICPGFLATAMVRSFLENDDTNKLLHDLTPWPRVGTAEDVAKAALFLASDDAEWMTGSMLTVDGAFTA

SEQ ID NO: 7455 - protein, 254 aa, Burkholderia cepacia; identical to SEQ ID NO: 4697

SEQ ID NO: 7456 - protein, 523 aa, Burkholderia cepacia
APDVFRRGAWVPMREYGNDDEVDFAIVGTGAGGGTLACRLAELGFRVVAFDAGAWWRPLEEFASDETHQAKLFWTDERICDGENPLQLGNNNSGKAVGGSTVHFAMVSLRFRPEWFKSRSALGYGADWPLDWREMWRYYAQVEDALKISGPVNYPWGPPRPRYPYRAHELNAAALVLARGAEAMGIPWTPTPLATLSAPRGLAHPCVYRGFCVSGCATNAKQSALVTWIPRALRAGAEIRDLAMVGRIATNALGRVNGVEYLREGRWQFQRAKHVVVAGYAIETPRLLLMSATSQYPDGLANRSGLVGKNLMAQSNQAVYGTMEEEIRWYKGPPSLAITEHWNYTDEGKDFFGGYSYMSQGPLPEVWAGAQNKRGLWGDALAREMRNYNHQAGLKIVGEMLPQERNRVTLADEKDQYGLPVARVTYSWGDNDKRLIAHSLDFMQQALAAAGGRDIWRETDDTCHLNGTARMGSDPATSVVDADCRSWDIPNLWICDGSVFPTVGGVNPSLTIQAIACRTAARI

SEQ ID NO: 7457 - protein, 569 aa, Burkholderia cepacia
QTVGDFIIDRLHAWGVRRIYGYPGDGINGVFGALNRAHGKIEFVQVRHEEMAAFMASAHAKFTGELGVCIATSGPGASHLLTGLYDARLDHMPVLAIAGQQARAALGGHYQQELDLVSMFKDVAGAFVEQASVPSQVRHLVDRAVRTALAERKVTALVLPNDLQDLAYEAPARKHGTLHSGVGYRRPRLVPYPDDLQQAAEVLNAGKRVAILVGAGALHATDEVIAVADKLGAGAAKALLGKAALPDDLPWVTGSIGLLGTKPSYDLMTECDTLLVIGSGFPYAEFLPKEGAARGVQIDLKADMLSLRYPMEVNLVGDSVETLRALLPLLEQKQDRGWREKIEGWTADWWKTLDKRAHEAGRKGMNPQRSVWELSPRLPANAIVTSDSGSCANWYARDLKVQRGMMCSLSGGLASMGAAVPYAIAAKFSHPERPVIALVGDGAMQMNNMAELITVAKYWKQWASPRWICMVLNNSDLNQVTWEQRVMEGDPKFEASQDIPSVPYHRFAELIGLKGIYVEDPERMGAAWDEALAADRPVVIEVKADPDIPPLPPHITLAQAKAFASTLIK

SEQ ID NO: 7458 - protein, 306 aa, Burkholderia cepacia
TIVSIGSINLDLQMRVDHPVGSAETQRAHDFSRLAGGKAANVAYLARRFGHDAQLLGMVGDDRFADEAVAPLRDLGIDVSRVRTAAGQPTAVSMIFVPDNGKKTIVLASNANDAWQRADIDAALEAIDAAPAHSVLAVDCEMSVDACAAVLAAAQRRALCVVLDPAPPQRAQSGALRALWRAVHALTPNEEEAAALTGIEIADQAGAVRAARALHREGFELVCVKRSDGGCIAVSRDGVLAVQVKPVEALDTTGAGDAFTGALAVSLVERRAFADAVRLATAAANLTVMAWGSQTALPDRARADAF

SEQ ID NO: 7459 - protein, 210 aa, Burkholderia cepacia; identical to SEQ ID NO: 4701

SEQ ID NO: 7460 - protein, 458 aa, Burkholderia cepacia
FIGGAWREPGAGERFASHAPASGEPLAQIAHGDAGDIDAAVCAARAAQPAWLALGGAGRARHLYALARMVQRHSRLFAVLEALDNGKPIRETRDIDVPLVARHFLHHAGWAQLQESEFAAYAPLGVIGQIVPWNFPLLMLAWKIAPAIAMGNCVVLKPAEYTPLTALLFAELAHRAGLPAGVLNVVTGDGRTGAALVEHPQIDKIAFTGSTEVGKAIRAVTAGSGKSLTLELGGKSPFIVFDDADLDGAVEGVVDAIWFNQGQVCCAGSRLLVQEGIEARFIARLKRRMETLRIGSSLDKSIDIGAIVDPVQLERIRSLVETGRREGCAVWQSPGTVLPAQGCFYPPTLVTGVAPASTLAQQEIFGPVLVAMSFRTPDEAIALANNSRYGLAASVWSETIGRALDIAPRLACGVVWINATNLFDAAVGFGGYRESGYGREGGREGIYEYLKPRAWLNL

SEQ ID NO: 7461 - protein, 335 aa, Burkholderia cepacia
SMKVYRFDQAGSLDHLTLHDEPTPEPQRGEVLIRVRASSLNYRDIAMVHGTYLRAQRAGLIPLSDAAGEIVAVGEDVVDFKVGERVINTFHPRWYGGNPPPTLGSEGYGSHRDGWLSEYKVVSQEAIVAAPPGLSFEEAATLPCAALTAWTSLSGLRPLRPGQTVLTQGSGGVSVFAVQLAKLLGARVIATTSSAEKAARLKALGADEVINYVETPAWGERVRELTEGRGVDRVLEVGGPGTLEQSIKAVASRGEVALIGFLASGDSGVGFNDLFRSGGVFYRISVGDRSGLLELVRAVTSSGLKPVIDTVFPFERALDAWHHFDDRAFFGKVVI

SEQ ID NO: 7462 - protein, 251 aa, Burkholderia cepacia
RLTGKTAIVTGGGSGFGEGIAKTYAREGANVVVNDLNGPAAERVASEIALAGGKAIAVTGNVAQREDWQKLREAALEDFGSVQIVVNNAGTTHRNKPVMEVTEAEFDRVYAVNVKSIYWSVQEFVPYFREQGGGCFINIASTAGVRPRPGLVWYNGSKGAVIIASKSLAVELGPDRIRVNCVNPVIGETALLSEFMGVEDTPENRQRFLAGIPLGRFSTPQDIANAALYLASDEAEFITGVCLEVDGGRCV

SEQ ID NO: 7463 - protein, 474 aa, Burkholderia cepacia
EARHFIGGEWSAASGGETIAVLDPSDGQPFTQLARGTAADIDAAVHAARRAFEGAWGEASAAERGRVLYRLSMLVAARQEELALLEARDTGKPLKQARADSAALARYFEFYAGAADKLHGETLPYQTGYTVLTIRDPHGVTGHIVPWNYPMQIFGRSVGAALAAGNACVVKPAEDACLSVLRVAELAAEAGLPAGALNIVTGYGHEAGAALARHPGIDHISFTGSPETGKLVTQMAAENHVPVTLELGGKSPQIVFADADLDAALPVLVSAIVQNAGQTCSAGSRVLIDRSIYEPLLDRLSGAFHALRVGPSHADLDCGPLISAKQQRRVWDFLSDAQHDGIPMAAHGEVIPEAPESGFYQAPTLLRDVPASHRLARDEVFGPVLAAMSFSGEDEALALANGTPFGLVAGIWTRDGARQMRLARRLRSGQVFINNYGAGGGVELPFGGVKHSGHGREKGFEALYGFTVLKTIAI

SEQ ID NO: 7464 - protein, 234 aa, Burkholderia cepacia
LRVKDVCRGFNKSQGELLVLDDANLSLREGEIVGLLGRSGSGKSTLLRIIAGLIEPTDGEVTYMGKPLDGPAKGVAMVFQTFALFPWLTVLQNVEAGLEAQGVGASERRTRALAAIDLIGLDGFENAYPRELSGGMRQRVGFARALVVDPTLLLMDEPFSALDVLTAETLRTDLLDLWTQGRMPIKAVLIVTHNIEEAVFMCDRILVLSSNPGRVIAEIKVPFKHPRNRLDPAF

SEQ ID NO: 7465 - protein, 469 aa, Burkholderia cepacia
MSRLIVVSNRVAPTQEGRPAAGGLAIGVLDALKETGGVWFGWSGETVSEPSAPVIEKQGNVTYATVGLTKRDYDQYYRGFSNATLWPTFHYRNDLSRYDRQEYAGYQRVNATLAKQLKELLKPDDIIWVHDYHLLPFARCLRELGVKNPIGFFLHIPFPVPEVLRTIPPHEELVKAMCSYDVIGFQTDADRQSFVDFIERGQHGTSSEDGMVHAYNRFLKVGAYPIGIYPDAIAKAAEQFTDRKPVRSLRDGMRGRKLIMSVDRLDYSKGLVERFQAFERLLLNAPGWHGRVSLVQIAPPTRADVQTYQRIRQTLEGEAGRINGRFAQLDWTPIQYLNRKYERNLLMALFRQSQVGYVTPLRDGMNLVAKEYVASQDPADPGVLVLSQFAGAAEQLPGALVVNPFDLSQMAEALERALSMPLAERQARHADMMAPMRENNLSVWRDTFLADLRNVATASSVTAKAVKLA

SEQ ID NO: 7466 - protein, 241 aa, Burkholderia cepacia; identical to SEQ ID NO: 4707

SEQ ID NO: 7467 - protein, 415 aa, Burkholderia cepacia
KKALVAACVGNFIEYYDFVIYGYFASVIARLFFPADNEAASLLLTFAVFAISYASRPLGGLIFGHLGDRYGRKTPLAVAVMLIACSTTVIGLLPTYSAIGIASPIILTAARLVQGISVGGEYGGATSFIAEYAPPGRRGFYTGWQTFTIGLALLVGGAVASIITGALSAEDLRAWGWRLPFFAGLPLGFVGLYLRLKLEETPHFSSVQQTAEIERTPLVTGLRREWKAILIGMGLIAAPSACIYIYYIYSPTYLSVVLGFKLADAQRANLYSLIFYCALLPVFAHLSDVVGRRPLMLVSSLAIMLVTYPAFHLLDPHDFGKTVAALCLMSLAFAPHSATALCAMAEIMPTRLRYTGLSVSLNIPVTLLGGTAPFIATYLVSRTGDLYSPAWFVIGAGLCTLVAAYAYKETLHSGL

SEQ ID NO: 7468 - protein, 209 aa, Burkholderia cepacia
LQLYSLPTPNGVKVSIMLEETGLPYEPHLVRFDTNDQMTPEFLSLNPNNKIPAIIDPDGPDGKPLPLFESGAILIYLADKSGRFIPQDAAGRYEAIQWVMFQMGGIGPMFGQLGFFHKFAGKEYEDKRPRDRYIAESKRLLGVLDRQLEGRDWILGDTYSIADIATFPWVRNLIGFYEAGDLVGIQDFPNVTRVLAAFVARPCRGEGAG

SEQ ID NO: 7469 - protein, 647 aa, Burkholderia cepacia; identical to SEQ ID NO: 4710
  unsure (1)..(647): unsure at all Xaa locations

SEQ ID NO: 7470 - protein, 242 aa, Burkholderia cepacia
LAGGRYLVTGASSGIGQASAQLIARLGGHVIAAGRDEARLQATLAGLHGSGHAAAAASLVDADQTAEWVSHLAETHGAFAGVFHAAGVELIRPAKLTRQEQLDQVFGSSLYAAFGIARAGSKKNVIVDGGSLVFMSSVAGSTGQAGMTAYSAAKAAVDGLVRSLACEMAPRKIRVNSIAAGAVHTAMHDRLTGGSPDEALAAYEKSHLLGFGEADDVAQSALFLLSGASRWITGTTLVVDGG

SEQ ID NO: 7471 - protein, 333 aa, Burkholderia cepacia; identical to SEQ ID NO: 4711

SEQ ID NO: 7472 - protein, 337 aa, Burkholderia cepacia
VQARILDIAGFLPEQVLTNEQLAALYPEWPADKILAKTGIQQRHIAAAGQTAADLAYEAARNLFAQGSVNAQDVDFVILCTQAPDYVLPTSACLLQDRLGISTHAGALDVNLGCSGYVYGLSLARGLVETGAARCVLLLTADTYSKYVHPLDKSVRTLFGDGATATAITASTNGDASIGPFVFGTDGRGAQNLIVKAGLFREPKNAQSALETQDASGNVRTDEHLYMNGAEVMAFSLAEVPKAATSLLEKAGMDREEIDFFVLHQANRFMLEALRKKMKVPEAKFPILMEQCGNTVSSTVPLALKQMKDDGLLQHGSRLMLLGFGVGYSWAGCLVTY

SEQ ID NO: 7473 - protein, 655 aa, Burkholderia cepacia; identical to SEQ ID NO: 4713

SEQ ID NO: 7474 - protein, 320 aa, Burkholderia cepacia; identical to SEQ ID NO: 4715

SEQ ID NO: 7475 - protein, 359 aa, Burkholderia cepacia; identical to SEQ ID NO: 4716

SEQ ID NO: 7476 - protein, 157 aa, Burkholderia cepacia
TIHIRPARAADAALILRFITELAVYEKAEHEVVASVKDIEASLFSASASAKALICEMNGEPIGFCVYFFSYSTWLGKQGLYLEDLYVSPASRGSGAGKQMLRHLARIACDTGCGRFEWSVLDWNEPAIGFYESIGASAQSEWVRYRLAGDALKKFAE

SEQ ID NO: 7477 - protein, 575 aa, Burkholderia cepacia; identical to SEQ ID NO: 4718

SEQ ID NO: 7478 - protein, 245 aa, Burkholderia cepacia; identical to SEQ ID NO: 4719

SEQ ID NO: 7479 - protein, 101 aa, Burkholderia cepacia; identical to SEQ ID NO: 4720

SEQ ID NO: 7480 - protein, 309 aa, Burkholderia cepacia; identical to SEQ ID NO: 4721

SEQ ID NO: 7481 - protein, 334 aa, Burkholderia cepacia
MLKEALASAETVAAQLMDTSRVEALAAKLAQQPRHVALTVARGSSDHAASYFASLTMSRLGVPVASLPMSVATLQQAPLQVCDQLALAFSQSGKSPDLVGTMEALRKAGALTVAAVNVSGSPLADACEFELPLVAGPELSVAATKSYIAMLSISAQLVAHWQKDAELLAALKTLPEALRAAGKLDWSNAVEELRGVERMIVIGRGLGLAIAQEAALKLKETSGIQAEAFSSAEVRHGPMELIDRDYPLLVFAPRGPEQAGLLQLARDMQARGARVLLAAPADVPEATLPLAITAHAALDPIAAILSFYVMAAGLAAARGRNPDAPRHLNKVTET

SEQ ID NO: 7482 - protein, 696 aa, Burkholderia cepacia
ETPLLVLRARGGAAAEASRQASATNVAEEARQQVTLVHAGGLHARPAARAREAARGFDARVEVRYEGRKAAIESVVGLLGLGAGEGATVELLGIGPQARAAIEAIAHELTREAQGEAEEKPARESSPAPQAVGHAADEALAPNTLAGVCAAPGVAVGKLVRWDDADIDPPEKAAGTSAAESRLLDKAIATVDADLGTTVRDASQRGAVGEAGIFAVHRVLLEDPTLLDAARDLISLGKSAGFAWRAAIRAQIAILAKIEDALLAERAADLRDIEKRVLRALGYTNAASRTLPEEAVLAAEEFTPSDLSTLDRSRVTALVMARGGATSHAAILARQAGIPALVAVGDALHAIPEGTQVVVNATTGRLEFAPTELDVERARLERSRLAGVREANRRTSQQAAVTSDGRAIEVAANIATLDDAKTAVENGADSVGLLRTELLFIHRAAAPTTDEHRQSYQAIVDALSGRTAIIRTLDVGADKEVDYLTLPPEPNPALGLRGIRLAQVRPDLLDDQLRGLLAVRPLGAVRILLPMVTDVGELIRIRKRIDEFARESGRTEPIEVGVMIEVPSAALLADQLAQHADFLSIGTNDLTQYTLAMDRCQADLAAQADGLHPAVLRLIAATVQGAGKHGKWVGVCGALAGDPLAMPLLIGLGVTELSVDPVSVPGIKARVRNLDYQLCRQRAQDALALESAQAVR

SEQ ID NO: 7483 - protein, 308 aa, Burkholderia cepacia
KRNMSAAAPVVEAVGLTKRFGAFTAVDGLNLSIAQGEVVGFIGPNGAGKSTTIRMLCGLLSPSAGRACVAGFDVGTQAEALRSHIGYMSQKFSLYGDLTCRENLRFFCGIYRVPRREIAERIQLAISTAGLEGREDTLVRTLAGGWKQRLALGCANLHHPPVLFLDEPTSGVEPEARRRFWDLIHGLAAGGVTVLVSTHYMDEAEYCHRIALIDAGHLVAIGSPSELREQNLGGNLFEVACTPLGAALAALREAPEVIDAAIFGDRLHVLMHLGAANTVLQQFLAARHIEVTSVRAIRASLEDVFVQL

SEQ ID NO: 7484 - protein, 572 aa, Burkholderia cepacia; identical to SEQ ID NO: 4725
  unsure (1)..(572): unsure at all Xaa locations

SEQ ID NO: 7485 - protein, 447 aa, Burkholderia cepacia
ELKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAYPLR

SEQ ID NO: 7486 - protein, 532 aa, Burkholderia cepacia
DERYVIGVDVGTGSARAGLFDLAGHMVASAKRDITLFHASGSIVEQSSGEIWIAVCDAVKDALSQAAVSPDQVAGIGFDATCSLVVLGAGGRPLPVGPSEQAERDIIVWMDHRAVAQAERINATGHEVLNYVGGKISPEMETPKLLWLLENRPAVFAAARQFFDLTDFLTWRATGDLSRSTCTVTCKWTYLAHERRWDESYFRSVGLGVLADEAFARIGQTVVDPGTPLGSGLTADAAAQLGLRTGTPVATGVIDAHAGGIGTVGADGDPEACLAYVFGTSSCTMTTTRSPVFVPGVWGPYFSAMVPDAWLNEGGQSVAGAAIERLLAMHPAAADAKRRAEHEGQSLPAMLAALAVQAADSLSEAAVLADGLHVVPEFLGNRAPLADPHARAVIAGLGMEDDLDSLVALYIAGICSVGYGLRQIIEAQANAGAPIARVVISGGAGRLDLVRQLLADATGKPVLATQAEEPVLLGAAMLGSVAGGQFGDVRSAMARMSQISKTYQPDTGKIAGLHEARYRAFLKLQSVAREIR

SEQ ID NO: 7487 - protein, 418 aa, Burkholderia cepacia
KAAPRLLESAKGMYYRSTDGREVLDGCAGLWCVNAGHGREEIIAAITQQLSTLDFAPTFQMGHPLAFEAATKVAELMPEGLDRIFFTNSGSESVDTALKIALAYHRSRGEGQRTRLIGRERGYHGVGFGGISVGGIAPNRKTFSGALLPAVDHLPHTHNLEQNAFSKGQPAWGAHLAEELERIVTLHDASTIAAVIVEPVAGSTGVLIPPQGYLQKLREICTKHGILLIFDEVITGFGRVGKATASEYFGVTPDLITMAKAINNAAIPMGAVAASRTVHDTIVNSGAQGAIELFHGYTYSAHPAATAAAIATLDLYRREGLFERAATLAPTFEAAAHSLRGAKHVKDVRNIGLIAGVELESRDGAPGARAYEAFVKCFEAGVLVRFTGDILAFSPPLIINEEQIAHIFKTVGDVLATV

SEQ ID NO: 7488 - protein, 177 aa, Burkholderia cepacia
AAVRVLLRWAGDDPAREGLIDTPARVVRSYEEFYAGYQVDPREILARTFSEVDGYDEMIVLKDIRFESYCEHHMVPIIGRAHVAYLPEHRVVGISKLARLVDAFAKRLQIQEKMTVQIADTLNEVLQPAGVGVILEAAHQCMSTRGVHKAGVTMVTSRMLGTFRTDPSTRREFLSIV

SEQ ID NO: 7489 - protein, 680 aa, Burkholderia cepacia
LDQLCINTIRTLSMDAVQKANSGHPGTPMALAPVAYHLWQNHLRYDPDEPLWPDRDRFVLSVGHASMLLYSLLHLANVKAVDDDGNPTDGPAVSLDDIEHFRQMGSKTPGHPEYRMTTGVETTTGPLGQGLGNSVGMAMAARWYESHFNKPDAPLFDYRVYALCGDGDMMEGISHEAASLAGHLKLSNLIWIYDSNRVTIEGHTDLAYSDDVETRFRGYNWHTLHVSDANDAAALEAAFVEAKSITDRPTLIVVHSIIGWGAPHKQDTSAAHGEPLGVEEVALAKKAYGWPEDKFFYVPDGVHERFAAGIGARGKAAREEWQAKYDAYSRKYPELAREFAQIEAHELPAGWDSDIPTFDADPKGVASRESSGKVLNAIAARVPWMIGGAADLSPSTKTNLKFEGAGSFEYDNYGGCNLHFGIREHAMGAAVNGLALSNLRPFGSTFLIFSDYMKPPIRLSAIMEVPAIYVFTHDSIGVGEDGPTHQPIEQLASLRGVPGLTVLRPGDANEVAEAWRVALADPRRPSCIVVSRQPLPTLDRSRYAAAKGTQKGAYVLADAADGQKPQVILIATGSELSVCVDVYEKLTSEGIAARVVSMPSWDIFERQDEAYQDSVLPPDVDARVAVEQAASLGWDRYVGRLGAQVVMHTFGASAPLAELKKKFGFTPEHVYEAAKQQIAR

SEQ ID NO: 7490 - protein, 541 aa, Burkholderia cepacia
  unsure (1)..(541): unsure at all Xaa locations
SGDWCWMEGRGRAAYDHHGVPLMIYGLGIDITERKEAQTVLLRQAAIFEHLSDAIVITDLRGNITDFNVGGERMLGYRMREILGKPVAMFLPPEQAPGIRREALAALAAEGTWRGELPFVRHDGSRGVCETVVKPLANARGDIYGAVSINRDITERRRAEQQLTRLNLELSKADRRKDEFLATLAHELRNPLAPMRNVLEILRLKEFADPQLSWSRDVFDRQLQHMTHLVDDLLEVSRITQGKLELRKQRLELARAMQSAMEAARPTVQASSHHLSVTLPREPLYLIADPTRLSQMILNLLNNAAKYTPPGGSISLAAEREGDEAVIVVRDSGIGIPGEHLDSVFEMFSQLAPALDRSQGGLGIGLALVRGLAELHGGTVAAFSEGPGKGSEFMIRLPLTATALQPSDSAPPEAPHAAGLRVLVVDDNADAAESLAMVLELEGHEVRTAGDGIAGLALVDTFAPQAVILDIGLPGLNGYEVARRIRHDYPNAGILLIAVTGWGQQQDKQTAVAAGFDHHFTKPVDPRELQRVLCRQQVXAA

SEQ ID NO: 7491 - protein, 284 aa, Burkholderia cepacia; identical to SEQ ID NO: 4731

SEQ ID NO: 7492 - protein, 653 aa, Burkholderia cepacia
GTPFPLGATWNGSGVNFALFSAHATKVELCLFDETGENEIERIELPEYTDEVWHVFVPNLKPGAVYGYRVHGPYEPEKGHRFNPNKLLLDPYAKAHIGELKWAPEIFGYTLDSEEGDLSFDERDSAPFVPKCKVVDANFSWSHPERNALPWERVIFYEAHVRGFTKRHPEVPENLRGTFAGLGQQVVLDYIKNLGVTSVELMPIQTFVNDSYLLDKGLTNYWGYNTIGFFAADPRFFASSIDSVGEFKEMVDRFHNANLEVILDVVYNHTAEGNERGPTISFKGIDNASYYRLMPDEPRYYINDTGTGNTLNLSHPRVLQMVTDSLRYWVTEMKVDGFRFDLATILGRELHGFDEGGGFLDSCRQDPVLSSVRLVAEPWDCGPGGYQVGGFPPGWAEWNDRFRDTVREYWKGDEGKVPDLATRLTGSGDKFNHRGRRPWASVNFIAAHDGFTLNDLVSYNDKHNEANGEDNKDGHSDNKSWNMGVEGPTDDPDIRQQRERQKRNLLATLLLSQGTPMILAGDEFGRTQKGNNNAYCQDNEISWVDWEAIDDDGRALIEFVRNLTTLRHRLPVLRRGRFLTGEYNEALDVTDARWISPDGKDLSQEQWDDASMRCFGLVIDGRAQASGIRRPASDATLLLVLNAHHDVVNFTLP

SEQ ID NO: 7493 - protein, 332 aa, Burkholderia cepacia
DTRSELQATIKAMVQPGKGLLAADESGPTIAKRFKTIGLESSEENRRAYRNLLLTTPGLGEFVSGVILYEETLGQKADDGTPFPQLAAKNGIVPGIKVDLGKIALALAPGDEITEGLDGLARRFVDYKRQGARFAKWRAVYNITASLPSRLAIEANADSLARYAAISQEAGIVPIVEPEVLMDGEHTIERSAEVTEAVLHAVFHALHRHRVVLEHILLKPSMVIAGSEHAQQSSTADIAAYTVRVLKRTVPSAVPGIVFLSGGQSPEEATANLDAMNRLGALPWNLSFSYGRALQEPPLQAWKGERSHVEQAQQALLKRARLNSAAALGKYE

SEQ ID NO: 7494 - protein, 337 aa, Burkholderia cepacia; identical to SEQ ID NO: 4734

SEQ ID NO: 7495 - protein, 659 aa, Burkholderia cepacia
MSAIESVLQERRVFPPSAETVAAATISGMDAYRALAAEAERDYEGFWGRLARETLSWNTPFTKVLDESKAPFYTWFEDGRLNASYNSIDRHVEAGNGARVAIIFEADDGTVTNVTYQDLLQRVSRFANALKKRGVKKGDRVVIYMPMSIEGIVAMQACARIGATHSVVFGGFSSKSLNERLVDVGAVALITSDEQMRGGKALPLKNIADEALAMGGCEAVRSVIVFQRTGGKIAWNADRDLWMHELTQAEPDQCAPEWVGAEHPLFILYTSGSTGKPKGVQHSTGGYLLWAAQTMKWTFDWKPTDVFWCTADIGWITGHSYITYGPLTLGGTQVVFEGVPTYPNAGRFWDMIARHKVSLFYTAPTAIRSLIKAADADAKVHPKSYDLSTLRIIGTVGEPINPEAWVWYYENVGGSHCPIVDTWWQTETGGHMITPLPGATPLVPGSCTLPLPGIMAAVVDETGQDVPNGQGGILVVKRPWPSMLRNVWGDPDRYRKSYFPEELGGKLYLAGDGAVRDKETGYFTIMGRIDDVLNVSGHRLGTMEIESALVSNPLVAEAAVVGRPDATTGEAVCAFVVLKRSRPEGEEAVKLANELRNWVGKEIGPIAKPKDIRFGENLPKTRSGKIMRRLLRSLAKGEEITQDVSTLENPAILDQLGES

SEQ ID NO: 7496 - protein, 416 aa, Burkholderia cepacia; identical to SEQ ID NO: 4737

SEQ ID NO: 7497 - protein, 396 aa, Burkholderia cepacia
LFSAVELAPRDPILGLNEAFNADTRTTKVNLGVGVYFNEEGKIPLLRAVRDAEKARVDAALPRGYLPIEGIAAYDAAVQKLLLGNDSPLIAAGRVVTAQALGGTGALKIGADFLKRLNPNAKVAISDPSWENHRALFEGAGFEVVSYPYYDAHTHGVNFDAMLSALNSYAAGTIVVLHACCHNPTGVDLNIEQWKQVVEVVKARNLVPFLDIAYQGFGDNIEADAAAVRLFAAAELNVFVSSSFSKSFSLYGERVGALSIITASKEEAARVLSQLKRVIRTNYSNPPTHGGSVVAAVLASPELRATWETELAEMRDRIRAMRNGLVERLKASGVDRDFSFVNAQRGMFSYSGLTAPQVDRLREEFGIYAVSTGRICVAALNTRNLDAVANAIAHVL

SEQ ID NO: 7498 - protein, 255 aa, Burkholderia cepacia; identical to SEQ ID NO: 4739

SEQ ID NO: 7499 - protein, 463 aa, Burkholderia cepacia
  unsure (1)..(463): unsure at all Xaa locations
KKPIHKVLYVQVIVAIIIGIGLGHFYPDLAVDMKPLGDGFIKLIKMVIGPIIFCTVVTGIAGMEDMKKVGRVGGKALLYFEIVSTFALVLGLIATHVLKPGVGFNIDPATLDGKAVASYAAKAHGQTTVDFLMHIIPDTLVSAFAQGEILQILLIALLFGAVLATAGEKGKVVTGFIDGLSHVLFGIVRIITKLAPIGAFGAMAFTIGKYGIGSLLPMLKLIGTFYLTSVVFVVVVLGIIARAVGFNILRFVAYIKEEMLIVLGTSSSEAALPQLMLKLERLGCSRSVVGLVVPTGYSFNLDGTNIYMTMAVLFIAQATNTDLTWTQQLTLLAVTMLTSKGASGVTGAGFITLAATLAVVPTIPLSGMVLILGIDRFMSECRALTNIVGNGVATVVVSAWEKELDRSKLNAALRGDVAIKEPAGVXTAHRQPAPAQPRRPRIPAYETGVRAPNLRAVGRRSLR

SEQ ID NO: 7500 - protein, 389 aa, Burkholderia cepacia
IVIVGVARTPMAAFQGDFATLSAPQLGSVAIQAAVQRAGLKPEQIDEVVMGCVLPAGLGQAPARQAALGAGLPLATGSTTVNKMCGSGMRAAMFAHDMLAAGSVDVIVAGGMESMTNAPYLLPKARAGMRMGHGQVIDHMFYDGLEDAYEKGRLMGSFAEECAASFDFTREAQDAFAVESLARAKRANEDGSFAWEIAPVKVESRKGEVTIDRDEQPFKANIEKIPTLKPAFSKTGTVTAANSSSISDGAAALVMMRESTAKRLGVQPIARVVGHSTLAQEPAKFTTAPVGAIRKLFEKNGWRADEVDLFEVNEAFAVVTMAAMKEHHLPHEKVNVNGGACALGHPIGASGARILVTLIGALKKRGGKRGVATLCIGGGEATAMGIELV

SEQ ID NO: 7501 - protein, 370 aa, Burkholderia cepacia
LDQDHLMVRDALRTFVREAITPHAATWDRERTFPKDVHRQLAQLGAYGVLVPETYGGAGMDALALALILEEIAAGDGGTSTAISVNNCPVCSILLTYGNDAQKREWLTPLARGDMLGAFCLTEPQAGSDASALRTTATREGDEYLLNGVKQFITSGRNGHVAIVMAVTDKAAGKRGISAFIVPTDTPGYVVARVEDKLGQHSSDTAQIIFEDCRVPAANLIGAQGEGYRIALSGLEGGRIGIAAQSVGMARAAFEAALSYAKERESFGVPLFSHQAVQFRLADMATQLEAARQLIWHAASLKDAGQPCLTEAAMAKLFASEAAERICSAALQIHGGYGYLSDFPVERIYRDVRVCQIYEGTSDIQKILIA

SEQ ID NO: 7502 - protein, 329 aa, Burkholderia cepacia
RRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYH

SEQ ID NO: 7503 - protein, 506 aa, Burkholderia cepacia; identical to SEQ ID NO: 4743

SEQ ID NO: 7504 - protein, 392 aa, Burkholderia cepacia
MKAPSVYLHALGMINALGGDLDSIVPALAAGRSPGMANAHTGIGEAFVGSVLAPLELAPRAELARYDCRNNRLLLAALAQIAPAVEAARERYGAHRVGVVLGTSTSGIEAAEAAFVYQAQAGDLPANFNYRQMEIGTAAPFAAAALGLHGPAFTISTACTSSAKAFASARRLLQLQLCDAVVVGGVDSLCELTVQGFASLESTSNVRSNPMSRNRCGINVGEGAAVFLMSRDEAMVRVAGVGESSDAHHISSPDPQGVGGELALRAALADAGVESAAIGYVNLHATATRKNDEMEAHLMSRVFPGGVPTSGTKPLTGHQLGAAGATELGFAWLTLARENVPLPRHLWDGEADPALPPLDLVESERFLPQGGAQYAMSNSFAFGGSNVSLILA

SEQ ID NO: 7505 - protein, 239 aa, Burkholderia cepacia
SRRVLVTGASRGIGRAIAYKLAADGFAVSVHCRTGRSEADAVATGIAAQGGTARVLQFDVRERAVCREVLEADVAANGPYYGIVCSAGVTRDAAFPALSGEDWDVVIETGLDSFYNVVHPLTMPMVRARQGGRIVTIASVSGVMGNRGQVNYSAAKAGLIGATKALAVELATRNITVNCVAPGLIETGMLDELPLEQVLKTVPMNRVGQPAEVASVVSFLMSDAASYVTRQVIGVNGGM

SEQ ID NO: 7506 - protein, 406 aa, Burkholderia cepacia
KRVVITGMGGVTALGDSWDVIETRLRSGVNAVRRMPEWDYFESLHTRLACPLPGFTMPAHYPRKKTRSMGPVSMYSVRASELALADAGLADDATIKDGRMGVAYGSSSGSVQPIRAFGTMLETGSMSDVTSNSYVQMMPHTTAVNVSLFWDLKGRIIPTSCACASGSQAIGYAYEAIQTGKQTLMLAGGAEELSGPAVAVFDTLYATSTRNDEPHLTPRPFDAARDGLVVGEGAATLVLEEYGHAVARGARIHAEIVGFGCNSDGAHMTQPTAETMALAMQLALRDAQLAPEAIAYVNAHGTSTDRGDIAESHATAQTFGAHMPISSLKSYVGHTLGACGALEAWWTIEMMKRNWYAPTLNLTRVDPACAPLDYIAGTGRQIDAEYVMSNNFAFGGINTSLIFRRV

SEQ ID NO: 7507 - protein, 406 aa, Burkholderia cepacia
MALQRVVVTGMGIVSCLGNTLDEVASALRAGRSRIQRIDAWRERGFASQVAGVASVAHEPPFERKLERFMGDTARFACHAARNAISDAGLDAAALRSPRAGTVIGSGVGTMSTYDAAMATAHARGVDKVPPYTVPHAMSSTASANVAQVFGLEGVSYSPSSACTTSALAIGQAMQLIQTGRQQIVLAGGSESLHDNMTLMFDAMGALSRRFNDTPQRASRPYDTERDGFVIASGGGVLVLESLEYALARGARIYAELTGFGDCTDSAGMVAPRAAGIARAMRGALHEAGKRPDYVNTHAPSTPLGDTEELRALSEVFGAAFDRRVPAFSSTKGMTGHPLGACGAHEAIYTLLMMRDGFIAGTAGIDTPEPAVDGMPLVRVTREARIDTAMSVSFGFGGSCASLVFE

SEQ ID NO: 7508 - protein, 938 aa, Burkholderia cepacia
DDTDYGTPERHADIDVTLEIDGQSVTVPAGTSVMRAAVEAGVNVPKLCATDSLEPFGSCRLCLVEIEGKRGYPASCTTPVEAGMKVRTQTDRLQSLRRNVMELYISDHPLDCLTCPANGDCELQDMAGVTGLREVRYGFDGANHLKDKKDESNPYFTYDASKCIVCNRCVRACEETQGTFALTIAGRGFESRVAASENVPFMESECVSCGACVAACPTATLQEKTVIMLGQAEHSVVTTCAYCGVGCSFKAEMKGNQVVRMVPHKNGQANEGHACVKGRFAWGYATHKDRITRPMIRAKITDPWREVSWEEALTYAASEFRRIQAKHGRDSIGGITSSRCTNEETYLVQKLVRAAFGNNNVDTCARVCHSPTGYGLKTTLGESAGTQTFASVDKADVIMVIGANPTDGHPVFGSRLKRRVREGAKLIVVDPRRIDIVDTPHVKASHHLQLRPGTNVAVVNALAHVIVTEGLVNEAFVAERCETRAFEQWRDFVALPENAPEATEAATGVPAQACAKPPASMRPAATPRSYYGLGVTEHAQGSTMVMGIANLAMATGNIGREGVGVNPLRGQNNVQGSCDMGSFPHELPGYRHISDTVTRTLFEEAWNVTLQPEPGLRIPNMFDAAVHGTFKGLYCQGEDIVQSDPNTHHVSAALSAMECIVVQDIFLNETAKYAHVLLPGSSFLEKDGTFTNAERRISRVRKVMPPVPGYADWEVTVLLARALGYEMDYTHPSQIMDEIARLTPTFHGVSYKKLDELGSIQWPCNENAPDGTPTMHIDTFVRGKGKFVITKFIATPEKVTRKFPLLLTTGRILSQYNVGAQTRRTENSRWHDEDRLEIHPHDAEERGIRTDDWVGIESRAGQTVLRAKVTERMQPGVVYTTFHFPESGANVITTDSSDWATNCPEYKVTAVQVMPVEQPSQWQRDYSRFNTEQLDLLK

SEQ ID NO: 7509 - protein, 260 aa, Burkholderia cepacia; identical to SEQ ID NO: 4750

SEQ ID NO: 7510 - protein, 436 aa, Burkholderia cepacia; identical to SEQ ID NO: 4751

SEQ ID NO: 7511 - protein, 277 aa, Burkholderia cepacia
SYLVGLIGSGIGGSLTPAMHEEEGSQLGLHYVYRRIDLEALKLDIAALPDLLIAAERMGFNGLNITYPCKQAVIPLLDELSGDARALGAVNTVLFKDGKRIGHNTDWSGFARAFQRGLPDVSLERVVQLGRGRRRRGGRAAALTLGAKSLTLFDVDASRAASLARELQKRFPAAAISAGSSLAGSLTAANGLIHATPTGMAKLPGLPLPVELLHRDLWVADIVYFPIRTALLQAAESLGCRTLSGGGMAVYQAVDAMRIFTGLEPDAERVYRHFQSL

SEQ ID NO: 7512 - protein, 141 aa, Burkholderia cepacia
ASVLVLNGPNLNLLGTREPAIYGSETLDDIAKLCGDAAERLNLSIDFCQSNAEHQLIDWLHAARTKVDGIVINPAAYTHTSVAIADALSAIEKPVIEVHISNVHRREAFRHHSYVSAAADGVIVGCGTQGYVLALERMAAI

SEQ ID NO: 7513 - protein, 288 aa, Burkholderia cepacia
IWEGVLPAVTTKFNADFSIDRAWTGKNIEAQIAAGVDGIIVCGSLGEASTLSLDEKLQVLDVAVEASRGRVPVLLTIAENSTLDACRQAEAGSRHGAAGYMVLPGLRYLSDRRETLHHFRSVADASALPLMIYNNPLAYGVDMTPDMFAEIADEKKVVAIKESCGDVRRVTDLINAVGDRFAILCGVDNLAMEAILMGAHGWVAGLVCAFPRETVVIYKLLKAGRFEEARAIYRWFAPLLALDVSAKLVQNIKLAEAIVGLGTEPVRPPRLPLAGDERKAVEALIRKA

SEQ ID NO: 7514 - protein, 362 aa, Burkholderia cepacia
SAAQRDLEGGHAAQEKQWIADAGLLTLAVPREFGGLGARWPDIYETVRKIAQVDSALAHLLGFTCLQVVSVNVWGNPEQRARFLSGTVENRWWWGNAVNPLDTRLIATASGDGGYLLDGQKGFCSGTRGSQMMTVSAQDPVTGKPVFGVLPTTREGITVHEDWNPIGQRQTDSGSVSFVRVKLEPHEVMERPDTPHASLRTLISQLVLTNLFVGIAQGALDEARAYVTQHGKAWIYSGVDKATDDPYLIQRFGEMRLQAVSAEALATRAAWLLDDAWQRGAALSPETRAQVALATSEAKIVAHRAALDVSEQLFDACGARATHAPLALDRFWRNARVHTLHDPLDYRVARRRPLRAHRHVAG

SEQ ID NO: 7515 - protein, 501 aa, Burkholderia cepacia; identical to SEQ ID NO: 4756

SEQ ID NO: 7516 - protein, 483 aa, Burkholderia cepacia; identical to SEQ ID NO: 4757

SEQ ID NO: 7517 - protein, 425 aa, Burkholderia cepacia; identical to SEQ ID NO: 4758

SEQ ID NO: 7518 - protein, 397 aa, Burkholderia cepacia
VTRQTFDEVMVPVFSPAAFVPDRGLGSRVWDTQGRDYIDFAGGIAVTALGHGHPELLKVLHEQGAKLWHIGNGYTNEPVLRLAKRLEELTFADRAFFANSGAEANEAALKLARRVAFERHGADKFEIVSFTQSFHGRTFFTVSVGGQPKYSEGFGPVPAGITHLPYNDIEAAKKAIGAQTCAVIVEPVQGEGGVIPADPAFLAALREACDQHGALLIFDEVQTGVGRSGYFYAYQETGVTPDILTTAKALGNGFPIGAMLTTNELAAYFKVGVHGTTYGGNPLGAAIAEKVVELISDPKLLEGVRSLSEALKGHLAKLNDRFGLFTEVRGRGLLIGAELTDAFKGRAKDFVTAAGQHGVIMLMAGPDVLRFVPSLIMPLDDMNEGFARLASAIEGIV

SEQ ID NO: 7519 - protein, 506 aa, Burkholderia cepacia
RRGGRPRARAAAETQTGMIMSELFIGGEWAAGTGPAFASRNPGTGAAVWEGNSASADDVDRAVRSARRAFAAWSASSVDERCAVVRRFAALVTERKEALAEAIGRETGKPLWEARTEAASMAAKVEISIQAYNERTGEKRSAMADGTAVLRHRPHGVVAVFGPYNFPGHLPNGHIVPALIAGNAVVFKPSELAPGVAALTVQIWRDAGLPAGVLNLVQGEKDTGIALANHRQIDGLFFTGSSDTGTLLHKQFGGRPEIVLALEMGGNNPLVIGPVADVDAAVHHTIQSAFLSAGQRCTCARRIFVPNDAAGDRFLERFTEVTSRITVGEYNADPQPFMGAVISVRAASRLVAAQERLLADGAKALLKMEQRDPKLGFVTPAILDVTNVANRPDEEHFGPLAQIIRYGSFNEALEQANDTEFGLSAGLLADDEALWAHFQRTIRAGIVNWNRPTNGASSGAPFGGPGRSGNHRPSAYYAADYCAFPMASVESAQLQMPASVSPGLQF

SEQ ID NO: 7520 - protein, 187 aa, Burkholderia cepacia; identical to SEQ ID NO: 4761

SEQ ID NO: 7521 - protein, 215 aa, Burkholderia cepacia; identical to SEQ ID NO: 4762

SEQ ID NO: 7522 - protein, 300 aa, Burkholderia cepacia
AAIGVGVIGSGWVARALAHGLDVIAWDPAPGAEKQLRENIANAWPALQRAGLAAGASPERLRFVDTIEACVGQADFIQESAPEREELKLALHEQISRAAKPDAIIASSTSGLLPTDFYARAVNPQRCIVGHPFNPVYLLPLVEVVGGENTAPATIDAALQVYRDLSMRPLRVRKEVPGFIADRLLEALWREALHLVNEGVATTGEIDDAIRFGAGIRWSFMGTFLTYTLAGGDAGMRHFMQQFGPALELPWTKLIAPKLTDELIDRVVDGTAEQVGPRSIKQLERYRDDCITSVLAAIAE

SEQ ID NO: 7523 - protein, 479 aa, Burkholderia cepacia
LTLKDPSLLKTHAYIAGEWQGADDGSTFEVKNPATGEIIATVPRMGTAETRRAIDTANAAWPAWRATTAKQRAVILRKWHDLMMENADDLAKILTTEQGKPLAEAKGEIQYAASFLEWFAEEGKRVNGDTIPTPANDKRIVVTKEPIGVCAAITPWNFPAAMITRKVGPALAAGCPIIVKPAEATPLSALALAVLAERAGVPRGVFNVVTGEPKAIGAEMTGNPVVRKLSFTGSTPVGRLLMAQCAPTVKKVSLELGGNAPFIVFDDADLDAAVAGAIASKYRNSGQTCVCTNRFYVHDKVYDAFAEKLRVAVEQLKVGRGTEDGVTQGPLINEAAVLKVESHIEDALAKGARIVTGGKRHVLGHGFFEPTVLADVTPAMKVARDETFGPLAPLFRFSSDEEVIRLANDTEFGLASYFYSRDIGRVWRVAEALEYGMVGINTGLISNEVAPFGGVKQSGLGREGSHYGIDDYVVIKYLC

SEQ ID NO: 7524 - protein, 421 aa, Burkholderia cepacia; identical to SEQ ID NO: 4764

SEQ ID NO: 7525 - protein, 262 aa, Burkholderia cepacia
IREAIRIERLSKTFSNGRKALDEIDLRIEPGEMVALIGASGSGKSTLLRHIAGFTASDAQPSQIEILGRPIQQNGRIVREVRSIRRDIGFVFQQFNLVNRLSVETNVLIGALARLPWWRRLSGRFPRAERALSIAALNEVGIGEHARERAANLSGGQQQRAALARALVQRARIVLADEPIASLDPESSRRVMDMLRTLNIEHRLTVLVSLHQVEIAMQYCPRTIALRRGKVVYDGPSAALTPALLKTLYGDEARELIDEAAQ

SEQ ID NO: 7526 - protein, 309 aa, Burkholderia cepacia; identical to SEQ ID NO: 4766

SEQ ID NO: 7527 - protein, 173 aa, Burkholderia cepacia
VRDSGIQRTSAFPDITLDDWQQVLSTNLTAQFLTAQAPVKEFRRRGPRPASRALGKIICMSSVHEVIPWAGHVNYAASKGGVQMFMKSLAQEVAPERIRVNSIAPGAIRTPINKDAWDTDAALQKLLKLIPYRRVGESQDIGKAAVWLASDESDYVVGTTLFVDGGMTLYPGF

SEQ ID NO: 7528 - protein, 240 aa, Burkholderia cepacia
NRTVLVTGACGGIGSVLCKRFVEQGDTVLALDIDAAALNALTAQLGEAHVTPVAVDLGDAAAVQRAVAAAVEVRGPVDVLVANAGAAQGLTLATTDAASWQRDIHLNLNGTYHTVEAVRASMIERQRGVLVLIGSVNGMAALGHPAYSAAKAGLIGYTKALALELGRYGIRANIVCPGTVKTQAWQARVEKNPQVFEDLKKWYPLRDFATPDDIADAVLFLASPMARVITGVALPVDGGL

SEQ ID NO: 7529 - protein, 541 aa, Burkholderia cepacia; identical to SEQ ID NO: 4769

SEQ ID NO: 7530 - protein, 596 aa, Burkholderia cepacia
  unsure (1)..(596): unsure at all Xaa locations
YSAPIKDMLFVMKELAGLEHIATLPGFEDANLDTAQAVLEESAKLCSEVLAPLNVEGDRNPSSWKDGVVTATPGFSEAFRQFGEGGWQGVQHPVHYEGQGLPKLIATACIEMLNASNLSFALCPLLTDGAIEALLTAGSEEQKQTYVPRLISGEWTGTMNLTEPQAGSDLALVRTRAEPQGDGSFKLFGTKIFITWGEHDMAKNIAHLVLARTPNAPEGVKGISLFIVPKFLVNKDGSLGERNDVHCVSIEHKLGIKASPTAVLQFGDHGGATGHLIGEENRGLEYMFIMMNAARFAVGMQGVGVSDRAYQKAVAYAKDRVQSRPVDGSAKQPVAIIQHPDVRRMLATMRGLTEASRALAYVAAAHCDIAHRHADEATRAEHQAIYEYLVPIVKGWSTELSIDVTSLGVQVHGGMGFIEETGAAQYYRDARILPIYEGTTAIQANDLIGRKTVRDGGKVAKSLLAGVAETVEALGAQQGPAFASMKKYLAQGHRSLSAVVEFVVANTKSDPNAVFAGSVPYLKLAGIVLGGWQMARALLVAAEKRDEDPSFYGAKIATAQFYAEHVLPLASALEASIVSAKGGESVLALSEDQFXW

SEQ ID NO: 7531 - protein, 392 aa, Burkholderia cepacia
REVVVVSGVRTAIGKFGGSLKDVAPTELGALVVREVLARAGVAGDKVGQVVFGNVIATEPKDFYLARVAALNGGVGQTTPAFNVNRLCGSGLQAIVSAAQSILLGDADIAIGGGVENMSRAPYIAPDARFGARMGDARLIDMMLGALSDPFHTVPMGVTAENVAKKYGITREQQDALAVESHRRAAHAIAEGRFKDQILPVTRTVKGRPVVFDTDEHVRLQLDPAEISGLRPVFQKENGTVTAGNASGINDAAAAVLLMSREAADASGVKPLARLVSYAHAGVDPLYMGIGPVPATRLALQRAGLGIGDLDVIEANEAFAAQACAVAQELEFDPRKVNPNGSGISLGHPIGATGALITVKALYELQRIKGRYALVTMCIGGGQGIAAIFENL

SEQ ID NO: 7532 - protein, 280 aa, Burkholderia cepacia; identical to SEQ ID NO: 4772

SEQ ID NO: 7533 - protein, 627 aa, Burkholderia cepacia; identical to SEQ ID NO: 4773

SEQ ID NO: 7534 - protein, 780 aa, Burkholderia cepacia
DLLANLNPEQHAAVTLPNEPALILAGAGSGKTRVLITRIAWLIQHGLASPATILAVTFTNKAAREMMSRLSALLPIDTRGMWIGTFHGLCNRMLRAHHRDAGLPATFQILDTADQLSAIKRLMKGLNIDDEKYPAKNLQYFINNAKEQGLRPKDVDATDNFNRKFVELYEAYDQQCQREGVVDFPELLLRCYELLAHNPPLRAHYQARFRHILVDEFQDTNKLQYAWLKLLAGEANSIFAVGDDDQSIYAFRGANVGNMRDFEHEFNVRHLIKLEQNYRSHGHILDAANQLIANNSRRLGKNLRTDAGHGEPVRVYESATDSQEAGWIVEEIKALISTGTSRSEIAILYRSNAQSRTIEHTLVNAGIAYRVYGGLRFFERQEVKHALAYLRLIDNPNDDTAFARVVNFPTRGIGARSIEQLADAARQYNCSMAAAIPYVAGKAGSSLAGFANLIGKMRAETQQMSLPETVEYVVRASGLSEFYQNEREGQDRLENLQELVNAAAAFVSEEGYGMDTPARSIPLRPGATAAPELAVATDDPNTIVFDAPGIADPAQNPDTMTPLAGFLSHASLEAGDNQAQAGQEAVQLMTVHAAKGLEFTAVFITGLEEGLFPHENSAMESDGLEEERRLMYVAITRAKERLYLSFAQSRMLHGQTRYNIRSRFFDELPQETLKWLTPKIEPGARWGGRSDNAGYGRDWFARPGYTGAASSTPAPLPAFANEQRAAETGFRVGQQVFHTKFGEGTITALEGGGTDAKAQVKFKRHGEKWLALAVAKLQAV

SEQ ID NO: 7535 - protein, 284 aa, Burkholderia cepacia
KVTKAVFPVAGLGTRFLPATKASPKEMLPIVDKPLIQYAVEEAMAAGITEMIFVTGRSKRAIEDHFDKSYEIEAELQARGKDKLLELVRSIKPSHVDCFYVRQPEALGLGHAVLCAEKLVGDNPFAVILADDLLYGTPPVMAQMIEVFDHYHSSVIGVEEIPAQETKSYGIVDGKEWEDSIIKMSGIVEKPEPNVAPSNLGVVGRYVLKPRIFEHLRALKPGAGGELQLTDAIQSLLADEQVLAYKYHGTRFDCGSKLGYLKATVEFALRHPEVAADFEEYLRT

SEQ ID NO: 7536 - protein, 331 aa, Burkholderia cepacia
FAPGRSRDIVCLGRLAVDLYAQQVGARLEDVSSFAKYLGGSSANIAFGCARLGLASSMLARVGNDHMGRFLTETLTKEGCDVSHVRIDRERLTALVLLGLKDRDTFPLIFYRENCADMAVDEADFDEAFIASSKALLITGTHFSTEQVNRTSRRALDYARRNQVRTVLDIDYRPVLWGLTGKADGETRFVASEGVTAHLQRILPLFDLVIGTEEEFRIAGGKTELVDALAMVRAVTPATLVLKRGPLGCQIIDGQVPASLDNVPIHGGVEVEVLNVLGAGDAFASGFLSGWLRDQPLEACARAANASGALVVSRHGCAPAMPTPAELDYFL

SEQ ID NO: 7537 - protein, 382 aa, Burkholderia cepacia; identical to SEQ ID NO: 4777

SEQ ID NO: 7538 - protein, 556 aa, Burkholderia cepacia
SNFIRNIIDEDNRTGKWGQRVETRFPPEPNGYLHIGHAKSICLNFGVARSYGGVCHLRFDDTNPEKESVEYVDSIIDAVRWLGFEWEKDGKEQLYYASDYYDKLYEFAELLIQRGKAYVDSQSAEEMRANRGSATEVGTPSPFRERSVQENLDLFRRMKAGEFKEGEHVLRAKIDMSSPNFNMRDPVIYRIRFAHHYRTGDKWCVYPMYDYTHCISDALENITHSLCTLEFEDHRPLYDWILNELAEAGIFTRPLPQQIEFSRLNLTYAITSKRKLLQLVTEGHVDGWDDPRMPTIVGVRRRGFTPESIQLFCERIGITKVDSWIDMSVFEGALRDDLDEKAPRTAAVLDPVKLIIDNFPEGVTEPCNAPVHPHHPEMGVREFPISRELWIERDDYNETPPKGYFRLFPGNKVRLRYGYVIECIGADKDENGNIVAVHCNYFPDSKSGTEGANNYKVKGNIHWVSAAAACPAEVRIYDRLFKEPQPDAGGRDFLEALNPDSKRVVNAYLEPGAREALPEQRYQFERHGYFVADRVDSKPGKPVFNRIVSLRDSWGK

SEQ ID NO: 7539 - protein, 374 aa, Burkholderia cepacia; identical to SEQ ID NO: 4779
  unsure (1)..(374): unsure at all Xaa locations

SEQ ID NO: 7540 - protein, 242 aa, Burkholderia cepacia; identical to SEQ ID NO: 4780

SEQ ID NO: 7541 - protein, 478 aa, Burkholderia cepacia
MFLGIDLGTTELKVLLLSSDGSVVGTARHSLEISRPRHRWSEQDPDDWWRATRIALSTLRNSHPDAFARVQAIGMSGQMHGAVLLGANDEPLRSAILWNDMRSASECAELEARAPRLREIAGNCAMPGLTAPKLLWLARHEPECFRRVSCVVLPKDYVRLRLTGIKLTDASDASGTLWLDVGRRQWSDELLHACDMTQMQVPRIVEGCQATGVVLASVASELGLSPNVLVAAGGGDTATSALGVGATEPGEGFLSLGTSGVLSVVTERFRPSPELGLHALCHAIPDRWHRTSVVLSAASCIRWLCKLTSADETALLAEVEGVSASGRTKAPLFLPYLSGERTPHNDPYAQGVFCGLNQSTDRATLAYSVIEGVTFALSDGLDALRTDGTQETLVNLIGGGARSTFWAQLLVDVLGIVLRRPFDTHYIAALGAARLGWLAAGGDFPVVVRTQSLSQEFFPDDERRQILSERLASYRFLY

SEQ ID NO: 7542 - protein, 605 aa, Burkholderia cepacia; identical to SEQ ID NO: 4782

SEQ ID NO: 7543 - protein, 461 aa, Burkholderia cepacia; identical to SEQ ID NO: 4783

SEQ ID NO: 7544 - protein, 524 aa, Burkholderia cepacia; identical to SEQ ID NO: 4784

SEQ ID NO: 7545 - protein, 460 aa, Burkholderia cepacia
ALEALLRDQRHAYLRAPYPSWETRAAHLKALRKVMLDNRDALADAMNVDFGNRAKQEVLLAEFLLVKEEIDAALRHGKRWMKSQRRSTSKWLLPARAKVVPQPLGVVGIIVPWNYPVLLAVGPLISALTAGNRAIIKMSELTPRTSALFEQLIGQTFARDHVAVVNGDAALAAAFSAQPFDHLLFTGSTRVGHEVMRAAAEHLTPVTLELGGKSPAIIGAHARFDNAVDNLVAGKTLNAGQTCVAPDYVLVPRGKEQAFVERARARMARMYPNFANNPDYTTIISARHFARLERLADEAQAAGAQLHPLTDSSPDAASRRFPLIAVTNAPDACALMQEEIFGPLLPIVPYDTLDDAIAWINARPRPLALYLYADDAATIGRVTHETIAGGMAVNETLMHLACESLPFGGVGASGMGAYHGYEGFVTFSKMKPVLTQARLNARGWISPPYGKRVNALLKLM

SEQ ID NO: 7546 - protein, 439 aa, Burkholderia cepacia
RNAIARPMRACGRLTRAAGLVLEAVGLRLSVGAEVMIELPQGSSLPMAEAEVVGFSGDKLFLMPTTEVMGLLPGARVFPLESAPIADPMAGAKRLPVGWELLGRVLDASGRPLDGLGPLGAHADAPLSAPVINPLNREPIHKVLDVGVRAINALLTVGRGQRMGLFAGSGVGKSVLLGTMARYTSAEVIVIGLIGERGREVKEFIEQILGEEGLARSVVIAAPADVSPLLRMQAASYSTSLAEYFRDQGKHVLLLMDSLTRYAMAQREIALAVGEPPATKGYPPSVFAKLPALVERTGNGPAGGGSITAFYTVLTEGDDQQDPIADSARAILDGHIVLSRSLAEAGHYPAIDIEASISRAMTALIDDNHLEKTRMFKQMLSRYQRNRDLINVGAYSSGRDALLDRAIALYPRMEAFLQQGFRECANFEPSLEMLDALFA

SEQ ID NO: 7547 - protein, 271 aa, Burkholderia cepacia; identical to SEQ ID NO: 4787

SEQ ID NO: 7548 - protein, 226 aa, Burkholderia cepacia; identical to SEQ ID NO: 4788

SEQ ID NO: 7549 - protein, 259 aa, Burkholderia cepacia
MDLGIDGRRAIVCASSRGLGKACALALAREGCEVFINGRDEARLGQAAREIEQASGRRPTPVVADLDSDAGRAALLAACPQPDILVNNNAGPAPGELEQWDHAAWLAALEANLLAPILLMSAVVPGMRTRKFGRVVNITSAVVKSPRLGMSLSTTARTGLTAFAKGLSREAVADNVTINNLLPQHIDTDRQEYMARRIMEDRGITFAQARSLQVKSVRARRLGRPEEFGDACAFLCSAQASFISGQNLQLDGGSYDGLF

SEQ ID NO: 7550 - protein, 247 aa, Burkholderia cepacia; identical to SEQ ID NO: 4790

SEQ ID NO: 7551 - protein, 506 aa, Burkholderia cepacia
VIAALDRAVAAHPDRVLLDFSGDLYTYAQVDGLSTRLANSLAELGVTAGQTVVTMLDNNLDAVITWLAINKLCAVSVPINTALRGEFLRHQLDDASARLVICEGDYVERIAAIADQLKEATRVLHRGATTSGNAARSRSRLSTSTAAATTRRLSRKPNPWDLASLIYTSGTTGPSKGCMISYNFMCNLARQQLRAGPATANDITITPLPLFHMNALAVGVLSNILVGARVAIVPRFSVSKFWSEVERSGATIASILGGMGGLLANAPDDEAAKRCYGQIHTVRGNPFTEATKQIWRERFGARQVGGNGYGLTEACVITSLPAGEYAAPGSSGKRIPEFDVRIVDELDRELPANQAGEIVCRPLHPDVMFMGYWHRPEDTLKLMRNLWFHTGDIGKFDDDGFFYFVDRKKDYLRRRGENISSFEMESAFSRHPDIAEVAVHAVPSDKGEDDVKVTAVLNPDAALTAEALFHWATDAVPYYALPRYIEFRDTLPKNPQGRILKYQLRD

SEQ ID NO: 7552 - protein, 278 aa, Burkholderia cepacia; identical to SEQ ID NO: 4792

SEQ ID NO: 7553 - protein, 386 aa, Burkholderia cepacia; identical to SEQ ID NO: 4793

SEQ ID NO: 7554 - protein, 379 aa, Burkholderia cepacia; identical to SEQ ID NO: 4794

SEQ ID NO: 7555 - protein, 263 aa, Burkholderia cepacia; identical to SEQ ID NO: 4795

SEQ ID NO: 7556 - protein, 252 aa, Burkholderia cepacia; identical to SEQ ID NO: 4796

SEQ ID NO: 7557 - protein, 348 aa, Burkholderia cepacia; identical to SEQ ID NO: 4798

SEQ ID NO: 7558 - protein, 253 aa, Burkholderia cepacia; identical to SEQ ID NO: 4799

SEQ ID NO: 7559 - protein, 263 aa, Burkholderia cepacia
  unsure (1)..(263): unsure at all Xaa locations
MNPIEDKVVMITGASSGIGEATARRLAQQGAKLVLAARRSERLSRLAAQLGGADRVLWDATDVTKPEALQQLAATARERFGHLDVLVNNAGIMPVSLIAQGRVDDWNRMIDVNIKGVLYGIHAVLGAMLERGVGHIINISSVAGLSVGPGGAVYSATKFAVRAISEGLRQECAGKVRVTSICPGLVASELPDSITVPAFRERAQKLFEGAMPADAVADAIVYALTQPEQVAVNEIVVRPLTQSFXAPARAAANACTGRVIDTT

SEQ ID NO: 7560 - protein, 512 aa, Burkholderia cepacia; identical to SEQ ID NO: 4801

SEQ ID NO: 7561 - protein, 251 aa, Burkholderia cepacia; identical to SEQ ID NO: 4802

SEQ ID NO: 7562 - protein, 252 aa, Burkholderia cepacia; identical to SEQ ID NO: 4803

SEQ ID NO: 7563 - protein, 448 aa, Burkholderia cepacia
YRTRRERVLAALRAAGGGVAIVPTAPEALRNRDADYPYRHDSYFYYLTGFTEPEALLVLDASAAPGEPASVLFCREKNVERETWEGFRFGPDGARAAFGFDAAFAIGEIDTQLPRLLADKPSLHYALGTSPQLDERVRGWLDAVRAQARGGVAAPAAAHDLIPLLDDMRLIKDDHELAIMRRAGQISAEAHRRAMAACRPGMREYELEAELLYTFRKFGAQAPAYTSIVAAGANACVLHYPAGNAIARDGDLILIDAACELDGYASDITRTFPASGRFTPAQRELYDIVLAAQQAAIDATRAGATFDDPHQAAVRVLSQGLLDTGIIERAKFASVDDVIAERAYVPFYMHRTGHWLGMDVHDVGDYRERGAPRDEAGALPWRTLQASMTLTIEPGLYIRPTEGVPERYWNIGIRIEDDAIVTPDGCELITRGVPVAADEIEALMLEAR

SEQ ID NO: 7564 - protein, 188 aa, Burkholderia cepacia
MIDHLICDCDGVLVDSEIIADRVMLETLSATFPGLDFEPVVKTAFGQQTSRFLESIEKSFDITLPANFFDTIEHNVELALAASLSPINGVRDALQRVTLPAAVVSNSRMTRVNASVRRAGLQQIFGERIFSAEQVARPKPYPDVYLFAAKTLGVEPSRCVVVEDSVAGLNAARAAGMKTIAFVGASHI

SEQ ID NO: 7565 - protein, 474 aa, Burkholderia cepacia; identical to SEQ ID NO: 4806

SEQ ID NO: 7566 - protein, 477 aa, Burkholderia cepacia
DLLVVGGGINGAGIARDAAGRGLSVLLCEQDDLAAHTSSASTKLIHGGLRYLEYREFGLVRKALQERETLLRAAPHIMWPLRFVMPHMPDLRPAWLIRAGLFLYDHLAKRELLPGSRGIVMRNHPAGAPLVDSIKRGFVYSDGWVNDARLVVLNALDAKERGAKILTRTKLLSAVRAGGEWRAQLKREDGTILDVRAASIANAAGPWVGELLQGALGRAASHSVRLVKGSHIVTRRLFEHDHAYIFQNPDKRIIFAIPYEHDYTLIGTTDLEYRGDPSQVAINAEETQYLCDSINRYFKQKISPADVRWTYSGVRPLLEEEGADNPSAVTRDYSLELDAPAGEAPLLSVFGGKITTFRKLAEEAVDQLAHALHHDTSSWTAGAPLPGGDIPGANFERFLSEFRQQHAWLPAGLAHRLARAYGTRVEHVIGNARSVAELGRAFAPGLYEAELTYLRDTEWARSAQDVLWRRSKLGLHV

SEQ ID NO: 7567 - protein, 450 aa, Burkholderia cepacia; identical to SEQ ID NO: 4808

SEQ ID NO: 7568 - protein, 711 aa, Burkholderia cepacia
MTSLDRRTFLRSAAGAAALGLFPPAIRRALAIPANNTTGTINDVQHVVIFMQENRSFDHYFGTLPGVRGFSDRFTIPQPGGTTVFQQNDGTRTVLPFHLDSTQGNALLAGGPHSWSDAHQAWDSGRMTQWPKAKGDVSMGYLNQADVPFHVALANAFTICDAYHCSLHGGTNSNRIFLWTGTNGASAGANPVVNNDGWDGLGASATGLTWTTYPERLQAAGVSWKVYQNMPDNYTDNSLAGFATYRKVNETLPGSPLLPYTQSLEAVAPLYKGIGNTMPDGGFLQALKDDIAAGQMPQVSWIVSPQAYCEHPGASTPGQGAYYLQLLLDTLTANPDVWSKTVLFVNYDENDCFFDHMPPPDAPSKNADGTFAGKSTVDTQYEYFTKTNPPGDSSPIVPDGQCFGPGPRVPMFVVSPWSTGGWVNSQVFDHTSVLRFLEQRFGVTETNISPWRRAVCGDLTSAFNFRNPNDVPPASLPAAPSKAQADAQNTQQSALGAVPVPSAASQQMPQQVLMSRPSRALPYLLHVSANADVQDGLIWLVFSNTGTAGAVFHVYDQLHLDRVPRRYTVEAGKELSDSWSALADDQGNYSLWVLGPNGFHRSFQGNVATVATGPNPEVRVCYDVVNNAVYLTIMNTGNAVANVTVTSNAYRGDGPWTYAVPAGMQVEPYWSTGAVGGWYDFTLSAAGGFSRRFAGRIETGKDSVSDPAMGV

SEQ ID NO: 7569 - protein, 383 aa, Burkholderia cepacia; identical to SEQ ID NO: 4810

SEQ ID NO: 7570 - protein, 302 aa, Burkholderia cepacia; identical to SEQ ID NO: 4811
  unsure (1)..(302): unsure at all Xaa locations

SEQ ID NO: 7571 - protein, 400 aa, Burkholderia cepacia; identical to SEQ ID NO: 4812

SEQ ID NO: 7572 - protein, 478 aa, Burkholderia cepacia
TRRLMHRATKIVATIGPASNTPEILLQMIQAGLDVVRLNFSHGTADDHRQRAGFVREAARQAGREVAIMADLQGPKIRVGKFENGKIMLVAGEPFVLDADCELGNEQRAGLDYKDLPRDLKPGDVLLLNDGLIVLNVSRVIGNEIHTVVKIGGELSNNKGINRQGGGLSAPALTAKDMEDIRTAMSLGVDYVAVSFPKNATDMEMARQLANIAGAPFGVKPKMIAKIERAEAIPALQGILDASDGIMVARGDLAVEVGNAAVPALQKRMIRMARESNKFVITATQMMESMIHAPVPTRAEVSDVANAVLDGTDAVMLSAESAAGKYPVQTIETMAAICIEAEKSEQSELDKDFLDRTFTRIDQSIAMGALFTAFHLGAKAIVALTESGSTALWMSRHWTHVPIFALTPRVGSERAMALYRNVTSLHLDTNTDRDTALQQALETVVSKGYASRGDMVVLTVGEPMGQAGGTNTLKIVRV

SEQ ID NO: 7573 - protein, 290 aa, Burkholderia cepacia; identical to SEQ ID NO: 4814

SEQ ID NO: 7574 - protein, 254 aa, Burkholderia cepacia
PTRVRLDITSPDACRRAIEIARPDYIVHLAAISFVGHNDPLDFYRVNVIGTLNLLEACAAVGHTPRKLLIASSANVYGNVTSEAIDESFPVTPVNHYAASKAAMETMVRTWFDRLPILIVRPFNYTGRGQASNFLVPKIVGHFARREASIELGNIDVARDFSDVRYVASAYEALLDSEAAAETVNVCTGTPFTLREILAAASDLTGHELEIQINPAFVRQTDVKMLAGSPARLRTLVPTVEAIPFMDTLRWMLA

SEQ ID NO: 7575 - protein, 317 aa, Burkholderia cepacia; identical to SEQ ID NO: 4816
  unsure (1)..(317): unsure at all Xaa locations

SEQ ID NO: 7576 - protein, 760 aa, Burkholderia cepacia; identical to SEQ ID NO: 4817

SEQ ID NO: 7577 - protein, 362 aa, Burkholderia cepacia; identical to SEQ ID NO: 4818

SEQ ID NO: 7578 - protein, 947 aa, Burkholderia cepacia
RVRRRAGEKIAGSRRRRARREPPRTAAAAVAAVAASATRAARPASRRAQSIPPITYPEALPVSGRREEIARAIVQNQVVIVCGETGSGKTTQLPKICLELGRGLGAGGSGLIGHTQPRRIAASATGRRIAEELGTPFGEVVGYKVRFTDNLSPGASVKLMTDGILLAETQTDPLLKAYDTLIIDEAHERSLNIDFLLGYLKEILVKRPDLKLIVTSATIDADRFARHFGSEDKPAPVIEVSGRLYPVEVRYRPVAEDSPAVKAAQGDGPAAQRGGDRPKTQRETDRDLMEAIVDAVDELCREGPGDVLVFLPGEREIRDAAEALRKHHPPHTEILPLFARLSAAEQERVFRTSNARRIVLATNVAETSLTVPGIRYVVDTGLARVKRYSYRNKVEQLQVESISQAAANQRAGRCGRVADGICIRLYEESDYQGRVRFTDPEILRSSLASVILRMKSLHLTAIETFPFIEPPPGRAIADGYQLLNELGAVDDDNQLTPLGRELARLPLDPRVGRMILAARDQQALKEVLIIASALSVQDPRDRPIEAQEQADQAHRRFADERSEFLQWLKIWNWFEEAITHKKSNRQLHEECRKNFLSQLRLREWRDVHSQLLTVVREHGWRLNEAEATFEQIHLALLTGLLGNIGLKADDEPYYLGARGIKFYLWPGSALVKKAGKWVMAAELVETSRLYARCIAKIEPEWIEKIGPHLLKKSLSEPHWEKRAAQVSAFERAVLYGLPIYHRRRVSFGKQDPARARELFIRGALVEGEFDTKLAFFAHNRKLLADIEQLEHKSRRQDVLVDDELIFAYYDQALPKGIYTGASFERWYRDEVKKSGQPEDRLRLLYLSRDDLMRHEAAGVTTDLFPKRMTMAGVDMALTYHFEPGSPRDGVTLGVPLYALNQVDARRCEWLVPGMLKEKTQLLLKSLPQKLRRHCVPVPEYAAGFVDR

SEQ ID NO: 7579 - protein, 437 aa, Burkholderia cepacia; identical to SEQ ID NO: 4820

SEQ ID NO: 7580 - protein, 804 aa, Burkholderia cepacia; identical to SEQ ID NO: 4821

SEQ ID NO: 7581 - protein, 459 aa, Burkholderia cepacia; identical to SEQ ID NO: 4822

SEQ ID NO: 7582 - protein, 249 aa, Burkholderia cepacia; identical to SEQ ID NO: 4823

SEQ ID NO: 7583 - protein, 497 aa, Burkholderia cepacia
LTLVPGQVTLGQLRRIIEARPMVQIERASLERVEKSKDIVSRIVADGKIVYGVNTGFGRLANTTIPAGRIAELQKNLVLSHSVGTGELMEDRVVGLIMALKAISLARGHSGVRPQVVLAIISMLNAGVYPCIPSKGSVGASGDLAPLAHLAAAMLGVGHVRIDGKRVPAAEGLSVAGLEALKLGPKEGLALLNGTQASTALALSGLFAAERVFASAMVTGALSLEAVKGSTVPFDPRIHVARGQRGQIDVAGRLAALLDGSGIIASHGNGTRVQDPYSIRCQPQVMGACLDHIRYVAGILTIEANAASDNPLVFDNGDVLSGGNFHAEPVALAADALAVAISEIGAISERRTALLLDSHMSGLPAFLVKESGINSGFMIAQVTSAALASENKSLAHPASVDSLPTSANQEDHVSMATFAARRLKDMADNTAVIVGIEGMAAAQGMDFHRPLRSSELLEEQHVQIRARVSFYTKDRYLADDIETMKNWALESSRPGIV

SEQ ID NO: 7584 - protein, 338 aa, Burkholderia cepacia; identical to SEQ ID NO: 4825

SEQ ID NO: 7585 - protein, 697 aa, Burkholderia cepacia
AAKNAQASGPQSDPKAKDLEQFRVSPEGEALRTNQGVKISDNQNTLRAGPRGPSLLEDFIMREKITHFDHERIPERIVHARGSAAHGVFQVYESMQEYTKAAFLQDPAVQTPVYVRFSTVQGPRGSADTVRDVRGFAVKFYTQEGNYDLVGNNMPVFFIQDAIKFPDFVHAVKPEAPNEMPTGGSAHDTFWDFVSLVPESAHMVLWTMSDRAIPRSLRTMEGFGIHTFRFVNAQGKGRFVKFHWRPVLGSYSLLWDEAQKLAGKDPDFHRRDLWESIERGDFPEFELGVQIIEEADEHKFDFDLLDPTKLIPEEQVPVKIIGKMTLNRNPDNFFAETEQVAFHPGHVVPGIDFSNDPLLQGRLFSYTDTQISRLGGPNFHEIPINRPVCPFNNNQRDAMHRQTINVGQASYEPNSLSGGWPKETDPAPSDGGFETYQERVEGTKIRVRSESFADHFSQAALFYNSMSPPEKDHIAAAYQFELGKVTKPEIRARVVNEILANFDAGLAAQVAEGLGLPAPKKGTAKLTGPKESPALSLLNRVKPGIKTRKIALLAAPGSDGAAIKKLQQALQGEGATPMLIAPTLAAIDGMAPDATIAGLPSIMFDAVIVVGGDQGAKALAQSGDARHFVLEAFKHLKAIAAIGAGRDVLAAAHLPHNADGVATGDDKQAAEVLKAFIEAAGQHRVWSRAQQAETVPA

SEQ ID NO: 7586 - protein, 396 aa, Burkholderia cepacia; identical to SEQ ID NO: 4827

SEQ ID NO: 7587 - protein, 755 aa, Burkholderia cepacia
MARTHIPGFPRIGAQRELKFAQESFWRGESGEPHLRGVARELRARHWQLQQDAGLDFVTVGDFAYYDQMLNLSALLGALPQRFGFEPKTLSLAEYYELARGNAAQPAMEMTKWFDTNYHYLVPELGPQTSFDGGVEWLFEEIDEALALNLPVKPVLIGPITYLWLSKSHVAGFDRLSLLPKLVIRYARLLDKLRQSGIEWVQLDEPALCVDLPAEWLDAFSAAYEVLGTSGVKVLLATYFESAAEHAPRVAALPVAGVHLDLVRAPQQLDAWRAALPAHAVLSAGVIDGRNIWRADLGEIVESLQSLQAEFGERLWIAPSCSLLHVPVSLDAEKKLDADLKSWLAFATEKLAEVATLALALRDPAAAEPALAATDRALEARRRSSAVVNALVQKRVAAVSSAMAERQSPFAERNRLQREALGLPLLPTTTIGSFPQTAAIRQARAAYKRGELRALDYLQRMRTEIEIAVRKQEELGLDVLVHGEAERNDMVEYFGEQLWGYAFTENGWVQSYGSRCVKPPIIYGDVYRPEPMTVETTRYAQSLTQRLMKGMLTGPVTMLQWSFVRDDQPRSTTALQLALAIRDEVVDLEKAGIRIIQIDEPAFREGLPLRRADWAAYLEWATRAFRISAAGVADQTQIHTHMCYSEFNDILPSIAAMDADVITIETSRSAMELLDGFGAFAYPNEIGPGVYDIHSPRVPGADAMQRLLERACEVIPAERLWVNPDCGLKTRGWPETEAALANMVRAAKALRAKLA

SEQ ID NO: 7588 - protein, 209 aa, Burkholderia cepacia
ETLKLYHSASSPNSRRVRIFLAEKGVPVTLVAVDLGKGEQHGDTYRAINPRRVVPTLVLEDGTSIGEVPAIQRYVEETHPDAPLFGTTPKDKALITMWERRAEQEGFASVMEAIRNIAPGLKGRAIAGPHDYEQIPALAERSRQRAANFLADLDDRLKDSAFVAGERYSVADITALVTIDFAAKAIDLQVPADLESLKRWYDTVSSRPS

SEQ ID NO: 7589 - protein, 246 aa, Burkholderia cepacia
LKMSHPVILITGALTGIGRATAIAFAEIGARLVVSGRREAEGKAFEKELRELGADAHFIQADVRRDEEVASLVDQTVARFGRIDAVNNAGTEGQPGAITSQTVESYSATFDTNVLGTLLSMKHELRVMSAQKSGSVVNVSSTYGHEGAAFASVYAGSKHAVEGMTRSAALEVASTGVRVNAVAPGPTDTGMLDRFTGTPENKAALAAQVPLGRIGKPDDVARAIVFLASDAASFVTGQIVTVDGGK

SEQ ID NO: 7590 - protein, 484 aa, Burkholderia cepacia
LNVLLVASEALPLAKSGGLGDMVSAYAAALRDAGVDVSILMPAYPAALERAVDVTPVARMTGLPGGDARLLRGHMPDTGVPVLLLQMDHLFAREGLYRDPQGRDYLDNLTRFASLAAAAARVARGVRNVKRPDIVHAHDWHAGLTPLYLRLAGVAARSVFTIHNLAFQGNHPLAMGGWIGVPPELLAPALSDERSIEFYGSLSMMKAGIVHADRVTTVSRRYAREILTPRFGHGMEGVLQAQAAKLSGIVNGIDSAVWNPATDKHIARPYSVDDTAGKQACKRDLQQAFGLTRDPFAPLVAIGSRLTEQKLADVVVHTLPALLERHPRLQFAILGQGEQGIEQALQGIAAAWPGRVGVQIGYDERRAHMLHAGADILLHGSRFEPCGLTQLYAMRYGTIPVASRVGGLADTIVDYLPHDPRGDRKATGFLFDGETPDDVMHALGRALDAFVEPSSWHVLQRNAMSRDFGWATSTSNYLSLYAEL

SEQ ID NO: 7591 - protein, 336 aa, Burkholderia cepacia; identical to SEQ ID NO: 4832
  unsure (1)..(336): unsure at all Xaa locations

SEQ ID NO: 7592 - protein, 299 aa, Burkholderia cepacia; identical to SEQ ID NO: 4833

SEQ ID NO: 7593 - protein, 246 aa, Burkholderia cepacia
RLSGKRIIITGAIGNIGKEAARGFIAEGARVVIGDIAEEAGRAVAAELGAAAHFVQVDVTSEASVANLIARGVEWLGGLDALAQNAGLQRSGAIAGFEQANWDALFAVNARAHFFGAKHAIPHLQRSGKGSIINMSSLAGKRGGPGLVAYSASKGAVIAFTTALALELAPDNIRVNAICPGWVDTAFNQPAIDFMGGADAQQKKIASLVPLGRQASATEIAPLFVYLASDESAYVTAQSFGIDGGV

SEQ ID NO: 7594 - protein, 472 aa, Burkholderia cepacia
MNHYDVVVIGCGAGGYNTAIRASQLGLSVACVERASNIGGTGMRTGCIPSRLLLHTSEIYDLANKGKNAALGIGCAPTLDLTQMMAYKASTVEKMSNSIHKLLRKQGVTLIHGDALLAAAGQVIVRKTGGVQQTLSGTALVIATGSVPIPLPFAAFDHMRILDSADALSLGKVPRHLAIIGAGAVGVELGSIWQRLGSRITLIERCDRICHWLDRDVTATLERSLRQRGIDIRVSSDVVGLDKHSDSVSVQLRAAASGKITHIDADRVLVAIGRRPSTAGMNLASVGMQTGYKSTLSQQGPATPVTSMTNGSGIWVIGDAGPGPMLMSKAEEEAIACAERIAGLPGFVSYPSIPYVLHTSPEVAMIGRTEDELRGTGAAYRVGYYPLAANPRAAICGTSEGFVKLLVDADTNLIAGAHLIGPGAADLISQVAIAMEASMICEDFARICHPYPVWSEALRQAAMAAGGWMMHV

SEQ ID NO: 7595 - protein, 300 aa, Burkholderia cepacia
GRVLVVGSINTDLVARAPHLPRPGETIGGHEFSQVAGGKGANQAVAAARIGARVAMIGCVGSDANGAQRVKDLEVEGIDCSGVEVHPTQPTGVAMVTVSDDGQNTIVVVAGSNGELTPQSVARHEAAIKACDVVVCQLETPWDSVHATLALARRLGKITVLNPAPATGPLPAEWLPLVDYLVPNEVEAAILAGLPVESQSGARRAATELQQGGAHNVIVTLGAQGAYLLVEGGEGRHFPAPQVHAVDTTAAGDTFIGVFAAQLASRQPLEGAINLAQRAAAISVTRAGAQPSIPTRAEVD

SEQ ID NO: 7596 - protein, 484 aa, Burkholderia cepacia
DAPPVLCVHGIGKTYAEPVLADVSLELRAGEVLALTGENGAGKSTLSKIVGGLVTPTTGSMTLGGAAYAPASRKDAEALGVRMVMQELNLLPTLSVAENLFLNRLPRNLVGWIDRARLRENARHAMAQVGLDAIDPDTLVGTLGIGHQQMVEIARNLIGDCRVLILDEPTAMLTAREVDLLFEQVERLKAHGVALVYISHRLEELKRIARRAAVLRDGRLVHVDEMANLSTDRLVTLMVGRDIGDRIDLGERRIGEVAFKVSGMTREPVVRDVSFEVRAGEIFGISGLIGAGRTELMRLIYGADHADAGSVSLGRGGAAPEPVTIASPSDAVQHGIALITEDRKGEGLLLTQPIAANISLGHLRAVSNKGVVDGRREAALARRQIDAMRIRSAGPSQPVSELSGGNQQKVVIGRWLARDCTVLLFDEPTRGIDVGAKFDIYALMGALAREGRALVVVSSDLRELMAICDRIGVMSAGRMTGLFE

SEQ ID NO: 7597 - protein, 172 aa, Burkholderia cepacia
MTTQTETALLAGGCFWGMQDLLRRYPGVLSTRVGYTGGDVPNATYRNHGTHAEALEVVFDPRQISYRQILEFFFQIHDPTTKNRQGNDVGTSYRSAIFYLDDEQKRVAENTVADVEASDLWPGKVVTEIAPAGPFWEAEPEHQDYLERIPNGYTCHFVRPRLEAAEARLKMK

SEQ ID NO: 7598 - protein, 153 aa, Burkholderia cepacia
YKLMDSPVGQLKLVANGERLAAILWQNDKPNRVRLGELIEANDRPVLIDTERQLNEYFAGTRREFDLPLAFQGTEFQKQVWAALLTIPFGQTRSYAEIAVQIGNVNAVRAAGAANGRNPISIVAPCHRVIGASGDLTGFAGGLANKMFLLSLE

SEQ ID NO: 7599 - protein, 254 aa, Burkholderia cepacia; identical to SEQ ID NO: 4840

SEQ ID NO: 7600 - protein, 322 aa, Burkholderia cepacia; identical to SEQ ID NO: 4841

SEQ ID NO: 7601 - protein, 480 aa, Burkholderia cepacia
PCTLVIFGAGGDLTKRLLMPALYNLAVDSLLDDGMKIIGVNHGARETSEWRDDLHKSLEQFAADKASTFHAGKLDDQAWDWVAQRLEYMAGEFETDDTFAQIKQKLEQTPGGNVIFYLAVSSRFFEPIVERLGNAGLLKEGDVGGFRRLVIEKPFGSDLASARDLNAHILSFAKETQVYRIDHFLGKDTVQSILAVRFANALFEPIWRREYIDSVQITASETIGVEGRGKFYEQTGAFRDMVPNHLFQLLGMVAMEPPNSFDAEAVRDRKAEIFDAIKPLTPDDVVFGQYEKGPAGVGYREEPDVAPDSTTETYAAARVFVENWRWAGVPFYLRTGKRLAGRRTEISVQLKPVPFRLFRDTPVDALTPNVLTLRIDPAHGTSFDFNVKTPGPVMQIGAVQSSFDYGDFFAERANVGYETLLYDCMLGDETLFQRADSIETSWCAVDDVLHPESGGAMPVHGYPAGSEGPAEADALLARGG

SEQ ID NO: 7602 - protein, 516 aa, Burkholderia cepacia
GTLGGPLLDNNDFVDGDGPPNYQLLSWTTYPERLQAAGISWQVYQQGLTGSDPLNGNYGTNILQNFTNFINAQPGSPLYERAQTVRTIDDLKADVLANKLPQVSWLCPPAAYSEHPSYTPAYGAEYTSQILDALTSNPEVWSKTVLFIMYDENDGFFDHLVPPQPATTAAQGQSTVSTEGEIHNVVNPLRGGSYTADGLPYGLGPRVPMTIVSPWSKGGFVCSQVFDHTSVIRFIEARFGVYEPNITAWRRAVCGDLTTAFDFRTPDSKVPPLPDTSNYKSIADNQCATQPKPTVPATPGAIDPQESGIRFARALPYELHVNGHADAKKNTFELSIGNTGDQGAHFYVYSTNRTDGPWRYTVEAGKSLSETFDLTVTSGAYTFEVFGPNGFVRKFAGNTQQPKAHNAPFGGGHGNNKPAEPEVKVQYDVANGNVFLKFSNKGGGIARLTVTDNAYGARPRPVLVPAGAQIEEAWVLASSHHWYDLTVTSNDDASFSRRLAGHVENGRPSISDPAAV

SEQ ID NO: 7603 - protein, 549 aa, Burkholderia cepacia; identical to SEQ ID NO: 4844

SEQ ID NO: 7604 - protein, 418 aa, Burkholderia cepacia
GLATFFDGFDVIAIAATLPILIAKWHLTPWEIGFLIGSGSVGQLIGAFVFPWYAERGGRVKAIALSSGIIGITSIACGFAPTFAAFVVLRVIQGLGLGGELPVAATYINEISRAHGRGRFVLLYEIVFPVGLLASNALGAWIVPRFGWQAMYFIGGMPLILFFVLRKLVPESPRWLAERERMADADTAVHAFERAVKGPLPPVTHSAEFEAMANRHPKRRMSDLFGPAYLKRTLAVAMLWITCGFIQYGLSTWLPTIYRTIYHAPLQLALNLAVAASVLGVVGSLTCALLVDKVGRKPIINLSFVACALSLLLAGVFHDSSVYVVATFCAFSLGFLACGFITAYVYTPELYPTSIRAMGCGVGGAWLKVAAIFAPAIVSKTMIGGNLQVAFYILAAVPFLAAVTVHFLGIETKGKVLE

SEQ ID NO: 7605 - protein, 486 aa, Burkholderia cepacia
FDTSLVPTGDIFIGGEWRQGRGNPYTSLYPADQSVNMEISTANADDARDAVEAADIAWRRADWSGLKPHQRALILYRIADLIMARHEALAQLQRRDNGKPIGETRVLVASAANTFRYFAACLETLDEEVTPSRGDYLTMSIYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAADKLMPVSLELGGKSPTIVFDDADLDHAVNGVLYGIFSSSGEACIAGSRLFVQRSIYDTFMKRLADGARKLRVGDPSRSETQMGPLITAAHRETVERYVALGLEEGGRLLCGGERPVGDGREAGTYFQPTILEGLTNNARICQEEIFGPVLVAMPFDDEASLLKEANNSVFGLAAGIWTRDYKRAYRIARALEAGTIWINTYKLFSISTPFSGWKESGMGREKGRLGIREYMQQKSLYWGLND

SEQ ID NO: 7606 - protein, 263 aa, Burkholderia cepacia
IQIDLTGQVAVVTGGSSGIGLATAELFLRAGASVAICGRDTERLAQAEAALKAQFPQAQLLARRCNVLDADDVKAFAEAVQSRFGRTGMLINNAGQGRVSTFADTTDEAWREELDLKYFSVIRPTRAFLPMLRDASASNSNAAIVCVNSLLALQPEPHMVATSSARAGVQNLLKSLAVELAPQRIRVNSILIGIVESGQWRRRYAKEAQPGQSWEDWTAELARKKNIPLGRFGRPEEAAQALFYLATTLSSYTTGSHIDVSGG

SEQ ID NO: 7607 - protein, 245 aa, Burkholderia cepacia; identical to SEQ ID NO: 4848

SEQ ID NO: 7608 - protein, 590 aa, Burkholderia cepacia
IAFLPCVTHAAGIVADGGTATTVVSAANGGQTVNIAPAVSGVSQNTYSSFNVGVAGATLNNVGINARTIVNQVTSSNPSLIEGQISVTGSRANVILANPNGITVNGGSFVNTGHVALTTGQVSFDDLQIAPGIFQRNVVLNTTGGAIVIGPQGLSSALVDLDLIAKTIQINGPVANTFTSATAITRAVAGTSAVTLNTGLSPSDNANDWLTLQTGQPLATANSFALDITAAGSVTSGRVEIIVTDKGPGVRSAGPLDASLGDFTLSSNGSVQISNTTVTANGNINFQVQDGISLTDTRVTSGTATLDASGAITLTGSSILTNGGATLSANGITLTPDSAQTGSTLASATAGVVLDSTADITNLGSLIQGQAATSGDAQSLGAVTLDASGNILNQSLPGTPLGILFGVKGDVVVSAGGNIVNQNARILSNENVTIAAGGDVDNIIDHTSGVDNGVASSYSSDGWSFLFLEHHSSGISVNYGELSDPTALSYITADAGNVTITGNNINNVGGSILSNDGAISITARNSLLDQGVFTGQAQFHESCFIFCHSSASSDVQLYGGDIEAGTSISLKAGTQILNTGGTVLAEGALT

SEQ ID NO: 7609 - protein, 402 aa, Burkholderia cepacia
QVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRTLSRGELERVTRRYTSEIGIIIGPNTDIPAPDVNTNEQIMAWMMDTYSMNQGQTATGVVTGKPITLGGSLGRREATGRGVFVVASEAARRIGVDIEGARIAVQGFGNVGGIAARLFQEAGSKLVAVQDHTGSLYKSTGIDAVALLEHVAKHGGVGGFPEADAVSNEEFWTVESDILIPAALENQITEKNAAKIRTKIVVEGANGPTTTAADDILHDRGILVIPDVVANAGGVTVSYFEWVQDFSSFFWTEDEINQRLERVMREAFAAVWQVSSEQKVSVRTAAFIVACKRILEARELRGLY

SEQ ID NO: 7610 - protein, 153 aa, Burkholderia cepacia; identical to SEQ ID NO: 4851

SEQ ID NO: 7611 - protein, 426 aa, Burkholderia cepacia
TRISMDIDQYMTDLGRRARQASRAMARASTAAKNAALAAVAEAIERDAASLKEANARDVAKAREKGHDAAFIDRLTLSDKALKTMVEGLRQVAALADPIGEISNLKYRPSGIQVGQMRVPLGVIGIIYESRPNVTIDAAALCLKSGNATILRGGSEALECNTALAKLIGEGLEAAGLPQDAVQVVATSDRAAVGKLITMTEYVDVIVPRGGKSLIERLMNEARVPMIKHLDGICHVYVDDRADLTKALTVCDNAKTHRYGTCNTMETLLVARGIAAEVLPPLGKLYRDKQVELRVDAAARAVLADAGVGPLGDATEEDWRTEYLAPVLAIKVVDDLDAAIEHINEYSSQHTDAIVTEDHDRAMRFLREVDSASVMVNASTRFADGFEFGLGAEIGISNDKLHARGPVGLEGLTSLKYVVLGHGEGR

SEQ ID NO: 7612 - protein, 263 aa, Burkholderia cepacia; identical to SEQ ID NO: 4853

SEQ ID NO: 7613 - protein, 418 aa, Burkholderia cepacia; identical to SEQ ID NO: 4854

SEQ ID NO: 7614 - protein, 336 aa, Burkholderia cepacia
MTIRVAINGYGRIGRNTLRAFYENGKKHDIEIVAINDLGDARTNAHLTQYDTAHGKFPGEVSVDGDYLVVNGDKIRVLANRNPAELPWGELNVDVVMECTGFFTTKEKASAHIKGGAKKVIISAPGGKDVDATIVYGVNHHVLKASDTVISNASCTTNCLAPLVKPLNDKIGLVNGLMTTIHAYTNDQVLTDVYHEDLRRARSATHSQIPTKTGAASAVGLVLPELNGKLDGYAIRVPTINVSIVDLSFIAARDTTVEEVNAIMKEASEGSLKGILGYNQAPLVSIDFNHNPASSTFDATLTKVSGRLVKVSSWYDNEWGFSNRMLDTAVALAHAK

SEQ ID NO: 7615 - protein, 661 aa, Burkholderia cepacia
MANAIRALSMDAVQKANSGHPGMPMGMAEIGVALWSRHLRHNPKNPQWADRDRFVLSNGHGSMLLYSLLHLTGYDLPIEELKNFRQMHSKTPGHPEYGITPGVETTTGPLGQGLANAVGMALAESLLATEFNKPDATIVDHHTYVFVGDGCLMEGISHEACSLAGVLKLNKLIAFYDDNGISIDGEVVHWFHDDTPKRFEAYGWNVIPNVVGHDVEAVDAAIKQAKQSDKPTLICCKTVIGEGSPNKAGSHDSHGAALGDKEVAATREKIGWKWEPFVIPQEVYAAWDATEAGARNESEWDKAFAAYAAKYPQEAAEFKRRNAKQLPADWKEKAKAIIAGANERAETVATRKASQQAIEALSAVLPELLGGSADLTGSNLTNWKAAKPVRVNAEGKAAGNYVNYGVREFGMSAAINGVALHGGFKAFGGTFLTFSDYSRNALRVAALMKAPSIFVFTHDSIGLGEDGPTHQSIEHVASLRLIPHLQVWRPADTVETAVAWTHAVEHHGPSCLIFSRQNLPFSERTDAQIANIEKGGYVLRDWNDEIVARKIILIATGSEVELALNAVEPLAREGIAARVVSMPSTTVFDKQDAEYRERVLPQGVRRVAIEAGVTDFWRKYVGLEGGVVGIDTFGESAPAGVLFKHFGFTVEHVVETAKAAL

SEQ ID NO: 7616 - protein, 275 aa, Burkholderia cepacia; identical to SEQ ID NO: 4857

SEQ ID NO: 7617 - protein, 289 aa, Burkholderia cepacia
FRGIISYPVTPFDLHDGSVDVPTLNRLIDRLVDSGSHGIAPLGSTGESAYLSDDEWDTVAEASVRRVAKRLPVIVGISDLTTRNAVRRAKFAESVGADAVMVLPVSYWKLNEAEIFRHYATIAEAISVPIMVYNNPATSGIDMQPELIVKLAREIDNVTMIKESTGDIQRMHRIAQLSDGRVPFFNGSNPLALGAFAAGAAGWCTAAPNLVPQWPVKLYEACEKGDMELARAVFYRLLPFLQCIMKGGLPTTVKAGLALRGFSVGAPRRPLQPLAEPAVRELAAVLGGL

SEQ ID NO: 7618 - protein, 213 aa, Burkholderia cepacia
SFGGYLALPKGGKGPAVIIIQEIFGVNSHIRSVADQYAQDGYIALAPDVFWRVQPRVELTYEGADREKGIELMQKTNVDQAVADIGAAAAALRAMPEVTGKIAAIGYCFGGRLAYLAAAQGTLDAAVAYYGGGIQNQLDEAAKIKVPMQFHYGELDAHIPVSAIGQIQERFAGRTDAEFHIYPNADHGFNCSDRASYNQRAAALAHGRTLTFL

SEQ ID NO: 7619 - protein, 461 aa, Burkholderia cepacia; identical to SEQ ID NO: 4860

SEQ ID NO: 7620 - protein, 426 aa, Burkholderia cepacia
EDLGVLRFITAGSVDDGKSTLIGRLLYDSKAVLSDQLSALSRAKNKRTVGDEIDLSLLTDGLEAEREQGITIDVAYRYFATAKRKFIIADTPGHEQYTRNMVTGASTAHAAIILVDATRVTFVDGVAQLLPQTKRHSAIVKLLGLQHAIVAINKMDLVDYSEQRFNEIRDAYVELARQLGLNDVRFVPVSALKGDNIVTASESMPWYAGEPLLDLLEALPVEVPTGQALRFPVQWVARQDGSQADDFRGYMGRVEAGEVKLGDTIVVLPANREATVAEIIAPVPGGTAAVDRAFAGQTVTIRLAEDVDVSRGDTFVLREAAPEPAKKLEADLCWFDDTPLSTQRKYLLKQTTNTVFARIGAIKEVLDVHTLSQATDRKELTMNDIGRVALTLQKPLVCDVYDSHQGTGAFVLIDEATHHTVAAGMI

SEQ ID NO: 7621 - protein, 553 aa, Burkholderia cepacia; identical to SEQ ID NO: 4862

SEQ ID NO: 7622 - protein, 452 aa, Burkholderia cepacia; identical to SEQ ID NO: 4863

SEQ ID NO: 7623 - protein, 308 aa, Burkholderia cepacia
MQPIVSVTNLSKTYASGFHALKNINLAINRGEIFALLGPNGAGKTTLISIICGIVNASEGSVTVDGRDIATDYRAARSLIGLVPQELTTDAFETVWATVSFSRGLFGKPKNPAYVEKVLRDLSLWEKRDSKIITLSGGMKRRVLIAKALSHEPRVLFLDEPTAGVDVELRRDMWKLVRSLAQSGVTIILTTHYIDEAEEMADRIGVINAGEIMLVEEKTELMRKLGKKQLTLQLESPLAQVPVSLGGYGLAVAKGGNELIYTYESEGGRTDIIALLKALDDAGIRFKDLQTTQSSLEDIFVSLLRGDQ

SEQ ID NO: 7624 - protein, 474 aa, Burkholderia cepacia; identical to SEQ ID NO: 4865

SEQ ID NO: 7625 - protein, 411 aa, Burkholderia cepacia; identical to SEQ ID NO: 4866

SEQ ID NO: 7626 - protein, 257 aa, Burkholderia cepacia
LRIATFNINGIRSRLPALLQWLEREAPDIVCLQELKAADSAFPVEQLRDAGYGAIWQGQSAWNGVAILSKGEAPLESRRGLPGFEDDTHSRYLEAAVGGIVVACLYLPNGNPQPGPKFDYKLAWFDHLIRHAAKLYRSGHPVVLAGDFNVVPTDEDIYNPRSWLKDALLQPESRERYRQLLAQGWTDALRTRFGNERVYTFWDYFRRHWETNSGLRIDHLLLSADLAPRLRDAGVDRWVRGEPHASDHAPTWVELEM

SEQ ID NO: 7627 - protein, 260 aa, Burkholderia cepacia
TTRRRVVTGTGIKKVALVTGAGSGIGRACALKMLEHGYSVVLAGRRQAPLDAVVEEAQHLGGDALAVACDVTDAGSVAALFDTIRERRGRLDVLFNNAGRSGSPVDIDELDIDEWRSVVDTNLTGVFLCTRAAFGLMKTQSPRGGRIINNGSISAHAPRPHSIAYTATKHAITGLTKAVSLDGRKYDIVCGQIDIGNAATEMAERMARGVPQANGEIAVEPLMDVQHVADAVLHMAELPLTANVQFMTIMASKMPFIGRG

SEQ ID NO: 7628 - protein, 468 aa, Burkholderia cepacia; identical to SEQ ID NO: 4868

SEQ ID NO: 7629 - protein, 803 aa, Burkholderia cepacia; identical to SEQ ID NO: 4869

SEQ ID NO: 7630 - protein, 213 aa, Burkholderia cepacia
IETAPNPEFAVILLHGLGADANDFVPLVPELRLANGPAVRFVFPNAPEIAVTANNGYVMRAWYDIRSFQSIERQVDEAGIEASCATVRQLIAGQNARGIPTTRIFLAGFSQGGAMTYSAGLTHPATLGGLIVMSGYLPSRAFIESRLAPANHGTPIFAAHGEYDQVLPIQLGEAARDFALAQGSKVEWHAYAMEHSVCGEEVAALRAWLGARI

SEQ ID NO: 7631 - protein, 312 aa, Burkholderia cepacia
  unsure (1)..(312): unsure at all Xaa locations
KVTKAVFPVAGLGTRFLPATKASPKEMLPIVDKPLIQYAVEEAIAAGITEMIFVTGRSKRAIEDHFDKSYEIEAELEARNKQKLLDLVRSIKPANVDCFYVRQAEALGLGHAVLCAEKLVGDSPFAVILADDLLHSSKPVMSQLVDTFNHYHSSVIGVETIAREDSRSYGVVDGREWEDNVIKLSGIVEKPAPDKAPSNLGVVGRYVLMPTIFKHIRALKPGAGGELQLTDAVQSLLTEEQVLAYRYFGTRFDCGSKLGYLKATVEFALRHPEVKAEFEAYLQAYMQTNMQEGVPAQYAAEAAXVARYFESW

SEQ ID NO: 7632 - protein, 499 aa, Burkholderia cepacia; identical to SEQ ID NO: 4872

SEQ ID NO: 7633 - protein, 737 aa, Burkholderia cepacia
STSVKTVCPYCGVGCGMVLHVEDGQVVKISGDKEHPANFGRLCTKGQSAHVALRKSGRLEGAFVRHARGRDPAPLPMTQAISATAARLRGLLDEHGPDALSFYVSGQMSIEAQYLVNKLAKGFVGTNNIESNSRLCMASAGSGYKLSLGADGPPGSYEDIDHADLFFVIGANMADCHPILFLRMMDRVKAGAKLIVVDPRRNTTAEKADLFMQIKPGTDLALLNGLLHLLHENGHTDAAFIAEATEGWEAMPAFLADYTPEKAAQITGLAVEDIRAAAQMIGSANEWISCWTMGLNQSTHGTWHTNAICNLHLATGKICRRGSGPFSLTGQPNAMGGREMGYMGPGLPGQRSVLVEEDRAFIEDLWRIPKGTLKPEAGNGTIDMFTRMAAGEIKACWIICTNPVASVANRQNAIDGLRAAQLVIAQDAFLDTETNRYADVLLPGALWAEAEGVMINSERNLTLMQKGVEPPGAALPDWQIIARIACEMGYAEGFTYASAEEVFAEITRVSNPKTGYDLRGASHRRLKETPLQWPLASDESAERNPVRYLNDGVSQTLKELADGSRPRLVFPTASCKAVFFARAYAAPAELPDREFPIVLNTGRLQHQWHTMTKTGKVAMLNKLNPAPFVEIHPEDATTLGIKAQDPVEIRSRRGRAVLPAVVTERVSAGSCFAPMHWNDVFGDDLCINAVTSDAVDPISQQPELKFCAVALSPVAADSRQPLLTDDDATITDASVAV

SEQ ID NO: 7634 - protein, 592 aa, Burkholderia cepacia; identical to SEQ ID NO: 4874

SEQ ID NO: 7635 - protein, 308 aa, Burkholderia cepacia
TVMGFGAAPIGNIFRPVSEEDSAALIKAAWDAGVRYFDTAPMYGHGLSEVRCGQGLRWYPRDQYVLSTKVGRLLKPRRRAEIDFAPWVDGLPFEPVFDYSYDGTMRSIEDSLQRLALEHIDIALIHDIDVFTHGERQPEMFEAAMAGASKALLKLRDEGVVKAVGLGVNEWQVAHEAIRRQDFDCLLLAGRYTLLEQDALDGFLPLCEKKQVSVILGGGYNSGILATGAVPGAKYNYAPAPEAILERVRKMEQVCREFSVPLKAASLQFVLGHPAIPTNIPGVRTVAQLEDNLQTFRAEIPAEFWAEL

SEQ ID NO: 7636 - protein, 178 aa, Burkholderia cepacia; identical to SEQ ID NO: 4877

SEQ ID NO: 7637 - protein, 792 aa, Burkholderia cepacia; identical to SEQ ID NO: 4878

SEQ ID NO: 7638 - protein, 869 aa, Burkholderia cepacia
APPEQRAWHAETAESTIERFGTDATRGLDTAEAARRRAVYGRNEIIETERRRIITMLIEQFKDFMILVLLAAAIVSGLVGDLEDALVIVTIVVLNGTIGFFQDFRAEHAMAELKRLAAFHASVVRDGHPLTIAAAEVVPGDIVLLEAGGAVPADLRVIEAPQLRVSEATLTGEAAPVDKHPQPLTGDATLPIADRTNMVYKGTVVTYGRARGVAVATGMNTELGKIAALLESAPALQTPLQQRLSRFGKQLAIAILAICALIFVFGVSSGEPPILMLLTALSLAVAAIPEALPAVVTMMLALGARSMAQRAALVRRLPAVETLGSVSFICTDKTGTLTLNAMRVVEVCPAGTQRLQTANMGVDDITGQLLRAVSLCNDATYDASGKLAGDPTEVALWEVAADAGIDRSALDRSMPRCTEMPFDSVRKRMTTVHRAEDSFIAYTKGAPETVIERCTSVVGQDGTPFDTTTLTSMAGAMAADGLRVLAVAMRRWPQKPPADTDELECDLTLLGFIGMLDPPRPEAAGAVALCRQAGITVVMITGDHPITALAIARSVGIASDEAQVMTGYTLGKLSDEALLEATQRIRVYARVDPSQKIRIVKAMQSTGHYVAMTGDGVNDAPALAAANIGVAMGKVGTDVAREAASVVLLDDNFATIVAAVREGRRVYDNVRKFIRYVLTGNLAELCAIALAPLFGLPIPLLPIQILWINLLTDGLPGLALAAEPAEPTIMQRPPRPPDDSLFAHGLWQYIVRIGIAIAAVTMGTQWFAMGLDDAHWRTMTFTVLALSQMGHVLAIRSGQTSIFTQGLLSNRPLAAAVALTVVLQLAAIYVPVLNNILDTAPLSAPELGFCILVSALIFVLVETEKWIIR

SEQ ID NO: 7639 - protein, 287 aa, Burkholderia cepacia; identical to SEQ ID NO: 4881

SEQ ID NO: 7640 - protein, 309 aa, Burkholderia cepacia
QLLSVDQFSRDSVEALFRVADIMQPIARRRKISRVLEGAVLGNLFFEASTRTRVSFGAAFCRLGGSVCDTTGFTFSSMAKGESIYDTSRVMSGYVDALVIRHPEQGSVAEFARATNVPVINGGDGPGEHPSQALLDLYTIQREFSRLGKIVDGAHIALVGDLKYGRTVHSLVKLLALYRGIKFTLISPPMLEMPGYIIEQISRNDHVIEQTHDLSTGLRGADVVYATRIQKERFTDESFEGYTPDFQINQALVDSVCGVDTLIMHPLPRDSRPGANDLSVDLNHDSRLAIFRQTDNGIPVRMAIFAVLL

SEQ ID NO: 7641 - protein, 463 aa, Burkholderia cepacia
MSTDCLQELENALGRAALVRDEDRALYDVDWRGHLHGRSLAVVCPSRVEDVGETIRIARRHQISIVPQGGNTGLAGGATPDSTGRQLVLCTRRLNRIRGVDLLGNFITVDAGCILQNVQDAAQSHDRLFPLSLAAQGSCTIGGNLATNAGGNAVLRYGNMRELCVGIEAVDAQGRLIGDLKCVRKNNTGYSLRDLLIGSEGTLGIITGAALRLFPRPFAYATALVKCADIDHALQVLGILRAHCADFLSGVEWMSNGSLSNVSKQFLDTRIPPGFDESCLCLVELSGSTPPGLLDDILASALDQAITSGFAADAALASNLAERDAFWALRERLPLAEARCRSLKHDVSLPAGNMSEFVAHLEGYLSSMTLRCAWAGFGHLGDGNLHANVLIPDTMPDALCDCIDEFVYSEVLRLEGSISAEHGIGSRKNDLLHRALDVASLQAMQAVRNALDPHNLFNPGKLL

SEQ ID NO: 7642 - protein, 267 aa, Burkholderia cepacia; identical to SEQ ID NO: 4884

SEQ ID NO: 7643 - protein, 280 aa, Burkholderia cepacia; identical to SEQ ID NO: 4885

SEQ ID NO: 7644 - protein, 450 aa, Burkholderia cepacia
IDGRDEQAADGATFETLDPGTGEHLATVAAMGPADVDRAVDAARRAFARSGWATMHPNDRAIWLHRLADEVERRKAIIGQIEALDAGKIEQQAQGDVQSFVDTLRYFNELALNTERRSALPVSGYEAWTTRQPWGACGFIVPWNFPMVLIGWNISPALAAGNTVVIKPAEDTPLSAIYLARLAREIGFPDGVINVVTGLGEIAGAALSRHPGLRRMSFTGSPEVGRMVAEACGRNLVPCKLELGGKGAAVIFDDVNIEETADKLARAITFHTGQVCCDATRWLVHESIFERFVDASVAALQRTKIGYQLDPGAEMGPVVSAKQRERVLGYLERGQRDGARAVLKGGAVDVAGHDGFYVSPALLAGSLENVAAREEIFGPVAFLAPFRDEAQAVELANDTDYGLANSVWSHDPRRASRVAEAMVAGNSWINAHNLFPLGVPYAGVNRSGMG

SEQ ID NO: 7645 - protein, 246 aa, Burkholderia cepacia
LELRGRTALVTGASTGIGTGIARALASEGVRLAITARRDALLEEVAASIVAEGGVRPIVIVGDLTAPGHIERILAQATDALGQIDILVNNAGASRPAPLDSGEDVWEEAFALNFTAARRMTHAVLPAMRSRKWGRVINISGSMEPRGLNPSGPAKAALHLWAKSLSREIAADGITINTIPPGRIHSEQIEKRLHPTEESKQAFIARNVPIGYFGDPLDIGYLAAFLASPRARYITGDVIPVDGGMH

SEQ ID NO: 7646 - protein, 400 aa, Burkholderia cepacia
MTEAFLCDAIRTPIGRYAGALSSVRADDLGAVPLKALMERNKEVDWNAIDDVIYGCANQAGEDNRNVARMSLLLAGLPQGVPGTTVNRLCGSGMDAVGIAARAIKSGEAALMVAGGVESMSRAPFVTGKATSAFSRQAEIYDTTIGWRFVNPLMKKLYGVDSMPETGENVATDYNISRADQDAFALRSQQKAARAQRDGTLAQEIVGVTIAQKKGDPVTVSQDEHPRETSLDALAKLKGVVRPDGTVTAGNASGVNDGAAALLLANEETARRFGLTPRARVLGIATAGVAPRVMGIGPAPATQKLLARLNMSLDQFDVIELNEAFASQGIAVLRALGVADDDTRVNPNGGAIALGHPLGMSGARLVTTAMYQLHRTQGRFALCTMCIGVGQGIAIAIERV

SEQ ID NO: 7647 - protein, 302 aa, Burkholderia cepacia; identical to SEQ ID NO: 4889

SEQ ID NO: 7648 - protein, 255 aa, Burkholderia cepacia; identical to SEQ ID NO: 4890

SEQ ID NO: 7649 - protein, 309 aa, Burkholderia cepacia
TRIPIIDLAGVRAGDPQALQRVAQEIREACTTIGFFYIVNHGVPQALIDAAAQAARRFFAFPVETKRRAAVNHRHRGFNALGDATMYQAKRPDYKEFFSIGLELPEDDPDVLAGQALRGPNNWPDFMPELRPALYGYYEAVGACGADLLRAVAVSLGVEEQFFAPRYTKRMQRTQMVYYPPQPPQSDEDQFGVAPHTDYGCITLLWQDQVGGLQVREIANDTWVDAPPVEGSFVVNVGDLLARWTNDRFRSTLHRVINASGRERYSIATFYDPTYGARVDPRDLGTNETDLKYQPVAAGDYILGRINDS

SEQ ID NO: 7650 - protein, 454 aa, Burkholderia cepacia
ETLDALRAALGEDSVRVGEQISERAMTDWTRHEPTRPAALLLPRTTEQVSRALAICHAAHQPVVPQGGMTGLAGGAIARATDIALSLERLDGVEEVDAASATLTVRAGTTLQAAQEAAAEAGFELALDLGARGSCQIGGNLATNAGGNRVIQSGTARDQVLGLEVVLANGDVLTSLGKMVKNNTGYDLKHWFIGSEGTLGVITRAVLRLHPPRAARHTALVALDGYDAAVNLLRRLSTRFGNDIGAFEIMWPDFYDFGVKLTGTRSPFADAHPLYALIEHASFDSDDDGERFSAALTEALEAGAIRDAVIAQSVADVRALWAIRECTAEFPVRLDAINFDVSLPIGAIGAFVDRCRAALDQRWPGNASYFFGHIGDSNLHVTVDGHSIPGVNHHAVYAFVYDMLGPLHGSVSAEHGIGLLKREFLPISRSPAELAAMAAIKHALDPHGILNPGK

SEQ ID NO: 7651 - protein, 565 aa, Burkholderia cepacia
  unsure (1)..(565): unsure at all Xaa locations
IQSHYDVVVVGSGYGGAIAACRMARAGRRVCVLERGREFMAGEFPRTPFQGAAQVQYNTAAAHIGSPLALLEVHVNEDVNAVVGCGLGGTSLINANVALEADPRLWDDARWPAALRADKAARDKGYALARAMLQPSPVPKDYPVLPKLQALEKSAQALGMEDRFTRPDITVTFEDRVNAAGVAQKACVGCGDCNSGCNYDAKNSTHMNYLPDAVAHGAQIFTGTAVHSVRRDATTRKWIVGYQLVSLGRESYGAPDLFVSADIVIVSAGTIGSTALLLRSRNQGLSVSGMLGKHFTGNGDVLAFAYNTEPVINGVGWGSHEPGDIPPVGPTHYRPHRSSQYGQRQGWLCDRRRLAGRSGGRGAGRPARRRRAARRRGCRAAFAPGTDRLRRPHVRELSARPLSRRAQSHAKLPRHGAXRRRRPDRRGRHRQPRIVWENAGKQPIFQVVEEALKQATVPLGGKYLRNPISTDIIGNRTVTVHPLGGCGMGEDAEHGVVDHMGRVFSGATGNAVHDGLYVMDGAVMPMSLGVNPLLTISALAERNCECCWPRIPXPPPRPTARPPRR

SEQ ID NO: 7652 - protein, 523 aa, Burkholderia cepacia; identical to SEQ ID NO: 4894

SEQ ID NO: 7653 - protein, 442 aa, Burkholderia cepacia; identical to SEQ ID NO: 4895

SEQ ID NO: 7654 - protein, 302 aa, Burkholderia cepacia; identical to SEQ ID NO: 4896

SEQ ID NO: 7655 - protein, 297 aa, Burkholderia cepacia
RVEVAGQAPASVGESPVWRIAEQALYWVDIPAQKIVRLRIDSGERSEWRMPEKVACIAFDHRGTVLAGCETGLFAVTLAGATATGEAVQVTGRKLAAPDFACDDMRFNDGRCDRQGRFWSGTMVQDMAAARPAGALYRFDARGVLSAPVVDGLITQNGLAWSPDGATMYLSDSHPLRRQIWAFDYDGETGEPRNRRVFADLNHHAGRPDGAAVDADGCYWICANDAGLLLRFTPLGKLDRQIAVPAIKPAMCAFGGRDLDTLFVTSIRPAANASEHDGHLFAVRPGVTGLPEPEFAG

SEQ ID NO: 7656 - protein, 208 aa, Burkholderia cepacia; identical to SEQ ID NO: 4898

SEQ ID NO: 7657 - protein, 483 aa, Burkholderia cepacia
PDLPLDMIIFGGTGDLSFRKLLPALYMAHLHCNLPPDTRILTIGRKPWSREEYINEFMEQKAKPFIEKKAFDAAAWDKFLALFEYVRMDVDSVEDYQRLKEASREGVRRVFYLATSPDLFTNICDNLAAAGLVDGNSRVVLEKPLGHDLASAQEINTAVGKHFSEAQIYRIDHYLGKETVQNLMVLRFGNPIFGPLWQAPYIKSVQITVAETVGVGSRAGFYDKTGALRDMVQNHLLQLLCIVAMEPPVSLDPDAVRDEKLKVLRSLRPMTPEDIARDTVRGQYTAGAVDGEAVKGYLEEDNVPAGSRAETFVALRAHINNWRWAHVPFFLRTGKRMQKKVSEIVIEFSELPFSIIPNGNSGRNYGNRLVIQLQPEESIQLQVLAKEPGSGMHMLPVNLNLDLQQAFTERRAEAYERLLIDVIRGRLTHFMRRDELEAAWAWAEPILAGWSKSGEKPRGYTAGTFGPAASTALMARENAVWAE

SEQ ID NO: 7658 - protein, 170 aa, Burkholderia cepacia
IKSHIRTVPDWPEPGVQFRDITPLLQEPKSLRVLIDLFVQRYIDAKLDYIAGLDARGFIIGPILAYELNLGFIPIRKAGKLPYNRLAQSYELEYGCATVEIHEDACKPGDRVVIIDDLIATGGTMMAGKILLERLGAVVVEGAAIIDLPELGGSKLLRDSGLALYTVTGF

SEQ ID NO: 7659 - protein, 406 aa, Burkholderia cepacia; identical to SEQ ID NO: 4901

SEQ ID NO: 7660 - protein, 241 aa, Burkholderia cepacia; identical to SEQ ID NO: 4902

SEQ ID NO: 7661 - protein, 448 aa, Burkholderia cepacia
ASVSARLDRLPPTRYFSGLVARIAIGGWFEFYEMFMAAYISLGLISSGLYRATTAGLFDVDGFASFLGSFFAGMFVGTVALGGFTDRFGRRAVFTCAMLIYSVATFAAAFQHSPQAMDLWRFVAGLGIGVQLITVDTYISELTPHHTRGRYSAFSILVILTSVPTVAVLSFLLVPHTILGLEGWRWVMIIGSAGAVLIWFMRRGLPESPRWLESKGRLDEARAIVDAIEARVVAETGRALQAPAQRAPQPLTGEHGGSWSEMWKGRYLSRTIMLSFFNFFQTFGVYGFGAWVPVLLYTKGITITHSLLYTMVIAFATPLGALGAMACAERIQRKWQLVGCAIVVAVAGVLFGMVREPLLILLFGSAVTIANNWLIGIFHTYQAELYPTRIRARAVGFVFSWSRLSSIFVGFWVAALLKHSGVPAVFVLISSAMFVIVVMVGLLGPKTN

SEQ ID NO: 7662 - protein, 437 aa, Burkholderia cepacia; identical to SEQ ID NO: 4904

SEQ ID NO: 7663 - protein, 369 aa, Burkholderia cepacia
ILDMLDRFLETEVRPYVHKFDHDDIYPAEIVEKMKEMGLFGCIIDPEYGGLGLSTRTYAQIIARISRVWMSVSGIINSHLILAMLVQRNGTPEQKSKYLPKFATGEWRGGIGLTEPDCGTDLQAIRTTAKRVGDEYVVNGNKTWITNSKHGNTLALLVKTDTTAQPRHRGMSLLLVQKGPGFEVSRQLEKLGYKGIDTCELSFNGYHVSTDALIGGVEGKGLQQILGGLELGRINVAARGVGVAQAALDESVSYSQQRKTFGKPICEHQAIQLKLGEMATRVEAGRLLVDAAAQKYDRGERCDMEAGMAKYFATEAALENSIEAMRIHGAYGYSKEYNVERLYRDAPLLTIGEGTNEMQRIIIAKQLIE

SEQ ID NO: 7664 - protein, 536 aa, Burkholderia cepacia
  unsure (1)..(536): unsure at all Xaa locations
SPGTTMRFLRFLKIFFTVIRFGLDEMMLSRVNDRRVRLLLRITTIGRKFDAPPGVRLRLALESLGPIFVKFGQVLSTRRDLLPVDIANELAKLQDQVPPFDSAVAIGLVEKSLGAPVDVLFDDFERVPVASASIAQVHFATVKAGQHAGKAVAVKVLRPNMLPVIDSDLALLRDIAVWAERLWADGKRLKPREVVAEFDKYLHDELDLMREAANGSQLRRNFAGLDLLLVPEMYWEFCTPTVLVMERMVGVPISQVETLRAAGVDIPKLAREGVEIFFTQVFRDGFFHADMHPGNIQVSLDPAHFGRYIALDFGIIGALSDFDKNYLAQNFLAFFKRDYHRVATLHLESGWVPPTTRVEELESAIRAVCEPYFDRALKDISLGQVLMRLFSTSRRFNVEIQPQLVLLQKTMLNVEGLGRSLDPELDLWKTAKPYLERWMNEQIGLRGWYERLKIEAPQWSKTLPQLPRLIHHALAERHDHTRGANDEMIRQILLEQKRTNRLLQGLLLFGVAVGVGAALARVFLALAYGGXMQSPG

SEQ ID NO: 7665 - protein, 393 aa, Burkholderia cepacia; identical to SEQ ID NO: 4907

SEQ ID NO: 7666 - protein, 495 aa, Burkholderia cepacia; identical to SEQ ID NO: 4908

SEQ ID NO: 7667 - protein, 493 aa, Burkholderia cepacia
IRSVGIVGSGAMGRGIAQIAALAGLNVHLYDIRQDAVEAARHHLRDTFATLATKGKIAVNAATDAVARIRSATSVDALKNCDLVIEAIAENLDAKRDLFTRLDAVVREDCILASNTSSLSITAISTACSKPSRVAGFHFFNPVPLMKVAEVIDGLHGVRETGDRLMELARRMGHTPVRVKDMPGFIVNHAGRGMNTEGLRIVSEGVADFVDIDRIVREQAGFRLGPFELMDLTSLDVSHPVMESIYHQFYEEPRFRPSPVTAVRLAGGLVGRKAGEGFYRYPGGRKEIPDEGLVHAALPERVWISSRSIDAHRQVTDLVAPTGVTIESGERPSESALILVMPYGKDATTAALEEGLDASRVVAIDCLFPLSASRRRTLMTTPLTNPSFRDGARALCSHGGAAVTVIRDSAGFVAQRIVAMIVNIGCDIAQQRIASPDDIDLAVTLGLGYPNGPLAMGDAVGAARILEILRNMTALLGDPRYRPSPWLARRAQL

SEQ ID NO: 7668 - protein, 275 aa, Burkholderia cepacia
VAGSGTMGTGIAIVAARAGFRTIVFDTRQDALDRARGQTEAFLRKSVARGKLSVEDLDAILGRWSSTTKLEDLASGDVVIEAVFEDLRVKHELFSALDRVCAADTIFASNTSTISITEIAGGSGRPDRFVGMHFCLPAQLMKLIEMSPGLETSDDTWQRAWEFALQMGQQPVKTKDTPGFILNYFLIPYNNDAIRLVEAGVAEPAEIDRAIRTALGYPMGPLELLDLVGMDTQRLLCEAMHGLTNEDRAACPPLVKRMIAAKRLGKKTGHGFHRY

SEQ ID NO: 7669 - protein, 459 aa, Burkholderia cepacia; identical to SEQ ID NO: 4911
  unsure (1)..(459): unsure at all Xaa locations

SEQ ID NO: 7670 - protein, 362 aa, Burkholderia cepacia
KVALITGVTGQDGSYLAELLLSKGYEVHGIKRRSSLFNTERIDHLYQEPHASDRRFVLHHGDLTDSTSLVRIIQRAQPDEIYNLGAQSHVAVSFEEPEYTANVDGVGALRILEAIRILGLEKKTRFYQASTSELYGLVQEIPQKETTPFYPRSPYAVAKLYAYWITVNYREAYGIYACNGILFNHESPVRGETFVTRKITRAISRIATGLQECLYLGNMSALRDWGHARDYVEMQWLMLQQEQPEDFVIATGVQYSVRQFVEQAAAELGIHLRFEGSGVDEVGIVERVVGGDTKVVRGDVIVRVDPRYFRPAEVETLLGDPTRAHEKLGWKPATSFESLVTEMVRADYQVAKRDALVTLAGF

SEQ ID NO: 7671 - protein, 305 aa, Burkholderia cepacia
  unsure (1)..(305): unsure at all Xaa locations
KVTKAVFPVAGLGTRFLPATKASPKEMLPIVDKPLIQYAVEEAMAAGITEMIFVTGRSKRAIEDHFDKSYEIEAELEARGKDKLLELVRSIKPSHVDCFYVRQSEALGLGHAVLCAEKLVGDNPFAVILADDLLHGTPPVMRQMIEAFDHYHSSMIGVEEIPSQDTGSYGVIDGSEWGDSIIRMAGIVEKPEPNVAPSNLGVVGRYVLKPRIFKHLRAIKAGAGGELQLTDAIQSLLADEQVLAYKYHGTRFDCGSKLGYLKATVEFALRHPEVRSEFRAYLEKHLSLLQMXIAIIAGGRAPLSP

SEQ ID NO: 7672 - protein, 447 aa, Burkholderia cepacia; identical to SEQ ID NO: 4914

SEQ ID NO: 7673 - protein, 386 aa, Burkholderia cepacia
LQTRVLRAGSPPFDSGAAPVNVPVVRASTVRFERDAERATLHRRREAGEAVSTYGRHGMATHRALEAALGELEGASDVLLAPSGLAAISLVFIALLSPGDHVLVQDSVYGPVRERIEPLLTRLGVSFSYFGASDGVPAALLRPQTRLIYVESPSSFLYEVVDLPALAAFAREHGVLLAADNTWGAGLLYRPLALGADISVQATTKYPGGHSDLMQGAVSTADAKLARRLRDTHDALGLSVGADDAYLALRGLRTLAVRLAQHGRNALEVARFLQTGTRVVARVFHPALPDHSGHALWQRDFTGANGLVSFAFRHAQPADASAFVDALRLFGIGASWGGYESLALIAPSARLREHSYWRGDVPVVRLHIGLEDPADLIDDLSQAFRR

SEQ ID NO: 7674 - protein, 685 aa, Burkholderia cepacia
MMLQTQAAECGLVCVGMIANYFGHDMDLASLRRRFTTSLKGATLNDIMQMSNQLGLTPRALRLDLNDLAKLNRPCILHWEMNHFVVLKEVSRDKITVHDPARGIRDIPMDEVSRGFTGVALELMPSASFQPVAEKQSISMLKLIGGVIGIRSAFVQVLLISAALEVCGIISPFYMQWVMDQVLVSADVDLLTLLGIGFLMLVVFQNAIAALRSWVVTWFSSLLSVQWTASVCSHLLKLPMSYFEQRHMGDIVSRFGSVGTIQSMLTSRFISTLLDGVMASITLVMLFVYSPMLTWLVLGLFAVYALIRWIAYRPLRRANEDQIAYSARAQSQLLESIRGVQTIKLGNKQEARVATYTNSVVDMTNRGIAIQRLSISFSTLQGVISGIGRVVLIWLAARQVLQNEFSAGMLVAFISFADQFTSRASGLIDTVIDIRMLRLHGERLADIVLTEPESNMEGSVTRANLVEEAKDRAPGIEVSNLRFRYADTEPWVIKDCSFTVEPGESVALIGPSGQGKTTMAKLLLGLLMPQKGEIRVDGVDIKKLGMLGYRDMIGSVMQDDILFAGSIADNISFFDTHPDYAQVERVARIAQIHDEITAMPMGYQSLVGDMGSSLSGGQAQRVLLARALYRNPSILILDEATSHLDVDRERLINDAIRNMEVTRIIIAHRPETIRSADRIIAMQQG

SEQ ID NO: 7675 - protein, 478 aa, Burkholderia cepacia
MYIGGEWVEPASGEYFETVDPFTAKPWALIPRGNAEDADRAIRAADKAFRDGPWRAMHPSERGLVLQRFGQLIGQHADELAGIEVRDNGRLLAEMRHQIRGIPKWYYYYGGLADKIEGAVHPVEQPALSFTRHEPLGVCVGIVPWNAPLLLLSLKAAPALAAGNTIVLKPAEFTSASALKLMELVEQAGFPPGVVNVVTGFGKEVGEPLVAHPLTRHLGFTGSTATGSHLYALAAKDVKRASLELGGKSANLVFNDADLNNAVRGVVGGIFGAVGQTCIAGSRLLVQRRIHDEFVDKLAAFTKTARIGDPRKPETQIGPIANRMQYNKILGYIDIAREEGAELVMGGARPDIAECGEGFFIEPTIYTGIRNDMRIAREEVFGPVLATIPFDDPEEAIAIANDSDFGLGAGVWTSDMRLALRMSERLEAGSVWINTYRDISYTTPFGGYKKSGIGRENGIEGIREYLQTKAVWISTAEE

SEQ ID NO: 7676 - protein, 361 aa, Burkholderia cepacia
AAGYDRENRFFAGDLEDLQRVGFLRASVPVELGGLGLTLPQLLREQVRLATRAPATALALNMHLYWIGAALHLYRRGDASARWILTEAAAGKVFAAGHGEPGNDLGLAHSFVKATPLGDGGYRFDGRKILTSLAPAWDWLGVHGLDDSDPAAPKIVHAFIHRDAAGHRTVETWDALGLRATRSDDTYLEGAIAQHQHVIRVLPAGIPDDPFVDGILGAVLPGLAAVYYGIAKRALELAIATAKTRTSQALAGKTYAYKPLTQLSVAQAAIELDSIEALVERVAAQWWQGYPDGEPWIARLLASKQHAVDGALRVVNLALKIAGAGALSKNNELERLYRDVRAGAFHPPNADATHEVIGQAW

SEQ ID NO: 7677 - protein, 752 aa, Burkholderia cepacia
YQHASGGWGSLKAVASALIQEKAPVETSRVLVHQNKPDGFMCVSCSWAKPAHPHTFEFCESGAKATAWDLTSRRVNPEFFQQHTLAELEQWHDQALEDAGRLCAPMRWDAALDKYVEVTWEHAFAEIGRELRAIKPDEAVFYTSGRASLETAYMYQLFARMYGTNNLPDSSNMCHESTSVGLKQAIGVGVGTITLEDFKHTDLMFFFGQNVGTNSPRMLHDLQEARERGVPIITFNPIREPGLVSFVNPQSPTQMLKPGATQISTQYHQLKAGGDSAAIVGICKAVIEADDRAQATGAARIVDAGFIAEHTSGFDDFARYVRNARWDELERICGLTRAALTAAADEYMRAKAVIIHYGMGLTQHRMGVQNVRMIVNLLLLRGNIGKPGAGPSPIRGHSNVQGQRTVGVTEKPELAPLDKLAEQYHFTPPRKEGMATVDACKGVIDGKVRAVFQLGGNLVRSVPDRYAIEPAWRKLRLTVSIATKLNRSHLVHGEVSYLLPCLSRIEIDERMGNAQAVAMEDSTGCMHGSHGVAQPASDQLLSEPAIVAGIAKAALDSTSVDWDAWSNDYALVRDAIAETYPEIFHDFNARMWTPGGFHRPLPARERKWETKSGKAEFMVPQTLNEDPDMPERQPDDLRLFTLRSDSQFNTTIYTLDDRFRGVRGTRMVLLMNRRDIERHGLEADAEVSLEAVSPDGIPRRVDGFRIMEFDLPAGCVAGYYPECNPLIPLSHHAKESKVPAAKAIPVRIVAAQ

SEQ ID NO: 7678 - protein, 376 aa, Burkholderia cepacia
MKALVYEGPRKVTVKEMPDAKIERPTDVLVKITTTNICGSDLHMYEGRTNMETGRILGHENLGVVVEVGAGVERIKVGDRVCLPFNIGCGFCKNCERGLTGFCLTTNPGMAGAAYGFAGMGPYSGGQAEYLRVPFGDFNCLVLPPDAEEKENDYVMLSDIFPTGYHATVLAGVEPGDSVVIYGAGPVGLMAALSASIKGASKIMVVDSHPDRLKLAEKIGAIPVDDTDGSSAERILEMTGGEGADRGCECVGYQCSCKGHEVPNLTMNNLIKAVRPTGGIGVVGVFVAEDPKAGDELAKKGQLALDFGQLWMKGQHIATGQANVKAYNRKLRDLIAAGKARPSQIISHELPLDKAPDGYKHFDERDDGWTKVVLKP

SEQ ID NO: 7679 - protein, 359 aa, Burkholderia cepacia; identical to SEQ ID NO: 4921

SEQ ID NO: 7680 - protein, 425 aa, Burkholderia cepacia; identical to SEQ ID NO: 4922

SEQ ID NO: 7681 - protein, 464 aa, Burkholderia cepacia
VDGRWVHSASAASVAVHNPADQQVLGHVPMLDAAQITEAVGAAQRAFSTWRWLPVSQRSALLLRWHELILRHQHDLAAILSLEQGKPLAEARGEIAYGASFVEWFAHEVRRLNGRTIPTHIDGAHLGTMIEPVGVAALITPWNFPCAMITRKAAAALAAGCTVVVKPAHETPFSALALAQLAEEAGFPAGVFNVVLGEPQMAMERLVGDSRVRSVSFTGSTRVGALVMQAAARAGIKKTALELGGNAPFIVTGDADLDQAVRVAVAAKFQTSGQDCCAANRIFVARPLYEAFVAQYSDAVKALKVGAAFEANVDVGPLMHQAAFDSTAQRVADAKARGARITAGGGAHERGGWFFEPTVVADAAPGMRIYDEENFAPISAVSPFDSLDEVVERANDTEYGLAAYVCARDLNTVFQLIRRLDFAMVSVNGAKFTGAPIPFGGIKSSGLGREGGAEGFEPFVETRY

SEQ ID NO: 7682 - protein, 250 aa, Burkholderia cepacia
LSGKRGLVVGIANEHSIAAGCARMFRAIGAEIAVTYLNDKAEPYVRAVAETLPASLVMPCDVTVPGQLEAVFARISREWGKLDFVLHSIAFAPAVDLHASLVDCSAEGFALAMDVSCHSFIRMTRLALPLMAEGGSLMTVSFYGAERAVDHYNLMGPVKAALESSVRYLAVDLAPRRVHVHAISAGAVKTRAASGLDHFDVLLDEVRARTPARHLVTIDEIGRIAAVLASDAGMTLTGSTLYADAGFHVV

SEQ ID NO: 7683 - protein, 465 aa, Burkholderia cepacia
PISSPNCSPMTQTTPDSREDAWLERSRATLAKAQPGARAEAVGRVEHVADGIALVSGLPDVRLNELLRFEGDRFGFALTLDADTIGAVLLDDADAITAGSIVTGTGQVVQVPVGPGLTGRVVDPLGRPLDGRGAVHADARMPIERPAPSIIERDLVAEPLATGILLIDALFAIGRGQRELIIGDRATGKTAIAIDAIVNQKNSDVICVYVAIGQRASAVERVIAAVREHGAPERCVFVFASSAASAGLQWIAPFSAMTIAEYFRDRGQHALVVIDDLTRHAATHRELALLTREPPGREAYPGDIFYLHARLLERAAKLSPERGGGSLTALPIAETDAGNLSAYIPTNLISITDGQIVLDTGLFAANQRPAIDVGLSVSRVGGKAQMPALRNVSGRLRLDYSQFLELEMFSRFGGLTEARVKAQVVRGERIRALITQPRFTPLRPVDEVALLGALAEGVFDALPVD

SEQ ID NO: 7684 - protein, 274 aa, Burkholderia cepacia
LSEVQGRISSVHELESVVSAMRGIAAARSREAQSRIEAIRACARTVGNAIGDALMFEQHDEPQAPPGHAAGNEVVIVLCAEQGFVGTFNEHVIEATARRVASRSTEFFLIGARGIAVAAEHGLTIGWSAPMVAHADEVPALADRITAALYERLNAGQATRVTLLHAVPNPSVTIEVVKTALWPFDFTRFKQALRANPPLITLTPEILLAKLAEEYIFAQLCEAIMLSFAAENEARMRAMVAARTNVHDTLDELIGESRRLRQDEITSEIVELSS

SEQ ID NO: 7685 - protein, 343 aa, Burkholderia cepacia
LHLSSNDYLAIARHPDIIGSMAATLLENGNGLLMSGIFLHGDCPQLQFENRLATFMQAEAGVLCQSGYAANTGLIQSIASEQTPVYIDMMAHMSLWEGVRSAGAVPVAFRHNDAAHLEQQIGRYGQGIVLVDSVYSTTGSVCRLVSLADVCERHACVFVVDESHSLGTHGPRGAGLVVELGLQSRVAFRTASLAKAFAGRAGFISCPVDFQEYFKFESNPAIFSSTLLPHEISGLDATLSVIECADRRRTRLASSAAWLRQRLTELGYNLNGSRSQIIALEAGTEQRTIVLRDALESRGIFGSVFCAPATARNRALIRLSIHAALSDAQVEKIASVCRDIRSE

SEQ ID NO: 7686 - protein, 245 aa, Burkholderia cepacia; identical to SEQ ID NO: 4928

SEQ ID NO: 7687 - protein, 532 aa, Burkholderia cepacia
QPVSQEQLDRAATTSNDWLLSNGSYAQTRYYRGAQINKTNVSKLRPAFIFQTAVNESMETAPIVSNGVMFITTSFNHVYAVDAVTGKEFWHYKHKMGAVTTFCCGPNNRGVAIAGDRLYMGTLDAKLVALDAKTGSVLWQTQIADPDEGYSETMAPTVVDGKVLIGTNGGEYGIRGFLKAFDANSGQLLWTFYTIPETGQEGVWATKDATGRDGKRDIDAEKKQLAEKGGDFYKTLGGGVWMAPAIDRQTHTVFFVVGNPSPDLYGAIRPGDNLYTDSLVAIDLDTGKYKWHYQYVPHDVWDLDAVSPPMLIDVRDNNGRMIPGVVHGGKTGHVYVHDRATGRLIRYSQAMIPQENMWTLPTAAGARMLPGANGGVEWSPMAFDPHTRLVYAANLHQPMTYQVEDAAYPGGSKLWLGGAFKTIASEQQWGKLSAVNVDTGKVAWDYKTEQPLIGGVLTTAGGLVFNGEGNGLFRAFDSATGKKLWEFQCGAGVNAPAVSYMVHGKQYIAVAAGGNTQLDFKRGNTVLVFALP

SEQ ID NO: 7688 - protein, 592 aa, Burkholderia cepacia
LAILASAALSSFVAQADSQLDGLMKNPSNWAAQAGDYANHRYSPLKQINENNVGKLQVAWTMSTGVLRGHEGAPLVIGDTMYIHSPFPNKVIAINLKDQTFIWQYLPKQDDQVVSVMCCDTVNRGLAYGDGKIFLQQADTKLVALNAKTGDVVWTAQNGNPKAGETNTNAPHVFGDKVLTGISGGEFGVRGRLIAYDIKTGKPAWTAYSTGPDKDMLIDPDKTTTYADGKMVPVGADSSLKSWKGDQWKLGGGTTWGWYAWDPKLNLVYYGTGNPGTWNPTQRPGDNKWSMSIFARDLNTGQARWVYQMTPHDEWDYDGVNEMILSDLSIDGKKVPAIVHFDRNGFGYTLNRETGQLLVAQKFDPAVNWADHVDMKSGKPIRNAAYSTQAAGSDHNVKGICPAALGSKDQQPAAYDPGSSLFLVPTNHVCMDYEPFDVDYVSGQPYVGATLSMYPGPNDNNSMGNFIAWDASKGKIVWSKPERFSVWSGVLATAGGVAFYGTLEGYIKAVRIKDGKELWRFKTPSGIIGNVFTYEYQGKQFIGVYSGIGGWAGIGMAAGLEKSTEGLGAVGGYRELAKYTALGGTLFVFAIP

SEQ ID NO: 7689 - protein, 344 aa, Burkholderia cepacia; identical to SEQ ID NO: 4931

SEQ ID NO: 7690 - protein, 660 aa, Burkholderia cepacia; identical to SEQ ID NO: 4932

SEQ ID NO: 7691 - protein, 368 aa, Burkholderia cepacia
RTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLF

SEQ ID NO: 7692 - protein, 389 aa, Burkholderia cepacia; identical to SEQ ID NO: 4934

SEQ ID NO: 7693 - protein, 446 aa, Burkholderia cepacia
YHGNEYGRMAVASAAQVTQAVDGALAGFRASTLSPYERFRILMEAARIVESRMPMLIDLMRDEAGFTHADGENEVRRCVQTFELSAEEGKHLAGELVPMEAAAGVRNRMGFTIRVPRGVVCAITPFNSPLNTLAHKVGPAIAGGNAVVIKPSNVTPLSAVELCKVLIDAGLPANLLALVHGSGSAIGRQLLADPRIAFYAFTGSTQVGREIQQAAGLRGMQLELGSIASTIVCEDADIDLAIPKIVNAGFRKAGQVCTSVQRLFVARGIADEFIPRFVAAVKATPYGDPADPKTILGPMISVQHAQRAAAWVREALDGGARLLTGGKCEGALFEPTVLHGVDATMKVVCQEVFAPVVSIIEFDDIGEAVAGANASDFGLAAGLFTSDLKTAFRTARELAFGGVHINEASSARIDVMPFGGVKDSGFGREGPAYAIREMTEERLITV

SEQ ID NO: 7694 - protein, 453 aa, Burkholderia cepacia; identical to SEQ ID NO: 4936

SEQ ID NO: 7695 - protein, 474 aa, Burkholderia cepacia
MTYAQIDSMASQLADSLVKRGIRKGCHVALMLKNAPEFVITWIALGRIGAVMVPVNTSYTQDELVFVLTDADAQYLVIDAEFLPRLAAAPALPGLLAWERVIVCGESEHPLRWAALLEAGSADFTAPSAVSRHDLLNLQYTSGTTGFPKGCMLSHDYWMIHCHGAARHRRGPEAGIENVLIWAPFFYMDPMWQFLMTMKLGGTAYIAERMSLTRFMSWLIDYRIHYCIFPEPALSQHPRGPRDAEVHLKYISIYGWTRSAREEVQARFGVIAREGFGMTEVGTGALVPAWAHDKALERTCGLPAPFRELQIRREDGSVAEVDEVGELWIRGRGILWGYYKRPEANAESFDGDWFRTGDLFRRDAQGFYFIVGRIKEMIKRAGENVSATEVETVLRGMDAIDEAAVVAVPDPLRREEVKAYLKLREGLTQGDVPPAAVFEHCARHLAPFKVPRYLQYIEGDFPRTPSRKIAKKRL

SEQ ID NO: 7696 - protein, 517 aa, Burkholderia cepacia; identical to SEQ ID NO: 4938

SEQ ID NO: 7697 - protein, 506 aa, Burkholderia cepacia
  unsure (1)..(506): unsure at all Xaa locations
RSSPKFQGALLXTFQTHRCGAPARQEIRPEGRAFIDGNYVGALSGRTFATVNPATGQVIAQVAECGEEDVNLAVASARKAFESGVWSRRAPAERKAVMLRFAQLMMEHREELALLESLDVGKPVANAYNGDIVSSATCIQWYGEAIDKLYGETAPAAPDMTTMIVREPLGVVAAVVPWNYPLSMASWKLGPALAAGNSVVLKPAEQSPLSAIRIAALAMEAGLPAGVLNVLPGYGETAGRALGLHMDVDAVGFTGSTAVGKLFMQYSGQSNIKRVGLECGGKSPHIVLDDCADLDAAARAVAAGIFGNSGQVCNAGSRLIVQAAVRDELLEKVAAIARELVPGDPLDPATKMGAIVSDVQHASIMSYIDAGRADGARVVAGGRAARPESGGYFIEPTVFDGVNNDMRIAREEIFGPVLSAITVDSPEEAVRVANDTIYGLAAAVWTSNVTRAQQVSRQLKAGVVWVNCFDRGTMSSPFGGFKQSGFGRDKSMHAFDKYMDWKAIWI

SEQ ID NO: 7698 - protein, 1019 aa, Burkholderia cepacia; identical to SEQ ID NO: 4940
  unsure (1)..(1019): unsure at all Xaa locations

SEQ ID NO: 7699 - protein, 383 aa, Burkholderia cepacia
SNLVERLQGRRTSAWEIHRVAQQAAANGEDVIVLSVGDPDFATPAPIVERAVEALRGGDTHYSAVSGREPVRAAIAEEHARTTGCAVSAANVILTAGAQNGVFASSLCLLEAGDEVIVPEPMYLTYEACVRAAGATLVAVPVDRARAFHVDCEALEAAVTSRTKAIFFATPCNPTGVVMPRADLERIARIACEHDLWVLSDEVYAELTFERGHLSIAALPGMAERTVTLGSLSKSHAMAGWRVGWAIGPAELIEHMGRLALAMLYGLPGFIQQAALTALQNKAQIAAGMREIYRRRRDVVFERLQRVPGLRCVLPEAGMFMMVDVSGTGLDTVDFTWQLFRAQGVSLLDASAFGETANGFVRLGFVVEEARLIDACERIAAFV

SEQ ID NO: 7700 - protein, 439 aa, Burkholderia cepacia
VFHRLPKQLLPVAVAGEGIEIIDSTGKRYIDASGGAAVSCLGHSNQRVIDAIKRQSQQLPYAHTSFFTTEPAEALADRLVASAPQGLEHVYFVSGGSEAIEAALKLARQYFVEKGEPRRRHFIARRQSYHGNTLGALAIGGNAWRREPFLPILIEAHHVSPCYAYREQRADETEEAFAQRLADELERKILELGADTVAAFIAETVVGATAGAVPPVREYFRKIRAVCDRYGVLLILDEIMSGMGRTGYLYACEEDGVAPDILTIAKGLGAGYQPIGATLVSERIYQAIVGGSGFFQHGHTYIGHATACAAALEVQRVIEEDNLLPNVLARGEQLRVRLREHYAQHPHIGDVRGRGLFVGVELVRDRAGKTPFDAALKLHAAIRREAFARGLMVYPMGGTVDGKIGDHVLLAPPFICTARDIDEIVSRLTDAIDGALAAV

SEQ ID NO: 7701 - protein, 428 aa, Burkholderia cepacia; identical to SEQ ID NO: 4943

SEQ ID NO: 7702 - protein, 435 aa, Burkholderia cepacia
AAHIGAFVSAAREAQHAWAQGGLAHRTKALLAWADELEKNGAEVVAALSVDTARHRISAEELGAVIHFIHGFCEHAPTVLATPFRKLEAHPDVVFKVTYAAYPVVGVISPWNFPLVLSFIDAIPALVAGAAVIIKPSEVTPRFIEPLRRTIEAVPALANIITLVTGGAQTGAAIVAQSDAVVFTGSVPTGQKIATAAAQAFIPAFLELGGKDAAVVLAGADVVRAATSILRSALYNSGQVCYAIERVYAHDSLHDALVEELRTQAAALKRSNAAGDGGHYGPMIFERQAAIIDAQLDDAVSKGASIVLGGKSERINGAVWIDPTVVTNVDHTMTLMTEETFGPIVPVMRFNDDAEAERLMNDSMFGLSGAVFGPDTHTAGDFATKMEAGGVSINDTELPRVMMFDGEKTAFKKSGMGGSRYGATSIMRYVRKRAL

SEQ ID NO: 7703 - protein, 244 aa, Burkholderia cepacia; identical to SEQ ID NO: 4945

SEQ ID NO: 7704 - protein, 476 aa, Burkholderia cepacia; identical to SEQ ID NO: 4946

SEQ ID NO: 7705 - protein, 532 aa, Burkholderia cepacia; identical to SEQ ID NO: 4947

SEQ ID NO: 7706 - protein, 376 aa, Burkholderia cepacia
  unsure (1)..(376): unsure at all Xaa locations
DEQRMIRDAARDFATERLAPYAGQWDRDAQLPAEVVTQMGELGFLGMIVPAEWGGSYTDYVAYALALEEIAAGCASCATLMSVHNSVGCGPILNFGSAAQKDRYLHDLATGRRIGAFCLTEPQAGSEANNLRTRAVLRDGKWILNGSKQFVTNGARAHVAIVFAVTDPDRGKRGLSAFIVPTDTPGFNVGKPEHKLGIRASDTCPISLDDCAVPEANLLGEPGEGLRIALSNLEGGRIGIAAQALGIARAAFDAARLYASERIQFGKALKEHQTIANMLADMATRLNAARLLVHHAARLRTEGKPCLSEASQAKLFASELAEEICSNAIQIHGGYGYLEDYAVERHYRDARITQIYEGTSEVQRMVIARHVXMQAR

SEQ ID NO: 7707 - protein, 332 aa, Burkholderia cepacia
MKAVQVAQAGGPLELVERDVPEPGAGQVLIKIQACGICHSDVLTKEGQWPGLEYPRVPGHEIAGVIDTVGAGVEEWQAGQRVGVGWHGGHCGHCEHCRRGDFVLCQRALVPGISYDGGYAEFMLAPVEALARIPDDLADVDAAPLLCAGITTFNALRNSGARAGDVVAILGIGGLGHLGVQFARKMGFVTVAIARGQDKASLAKQLGAHHYIDSTAANVAQALQALGGARVILATVTSGKAMSAVVGGLGLNGKLIMVGLSDEPVEVPVAQFIMGRNSVQGWPSGTSADSQDTLAFSALSGIKPMIEEFPLTKAAEAYERMMSGAARFRVVL

SEQ ID NO: 7708 - protein, 254 aa, Burkholderia cepacia; identical to SEQ ID NO: 4950

SEQ ID NO: 7709 - protein, 241 aa, Burkholderia cepacia; identical to SEQ ID NO: 4951

SEQ ID NO: 7710 - protein, 429 aa, Burkholderia cepacia; identical to SEQ ID NO: 4952

SEQ ID NO: 7711 - protein, 526 aa, Burkholderia cepacia
VLLLEAGGPDYRFDFRTQMPAALAYPLQGRRYNWAYETDPEPHMNNRRMECGRGKGLGGSSLINGMCYIRGNALDYDGWAAHAGLENWTYLDCLPYFRKAETRDIGANAYHGGDGPVHVTTSKPGNNPLFAAMVEAGVQAGFPRTDDLNGYQQEGFGPMDRTVTANGRRASTARGYLDRAKARPNLTIVTHAVTDRVLFSGKRAVGVSYLHHGNVLNAQARREVLVCSGAIASPQLLQRSGVGRSTWLRELDVPLVHDLPGVGENLQDHLEMYIQYECKEPVSLYPALQWWNQPAIGLEWMLNGTGIGASNQFEAGGFIRTRDDDPWPNIQYHFLPVAINYNGSNAIRMHGFQAHVGSMRSPSRGRVKLTSRDPNAHPGILFNYMADPLDWREFRDGIRITREIMRQPALDRYRGRELNPGAELTTDEQLDSFVRMRAETAFHPSCSCKMGYDDMAVVDNEGRVHGMQGLRVVDASIMPRITTGNLNAPTIMLAEKIADRIRGREALARVDTPYFVANGVASRKRE

SEQ ID NO: 7712 - protein, 489 aa, Burkholderia cepacia; identical to SEQ ID NO: 4954

SEQ ID NO: 7713 - protein, 271 aa, Burkholderia cepacia
IAEMKQQIREHSEILTVVRTTDDIFRAKKENKTGIIFGFQNAHAFEDNLGYIEAFKDLGVNVVQLCYNTQNLVGTGCYERDGGLSGYGREVIQEMNRVGIMVDLSHVGGKTSSEAIAASNKPVCYSHCCPSALKEHPRNKSDEQLKEIADAGGFVGVTMFAPFLKRGPDATVEDYIEAIEYVVNLIGEDQVGIGTDFTQGYSTEFFDWITHDKGRYRQLTNFGKVVNPEGIRTIGEFPNLTAAMERAGWSETRIKKIMGENWVRVFGEVWK

SEQ ID NO: 7714 - protein, 511 aa, Burkholderia cepacia
MLETKKNILILMADQMTPFALAAYGHRLTKTPNLDRLAKQGVVFESAYCASPLCAPSRFSFLSGKLPSAIGAYDNAAEFPSQTLTFAHYLRAEGYRTILSGKMHFCGADQLHGFEERLTTDIYPADFGWTPDWEHFETRPTWYHNMSSVIDAGPCVRTNQLDFDDEVTFTTRQKLFDIARERHAGKDARPFCLVASLTHPHDPYAIPQKYWDMYRDEEIDMPAFRDSFEDADPHSKRLRHVCETDRTPPTDQQIRNARRAYYGAISYVDDQFGAILEALEQSGLAKDTVIVVTSDHGEMLGERGLWYKMTFFEGGCRVPLIVHAPQQFDAHRVEASVSHLDLLPTLVELARGEQPAVWPDSLDGQSLVPHLMSGQGGQGGHDEAIGEYLAEGAIAPIVMLRRGRFKFIHTPADPDQLYDVAADPLERENLAARSEYASQVTAFREEIAQRWDLAALHHEVLQSQRRRHFHFASTTQGVVASWDWQPHVDASQRYMRNHIDLDSLEAMARFP

SEQ ID NO: 7715 - protein, 383 aa, Burkholderia cepacia
ADDAQALLAARRLAEAFAPDAALRDRERRLPWAELDAFVASGLWGITVPREFGGAGVSNGTLAEVTATIAAADGSLGQIPQNHFYALEVLRVGGSVEQQRFFYGRVLAGERFGNALAEIGHKDFKRRTRLTREAAGWHIDGRKFYCTGALYAHWIPTLVVAEEQGRDVTYLAFVPRDTPGVTVTDDWDGFGQRVTGSGSVQFDYVRVEPEWVVPFQASFERPTTIGPLAQIIHAAIDLGQARGAFEAGLKFVRERSRPWIDAKVERAADDPLTLAQFGDISVRLRAAEALLRRAGRFVDAAQAQLTEQSVAQASIAVAEARALTTTASLDAGSRLFELAGTAATLDGLGLDRFWRNARTHTLHDPVRWKYHAVGNFYLNDKLP

SEQ ID NO: 7716 - protein, 255 aa, Burkholderia cepacia; identical to SEQ ID NO: 4958

SEQ ID NO: 7717 - protein, 382 aa, Burkholderia cepacia; identical to SEQ ID NO: 4959

SEQ ID NO: 7718 - protein, 545 aa, Burkholderia cepacia
NISSLAGKPLPPALLVNVPRLVASYYTGTPDPSLAAERVKFGTSGHRGSSLQRSFNEWHVLAITQAICRYRKLQGIDGPLFLGIDTHALSEPASASALEVLAANGVEVMIAPDGEYTPTPAISHAILTYNRGRSSGLADGIVITPSHNPPGDGGFKYNPPSGGPADETVTGWIEVAANSLLENRLDGVMRMPLANALRASTTHYHDFLRIYVADLDSVIDMSVLRGAPIRLGVDPLGGAGVHYWAAIAERYRLNLTVTDEDVDPTFRFMSADWDGQIRMDPSSPYAMQTLIGKADRFDTAFACDTDHDRHGIVTPTAGLLPPNHYLAVMIDYLCAHRPDWPAHAAIGKTMVSSRLIDHVAAKHGRALYEVPVGFKWFVGGLLDGSLGFAGEESAGATCLRLDGRAWTTDKDGMVPALLSAEIATRTGRDVAEHYRALTERLGEPRERRVQAAASASQRALLGRLSPAQFAHTELAGEKIDSVLDRAPANQAPLGGIKVSTKSGWFAARPSGTENIYKIYAESFLGDDHLARIVGEAQSMVDNALA

SEQ ID NO: 7719 - protein, 557 aa, Burkholderia cepacia
DYLILGGGSAGCVLAARLSEDEGSTVCLVEAGRNISRTDMPAAVRSRYPGRAYLDTANIWQHLKARMNTSAATRRYEQARLLGGGSAINALMANRGAPADYDEWHARGAHGWNWAACLPYFRKLETDCDFGGALHGASGPVRIQRTPWARISPFVRAVLATLDARGHTRRDDQNGEWQDGTFIGSIAVSEAGERIPTSVCYLDDTVRARPNLTIRTQTLVEHVLFDGGRAIGARVVGENGASETLHARQVIVCAGAIHSPALLMRSGIGPASELAALGIEVVADRGGVGGNLMEHPSIAVSAVLPRAARALYPDEHHEQAIVRFSSGVSGAVPGDMHGAILSRSGWHSVGYRLGTLFFWVNKSYSRGRVSLTSASPHDEPAVDFNMLSDARDLERLKLALRFGARTLADPMMAQHRTTLLPSSYSPRVASVAVPGVWNALQRGLLSALLDIAGPLRGWLVRRVVTQGVTLDELLADDHALTRFVTRSAGGTWHPCGTCCMGAADDPLAVCDARGAVYGVSGLYVGDASLMPSIPCANTNVPTIMIAERIADMLRGRA

SEQ ID NO: 7720 - protein, 483 aa, Burkholderia cepacia
FNPDDVAIRSGHYIGGEYVEAGGRRIEVARPSDGVVYATVPLADAGMVDRAVENAWQAFRHSGWARMAPRERAKILRRFAELVEADAPTLGRLEALGSTRPIAQAIGWDVPFTAEGIRFYAEFADKLGGDVAATDHDHLGMTIAEPYGVIGAIAPWNFPLVMASWKIAPALAAGNAVVLKPSEMTPFSVLRLAELAVQAGVPAGIFNVIQGDGRVTGDELVRHPKISKVTFTGSTRTGASIMAACANSGTRPVTLELGGKSPQIVFADAPRLDDVARRIAGAITGNAGQVCVAGSRLLVERSLAEPLAERIGKIFAELKPGATWAAGTTLSPIISAPQAARIEGIVGRTLEAGATLRYGGVRADVGSNGAFYTPTLLTNVTAHSEAVREEIFGPVLTLQTFDTEEEALALAQHPEYGLAAGVHTADLGRALRFVRGLEAGTVWVNRYGRTSDFMIPTGGYKRSGIGKDLGRQAYEANLRFKSV

SEQ ID NO: 7721 - protein, 433 aa, Burkholderia cepacia; identical to SEQ ID NO: 4963

SEQ ID NO: 7722 - protein, 357 aa, Burkholderia cepacia
KKYRIAVIPGDGIGVEVMPEAIRVLEAVKARFGIELEYQHIEWASCEYYAKHGKMMPDDWKAQLLSADAILFGAVGWPDTVPDHISLWGSLLKFRREFDQYINLRPARLFAGVPSPLAGRKAGDIDFWIVRENTEGEYSSVGGVMFEGTEREFVLQESVFTRHGSERVLKFAFDLAQRRARKKITVATKSNGIAISMPWWDKVAAGIAAQYPDVTWDKQHIDILCARFVLNPDRFDVVVATNLFGDILSDLGPACTGTIGLAPSGNLNPDRKFPSLFEPVHGSAPDIAGKNIANPIAMIWSAAMMLDFLGNHAGKEREAHDAILAAIEATLIEGPHTGDLGGKANTTEVGQAIAKKL

SEQ ID NO: 7723 - protein, 480 aa, Burkholderia cepacia
LIRSDNFIDGAWTPAQDNLRFAVTNPASGEIIAEVADSSPADARAATDAAARALPAWRARLPKERAAVLHRWHALIMANLDALGALISLEQGKPLAEGKGEVAYGASYVAWFAEEATRIYGDLIPQQQRGKRMTAVKEPVGVVAAITPWNFPLAMIARKIAPALAAGCTVVAKPAEDTPLTASALVLLAHEAGVPPGVLNLITASRDHAVAAVAEWLHDARVRKITFTGSTPVGKYLARESAETLKKLSLELGGNAPFIVFDDADLEAAVAGLMAAKFRNGGQTCVCPNRVYVQAGVYERFGALLAERVGALKVAPATDPAAQIGPMINSRALDKIARHVDDAVAHGARVLTGGKRLAELGPHYYAPTVLADATAAMQLNSEETFGPIVPLFRFEDEAEAVNAANDTPFGLAAYFYSEGVKRIDRVARALEAGIVGINEGAVASEAAPFGGVKESGYGREGSKYGLDDYLSIKYLCQGNL

SEQ ID NO: 7724 - protein, 521 aa, Burkholderia cepacia
HPMPQSADRILDHELLFREPEYQEIFRTKKENFEFNHPDEQVSQIVEWTKTEDYKQKNFARDSLTVNPAKACQPLGAVYVANGFHKTLSFVHGSQGCVAYYRSHFSRHFKEPTSCVSSSMTEDAAVFGGMNNMIDGLANAYNLYKPEMIAVSTTCMAEVIGDDLDAFIKNSKQKGSVPEDYDVPFAHTPAFVGSHVTGYDNALLGILKHFWDGKAGTAAPLERVADESVNFIGGFDGYVVGNMKEIRRIFDLFGVQVNILCDPSETWNTPTDGEFRMYEGGTTKDEVERALNAKATFVFQEYCCEKTSKFIAEHGQEVVVLNAPVGVAGTDQFLMEISRVAGKPIPAQLEKERGQLVDAMADSQAHLHGKRFALYGDPDQMLGYTQFLLELGAEPAHVLATNGGETWAAKVQALFDASPYGAGCKVYPKRDLWHMRSLLFTEPVDFLIGNTYGKYLERDTKTPLIRMVFPIFDRHHYHRFPTWGYEGALRVLVTLLDEFFEALDANTIVAAKTDYSYDIIR

SEQ ID NO: 7725 - protein, 116 aa, Burkholderia cepacia; identical to SEQ ID NO: 4967

SEQ ID NO: 7726 - protein, 621 aa, Burkholderia cepacia
MALLQIAEPGQSAAPHQHRLAAGIDLGTTNSLVATVQSAVARALPDEDGACLLPSVVRYTRAAEPEVGRPAQARQAEDPVNTIASVKRFMGRRLADLPEAASLPYRFIDQTGMVGLATAAGERSPVQVSADILRTLRVRAEASLGGELAGVIITVPAYFDDAQRQATRDAAHLAGLTVLRLLNEPTAAAIAYGLDRAAEGVFAIYDLGGGTFDISILRLSKGVFEVLATGGDSALGGDDFDRAIAQWFCNGHGVEGLAMLAPSAQRSLMMAARAAKETLSHAGSAVIALAHADRSIWQAALSRAQFAELGAALVARTLAATRRALRDAKLGTGDIDGVVLVGGSTRMPLVRHAVQEFFGREPLADIDPDQVVALGAAIQADVLAGNRNGDGWLLLDVCPLSLGIETMGGLVEKIIPRNSTLPTARAQEFTTFKDGQTAMSLHVVQGERESVADCRSLARLELRGIPPAVAGAARVRVSFQIDTDGLLAVTAREQTTGVETHVEVKPSYGLTDVEIAAMLQQAIDASLPDMQLRTLREAQIDARRLLDATEAALDSDAALLSADELAAVRRAMFQVGEALETDACVDLLKAAATDLAGATETFAARRMNASIRNALAGRNLD

SEQ ID NO: 7727 - protein, 431 aa, Burkholderia cepacia; identical to SEQ ID NO: 4969

SEQ ID NO: 7728 - protein, 325 aa, Rhodobacter sphaeroides
HPLPVVIAHGEGAWVRRGGRRYLDCLAGYSAVNFGHRNPELLAAARAQLDRITLTSRAFHHDRFAPFVAALADLVGKEQVLPVNTGAEAVETGIKIARKWGYEVKGVPDGRAVIVVASGNFHGRTTTIVSFSTDPAAYRGFGPPTPGFRIVPYGDAAALADAIDADTVAVLVEPVQGEAGVIVPPADYLPRVRDLCTRAGILLIADEVQSGLGRTGTVRACDHSGVDADIYLFGKALGGGILPVAAAVGDAEVFDVIRPGQHGSTFGGNALACAVGTAVVSLVRDGPYLDHVRALAPVLRARLDQLVGNGVVAARSIGLWAGIDV

SEQ ID NO: 7729 - protein, 121 aa, Rhodobacter sphaeroides
IQLIQRIIPHRYPFLLVDRVRDIVPNKSAVGIKCVTMNEPQFTGHFPGLPIFPGVQIIEAMAQTSAVLVGVSMDLADKGAKVYFMGIDGAKFRRKVVPGDVLEMTVTVKRGGGKVWKFEGR

SEQ ID NO: 7730 - protein, 304 aa, Rhodobacter sphaeroides
  unsure (1)..(304): unsure at all Xaa locations
MRKGXAMTASKPGRIAVVGSNMVDLVTYITRMPAPGETIEAPDFEIGCGGKGANQAVAAAKLGSAVSMVTKVGDDIFGENTRRNLAQHGIDIRHVETVAGKSSGVAPIFVEASGENSILIVKGANADLLPADVDTAEETLRAADLILMQMEVPRETVIHTVRRAAEWGVRTILNPAPAAADLNVDDLRDLSFLVPNESELALISGLPTGSEEEIAAAALSLIERGIGTVIVTLGGRGARLVTRAGVVPIAPVRVTPVDTTGAGDAFIGAFAHFLAATGEVEGALAHAARYAAHSVTGRGTQKSY

SEQ ID NO: 7731 - protein, 439 aa, Rhodobacter sphaeroides
HIFGRSTRGSLPVAAEGEGCYILDTEGRRYLDGSGGAAVSCLGHSNAAVRAALHDQLDRLAFAHTGFFTSEPAERLADRLAAAAPEGIERVYLVSGGSEAVEAALKLARQYFMEVGQPGRHRVIARRQSYHGNTLGALAAGGNEWRRAQFAPLLVETSHVSPCYEYRGRAEDESLEAYGLRVADELEAEIQRLGPETVMAFVAEPVVGATAGAVPAVPGYLKRVREICDRHGVLLILDEVMCGMGRTGHLFACAEDGVAPDMITIAKGLGAGYQPIGALLVQGRIYDAIAAGSGFFQHGHTYMGHAMAAAAANAVLDEIEGRDLLQAVRRQGARLEALLQERLGQHPHVGDIRGRGLFRGIELVADRETKEPFDPARKLHARIKAEAFAGGLICYPMGGTLDGVRGDHILLAPPFIISDAELDELVDKLSGALDRALAA

SEQ ID NO: 7732 - protein, 346 aa, Rhodobacter sphaeroides
HMKRIPLGRTDLTVSELCLGTMTWGSQNSEAEAHAQIDLALDHGVNFLDTAEMYPTNPVTAETVGGTETIIGRWLAARGGRDRIVLATKITGEGSAAVRGGEQVTPESLRRALEGSLARLGTDHVDLYQIHWPNRGSYHFRKMWAYVPPTGVEAVRDNMVAVLEEAQKLVAEGKVRHFGLSNETVWGAAQWLSLADRHGLPRMATVQNEYSLLCRQFDTDWAELSALEEMPLLAFSPLAAGLLSGKYAGDVTPDGSRRERNATLGGRVTPTVFEAVAGYLGIAARHGLDPCQMALAFCRKRPFPVIPILGATSLDQLRTNLGACDLELSPKVEAEIAAAHRTWPAP

SEQ ID NO: 7733 - protein, 389 aa, Rhodobacter sphaeroides
  unsure (1)..(389): unsure at all Xaa locations
VQXRARRMFHAPMTFDLGEEIAALRETVHAWAQERVKPMAARIDRENVFPAELWREMGELGLLGITVPEEFGGSDMGYLAHTVAVEEVARASASVSLSYGAHSNLCVNQIRLNGSPEQKARYLPKLVSGEHVGALAMSEAGAGSDVVSMKLKAEKRNGYYVLNGTKYWITNGPDADVLVVYAKTDPEAGAKGITAFLIEKSMTGFSTSPHFDKVGMRGSNTGELIFENCEVPFENVLGQDGKGVRVLMSGLDYERVVLSGIGTGIMAACLDEVVPYCQSRQQFGQPIGNFQLMQGKLADMYVALNTARAYVYETARACDAGRVTRADAAGCVLYASEQAMVQAHQAVQALGGAGFLNDSVVSRLFRDAKLMEIGAGTSEIRRMLIGREL

SEQ ID NO: 7734 - protein, 272 aa, Rhodobacter sphaeroides
MALKSYKPTTPGQRGLVLIDRSELWKGRPVKTLVEGLIKTGGRNNTGRVTMWHKGGGAKRLYRIVDFKRRKFDVPAVVERIEYDPNRTAFIALVRYEDGELAYILAPQRLAVGDSVVAGVKTDVKPGNAMPFSGMPIGTIVHNVELKPGKGGQLARAAGTYAQFVGRDGGYAQIRLSSGELRMVRQECMATVGAVSNPDNSNQNFGKAGRMRHKGVRPTVRGVAMNPIDHPHGGGEGRTSGGRHPVTPWGKGTKGNRTRKSKASDKLIVRSR

SEQ ID NO: 7735 - protein, 521 aa, Rhodobacter sphaeroides
LVLLLGAEFLLAILSDLLGRLGGLTDTLLTERLTMSSSVRLMHHAASLDLAAFEDAGFQDRLERARRQSGGRMTLTGQILSLMQDAVTVTSLAGGLLLYNPWLILLLVAALVPAFLGEAHFNAQNYNLDFRRTPERRELDYIRVTAAGVETAKEIKIFGLAPFLIERYRTLSESFYAARRRIASARAVWGTLFSALGTAGYYLAYLWMIGATLSGRLSIGDLTFLAGSFLRLRGLVEGLLTGFSTTAAQALYLEDLFGFFRQQPTILAPAEPRPVPKPIREGFRFEKVGFRYPGAGGWAVRDLSFTLKAGETLALVGENGAGKTTLVKLLARLYDPDEGRILLDGQDLRSFDPVALRGAMGVIFQDFVRYSMSAGENIAVGRIEARSEEDRIAEAARRSLADRIVARMPDGYGQMLGKRFREGVDLSGGEWQKFAIARAYMRDAEVLILDEPTAALDARSEFEVFQRFKELSAGRTAVLISHRFSSVRMADRILVLAGGRVEASGTHEELLAQPGRYAELF

SEQ ID NO: 7736 - protein, 466 aa, Rhodobacter sphaeroides
  unsure (1)..(466): unsure at all Xaa locations
FSDLALDPRVLKAVQEAGYETPTPIQAQAIPHALEGKDVLGIAQTGTGKTASFTLPMITILGKGRARARMPRSLVLCPTRELAAQVAENFDIYAKHSKLSKALLIGGVSFTEQDKLIDRGVDVLIATPGRLLDHFERGKLLLTGVQIMVVDEADRMLDMGFIPDIERIFSLTPFTRQTLFYSATMAPEIERITNTFLTGAVKIEVARQATTSETIEQKLIQVTPTRKERSFADKRAVLRALIRAEGEACTNAIIFCNRKMDVDVVAKSLKQHGFNASPIHGDLEQSQRMKTLDGFRDGSLHLLVASDVAARGLDIPAVSHVFNFDVPTHPEDYVHRIGRTGRAGRKGKAYTIAVPSDEKHVTAIESLVKQAIPRGELPEGFSLEDRPDRPERDNARGERSERPARGRRGRDRDRREEAPGRGRGSPGRGRSRSAGSARGAPAPPRRAARRAPRGRQQPARAXPRPP

SEQ ID NO: 7737 - protein, 479 aa, Rhodobacter sphaeroides
REALTFDDVLLVPAASSVLPSDADTSTFVTKAIRMNIPLLSSAMDTVTEGRMAIAMAQAGGIGVIHRNLGIEEQAREVSRVKRFESGIVYAPITLRPDQTLADAKALQERYNVTGFPVVDESGRVVGIVTNRDMRFANDDRTPVKVMMTSDNLAILQEPADRDTAISLMKARRIEKLLVTDGQGKLTGLLTLKDTEKSVLNPNACKDELGRLRVAAASTVGEAGFERSQALIEAGVDMVVIDTAHGHSEGVSLAVERIKAFSNSVQVVAGNVATAEATRALIGAGADAVKVGIGPGSICTTRIVAGVGVPQLTAIMDAAGAAGDVPVIADGGIKFSGDFAKAIAAGASCAMVGSAIAGTDESPGEVILYQGRSFKSYRGMGSLGAMARGSADRYFQKDAASDKLVPEGIEGQVPYKGPAAAVIHQMVGGLRAAMGYTGNRTVAEMRQGCRFVRITGAGLKESHVHDVQITRESPNYRLG

SEQ ID NO: 7738 - protein, 401 aa, Rhodobacter sphaeroides
KRVVITGAGTINALAHDVAGTLAAFREGRCGITELDIRDKDRLSIQIGGQVHNWDPEAHFNRQQIVLYDKFTQFTLLAAREAVAQSGLTFAGSLGLEAGVILGTAGGGVNTWDENYRVVYEEGKNRVHPFVVPKLMNNAAASHVSMEFQLRGPSFTVATACASSNHAMGQAFQMVRSGMARAMLTGGSEAMLCFGGIKAWEGLRVMSKDACRPFSLNRNGMVQGEGAAIFVFEEYEHARARGAEILAEVIGFAMTSDASDIVMPSKLGAARAIEGALRDARVTPDAVGYINAHGTGTAANDKTECAAVADVFRHHADRLMISSTKSMHGHLIGGTGAVELLACILALREGVIAPTIGYEEPDPECALDVVPNVARQARVDVVLSNAFAFGGLNAVLALRRV

SEQ ID NO: 7739 - protein, 444 aa, Rhodobacter sphaeroides
LSNSLAAADIAHSLHPYTNARAHERNGPLIITRGQGVHVYDSEGREYIEGLAGLWSVAVGFSEPRLAEAAARQMAELPYYHTFAGKAHEPQIRLAEKLVEMTPEALTRVFFTNSGSEANDTVVKLVWFMNNALGRPQKKKFLSRIKGYHGITIASGSLTGLPVNHRASICPPSRSCIWAAPHHWRFGAEGESEAEFCARLLREAEETILAEGPETVAAFIGEPVMGAGGVIVPPDGYWSGIEALCRKYDILLVSDEVINGFGRTGARWGCEKFGFTPDILVTSKQLTSSYMPLAAVLMTDKVYQTIADHTETLGTLGHGFTGSGHPVATAVGLENLTVIEERDLMGNAARLERPFQDGLRAFRDNPLVGEVRGTGLIAAIEMVADRATKRSFEPLGKVGARAAAFAAEEGLLCRALGDTLALCPPLIVTEADVGRILERMGRAL

SEQ ID NO: 7740 - protein, 296 aa, Rhodobacter sphaeroides
MDPQQIKAALGSGLLSFPVTPFDAENRFAAAPYQKHVEWLSGFDAPVLFAAGGTGEFFSLTPDEIPAIVKAAKESAGKTAIVSGCGYGTEIARGIARSVEAAGGDGILLLPHYLIDAPQEGLYAHVRAVCQATGMGVMVYNRDNAVLQADTLARLCDDCPNLVGFKDGTGDIGLVRQITAKMGDRLTYLGGMPTAELFAEAYLGASFTTYSSAVFNFVPALANKFYAALRAGDRATCESILNSFFYPFMELRSRRKGYAVAAVKAGVRLVGFDAGPVRAPLSDLTGEEEEILKALI

SEQ ID NO: 7741 - protein, 599 aa, Rhodobacter sphaeroides
IRQLDEAAINRIAAGEVVERPASAVKELVENALDAGARRIAVDIACGGKALIRVTDDGCGMTADDLPLALSRHATSKIDGSDLLDIRSFGFRGEALPSLAAVGRLTITSRVAEAEGAQIAVSAGRIEPVRPAALGAGTVVELRDLFFATPARLKFLRTDRAETQAIAEVVRRLALAEPEVGFTLTDHSAGEPRLLFRAEAEGGDLFDALHRRVARVVGAEFAENALRIDVAREGLRLQGYAALPTYSRGSGVAQFLFVNGRPVLDRMLLGALRAGYMDVLSRDRYPAAVLNLICDPQRVDVNVHPAKAEVRFREAGEVRGLIVTALRQALAGAGHRASTTVAGETLEAFRPERPAAAGPGPASRIYQMDRPSVAAVARSFAFQAPEPAMPGLAEAPAARVEAPAAEEAHDRPLGAARAQIHGNWILAQTESGLVIVDQHAAHERLVYEKLKRQRDETGIARQALLIPEIVELSPTDAARLLEAADELASAGLVIEPFGGGAVAVREVPAILGKVEAAPLLRDILDDLADLGSSDRLQARMDAVLSRMACHGSVRSGRALRAEEMNPLLREMEATPLSGQCNHGRPTYVELKLADIERLF

SEQ ID NO: 7742 - protein, 338 aa, Rhodobacter sphaeroides
IAILGASGYTGAELVRLIATHPAMRIVALSGDRKAGMAMSEVFPFLRHLDLPRLQKIEEIDFSSVDLAFCALPHATSQAVIAGLPRDLKVVDLSADFRLRDPAAYETWYGKPHAAPELQKEAVYGLTEFYRDEIRGARLVAGTGCNAATGQYAIRPLIEAGVIDLDDILIDLKAGVSGAGRSLKENLLHAELSEGTHAYSAGGRHRHLGEFDQEFSKIAGRPVQVRFTPHLTPMNRGILANVYVKGDPQAVHRALTERYLTETFLEVLPFGALPSTRDIRGSNYVHIGVIGDRVPGCAMVVAVLDNLCKGSSGQAIQNANLMLGLDEAAGLGLAPVFP

SEQ ID NO: 7743 - protein, 470 aa, Rhodobacter sphaeroides
MTTTAGAPIADNQNTLTAGPRGPVLLEDYQLIEKLAHQNRERIPERVVHAKGWGAFGTFTVTNDITRYSCAKVFSEVGKQTDLAVRFSTVAGELGAADHERDVRGFSVKMYTEEGNWDLAGNNTPVFFVRDPMKFPDFIHTQKRHPRTNLRSATAMWDFWSLSPESLHQVTILMSDRGLPVDPMHMNGYGSHTYSLWNAQGERFWVKFHWKTLQGHAHYTNAEAAEIVGRTREGYQEALFGAIEEGRFPKWRLMVQVMPEAEAETTPYNPFDLTKVWPHSDYPLIEVGVMELNRNADNYFAQIEQLAFSPSNKVPGIGYSPDKMLQARVFSYADAHRYRLGTHYEALPVNAPRCPVHHYHKDGQMNFFGHRTGAVDAYYEPNSVPGAAVEDPAVAEPPLRISGDAARYNHREGNDDYSQPRALHDKVMTDEQRARLYANIAEAMAGIPEEIANRAIAQFDRVSPAYGEGI

SEQ ID NO: 7744 - protein, 179 aa, Rhodobacter sphaeroides
MPTRPYVIDQLISPKQIAARVEVLARQITEHFAETEKLVVVGLLRGSFVFIADLVREIHLPVEVDFLEASSYGDAMTSSREVRILKDLRGEIAGRDVLVVEDIVDTGFTLSHVVRLLRSREPKRLEVCALLDKPSRREVDIRATWTGFEIPDEFVVGYGIDFAQRNRNLPFIGKVRFLE

SEQ ID NO: 7745 - protein, 311 aa, Rhodobacter sphaeroides
TMSRAFVFPGQGAQTIGMGRALAEAYPAARAVFDEVDEALGEKLSALIWDGSIEELTLTQNAQPALMATSMAALAALEVEGLGIATASFVAGHSLGEYSALCAAKSLKLSDTARLLRIRGQAMQEAVPVGVGAMAALLGLDYDTAVEVAHEAAQGEVCQAANDNDPAQVVVSGHKAAVERAVEIAKGRGAKRAILLPVSAPFHCALMQHAASVMSEALAAVVIEAPVCPVVVNVRAEAVSEPDRIRALLVAQVTGAVRWRESVMWMENAGVDEFWEIGAGKALSGMIKRIAKGAATRAIGTPEDVAAAATA

SEQ ID NO: 7746 - protein, 301 aa, Rhodobacter sphaeroides
MSVNLSLHPRSVPEPRALLELIQPITWFPPIWAYLCGTVSVGIWPGEKWPLVLLGMVLAGPLVCGMSQAANNWCDRHVDAVNEPDRPIPSGRIPGRWGLYIALLMTVLSLAVGWMLGPWGFGATVFGVLAAWAYSVEPIRLKRSGWWGPGLVALCYEGLPWFTGAAVLSAGAPSFFIVTVALLYAFGAHGIMTLNDFKALEGDRQHGVRSLPVMLGPEVAAKLACTVMAMAQILVITLLVIWGKPIHAGIITALLVAQLFAMRVLLRDPAGKCPWYNGTGVTLYVLGMMVAAFAIRGLEVL

SEQ ID NO: 7747 - protein, 394 aa, Rhodobacter sphaeroides
MAYDVFVVGGGPSGATAADELARAGKSVALLDRAGRIKPCGGAIPPRLIEDFDIPDSQIVARIRTARMISPTGRKVDIPIEGGFVGMVDREHFDEWLRRRAAKAGAERLTGTFLRVERDSFHTYVVWREKATGEEKRSETKLVIGADGAKSDVARAEVPGGDKIPMVIAYHEIIKPPTSSVIDYDPTRCDVIYDGRVSPDFYGWIFPHGETASVGMGTGILGFDLKEATALLRRQAGLDQCETIRKEGAPIPLQPLEKWDNGKDVVLAGDAAGVVAPSSGEGIYYAFVGGQVAARACLAALKSGRATDLQLARKMFMADHKTVFKVLRSMQDAYYRDDERRERFVSLCHDTDVQRLTFESYMNKKLTSKQPWAHIKIGFKNVMHLTRLVSPQWT

SEQ ID NO: 7748 - protein, 177 aa, Rhodobacter sphaeroides
MTEMVPAWVEGRLMPVEKLEAHQRGLRHMAISVFVMAGEAVLIQRRAAGKYHTPGLWANTCCTHPRWGEEAADCAVRRLREELGITGLVTVFADRVEYRADVGNGLTEHEVVDIFVAEAPSDLPVNPDPEEVWETRWVDLTDLAREVKEHPERFTPWLRIYLAEHMERIFGKLRVVQ

SEQ ID NO: 7749 - protein, 558 aa, Rhodobacter sphaeroides
VPLGPWERVEAALTLLAIDPAGLKGLWLRARASALRDRITGALGALPLPVRRIHPTIGDDALFGGLDLAATLSAGTPVVQKGILDEPAVLVLAMAERTLPGLAARLGTALDAPRHCLIALDEGAERDELLPLGLVDRLALFLDLDGLPWGETREIALDPERLAAARARLAAVATPPEAAATLARVAAQLGIASLRAPTLALAAARAQAAWEGHAAVTDEDIRRAADLVFAHRAMPASEEAPPEPEPEPPEDQPDDSPPPPEQQQGEEMFPEEMLVEAVRAALPADLLEQLAAGRAARMARGATGTGSAKAGNRRGRPLPSRMGRLGTGARIDLVGTLRAAAPWQPLRRRQQKTDAVLLVRPSDIRIKRFRETSDRVLIFAVDASGSSAMARLSEAKGAVELLLGQAYARRDHVSLLAFRGRDAELILPPTRSLVQTKRRLAGLPGGGGTPLAHGLRLALAVGLQARARGMTPTVALLTDGRGNIALDGSANRAQAEEDALKLAASLRGSGLPAVVIDTANRPQPSLAALARALDAPYIALPRADAHKLSNVLGAAMGD

SEQ ID NO: 7750 - protein, 518 aa, Rhodobacter sphaeroides
MPSISPASDADRALVIGSGLGGLAAAMRLGAKGWRVTVIDKLDVPGGRGSSITQEGHRFDLGPTIVTVPQSLRDLWKTCGRDFDADVELKPIDPFYEVRWPDGSHFTVRQSTEAMKAEVARLSPGDVAGYEKFLKDSEKRYWFGYEDLGRRSMHKLWDLIKVLPTFGMMRADRSVYQHAALRVKDERLRMALSFHPLFIGGDPFNVTSMYILVSQLEKEFGVHYAIGGVAAIAAAMAKVIEGQGGSFRMNTEVDEILVEKGTATGVRLASGEVLRAGLVVSNADAGHTYMRLLRNHPRRRWTDAHVKSRRWSMGLFVWYFGTKGTKGMWPDVGHHTIVNAPRYKGLVEDIFLKGKLAKDMSLYIHRPSITDPTVAPEGDDTFYALSPVPHLKQAQPVDWQAVAEPYRESVLEVLEQSMPGIGERIGPSLVFTPETFRDRYLSPWGAGFSIEPRILQSAWFRPHNISEEVANLFLVGAGTHPGAGVPGVIGSAEVMAKLAPDAPRARREAEPAERLAAE

SEQ ID NO: 7751 - protein, 118 aa, Rhodobacter sphaeroides
KMKYTKEHEWLRVEGDLVVVGITEHAATQLGDVVFIELPEIETVVAEGDEVAVIESVKAASDISAPMDGEIVAVNEKLVDKPGLVNDDPMAAWFFKMKVDDLSVLDDFMDEDEYQDLI

SEQ ID NO: 7752 - protein, 671 aa, Rhodobacter sphaeroides
DKGTMMFKKILIANRGEIACRVIKTARKMGIQTVAVYSDADRNALHVSMADEAIHIGPPPANQSYIVIDKIMEAIKASGAEAVHPGYGFLSERMDFAAALEAAGVVFIGPPSGAIEAMGDKITSKKLAKEAGVSTVPGYMGLIADADEAVKISNEIGYPVMIKASAGGGGKGMRIAWSEAEVKEGFESSKNEAANSFGDDRIFIEKFVTQPRHIEIQVLADKHGNCVYLHERECSIQRRNQKVIEEAPSPFLDEATRKAMGEQACALAKAVGYASAGTVEFIVDGQKNFYFLEMNTRLQVEHPVTELITGIDLVEQMIRVAAGEKLPFQQSDLKINGWAMESRLYAEDPYRNFLPSIGRLTRYRPPVESVTPTSVVRNDTGVYEGGEISMYYDPMIAKLCTWAPTREAAIEEMRLALDTFEVEGIGHNLPFVGAVMDHPRFVKGDITTAFIAEEYPDGFQGAVLDEPTLRRVAAAAAAMNRVAEIRRTRISGTMNNHERHVGVDWVVALQGESYHVSIAADREGSTVSFSDGSSLRVTSDWTPGQPLASLMVDGRPLVMKVGKIPMGFRLRLRGADLKVNVRTPRQAELALLMPEKLPPDTSKYLLCPMPGLVVKINVAEGDEVQEGQALATVEAMKMENILRAERRGTVKKIAAAPGASLRVDDVIMEFE

SEQ ID NO: 7753 - protein, 226 aa, Rhodobacter sphaeroides
TGASGGIGGGIARALHARATVPSARTGPLEELAAELGDRAHVLACNLSDAAAVEARRQREDWAVTLVTAGITRDQLAMRMSDEDWEQVIEVNLTSTFRLCRGVLRGMMKARWGRIVNITSIVGATGNPGQANYAASKAGVVAMSKSFAAEVASRGITVNAVAPGFIATAMTDKLNDEQKARILGQVPMGRMGAPDDIAAAVLYLASPAAGYVTGATLHVNGGMAML

SEQ ID NO: 7754 - protein, 79 aa, Rhodobacter sphaeroides
  unsure (1)..(79): unsure at all Xaa locations
MSDIADRVKKIVVEHLGVEEEKVTENASFIDDLGADSLDTVELVMAFEEEFGIEIPDDAAETIQTFGDAVKFISEAAXA

SEQ ID NO: 7755 - protein, 417 aa, Rhodobacter sphaeroides
RRVVVTGLGMVTPLACGVEETWKRLLAGQSGAGPIQRFDTSNVTTQYACEIPVGDGSDGTFNADDWMEPKDRRKVDDFILYAMAAATQAVKDSGWEPQSEEDRCRTGVMIGSGIGGLSAIADTAVLIKEKGPKRVSPFFIPSALINLASGQVSIRFGYKGPNHAVVTACSTGAHAIGDAARLIQLGDADVMLAGGAESPISEIGIAGFNACKALSTKRGNEPEAASRPWDADRDGFVMGEGAGVVVLEEYEHARARGAKIYAEVLGYGLSGDAYHITAPSEDGDGGFRSMTMALKRAGLEPSAVDYINAHGTSTMADVIELGAVERLLGEAAAAATMSSTKSSIGHLLGAAGAVEAIFCVLAIRDQVAPPTLNLDNPAVEARIDLAPKAARPRKIDVALSNSFGFGGTNASLVLGRV

SEQ ID NO: 7756 - protein, 261 aa, Rhodobacter sphaeroides
LVLLGCGKMGSAMLEGWLGRGLALSAVWVTDPRPSDWLKSLAARGLHLNEALPDEPAVVLVAVKPQMMSEALPGLAALGEGRVLFLTVAAGTPISYYERTLGAATPVIRAMPNTPAAVGRGITALVGNAAASEAQMALAEDLLSAVGQVVRLEGEHQMDAVTAVSGSGPAYVFHLIEALAAAGEAEGLPADLAMTLARATVTGAGELAHRAPESASQLRVNVTSPGGTTAAALGVLMDPESGLPPLLRRAVKAAADRGREL

SEQ ID NO: 7757 - protein, 232 aa, Rhodobacter sphaeroides
MTAIVSVRDLVKTYDTGFRALKSVSLDIREGEILALLGPNGAGKTTLISTICGIVRPTSGQVTVGGHDIASDWRAARAMIGLVPQEIALEPFEKVFRSVSYARGLYGKPPDPAHVERVLRQLSLWDKKDSAIQPLSGGMKRRVLIAKALAHEPRVLFLDEPTAGVDVELRKDMWAVVEDLRAEGVTIILTTHYIEEAEAIADRVGIITGGEILLVEDKASLMARMGRKELKV

SEQ ID NO: 7758 - protein, 331 aa, Rhodobacter sphaeroides
MALITLRQLLDHAAEQGYGVPAFNINNMEQGLAIMEAARACDAPVIIQASRGARSYANDIMLAKMIEALAAIYPEIPLCMHQDHGNNEATCMTAIRHGFTSVMMDGSLKADAKTPADYDYNVDITARVSHMAHWVGASVEGELGVLGSLETGESEAEDGHGAEGKLDHSQLLTDPDQAVDFVKKTQVDALAIACGTSHGAYKFSRKPDGEILAMSVIEAIHKKLPDTHLVMHGSSSVPQELQDIINAFGGAMPQTFGVPVEEIVRGIKMGVRKVNIDTDCRMAMTGQFRRIAQQTPSEFDPRKFLKPAMDAMRDLCKQRLEAFGTAGQAGK

SEQ ID NO: 7759 - protein, 333 aa, Rhodobacter sphaeroides
MTIRVAINGFGRIGRNVLRAIVESGRTDIEVVAINDLGQVETNAHLLRFDSVHGRFPAKVTSGDDWIDVGRGPIKVTAIRNPAELPWAGVDMAMECTGIFTTKEKAAAHLQNGAKRVLVSAPCDGADRTIVYGVNHATLTADDLVVSNASCTTNCLSPVAKVLHDAIGIAKGFMTTIHSYTGDQPTLDTMHKDLYRARAAALSMIPTSTGAAKAVGLVLPELKGRLDGVSIRVPTPNVSVVDLVFEAARDTTVEEVNAAIEAAACGPLKGVLGFTTEPNVSSDFNHDPHSSVFHMDQTKVMEGRMVRILSWYDNEWGFSNRMADTAVAMGRLL

SEQ ID NO: 7760 - protein, 331 aa, Rhodobacter sphaeroides
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 7761 - protein, 467 aa, Rhodobacter sphaeroides
VRTAATMERTGAIGAVLEAMDAPANLRVVARVLGWPFKWLGLPGDPALPPATRALTALGPAYIKFGQILSTRPDVVGPEMALQLQYLQDKLPPFPTSVAKALIEEELHLPVDRVFSEFSEPVAAASIAQVHRARLADTGVEVAVKVLRPGIERAFRTDIDAFYLAAQIIELLSPSSRRLRPTEVIRHFEGVVNGELDLRLESASAGEFAVNTEADAGFQVPKPVWNLSARQVMTIGWAEGLSLADNPALDAAGHNRTELGTRVLSLFLSHALRDGFFHADMHQGNLKVAANGDIIAYDFGIMGRLDEYTRRVYAEIIFGFIQRDYRRVAEVHFEAGYVPADRDIDEFARALRAVGEPIFGMDASRISMARLLAYLFEVTERFGMETRTELILLQRTMVVVEGVARSLDPHINIWQVARPIVEDYIRDNVGPKGCRPRSPADSADPRAVRAAPAATRRGTADPAGPSR

SEQ ID NO: 7762 - protein, 424 aa, Rhodobacter sphaeroides
MSTIIDIHAREILDSRGNPTVEVDVTLESGAFGRAAVPSGASTGAHEAVEKRDGDKSRYMGKGVLEAVAAVNGEIAEMLVGFDATEQVGIDRTMIEMDGTPNKGRLGANAILGVSLAVAKAAAEFTNQPLFRYVGGSSARVLPVPMMNIINGGEHADNPIDIQEFMIMPVAAQNVREAIRMGSEVFHTLKKELAAGGFNTGIGDEGGFAPNISSTREALDYILRSIEKAGYKPGEDIYLALDCASTEYFKGGKYEMKGEGKSLTSAENVDYLAALCADYPIISIEDGCAEDDWEGWKLLTDKLGAKVQLVGDDLFVTNPKRLEQGIKAGVANSMLVKVNQIGSLTETLMAVDMAHRARYTNVMSHRSGETEDATIADLAVATNCGQIKTGSLSRSDRLAKYNQLIRIEEMLGEVAEYAGRSILK

SEQ ID NO: 7763 - protein, 603 aa, Rhodobacter sphaeroides
MCGIVGVLGNHEVAPLLVEALKRLEYRGYDSAGIATVNGGRLDRRRAVGKLVNLSDLLVHDPLAGKSGIGHTRWATHGAATVTNAHPHRAGPVAVVHNGIIENFRDLRAELAEAGFAFETQTDTETVALLTQMHMARGLGPREAAAETLARLTGAFALCFLFEGEDDLLIAARRGSPLAIGHGDGEMFVGSDAIALAPMTDAITYLEEGDWAVVTRAGAEIFDSHGRRVNRATTRIQIDAARIEKAGYKHFMAKEIAEQPVVLADALRHYVQDGRINLPGVDFTGVDRVTLVACGTASYACHVAKYWFEQIAGLPADVDIASEFRYREPVLSPTSWAVFVSQSGETADTLAALRHAGDAVARTLAVVNVPTSSIAREANLALPILAGIEVGVASTKAFTCQLTVLALLALKAAQDRGRIDAAELGRRLDALATLPGLMNHALRLADDIRDLAGELAEAQDILFLGRGPMYPLALEGALKLKEISYIHAEGYASGELKHGPIALIDNRVPVIVMAPRDALFDKTVSNMQEVMARHGKVLLISDARGIEEAGAGCWRTLALPQVADFLAPILYAVPAQLLAYHTAIAKGTDVDQPRNLAKSVTVE

SEQ ID NO: 7764 - protein, 565 aa, Rhodobacter sphaeroides
  unsure (1)..(565): unsure at all Xaa locations
LEKCAANYAALTPLSHLKRAAEVHTDRTALVNGSIRLTYGEYHARVSRLASALAGMGIQSGDVVATLLPNIAAHAEAHFGVPACGAILNAINTRLDLDTVSYILEHGGAKLLLCDTAFLKLAKDACARLEGKAPILVEVCDREAGFSPSGEVLEYEDLMDRGNPWAPLGDAEDEWESIALNYTSGTTGRPKGVVYHHRGAYLSTYGNAIAWRMQLYPVYLTIVPLFHCNGWCHTWMVPMLGGTVVCCRDITATAIYAAIADEGVTHFGGAPIVLNTLINAAPEDRRSFDQVVEVFTAGAPPPAATLAAIEPLGFNVTQVYGLTEVYGPATECIWKPEWDETAGEERSALKARTGVAMATLEGAEVHDTHGQPIPRDTVHLGEIAMRGNMVMKGYYKNPEATAEAFRDGWFRSGDIAFQHPDGYIKITDRAKDIIISGGENVSSVEVEGVIAHHPAVSLCAVVAKPDERWGEVPCAFVELKRGRQATEEEIIAFARERLAGFKTPKQVIFCELPKTSTGKIQKFELRAVAKLAVTETEDARXGAAVIVTGGEAGYRRAAGTQGRGR

SEQ ID NO: 7765 - protein, 628 aa, Rhodobacter sphaeroides
HTMAYASLYKWSLEDPNGFWMKAAEQIDWVSPPSKALFDEKEPFYEWFADGQVNACWNAVDRHVEAGRGKQIAIVHESPITHSSKGITYAELQARVASLAGALRAKGVEKGDRVIIYMPMIPEALEAMLACARLGAIHSVVFGGFAAHELAVRIDDCTPKAIIAASCGLEPSRVVHYKPLLDQAIEEASHKPDFCVIFQREQEVAKLIEGRDVAWHTFQYGVEPAECVPVEGNHPAYILYTSGTTGQPKGVVRATGGHLVALNWTMKAIYDIDAGDVFWAASDVGWVVGHSYICYGPLIAGATTIVYEGKPVGTPDAGAFWRVMQNHKVKTFFTAPTALRAIKREDPQGALIQDYNLRNLKALFLAGERADPDTIVWAQKNVGVPVIDHWWQTESGWAMAANPLGIEALPVKIGSPSLPMPGYDVRVLDEGGHQLEAGQLGAIAIKLPLPPGTLPTLWNAQDRFVKSYLTHFPGYYETGDAGYIDEDGYIYIMARTDDVINVAGHRLSTGAMEEVLASHEDVAECAVIGVTDALKGQSPLGFLCLNKGSNRAAEDVVKECVKLVREKIGPVADFKRACVVDRLPKTRSGKILRGTMVKIADGQEFKMPATIDDPAILDEIRVALEAVG

SEQ ID NO: 7766 - protein, 1144 aa, Rhodobacter sphaeroides
KILIANRGEIAIRVMRAANEMGKKTVAVYAEEDKLSLHRFKADEAYRIGEGLSPVGAYLSIPEIIRVAQMSGADAIHPGYGLLSENPDFVEACDAAGIAFIGPKAETMRALGDKASARRVAMAAGVPVIPATEVLGDDMEEIKRQAAEIGYPLMLKASWGGGGRGMRPITSEAELADKVREGRREAEAAFGNGEGYLEKMIQRARHVEVQILGDKYGAIYHLYERDCTVQRRNQKVVERAPAPYLTEEQRTEICELGRRICAHVNYECAGTVEFLMDMDSEKFYFIEVNPRVQVEHTVTEEVTGIDIVQSQIRIAEGATLAEATGCPSQDDIKLSGHALQCRVTTEDPQNNFIPDYGRLTAYRSATGMGIRLDGGTAYAGGVITRYYDSLLVKVTAWAPTPEKAIARMDRALREFRIRGVATNIAFVENLLKHPSFLDYSYTTKFIDTTPDLFNFKPRRDRATKILTYIADITVNGHPETAGRVRPSAELKDPKAPEPKGAPQPGTRTLLEEKGPQAVADWMAAQTRVLMTDTTMRDGHQSLLATRMRSIDMIKVTPAYAANLGGLFSVECWGGATFDVAYRFLQECPWQRLRDIRARLPNVMTQMLLRASNGVGYTNYPDNVVQEFVRQAAETGVDVFRVFDSLNWVENMRVAMDAVIEANKVCEGTICYTGDLLDPDRSKYDLNYYVGMGRALRDAGAHVLGLKDMAGLLKPAAARVLVKALKEEVGLPIHFHTHDTSGIAGATVLAACDAGVDAVDAAMDAFSGGTSQPCLGSIVEALKHTDRDTGLDIAAIREISDYWGHVRQQYSAFESGLPSPASEVYLHEMPGGQFTNLKAQARSMGLEERWSEVAQAYADANRMFGDIVKVTPSSKVVGDMALMMVAQGLTREEVEDPEVEVSFPDSVVDMLKGNLGQPHGGWPEPILKKVLKGEAPSTERPGAHLPPVDIAAAREKLLSEIKQGDDDPLDTAVDAEDLNGYLMYPKVFTDYRARHRIYGPVRTLPTRTFFYGMEPGEEISAEIDPGKTLEIRLSAVGETSDDGDAKVFFELNGQPRVIRVANRAVKAKTATRPKAQDGNPAHVGAPMPGSVASVAVSAGQKVKPGDLLVTIEAMKMETGLHADRAATVKAVHVGPGAQIEAKDLL

SEQ ID NO: 7767 - protein, 632 aa, Rhodobacter sphaeroides
YIDELNPAQRAAVLALDGPVLMLAGAGTGKTKALTARIVHLLDSGKARPNEILAVTFTNKAAREMKDRVARLLGQVEGMPWMGTFHAISVKILRRHAELVGLKSNFTILDTDDQLRLLKQLIVAANIDEKRWPARMLAGLIDHWKNRAWTPAKVPASEASAYNNRGTELYDQYQQRLRELNATDFGDLLLHVLTIFQSHPDVLEQYRRWLRYILVDEYQDTNVAQYMWLRLLAQTHRNICCVGDDDQSIYGWRGAEVGNILRFEKDFPGAQVIRLEQNYRSTPHILAAASGIIAANAGRLGKTLWTERQEGEKVRLIGHWDGEEEARWIGDEVESFQRGRGGLGPFRLDDMAILVRASHQMRAFEDRFLTIGLPYRVIGGPRFYERLEIRDAMAYFRLAVSPDDDLAFERVVNQPKRGLGDKAQQEIQREARAHGTSLLEGARSLLARGGIGGKGAGQLRAFVDGMDRWHGTTLDRDHDHIRLAEQILDESGYTAMWQADKTPEAPGRLENLKELVKALEQFENLQGFLEHVALIMENETEESVDKVTIMTLHAAKGLEFPVVFLPGWEDGLFPSQRAMDETGLKGLEEERRLAYVGITRAEQLCTISFAANRRVYGQWQSQLPSRFIDELP

SEQ ID NO: 7768 - protein, 664 aa, Rhodobacter sphaeroides
SFALREGRPFPLGATWDGSGTNFAIFSAHARKVELCLFDARGRREIARVALPEYTHEVWHGYLPEVRPGQLYGYRVHGPYEPQAGLRFNPNKLLIDPYALMLQGEVVWHDAVFGYRMGNARADLSFDRRDSAFVMPKCVVVDPAVTWGPDYPPNIPWPETIIYEAHVKGMTAQNAAIPDRVRGSFAALADPRAIEHLVTLGVTAIELMPTQAFFDDRYLIEKGLTNYWGYNTIGFFAPATRYISPGGGVHEFKLMVRRLHEAGIEVILDVVYNHTAEGNHLGPTLSFKGIDNASYYMLGDDPRYYYDTTGCGNTVNLGHQRVLQMVMDSLRYWVEACHVDGFRFDLATSLGRDRQGFNANAVFLDAVRQDPVLSRVKLIAEPWDTGHEGYQLGNFPPGWAEWNDQYRDTVRSYWKGDAGELPGLASQLLGSAGHFDRRGRRPWASVNFITAHDGFTLADTVSYNDKHNAANEEGNRDGHSDNRSWNCGEEGPTEDAEVLDLRDRMRRAMMGTLLISQGTPMLLMGDEVGRSQGGNNNAYCQDNAMNWLKLEGLEPRDAAFLDFTRRLIALRRSRPLLRHPSFLHKAAVGEEPVEVRWLRPDGEEMEPDDWHNPAARTLGLLIRNKPALLALFNSHFEEVPFSLPVRGRGWGLLLDTAAGRVPER

SEQ ID NO: 7769 - protein, 717 aa, Rhodobacter sphaeroides
VPESDVAAIMRGTHGDPFRVLGMHGGGGAPLSVRVFAPQAAEVAVLGQGGEVLAPLERIGAEGFFAGTVPGEEKFPYRLRFVSGPHEWEADDPYRFPEVLGELDEYLLGEGRHYQLYTRLGAHPAEIEGVQGVSFAVWAPNARRVSVVGAFNAWDGRRHPMRKRIGVGVWELFVPGLHTGDLYKYELLGPSGERLPLKSDPLSFAQEAPPATASVVHGLPEAEWHDAGWMQERESRQRRDAPISIYEVHAGSWRQGLDYDALAEELSAYVREMGFTHVEFLPISEHPFTGSWGYQPIGLFAPTARFGPPEGFARLVDRLHRDGIGVILDWVPAHFPSDAHGLANFDGTHLYDHADPRQGFHRDWNTQIYNFGRQEVANFLQASALFWLDRYHVDALRVDAVASMLYLDYSRNAGEWVPNRHGGRENLEAIDFLRGVNERVRLDHPGCITIAEESTAFPQVSRPVEDGGLGFGFKWNMGWMHDTLGYFRRDPIHRKHHQNDLTFGMVYAYSEDFVLPLSHDEVVHGKGSLIGQMAGDRWQKFANLRAYFGFMWAHPGKKLLFMGGEFAQEREWNHDASLDWHLLDDPSHAGMKRLVADLNREYRKRPALHRMDCDPEGFEWIDAGDSENSVLSFLRKAPGEKPVLAVCNLTPVVRSDYRIGVPEGGEWREILNSDAAIYGGSDVGNPGGLQAEEFSWHGRPASLRLTLPPLATIFVTP

SEQ ID NO: 7770 - protein, 717 aa, Rhodobacter sphaeroides
  unsure (1)..(717): unsure at all Xaa locations
RAGRARASRPRPRASLQVARRSRSPCSRASRCGASPRRPSARASSMXRSTRRTAPRSATPTXSIRGRSSPFRRRRTDRRRAGGTGFGSGNPGEGGLGRALRGDPRXAKRDRGRARRRXSAGNERLGDHEAHGALPLAEGPDLGEAARRHRHGDAGAGQGDLCLDPLLLQGRGGCRSRAMRPRPPSCWASARSGXRWPTGWRGSAPWPSGNCATRSSCAWASVPCASSALETFTHIHRLSLRYHISRKTGGLSRIIERGVKGVDFLLRFMLFSIGPLFIELTLVAIIFAVVFGWQYMVVVVATVALYVAFTFKVTEWRVQIRRQMNEQDTDANQKAIDSLLNFETVKYFGAELREAERYDAAMAGYEKAAVKTGQSLAVLNAGQSLLITAGLVAVMVMAAYGVQAGRLTVGDFVMVNAYMIQITLPLGFLGTVYREIRQALVDMGQMFGLLAQPAEVSDAPGARPLAVAGGTVELENVRFGYDAGRTILKGISLRVEAGETVALVGPSGSGKSTIGRLLFRFYDVNEGAIRIDGQDLRAVTQDSLHAQIGVVPQDTVLFNDTIFYNIAYGRPGATPEQVEAAARAAKIHDFILRLPEGYRTMVGERGLKLSGGEKQRVGIARTLLKNPPILLLDEATSALDTQTERDIQDSLREMGEGRTVITIAHRLSTIADADRIVVLEEGRIVEEGRHEQLLARSGRYASMWARQSAEEEDEAAA

SEQ ID NO: 7771 - protein, 390 aa, Rhodobacter sphaeroides
GRVTGIGRGTLSVGGLEQGTALGDRVEICGAGGILGGEVLRLSSHEVTILPDGSPEGLAIGDAVALVGPAEIAPDDSWIGRIVDPLGRPLDGRPLFRGPRARPLRAAAPQAAARRSLGPRLPTGVAVFDTLLPLVQGQRIGLFAGSGVGKSSLLAKFARSVVADVVVIGLVGERGRELREFTERVLGPAGMARAVVVTATSDQSPLVRRRCGWAAMAVAEHFRDQGLHVLLLVDSITRFAEAHREVALAGGEAASMRGFPPSTAHTIMALAERAGPGAEGTGDITAVFSVLVAGSDMEEPVADILRGVLDGHVVMDRKIAERGRFPAIDLLRSVSRALPEAASTAENALIAEARRLLGAWDRAEMMIQAGLYARGSDPLVDAAIRVWPAL

SEQ ID NO: 7772 - protein, 216 aa, Rhodobacter sphaeroides
FLLNRKKSEMVSAAEALPGRPDPIPTAETHFLSGLPLKSPVPAGMAEAVFGMGCFWGVERKFWQVPEGVWLTMVGYAGGYTPNPTYEEVCSGRTGHTEAVRVIYDPSVVSYAMLLKLFWENHDPTQGMRQGNDSGTQYRSAIYTYGPEQAEAARASATAYQGALSAAGRGRITTEILPAPPFYFAEAYHQQYLAKNPAGYCGVGGTGVSCPIGTGV

SEQ ID NO: 7773 - protein, 293 aa, Rhodobacter sphaeroides
LAPLSAGLLAECLVESGRAGGVVNIVHGGAETGALLVRHPGVAKLAFTGSTAVGREIRRATAGSGKSLTLELGGKSPFVVCADADLDAAVEGVVEGVWFNQGEVCCAGSRLLLQEGIAERFLAKLRARMEKIRVGDPLDKSTDMGAIVSARQKARIEELIAGAAREGYRLEQAACPLPAAGHFVAPGFFADTEPAATVAQVEIFGPIAVTTTFRTVDEAVALANNTPYGLAASVWSENINAATELAARIRAGVVWINASNLFDAGAPFGGMKESGFGREGAREGLGAYLRPRT

SEQ ID NO: 7774 - protein, 307 aa, Rhodobacter sphaeroides
DSLSTPRFVGLPSFMRLPMATELQGLDAAIVGLPSDSGAPFRTGARFAPNALRAMSVMLRPINPYRGHINIFEVLRVADAGDATCVPGYEIESLAALERALDAVVEAGAVPFGIGGDHSVSLAGLRAVAKRHGPLGLVHFDSHTDTWDSYFDGKRYSAGTMFRRAIEEGIVDPARSIQVGMRGSLFQPADVSQSVDLGLEVITCDEMFALGLPETARRIAARSAGHPAFLSFDLDFVDPAYAPGVETPECGGPTARETLSLLRSLQGLNLVGCDVVELNPSYDGPGQITALLGATVMAELLAILAEA

SEQ ID NO: 7775 - protein, 261 aa, Rhodobacter sphaeroides
MDLGIRGKTALVLGAGGGLGGAIARSLAREGARVALGDIDLAAAEATAEAIRAEGGTALPLAWDLADLGAIETNVSLIEAELGPVDILVNNTGGPKPSPIAGQEAALWRASFESMVLSVISITDRVLPGMKARKWGRIITSTSSGVVAPIPNLGLSNALRISLVGWSKTLAREVGRDGITANVVLPGRVATKRITFLDEQKAAREGRAVAEVAAESVASIPLGRYGQPEEYGDAVAFLASARASYITGSTIRIDGGLIASV

SEQ ID NO: 7776 - protein, 542 aa, Rhodobacter sphaeroides
MSAKEVRFGTDARGRMLKGINTLADTVKITLGPKGRNVILDTSYGAPRITKDGVTVAREIELSDRFENVGAQMVKEVASRTNEEAGDGTTTATVLAQAIAKEGMKAVAAGMNPMDLKRGIDRAVAIVIAEIRSMSRPVGDSAEIAKVGALSANGEAAIGRQIADAMAKVGTAGVIKVEENKGLETETEVVEGMQFDRGYLSPYFITHAQKMVVELDDCAILLHEGKLTSLASMVPLLEAVVQAEKQLLVVAEDVEGEALTTLVVNKLRGGLKVAAAKAPGFGDGRAAMLEDLAVLTGAHLISAELGTKLETVTLDMLGFAKKVVLTKDSTILIDSAGDKAAIASRIGQIRNQIEDTTSAYNKEKLQERLARLAGGVAVIRVGGATEIEVKERRDRVEDTLNATRAAVQEGVVPGGGAALIHAGKALAGLKGDNPDQDAGIKIIRRAIQAPLRQIADNAGIDGSVVAGKVIENDSATFGFDAQLETYGDMLQAGIIDPTKVVRIALEDAASIAGLLITTEVIIAHKPERGERMSQMDEMGGMM

SEQ ID NO: 7777 - protein, 1394 aa, Rhodobacter sphaeroides
FDEIKISLASPERILSWSYGEIKKPETINYRTFKPERDGLFCARIFGPIKDYECLCGKYKRMKYRGVVCEKCGVEVTLQKVRRERMGHIELAAPVAHIWFLKSLPSRIGLMLDMTLRDLERILYFENYVVIEPGLTDLTYGQLMTEEEFLDAQDQYGADAFTANIGAEAIREMLSAIDLEQTAETLREELKEATGELKPKKIIKRLKIVESFLESGNRPEWMILTVLPVIPPELRPLVPLDGGRFATSDLNDLYRRVINRNNRLKRLIELRAPDIIVRNEKRMLQEAVDALFDNGRRGRVITGTNKRPLKSLSDMLKGKQGRFRQNLLGKRVDFSGRSVIVTGPELKLHQCGLPKKMALELFKPFIYSRLEAKGLSSTVKQAKKLVEKERPEVWDILDEVIREHPVLLNRAPTLHRLGIQAFEPILIEGKAIQLHPLVCSAFNADFDGDQMAVHVPLSLEAQLEARVLMMSTNNVLSPANGAPIIVPSQDMVLGLYYTTMERRGMKGEGMAFSSVEEVEHALAAGEVHLHATITARIKQIDEEGNEVVKRYQTTPGRLRLGNLLPLNAKAPFELVNRLLRKKDVQNVIDTVYRYCGQKESVIFCDQIMGMGFREAFKAGISFGKDDMLIPDTKWPIVNEVRDQVKEFEQQYMDGLITQGEKYNKVVDAWSKCSDKVAGEMMAEISAVRYDDAGAEKEPNSVYMMSHSGARGSPAQMKQLGGMRGLMAKPNGEIIETPIISNFKEGLTVLEYFNSTHGARKGLADTALKTANSGYLTRRLVDVAQDCIVRTHDCGTENAITASAAVNEGEVVSPLAERVLGRVAAEDILVPGSDEVIVARGELIDERRADLVDQANVASVRIRSPLTCEAEEGVCAMCYGRDLARGTLVNIGEAVGIIAAQSIGEPGTQLTMRTFHIGGIAQGGQQSFLEASQEGRIEFRNPNLLENANGEQIVMGRNMQLAIIDEAGQERATHKLTYGAKVHVKDGQTVKRATRLFEWDPYTLPIIAEKAGVARFVDLVSGISVREDTDEATGMTQKIVSDWRSTPKGGDLKPEIIIMNPETGDPMRNEAGNPISYPMSVEAILSVEDGQTVRAGDVVARIPREGARTKDITGGLPRVAELFEARRPKDHAIIAENDGYVRFGKDYKNKRRITIEPVDDTLNSVEYMVPKGKHIPVQEGDFVQKGDYIMDGNPAPHDILRILGVEALANYMIDEVQEVYRLQGVKINDKHIEVIVRQMLQKYEILDSGETTLLKGEHVDKAELDEVNQKAMDHGMRPAHAEPILLGITKASLQTRSFISAASFQETTRVLTEASVQGKRDKLVGLKENVIVGRLIPAGTGGAHLARQEDRARPRPEGDRHPPGRGRIRGGAGGADGRGDRSRLRGLGAGGNGGE

SEQ ID NO: 7778 - protein, 596 aa, Rhodobacter sphaeroides
LHRNATAFPRQPAYREKEFGIWQVWSWAEAASEIRAIALGFLALGMQRGDHVAVVGRNRPALYWSMVAAQMCGAVPVPLYQDAVAEEMVYVLDHCGARFVICGDQEQVDKVIEVQDRIHHIEQVVYVDKRGMRKYDHSRMNWLEDVVAEGRAAHRRFDEELDRRIAELDYGSTCVMLYTSGTTGKPKGVVLSNRNIIETSKNSVAFDGLRPGDEVLAYLPMAWVGDFIFSVGQAMWTGFCVNCPESATTMMNDLREIGPTYFFAPPRVFEGQLTNVMIRMEDAGRIKKALFRHYMEVARRVGPAILDGRPVSTADRIAYWIGDKLIYGPLKNTLGFSRVRVGYTAGEAIGPEIFDFYRSLGINLKQLYGQTEASVFITQQPDGQVRSDTVGVPSPGVEVRIAETGEVFYRSPGTFVAYYKNPESTASTKDAEGWVATGDAGFFEEATGHLRIIDRAKDVGKMADGRLFAPKYVENKLKFYPSILEAVVFGNGRERCTAFLNIDLAAVGNWAERNNIAYSSYQELAGHPKVYEMMKGHVEEVNRSVAEDPMLSGCQIHRFLILHKELDADDGEMTRTRKVRRKVIEEKYHDLIAALY

SEQ ID NO: 7779 - protein, 366 aa, Rhodobacter sphaeroides
  unsure (1)..(366): unsure at all Xaa locations
IRPQPGILDIALYEGGKSHVAGIQNALKLSSNENPFGPSPKAKEAFLRSVHTLHRYPSTDHAGLRHAIAEVHGLDPARVICGVGSDEIITFLCQAYAGPHTDVVFTEHGFLMYRISALAVGANPVEVPERERTTDVDAILAACTPHTRLVFLANPNNPTGTMIGQADLARLAAGLPAQAILVLDGAYAEYVPGYDAGLALIEERGNVVMTRTFSKIYGLGGLRVGWGYGPKAIIDVLNRIRGPFNLSTTQLETAEAAVRDQDHVARCRADNARWRIWLAEALAEIGVPSDTSMANFILARFSDTEEAEACDLHLQTQGLIVRRVAGYKLPHCLRITIGDEASCRRVAHAIGQFKRMRXWPSTNALR

SEQ ID NO: 7780 - protein, 258 aa, Rhodobacter sphaeroides
LATWNINSVRLREALVSRLLTEEMPDILCLQECKSPVEKMPLEAFRALGYHWCVARGQKSYNGVAILSKLPLVDAGDHDFADLGHARHVSAALENGVTIHNCYVPAGGDIPDREQNVKFGQKLDYLTRMRDWCRADTPKKAILVGDLNIAPREDDVWNHKSLLKIVSHTPIEVDHLNALMEAGAWIDVTRKDLPEGRLYSWWSYRSPDWEAADKGRRLDHIWATPDIVNAAHGSRILKAARGWLQPSDHAPVFATFDL

SEQ ID NO: 7781 - protein, 236 aa, Rhodobacter sphaeroides
PNPLLPENRPATAARVRETGADFGVAWDGDFDRCFFFDHEGRFIDGEYVVGLLAEAFLARHPGATVIHDPRIIWNTQDVVARAGGRAVQTRTGHAFIKQAMRDEAALYGGEMSAHHYFRDFYHCDSGMIPWLLVAGLVSRHGRLADLVADRRAAFPSSGELNFVLEDPAAAMARVRQAFAPEARAVDEMDGLGFDLGSWRFNLRSSNTEPVVRLNVEAKGKPELVAQGVTAVKALL

SEQ ID NO: 7782 - protein, 656 aa, Rhodobacter sphaeroides
SNLKKIIIDGIEVEVDGAMTLLQAAEEVGIEIPRFCYHERLSIAGNCRMCLVEVVGGPPKPTASCAMQVRDLRPGPNGEAPVVKTNSPMVKKAREGVMEFLLINHPLDCPICDQGGECDLQDQAMAYGVDFSRYREPKRASENLNLGPLVATQMTRCISCTRCVRFTTEVAGITQMGQTGRGEDSEITSYLNQTLDSNLQGNIIDLCPVGALTSKPYAFTARPWELGKTESIDVMDALGSNIRVDTKGREVMRILPRNHDGVNEEWISDKTRFVWDGLRRQRLDTPYIREAGKLRKASWGEALKAVAAAMKGRKVAGLVGDLAPVEAAFSLKMLIEGMGGRVECRTDGARLPAGNRSAYVGNAAIEDIDNAKSILLVGCNPRDEAPVLNARIRKAWLQGAQVSVIGPAVDLTFDYNHAGTDRAALMSLVSEAERSGADGKPGLVIVGQGALAEADGEAVLAQAMKLAQTMGAKLLVLHTAAARVGAMDVGAVTEGGLSAAIEGAEVIYNLGADEVEIGAGPFVIYQGSHGDRGAHRADVILPAAAYTEENGLFVNTEGRPQLAFRAGFPPGEAKENWAILRALSAELGQTLPWDTMAGLRRKLVETVPHLGRIDQLTESEWQPLPLRDPATADFRLAVRDFYLTNPIARASQLMAE

SEQ ID NO: 7783 - protein, 639 aa, Rhodobacter sphaeroides
KILIANRGEIAVRIAATARRLGVATVAVHSDADAEALHVAVADEAVPIGGPQPADSYLRGERLIEAALATGAEAIHPGYGFLSENPEFVEAVEAAGLVFIGPSAAAIRAMGLKDAAKALMAEAGVPVVPGYHGADQEPEHLALMAQDIGYPVLIKAVAGGGGKGMRRVERAEEFAAALASARAEARTAFGNEAVLIEKWIDCPRHIELQVFGDGTDAVHLYERDCSLQRRHQKVIEEAPAPGMTPAMRAAMGEAAVRAARAIGYRGAGTVEFIVDGSAGLSPDRFWFMEMNTRLQVEHPVTEAVTGIDLVEWQLRVAAGEPLPLAQEDIPLRGHAFEARLYAEDVPAGFLPAIGRLDHLRFADGIRADTGVRTGDRISPWYDPMIAKIVAHGPSRASALNRLARALEETEVAGTVTNLAFLRRLAQHPGFAAGEVDTGLIGRDLAALIAPATLAPETVAAALLVAELGETPAPLQGFSLWTPLRRHVRLRHGSEEIAAALTVEAPGRATVELGEARLAARLRPEGWAVAGRPPARVLRIGTQVHVFARTGTVSFEIPDPLDRGTEEAGQGGLTLSPMPGLVREVSVRAGDRVEKGDRLAVIEAMKMEHVLTAARDGTVAEVLVEAGAQVEAGAALVRLE

SEQ ID NO: 7784 - protein, 506 aa, Rhodobacter sphaeroides
YFLAIDAGTGSGRAVLFDETGAEIAASGQEWWHVADPRYPGSMDFDTEGNWAILARCCREVIARSGVDPAEIRAVSATAMREAFVLHDATGREIWACANVDARAGAEVRELKEDHPGLEAQIYARSGQTYALGALPRLAWLRRHAPETLARARSLTMLSDWILYRLSGELTLEPSNGGTTGLLDLRTRAPLTDALATVGLPTDLFPRGVTTGEVVGEVQTAAAAETGLAPGTLVVAGGGDCQTGALGLGIVREGDCAVLGGTFWQQVVNVPLTLTDPTMNLRINPHMVAGLNQAEAISFFVGAVMRWFRDSFGQGRDYTALEADSMQVPPGAHGIIPIFSDVMRYGDWFHAAPSLLNLSLDPAASGPAAIFRALQENAAIVARRNLESVFALTGHRPERLVFAGGAAKSAHWSQILADVTGLTVVTPEVKEATAQGCASAAATGAGHFASLAEAGGAWMRIDRTFTPDPALRPLYDEAGDRWARAYAAQRGLVQDGTATAMWRAPG

SEQ ID NO: 7785 - protein, 523 aa, Rhodobacter sphaeroides
DYIIVGAGSAGCVLANRLSKDPSNRVLLIEAGKRDNYHWVHIPVGYLYCINNPRTDWCFTTEPEEGLEGRSLIYPRGKVLGGCSSINGMIYMRGQAEDYDGWRQMGCTGWGWDDVLPLFRRQQDHHRGESEHHGAGGEWRVERARVRWAVLDAFLDAAEQAGIPRTEDFNRGSNEGGGYFDVNQRSGIRWNTAKAFLKPALSRPNLRVVTEAQVERLIVEAGEVRGVLYRQGGTLHEARARRETVLAAGAIGSPHILELSGIGDPEVLRAAGVEPQVAVPGVGANLQDHLQLRLVFKVRGVPTLNEKATSLFGRAAIGAEYLLRRSGPMSMAPSQVGIFTRSGSEKATPDLEFHVQPVSLDKFGDKVHPFPGMTASVCNLRPESRGSVHLKSPDPARQPAIAPHYLSTEGDREVAVRSIQIARHIASQPAFARFHPEEYRPGAEHDTREALVAAAGRIGTTIFHPVGTCRMGSDPASVVDPRLKFRALGGLRIADASIMPAITSGNTNSPTLMIAEKAAEMIL

SEQ ID NO: 7786 - protein, 145 aa, Rhodobacter sphaeroides
  unsure (1)..(145): unsure at all Xaa locations
IYILNGPNLNLLGQRQPEIYGHETLADVERRCAAVAAEKGFSVRLFQSNHEGAIVDQIHEARQAACGIVINPAAYTHTSVAILDALNAFEGPVIECHISNVHKRESFRHHSYVSLRADGVLAGFGIEGYELAVRRICSLCAGGXA

SEQ ID NO: 7787 - protein, 357 aa, Rhodobacter sphaeroides
IRTHRIAAIPGDGIGIEVVAAGLEVLEALADRDGGFRFDVESFDWGTDRYRRTGAFMPEDGADRLRGFDAILFGAVGAPDVADHLTLWGLRLAICQPLDQYANVRPTRMLPGIRSPLRHVGESELDWVIVRENSEGEYAGQGGRSHPGLPLEVATDVSIFTRAGVERIMRFAFRLAQSRPRKLLTVVTKSNAQRHGMVLWDQIAGEVAREFPDVRWDKMLVDAMTVRMVQKPASLDTIVATNLHADILSDLAAALAGSIGVAPTANLNPERDTPSMFEPIHGSAFDITGRGIANPVATFWTAAMMLEHLGEAEAAGRLMTAVGRVTADEDLHTPDLGGRATTRQVTDALIAALRGRN

SEQ ID NO: 7788 - protein, 356 aa, Rhodobacter sphaeroides
MADNHLKIAVIAGDGIGKEVVPEGLRVLEAVAGRHRIDLRFEEFDFASCDYYARHGQMMPEDWQERIGGHDALFFGAVGWPATVPDHVSLWGSLIQFRRQFDQYVNLRPARLMPGVPSPLAGRGPGDIDMWIVRENTEGEYSAIGGRMYPGTEREIVLQETVMSRHGIDRVLRYAFELANRRERRRLTSATKSNGISITMPYWDERVEAMAQDYPDVAWDKYHIDILAAHFVLNPDRFDVVVASNLFGDILSDLGPACTGTIGIAPSGNINPERAFPSLFEPVHGSAPDIAGQGIANPVGQIWAGAMMLDHLGHGEAAAEIMAAIERVLADPRLRTRDLAGAADTVTCGKAIVEAL

SEQ ID NO: 7789 - protein, 506 aa, Rhodobacter sphaeroides
  unsure (1)..(506): unsure at all Xaa locations
PSRRRRQPLXSRLWXPPARGRAAPRLPTASSPPWPRKANGSATRASRRAPRTSIWSRCMATASPVTRGDRCFTPRARPEAARAEHDRRARGRPEHIHARRGRFGRTDMTQVFICDYIRTPIGRYGGALSPVRADDLGAVPLKALMARNGGVDWEAVDDVIFGCANQAGEDNRNVARMSALLAGLPVGVTGTTINRLCGSGMDAVLTAARQIAAGEADLVIAGGVESMSRAPFVLPKAGTAFTRSAEIHDTTIGWRFVNPAMEAAYGVDPMPQTGQNVACDFGISREAQDAMALASQTKAAAAQANGRLAQEITPVLVPQRRGEPVRVEQDEHPRATTPEALAKLKPLFAGGSVTAGNSSGVNDGAAALILASEAAVRRHGLTPMARVLGGATAGVPPRIMGIGPVPATRKLMARLGLTTEAFDVIELNEAFAAQGVATLRQLGIAEEDARVNPNGGAIALGHPLGMSGARITGTAALQLQRTGGRRALSTMCIGVGQGIAIALERV

SEQ ID NO: 7790 - protein, 415 aa, Rhodobacter sphaeroides
VLTHAEGIYVHTEDGRRLIDGPAGMWCAQVGYGRREIVDAMAHQAMVLPYASPWYMATSPAARLAEKIATLTPGDLNRIFFTTGGSTAVDSALRFSEFYNNVLGRPQKKRIIVRYDGYHGSTALTAACTGRTGNWPNFDIAQDRISFLSSPNPRHAGNRSQEAFLDDLVQEFEDRIESLGPDTIAAFLAEPILASGGVIIPPAGYHARFKAICEKHDILYISDEVVTGFGRCGEWFASEKVFGVVPDIITFAKGVTSGYVPLGGLAISEAVLARISGENAKGSWFTNGYTYSNQPVACAAALANIELMEREGIVDQAREMADYFAAALASLRDLPGVAETRSVGLVGCVQCLLDPTRADGTAEDKAFTLKIDERCFELGLIVRPLGDLCVISPPLIISRAQIDEMVAIMRQAITE

SEQ ID NO: 7791 - protein, 488 aa, Rhodobacter sphaeroides
WHARAKAVALPNRPFIDGQYVDSLSGETFACIYPGDGRPLTDVASCNAADVDVAVRSARKAFEAGVWSRMAPADRRRILLRFSELILANREELALLETLNVGKPIANAYNGDVVSAAACIAWYAEAIDKVYGEVAATAYDMTTLVMREPLGIVAAVVPWNYPMSMAAWKLGPALATGNSVILKPAEQSPFTALKFGELAIEAGMPPGVLNVVPGLGHIAGKALGLHMDVDCVGFTGSTEVGKYFMQYSGQSNIKRIGLELGGKSPQVVLADCDDLDAAAAGIAAGIFANTGQVCNAGSRLIVDEKIHDQLLEKIAAQAKVFAPGDPLDTATRMGSMVSEEQMDRVLGYIDAGRADGARPVIGGGRVKTETGGFYIEPTIFEGVRNDMKIAQEEIFGPVLSAIPVKGFDEAMATANDTVYGLAGAVWTGSVKNAHRAAKSLRAGVVWVNCFDRGSLAVPFGGFKQSGFGRDKSLHAMDKYTDLKAVWFA

SEQ ID NO: 7792 - protein, 514 aa, Rhodobacter sphaeroides
EDRRRRIEAEPLPENIGALIDAAAAEAGDRVVWNFFESGETLTYGEMRRKVNGLAARLVALGIGKGTHVGVMLPNVEAFPLTWLALGRIGAVMLPINPGYTPREIAHVMKVAEADWVVTHDSTRAVLDEAHAAGLIALPAERLIVVGGALGGAHDWAELASEPQDHFTPPEPVGHDDLLNIQFTSGTSGFPKGCMLGQRYWISAGKVNAFRDGRIYRRILASTPFFYMDPQWLLLMTLYQRGTLFVAARQSTSRFSGWLEEHEIDFCLLPWVLHGMAPQQHDAQNRVVRANIYGCPRDLHRGLEERFDLNAREAFGMTEIGPAMFAPIERADKVGSGSCGVPCPFRECRIVGEDGQPVARGEIGELQIRGPGIMLGYYNNPEATAEVLKDGWFSSGDLFRQDEDGFFYIVGRKKDMIRRSAENIAAREVETVLAAAPGVAEVAVVGVPDPLRGEEVKACIRLKEGVVADAAILEGIVATAQAGLAPFKVPRFYAFVEDFPRTASLKIAKPRITE

SEQ ID NO: 7793 - protein, 438 aa, Rhodobacter sphaeroides
ARSNSTGGDPMSSDRKLGFDTLQIHAGAKPDPATGARQVPIYQTTAYVFRDAEHAARLFNLEEVGYIYSRLTNPTVMALAERVAALEGGAGAVCCSSGHAAQIMALFPLMAPGRNIVASTRLYGGTITQFSQTIRRFGWSAKFVDFDDPAAIEAAIDSDTRALFCETIANPGGVITDLDAVSAIADRMGLPLIVDNTTATPWLCRPIEHGATLVVHSATKYLTGNGTVTGGVIVDSGKFDWSASDKFPSLSQPEPAYHGLVFHKALGPMAYTFHSIAVGLRDLGMTMNPQGAHYTLMGIETLSLRMARHVENAQKVAAWLEQDPRVEFVSYAGLPSSPWHGRVARICPKGAGALFTFAVKGGYDACVALVDALQLFSHVANLGDTRSLVIHSASTTHRQLTPEQQVAAGAAPNVVRISIGIEDADDLIADLDQALAKA

SEQ ID NO: 7794 - protein, 551 aa, Rhodobacter sphaeroides
SAARTASIAAKPDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLGRFRGAVPVELTGRSEFPPVGDLPYMLTLPPYGFYWFILSD

SEQ ID NO: 7795 - protein, 208 aa, Rhodobacter sphaeroides
VIFDCDGVLVDSEPTAFALLGEDLARHGLALDHATLEAHFLGGTIPGAAVTARRLGADLPADWVEDFYERLYARLAEGTPLIPHVEEVVAALDQAGIPYAVGSNGSDRKMQVTLGQHPALMARLDGRLFSGQSMDAPKPAPDLYLHAARALGVEPDRCAVIEDSPTGARAARAAGMTCFGYVPDGSPEALVAEGARPFSDMRELPALL

SEQ ID NO: 7796 - protein, 208 aa, Rhodobacter sphaeroides
MQGSANTFVRRPGKEQRNGQHAGKVVAITGASRGIGAAAVRVFAAAGARVALLSRSGAEIEALAAEAGQGAFALTCDVADRASVQTAIDRVVETAGRIDVLINNAGVIEPIARLADADPDAWDRAIDVNLKGVFHGMRAAVPYMRARGGTIITVSSGAAQNALEGWSAYCSSKAGAAMLTRCAHLEEAVHRIRILGLSPGTVATEMQD

SEQ ID NO: 7797 - protein, 328 aa, Rhodobacter sphaeroides
MSLMKALVCVEPGRFEQQDRPRPEAKPGHIRIRILQVGICGTDYHIYGGHQPFLAYPRIMGHELSGRAMEASADGRIAEGDLVVINPYLTCGTCRACRAGKPNCCENIAVLGVHTDGGMCEEIVVPEGNVYGAEGLTEQSAAMVEFLAIGAHGVRRGGVRAGSAALVVGAGPIGIGAALFAAIEGAAVTLRDTSASRLALAQKVLLEARIELVGEEAAEVYDTVFDATGNIRAMNAGLQYVGHGGAYVLLSVVKGDLSFADPEFHKREATLFASRNALKKDFEHVIAQIRNGRVPVEALATHATSFEDAVTNLPLWAEDRGTLIKAII

SEQ ID NO: 7798 - protein, 293 aa, Rhodobacter sphaeroides
GVYIIAATPFTDRGEIDHDSLLSLVDFYIGHGVTGLTILGMMGEANKMTGDERRAVIDTVLSRSGDLPVVVGVSDAGLANLTDLASYAMDKGAAGVMVAPSAGPAREDRIEGYFHAVCEALGPEVPVCFQDFPLATGLPVSPALIRRLSQERDQIVMLKHEDWPGLTKITQLRKQEEAAGVARLSILCGNGGLYLPQELQRGADGAMTGFAYPEALVQTVALHHAGRVDEAEDLFDRYIPILRHEQQPGFGLAVRKYVLMKRGAIASAATRAPGPKMSAVDAAETDRLMARLE

SEQ ID NO: 7799 - protein, 845 aa, Rhodobacter sphaeroides
AFSAAAQAAKARGNPYVELVHLIEALLAADRSDMALLMRAAGCDAGRLSADVARAVDALPRGASAVEEFSDHLFHAIREGWTFGSLRFGDDRVRSGYLLLGALRVPVLEALLMRISGAFGQVDAESLSETFRDLTQGSAEGDAAPPPARPGAADGSALARYATDLTARAREGRLDPVVGRDPEIRQIIDILMRRRQNNPILTGEAGVGKTAVVEGLALRLARGDVPPPLRPVTLWMLDLGLMQAGASMKGEFEKRLKSVIDEVHASDAPVILFIDEAHTLIGAGGAAGTGDAANLLKPALARGELRTIAATTWAEYKQHIEPDPALTRRFQVVRIEEPSEEAAIRMCRGVAAVLERHHRVEILDEAVGAAVRLSQRYLPARQLPDKAISLLDTACARVAVSQHATPAEVEDIDRRAQALALEAGILEREEAVGMDVTARRGEVEAARTAVAADRAAAEARWEAEKALVAEILELRARLRAEGDALDGTAAQAAEEAEPPKDDRAALLDRLRRCSRDLAEAQGERPLILPTVDRQAVASVVQDWTGIPMGRMLASRNERALGLADLLARRVVGQDHAMEAIASRIQTAQAGLGPPEKPLGVFLLCGPSGVGKTETALALAEQLHGGEQALITINMSEFQEAHTVSTLKGSPPGYVGYGKGGILTEAVRRKPYSVILLDEVEKAHPDVHEIFFQVFDKGRMDDSEGRQIDFRNTVILLTSNVGTDEIVEAAGQDLARVSATLRAPLLQVFPAALLGRMIVLPFLPLSDRMIAAIAGQKLEAIARRLKAGHGAELVLGEGVLETIRARCTEVESGGRMIDAILSGTLLPELSRKLLERQLAGAAFSRV

SEQ ID NO: 7800 - protein, 270 aa, Rhodobacter sphaeroides
ILNHTYEIEGVLGRGGTGEIYRARNLISGRIVAVKALNRRFSGNDDYIGLMRREEQLRDVIDDAVVRYTECSRSDGGHVFLVMDHIEGPSLAQAMEAGRIEARDLLIVAHRVAEGLRAAHRHGIVHRDLSPDNIILRGGAPERATIIDFGIAKDLSAGAQTIVGNDFAGKYEYAAPEQIDGRAEPRSDLYALGATLLAAFRGEAPFAGATPGEIVRRKGRPLDTEGVPEPLRGLIDRLAAPEAERRPASAAAVVEELDRLLRPQAEPDRR

SEQ ID NO: 7801 - protein, 1193 aa, Rhodobacter sphaeroides
MHGEVSGPAGTPGYSIAIVTLDAHAAGPAARIAPRLQQDFPGLTLSIHAAAEWAEKPEALAAAREAIGRADIVIANLLFIEEHINAVLPELQAARERVDAFVGMIADPSIVKLTKMGDLDMQKPASGPMALLKKLRGASKEQGNSGESQMRMLRTIPKMLKFVPGKAQDLRAWFLSMQYWLGGSDDNLEQMVRYLVSRYSANRAWHRIHAKAPIEYPEVGLYHPSLPDRITTDPNDLPRPAGAKVTVGLLMLRSYILASDTAHYDAVIEAFERKGIAVLPAFAGGLDGRPAIDAYFHDKLGTTIDAMVSLTGFSLVGGPAYNDSHAAIEALKGLDVPYIAAHPLEFQTLGQWAQAGGGLGPVETTMLVALPEIDGATNPTVFAGRHDLSGCTGCPGGCKATAQAAECRAMSPCHERIQTLAEKTLRLALLRRSKIAERRVGVVLYGFPPNAGAVGTAAYLAVFESLFNVLNAMKREGYQLEVPESVQALRDAVLGGTASQYGQPANIAAHVSAEKIVSGTPWLADIEKAWGAAPGRIQSDGRGVYILGQQFGNVFVGVQPVFGYEGDPMRLLFEKGFAPTHAFSVFYRWLREDFGADVLLHFGMHGALEFMPGKQAGMSGACWPDRLIGALPNVYLYAANNPSEASLAKRRSNAITVTHLTPPLAKAGLYRGLQDLKDSLTRYRQLAPDAPEREELSLLIGEQARAVNLDMVDVDTMWLKLLETEGSLITDGLHVVGRPMTEEQIADNIALMPEMSSERRAEVEGMLRQETEIAGLLRALGGHYMEPVPGGDLIRAPEILPTGRNIHAFDPFRMPTAYAIQDGAAQAQRLLDAHPKLPETVALVLWGSDNIKSDGGPIAQALALMGARPRFDHYGRLAGADLIPLSELGRPRIDVIMTLSGIFRDLLPLQTRMLAEAAWKAANAEGEPLAQNFIRAHALSYAQEMGVDMETASLRVFSNAEGAYGSNVNVLVGSSAFGEEDELADAYEARKSFAYGRSGKPVQNAALLQKSLKTVDVAYQNLESVELGVTTVDHYFDTLGGIARAVKRARGEEASVYIGDQTRGGGTVRTLKDQIALETRARSLNPKYYEGLLKHGAEGVRQIEAQVTNTLGWSATTQQVEPWVYQRLSETFVLDEAMRRRLAELNPEASVRMAERLLEASARNYWQPDAETLAALQGAADELEDRLEGIAAE

SEQ ID NO: 7802 - protein, 531 aa, Rhodobacter sphaeroides
MKLTLWTYEGPPHVGAMRVATGMTGMHYVLHAPQGDTYADLLFTMIERRGKRPPVSYTTFQARDLGSDTAELFQSACRDAYERFQPQAIMVGSSCTAELIQDDTGGLADALSLPVPVVHLELPSYQRKENFGADESFLQICRKLARPMERTEKVSCNLLGPTALGFRHRDDILEVTRLLEGMGIAVNAVAPMGASPADIARLGAAHFNVLLYPETGESAARWAEKTLKQPYTKTVPIGVGATRDFVAEVAALAGVAPVADDSRLRQPWWSASVDSTYLTGKRVFLFGDATHVIAAARVARDEMGFEVVGMGCYNREFARPMRAAAKGYGLEALVTDDYLEVEEAIQALAPELILGTQMERHIAKRLGIPCAVISAPVHVQDFPARYSPQMGFEGANVLFDTWIHPLTMGLEEHLLTMFREDFEFHDEAGPSHHGGKAVPASAPRADEAAEALPLTGAETAEGGSIPPEAVPPAEAAAVPAGEIVWLTDAERELKKIPFFVRGKARRNTEKFAAEKGLTRISLETLYEAKAH

SEQ ID NO: 7803 - protein, 428 aa, Rhodobacter sphaeroides
MSLDLPPPPARGCRSTEVLKERGQREVFCGLTGIIWLHRKMQDAFFLVVGSRTCAHLLQSAAGVMIFAEPRFGTAVLEEKDLAGLADANAELDREVDRLLARRPDIRQLFLVGSCPSEVIKLDLHRAAERLSAHHGPAVRVYNFSGSGIETTFTQGEDACLASIVPTLPATEARELLLVGALPDVVEDQAVSLLTQLGIGPVRCLPAHHAAEAPGVGPNTVFALVQPFLGDTHGALTRRGARHIAAPFPFGEEGTTLWLKAIADEFGVSADTFEAVTAAPRARARKAVAAASEGLRGKSVFFLPDSQLEPSLARFLTRECGMSAVEVGTPFLHRGILGPDLDLIAEGPVLSEGQDVERQLDRVRAARPDLTVCGLGLANPLEAEGFTTKWAIELVFTPVHFYEQAGDLAGLFSRPVRRRAILRREAAE

SEQ ID NO: 7804 - protein, 525 aa, Rhodobacter sphaeroides
DISERLEREESLKKARNDALKGEEAKSRFLAVMSHEMRTPLNGLMAASDLLQTSTDLTDRQRWLTDIVIGCGSAALDQVNNVLELTRLSDKDGASYARTVFSPVDLIEGLIRQNQPQADKRGNKLWFAQPKNPVPPVLGQRHLFLRVMYNLIGNAIKFTDNGKVSVELLWHPGRTSGTVDLCIHVGDTGIGIAEEHLDTIFRNFETLDASYGRIREGTGLGLGIAKLAAETMGGQIDVQSKLGLGSVFTLRLQLPVAQGAEAAQEEFAEDAPSAGDGARAILVVDDNAINRQLLAEILRMAGHEVATAEDGAEAAEAAGARRFDLILMDVSMPRVDGLEATRRIRRAGASTDTPILGATAHADPDRVPDFLAAGMNDVLVKPITRSALFRAIRQFTETSAAVEEVLPAGDPPPDDLPLIDAELRADLEGNLGPDYIAGMIGRVLSETGDALPEMRRLHEAGDHLAAAKLAHRTAGAAAAVGLMALHRSLASYETAADASNTAEAARALESLPATLERTAAACQAT

SEQ ID NO: 7805 - protein, 214 aa, Rhodobacter sphaeroides
LVIFDCDGVLVDSEVLAVAVLIAELDRAGARVDEAFVHRHFLGRSFPVVQEVVQRQFGVTLPETFQAGERARLLAAFETGLRAMPGAAETVRALAVPFCLATSSTPARLTRSLEITGLAALFEGRCFTASQVARGKPAPDLFLLAAAEMGVAPARCLVIEDTEPGVRAGLAAGMQVWRFTGGSHFANRSPEDAPDARPHRRFDSFDRFYETLPG

SEQ ID NO: 7806 - protein, 256 aa, Rhodobacter sphaeroides
MRLDGKTALITGSARGIGRAFAEAYVREGARVAIADINLEAARTTAAEIGPAACAIGLDVTDQASIDRCVAELLDRWGRIDILVNNAALFDLAPIVEITRESYDRLFAINVSGTLFMMQAVARAMIAGGRGGKIINMASQAGRRGEALVGVYCATKAAVISLTQSAGLNLIRHGINVNAIAPGVVDGEHWDGVDAKFADYENLPRGEKKRQVGAAVPFGRMGRAEDLTGMAIFLATPEADYIVAQTYNVDGGNWMS

SEQ ID NO: 7807 - protein, 608 aa, Rhodobacter sphaeroides
ITVNGRPLEVEGSKDLLTTCLSAGIEIPHFCWHGDLGSVGACRLCAVRVHDGPEDTEGRIEMACMTPVREGQRIEVMDPEAERFRARIVEWLMVNHPHDCAVCEEGGACHLQDMVVASGHHRRRAEVAKRTHRNRDHGPFLTQEMNRCIGCYRCLRFYRDYAGGRDFEVLGAHDRVWFGRTEPGALDSPFAGNLAEVCPTGVFDDRWWSRHYARPWDMAETPSICANCAVGCNITLFERGGTLRKVQNRTHGAINGSFLCDRGRFGALAAEAARPTHPTRKGAGILWTEAIEAARALVARGAIGIGSPRACLETNFALRRLVGEDRFFAGCSASEAALVARMAAILRQGPAGIAAIRDIERADAVLVLGEDLTGTAPRAALALRQAARGAERRLAAEKGVPDWMDAAVRVAGEGRRSPVAVVTPLPDALDEVALWPLRRTPAEVGAFGHAVAAALRGEEAAPDARAVAEALVAAEVPVVIAGAGLGLAAPAEAAAAVAAALGARARIALFPPEAGSLGLALLGGTGLERAVAELEAEPRPVILLDASLPDRAPAELVERLMAAATEVMLLDWLDGPLAPQADLLLPVTAPAETSGTYINHEGRAQRFF

SEQ ID NO: 7808 - protein, 747 aa, Rhodobacter sphaeroides
AEQIWDMKYRLKDGAGHPVDGSVEDTWRRIARALAEVEAEPALWEDRFYSALEDFRFLPAGRITAGAGTGRTVTLFNCFVMGTVPDSMAGIFDALKEAALTMQQGGGIGYDFSTIRPRGAEVKGVAADASGPLSFMDVWDAMCRTIMSAGSRRGAMMATMRCDHPDIESFIEAKKDPARLRMFNLSVLVTDAFMEAVKADGPWELTFGGKVYRTLQARDLWNRIMRSTYDFAEPGVIFIDRINQMNNLAYCETISATNPCGEQPLPPYGACLLGSVNLARLVAKPFSDGAELDLAELDELVRLAVRMMDNVVDASRFPLPEQAREAQMKRRIGLGVTGLADALLMVGLRYGSEEAAARTEAWMKAIARSAYLASADLAREKGAFPLFEADKYLGSGSLTHMDEDVRAAIRTHGIRNALLTSIAPTGTISLYAGNVSSGIEPVFAYAYKRKVLQKDGSRTEEEVVDYAVRLWREQMGDAPLPDYFVNAQTLAPLEHVRMQAAAQKWIDSSISKTINCPEDIGFEEFADVYLAAWDQGCKGCTTYRPNEVTGSVLSVSEAGQAAPAEAPEPKGGEVVYLTDPLDRPAALEGATYKVKWPGSEHALYITVNDIVISGHRRPFEVFINSKNMEHFAWTVALTRMISAVFRRGGDISFVVEELKAGLRPPRRRLDGGALIPSILAAIGGVIERHLIAIGFIEGEGMGLKTDPHADVQVLGVKAKACSSCGSYDLRMVEGCMTCASCGFSKCG

SEQ ID NO: 7809 - protein, 210 aa, Rhodobacter sphaeroides
FQGFEVPRQGSQTVLDVVSWIQQNLDPTLTYRYACRVGMCGSCAMMVNGVPRWTCRTHVNKVDQGGALTIGPLRNLPVIKDLAADMDPFFEKWVKAEGLFHPARTRHEEVARVDPASEARRTADRAIECINCSVCYAACDTVAGNPDYLGPAALNRAWSVVNDERDAGRAEVLAAVSVSGGCHNCHSQGSCTRHCPNELSPLDSIAGLKR

SEQ ID NO: 7810 - protein, 527 aa, Rhodobacter sphaeroides
ETDILILGSGGAGLFAALHAQQSAPTGTRITIAVKGLLGKCGCTRMVQGGYNVALGAGDTVERHFMDTIHGGKWLPDQDMAWRLCQEAVTRVRELENEVGCFFDRNPDGTLHHKAFAGQTADRTVHKGDLTGIEIINRLMEQVLARPIERLQEHRAVGLIPAEGGGAISGVLFIDMRTGRFRFVRAKKVLMATGGGPTMYKYHTPSGDKTMDGLSMALRLGLPLRDMEMVQFHPTGLLAGPGTRMTGTVLEEGLRGAGGHLLNGHGHRFMYDHDAAGERATRDVVSRGIYAEMRKSNTSENGGVYISMAHLGPDDVRRRFKGMVKRCADCGFDLAGGLVEVVPTAHYFMGGVVVDPDTRTEIDGLHVAGEDAGGAHGANRLGGNGVANSTVFGGIAGDVMGAEVASIRHLRPADEAVLAAEIDRAMAPLSKRPGQVQVLREALQEAMWEDVGVLRTGAGLERGLTRVAAIGAELAETGVDGANLAFNLTWHDWLNMRSLVDISEAIATAGLARENSRGAHYREDHPE

SEQ ID NO: 7811 - protein, 442 aa, Rhodobacter sphaeroides
MKDWLRKHPQVRTIRVAAADLNGQARGKRIPARFADKVVKDGTRFPFSVLNLDIWGEDIDDSPLVFEQGDADGILRPTERGFMPMPWLEAPTALLPIWMFREDGRPYEGDPRHALRAVLDRYKARGLTPVVAVELEFFLIDDSGKTLQVPPSPRSGKRRKAAEALSIRALDAFDIFFTDLYDACEEMDIPADTATSETGLGQFEVNLMHCDDALRAADDAWFFKLLVKGLARRHGFAASFMAKPYPEYSGSGLHMHFSVLDAQGRNVFDNGGPTGTAMMRHAVAGCLNAMHDSTLVFAPHANSYDRLVPGMHAPTAISWGYENRTTAVRIPAGNPAARRIEHRVAGGDVNPYLLVATILGAALTGIEDQEEPPQAIMGNAYALEDLPQIPPSWEAAIQSFENSAIMPRILPRELIRNYVLTKRQELHYLAELSPEEQVELYL

SEQ ID NO: 7812 - protein, 403 aa, Rhodobacter sphaeroides
  unsure (1)..(403): unsure at all Xaa locations
MANVVVVGAQWGDEGKGKIVDWLSERADVIARFQGGHNAGHTLVIDGKVYKLSLLPSGIVRPGKLSVIGNGVVLDPWHLVQEIAKLRADGVEISPQSLMIAENAVLILPLHGELDRARESQNSVAKIGTTGRGIGPAYEDKVGRRAIRVADLADEATLALRVDRLMVHHDALRRGLGIEPVDREALLAQLREIAPQVLPYAKPVWKVMNEMRKAGKRILFEGAQGALLDIDFGTYPYVTSSNVIAGQAATGTGIGPGAIGFVLGIVKAYTTRVGEGPFPAELQDADGERLGERGREFGTVTGRKRRCGWFDAVLVRQTCATSGVSGIALTKLDVLDGFETLKICVGYELDGERLDHLPIAADQQARCTPIFEELEGWSESTAGARSWADLPGAAXNTSAASRS

SEQ ID NO: 7813 - protein, 380 aa, Rhodobacter sphaeroides
NYVFTSESVSEGHPDKLCDRVSDAVLDTFLAEEPTARVACETFATTGRVVVGGEVGLSDPQKLDEFMERVDGIVRDCVKDIGYEQQEFHWRTIEVQNFLHRQSAHIAQGVDKDGAGDQGIMFGYACRETPELMPAPIQYSHAILRRLAEVRKSGQEPDLRPDAKSQLSLRYENGKPVEVRSIVLSTQHAHEEQTSDDIRAIVEPYIREVLPEGWITEATEWWVNPTGTFVIGGPDGDAGLTGRKIIVDTYGGAAPHGGGAFSGKDPTKVDRSAAYAARYLAKNVVAAGLAERCTLQVSYAIGVAKPLSIYVDTHGTGQVDAAQIEKAVADCMDLTPRGIREHLNLCRPIYARTSAYGHFGRAPEADGGFSWERTDLTDAL

SEQ ID NO: 7814 - protein, 418 aa, Rhodobacter sphaeroides
LKGRAEIPGDKSISHRALILGAMAVGETRITGLLEGQDVLDTAKAMRAFGAEVIQHGPGAWSVHGVGVGGFTEPAEVIDCGNSGTGVRLVMGAMATSPLTATFTGDASLRKRPMGRVTDPLALFGTRAYGRKGGRLPMTLVGAADPVPVRYTVPVPSAQVKSAVLLAGLNAPGQTVVIEREATRDHSERMLRGFGAELSVETGPEGQVITLTGQPELRPQTVAVPRDPSSAAFPVCAALIVEGSEILVPGVSRNPTRDGLYVTLLEMGADIAFENEREEGGEPVADLRVRASALKGVEVPPERAPSMIDEYPILSVVAAFAEGLTIMRGVKELRVKESDRIDAMARGLEACGVRIEEDEDTLIVHGMGRVPGGATCATHLDHRIAMSFLVLGMAAEAPVTVDDGSPIATSFPAFIDLM

SEQ ID NO: 7815 - protein, 212 aa, Rhodobacter sphaeroides
MAGVRVKICGLRTESDVKAAASSGAAYVGLVFFPKSPRHLELAQAQRLALAAPPGVAKVALTVDASDETLDAIVEAVPLDMLQLHGGESPERVAEVRARYGLPVMKAVGVADEGDLPQILEQSLAADQILIDAKPPKGAALPGGNGLSFDWRLISGRHWIRPWMLAGGLTVENLAEAVRRTGASQVDVSSGVESAPGVKDPARIAAFLQAAR

SEQ ID NO: 7816 - protein, 482 aa, Rhodobacter sphaeroides
DRCRASEARLGAVIREARHVYGLTTGFGPLANRLISGENVRTLQANLVHHLASGVGPVLDWTTARAMVLARLVSIAQGASGASEGTIARLIDLLNSELAPAVPSRGTVGASGDLTPLAHMVLCLQGRGDFLDRDGTRLDGAEGLRRGRLQPLDLSHRDALALVNGTSAMTGIALVNAHACRHLGNWAVALTALLAECLRGRTEAWAAALSDLRPHPGQKDAAARLRARVDGSARVVRHVIAERRLDAGDIGTEPEAGQDAYSLRCAPQVLGAGFDTLAWHDRVLTIELNAVTDNPVFPPDGSVPALHGGNFMGQHVALTSDALATAVTVLAGLAERQIARLTDERLNRGLPPFLHRGPAGLNSGFMGAQVTATALLAEMRATGPASIHSISTNAANQDVVSLGTIAARLCREKIDRWAEILAILALCLAQAAELRCGSGLDGVSPAGKKLVQALREQFPPLETDRPLGQEIAALATHLLQQS

SEQ ID NO: 7817 - protein, 481 aa, Rhodobacter sphaeroides
MVSRVIPVDTFDLVIFGGTGDLARRKILPGLYRRFTGGQMPPDSRIIAAARSEMDDAAYRAQVRAALEEFVPAGKRDEGGISAFLERIHYVAIDATGTSGWADLKKMMRPDVVRAFYFSVAPSLFGALAERLHENGIAGPQSRIVVEKPFGRDLESARALNRVLALHFAEEQIYRIDHYLGKETVQNLMAVRFANILFEPLWKAQYIDHVQITVAETVGVGGRGAYYDTSGAMRDMVQNHLMQLLCLIAMEPPYHFDPNAVRDEKLKVIRALDPVPPEDIVRGQYLAGGGQESYVDHAGNPRSRTESYIALKVHIANWRWKGTPFYLRTGKRLRARASEIAITFREPPHSIFDDAEDWRENVLVIRLQPDEGINLKVMIKEPGPGGMRLTQVPLDMSFAEALGPDGEDIPDAYERLIMDVIRGNQTLFMRGDEVEAAWAWADPIIAAWERRGDRPKTYEPGTSGPEDALMLMHRDGRRWRE

SEQ ID NO: 7818 - protein, 532 aa, Rhodobacter sphaeroides
KQIWQALKAHQQAVEHRAILDLFTDPRRAETFSTRLGDMLFDWSKTNIDHTARDLLIDLAGAAGVAEKREAMFSGAKINETEGRAVLHTALRNMDRPVRVDGVDVTPALRETHARMQAFVRDLRSGRFTGQGGPITDVVNIGIGGSDLGPAMACLALAPYADGPRCHFVSNVDGAHIHDTLQDLDPATTLVIVASKTFTTIETMTNAETAKRWMAKRVSDPAAQFAAVSTAADKTAAFGIDASRVFGFEDWVGGRYSMWGPIGLALMIAIGPEAFDAFLAGGAEMDRHFREAPFAENLPVLLALVGLWHNQICGHATRAVLPYDQRLARLPAYLQQLEMESNGKRVAMDGHELTHHSGPIVWGEPGTNGQHAFYQLIHQGSRIVPCEFLVAREGHEPDLAHQHLLLVSNCLAQSEALLRGRSVEEARAILGKKGLTGSELERQARHRVFPGNRPSTVLAYEKLTPATLGRIVALYEHRVFVEGVILGINSYDQWGVELGKELALALQPMLEGRAGTEGKDGSTAQLVAYLRR

SEQ ID NO: 7819 - protein, 1174 aa, Rhodobacter sphaeroides
  unsure (1)..(1174): unsure at all Xaa locations
LPEPPSSAVSAASXRXSGRTASDCTVIXAKQECPSMLAAAVHPTSSDTLDEAGLVARLIAEADLDPSARARIVDRGADLVRRIRQGSRPGLMEGFLAEYGLSTDEGIALMCLAEALLRVPDAETMDALIEDKIAPSDWNRHLGRSASSLVNASTWALMLTGKVLDDREPGVAGHLRGLVRRLGEPVIRKAVARAMKEMGRQFVLGETIEGAMARAAELEAKGYSYSYDMLGEAARTEADARRYHLAYSRAITAIAAAAKSRDIRDNPGISVKLSALHPRYEVAKRTRVLAELVPRVTALAGLARAAGLGFNIDAEEADRLDLSLEVIAAALAEPSLAGWDGFGVVVQAYGRRAGEVLDRLYGMAVRLDRKLMVRLVKGAYWDGEVKRAQVLGLDDFPVFTRKMATDVSYIAQARKLFSMSDRIYPQFATHNAHTVAAILELAEGRPFEFQRLHGMGERLHDLVLTEEKTRCRIYAPVGAHRDLLAYLVRRLLENGANSSFVNQIVDESVSPEAVAACPLTAMERTEPVRNPVLRAGTDLFPGRRNSRGFDLASAEDLALIESARSPHRTALFDARPILAESLAGGQRAEVTDPSTGARVGNVLPASLPDVETALHHAVPWEARPEDRAEVLRRAADLYEASFGPIFALLAREAGKTLPDAVGELREAVDFLRYYAAEGEALTAPPLGTVVCISPWNFPLAIFTGQIAAALMAGNAVLAKPAEQTPLIAALAVELLHRAGVPVTALQLLPGEGGTVGAALTRDPRVGGVVFTGSTETARAIRQSMAAHLDPAAPLIAETGGLNAMIVDSTALPEQAVRDILASAFQSAGQRCSALRCLYLQEDVAEGVLEMLFGAMDELQAGEPWDLATDLSPVIDAEAQAGIRDWIAAARAEGRVLKQLAVPARGTFVGPTVIRVGSIREMDREIFGPVLHVATFRATEIDRVIAEIDATGYGLTFGLHSRIDDRVQALVGRLRVGNIYVNRNQIGAVVGSQPFGGEGLSGTGPKAGGPAYLARLVSRPAPDCAGSEAPAQPAAEVQAALDRLAPKAGELIGTHALPGPTGESNRLSLLRRPPLLCLGPGAAAARAQAEAVRTLGGLAVEAPGLAPEALATLRGFAGALFWGGAGDARPRAQALASREGAILPLIGGLPDEAHVAVERHLCIDTTASGGNAELL

SEQ ID NO: 7820 - protein, 421 aa, Rhodobacter sphaeroides
MLNADVSRRRTEAVSRGVGMQTQIYADRAVNAEIWDIEGRRYIDFAAGIAVVNTGHCHPKVMAAVAEQMGRFTHTCHQVLPYENYIRLAERLNAAAPGDFPKKTVFVTTGAESVENAIKIARIHTGRSAVVAFGGGFHGRTFMTMSLTGKVEPYKKGFGTMMPEVYHVPFPQALHGISDRGAMAALARLFKADLDPGRVAAIIFEPVQGEGGFYPAPPDLVRAIRQLCDAHGIVMIADEVQTGFARTGTLFAMHGYDVAPDLVTMAKGLGGGLPIAAVTGRAEIMDAAHPGGLGGTYGGNPLGIAAAHAVLDVIEEENLCARATELGSRLKQKLAEIRATAPEIADIRGPGFMVGAEFADPGSKAPDAGFTNRVREEALKRGLILLTCGVHGNVIRFLAPITIPEPHFAEALEILEASVAA

SEQ ID NO: 7821 - protein, 864 aa, Rhodobacter sphaeroides
AYPQVAGQEEGSMAVVVVESPAKAKTINKYLGSDYTVLASYGHVRDLPPKDGSVDPEHEFAMTWEVAADSKKHVRAIADALKTDDTLILATDPDREGEAISWHLQEALASSLKKGKTVRRVTFNAITKSAVTEAMKAPREVDTALVEAYLARRALDYLVGFTLSPVLWRKLPGAKSAGRVQSVCLRLIVEREMEIEAFRAREFWTVSAVLATPRGQEFEARLTVLGGKKLEKFDLATSEAAELAVQAVTSRPLKVASVEAKPASRNPSAPFMTSTLQQEASRKFGMGAKQCMSAAQRLYEAGHITYMRTDGIDMAPEAVMAARDEIKRRFGANYVPDSPRMYKNKAKNAQEAHECIRPTDMSASPEKLGLTDTDQRKLYELIWKRTLASQMAAARLERTTVEIASPDGQVGLRATGQVVLFDGFLKVYEEGRDDRSDGDEDDEGRLPQIMANEAVEKKSITPEQHHTQPPPRYTEATLVKRMEELGIGRPSTYASIVSTIQDREYVRKDKNRLIPEDKGRLVTAFLANFFRKYVEYDFTADLEGELDDVSAGERNYKEVLARFWRDFSAAVAETADLRIGEVLDKLDEFLAPHLYPPRPDGSDPRICPTCGSGRLHLKTARGGGAFIGCGNYPDCRYTRPISVTGDEENAISPDGKLLGHDEDGAPISLRSGRFGPYVQKGEVTAEVPKPPRASLPKGWAPDTVDLDRALMLLNLPRLVGSHPEDGQPVEAAIGRYGPYVKHGSTYANLPDVEEVFTIGMNRAVEVLAQKAAGRRGASAPAQPIKELGEHPDGGLLAVMPGRYGPYVKWGKVNATIPKGIEPEAITLEEALALVAEKAGKAPKKKAPARKAKAEEGAPKKAAPK

SEQ ID NO: 7822 - protein, 467 aa, Rhodobacter sphaeroides
FVDGRPLEDETGAPIPVIYPATGEEIARLHEATPAVIEAALASGARAQAAWAAMRPVERARILRRASDLIRAHNEELSLLETLDTGKPLQETLVADWASGADALEFFAGLAPVVTGETVPLGQDFVYTIREPLGLCVGIGAWNYPSQIACWKAAPALALGNAMVFKPSEVTPLGALKLAEILIEAGLPPGLFNVVQGRGAVGASLVTDSRVAKVSLTGSVPTGRRVYAAAAEGVRHVTMELGGKSPLIVFDDADLESAIGAAMLGNFYSAGQICSNGTRVFVQKGIKEAFLARLAERADAIRMGDPLDPEVQMGPLVSQAQLEKVLAYIEKARAEGGRLVCGGEASVSPGCYVQPTVFADVTDAMTLAREEVFGPVMAVLDFETEEEAIARANATDFGLAAGVFTADLTRAHRVVAQLQAGTCWINAYNLTPVEAPFGGVKLSGVGRENGRAAVQHYTQVKSVYVGM

SEQ ID NO: 7823 - protein, 525 aa, Rhodobacter sphaeroides
DYIIVGAGSAGCAMAYRLGEAGRSVLVIEHGGTDAGPFIQMPAALSYPMNMGIYDWGLKTEPEPHLDGRVLATPRGKVIGGSSSINGMVYVRGHARDFDHWAESGATGWGFADVLPYFKRMENWHVPGDVEWRGHDGPLHVTRGPRSNPLFNAFIEAGRQAGYPVTDDYNGAAQEGFGPMEATIWQGRRWSAANAYLRPAMKRFGVQLTRALALKVVIEEGRAVGVEVQRRGGREVIRAGREVILAASSLNTPKLLMLSGIGSAAHLAEHGIPVVADRPGVGQNLQDHLEVYMQFASLQPVTLFKHWNLRGKVSIGAQWLFTGRGLGASNQFEACAFIRSKPGVEYPDIQYHFLPIAVRYDGKAAAEGHGFQVHVGPMRSPSRGSVTLRSADPEAPPVIRFNYMSTEEDWQDFRRCVRLTREIFGQEAFKPFVRHEIQPGAACASDAEIDAFIREHVESAYHPCGTARIGRADDPMAVVDPECRVIGVEGLRVADSSIFPRVTNGNLNAPSIMVGEKASDHILGR

SEQ ID NO: 7824 - protein, 647 aa, Rhodobacter sphaeroides
ANAVYTASADFIAQAHVDAAGYERMYAASVADPEAFWGEQGKRLDWIKPYTKVKNTNFRPGEVSIKWFEDGTLNIAWNCIDRHLATRAKQTAIIWEPDDPNVPAQHISYQELHDNVCRMANVLVSQGVRKGDRVVMYLPMIPEAAYAMLACARIGAIHSVVFAGFSPDALANRINDCQAKVVITADTAPRGGRRTPLKSNTDAALLHCSDRVRCLVVKHTGDQIHWMDGRDVDVKELMRHASPDCPIEEVNAEDPLFILYTSGSTGKPKGVVHTSGGYLTYAAMTHQMTFDYHDGDVFWCTADVGWVTGHSYIVYGPLANGATTLMFEGVPTYPDAGRFWAVCEKHKVNQFYTAPTAIRSLMGLGPEWVDKYDLSSLKLLGSVGEPINPEAWSWYNTHVGKGRCPIVDTFWQTETGGHMITPLPGAIPVKPGAASKPFFGVKPVILDPTDGHELHETATEGVLCIADSWPGQMRTLWGDHERFEEAYFSQYKGYYFTGDGCRRDADGYYWVTGRVDDVINVSGHRMGTAEVESALVAHAQVAEAAVVGYPHDIKGQGIYAYVTLMNGVQPTEELRKDLVKWVRTEIGPIASPDVIQWAPGLPKTRSGKIMRRILRKIAENDFGSLGDTTTLADPSVVDDLIANRKNR

SEQ ID NO: 7825 - protein, 220 aa, Rhodobacter sphaeroides
  unsure (1)..(220): unsure at all Xaa locations
ALVTGGAGLIGAGICRTLRAHGWKVASFDLEEAPEATRSVRCDVTDEGSVATAMATLGXSELDLLVNNAGRADPVTGPIAELTLADWRRMTDSHLTAAFLMVRAAVPLLRPGGSIVNMASTRAFMSEPDTEAYAASKGGLVALTQALAVSLGPRLRVNAIAPGWISDGDGLRDIDHAQHPAGRVGRPEDVADTVLWLTDAGFVTGQVIVVDGGMMRKMIY

SEQ ID NO: 7826 - protein, 404 aa, Rhodobacter sphaeroides
RARAAAAELAFAEPSRKEEALNAAAEAMLARSDEILEANGRDLAFGAEKGLTPAMMDRLKLDAARIDGIVEGLRAVAGQPDPVGQVIAEWDRPSGLHIRRVRTPLGVVGVIYESRPNVTADAGALCLKSGNAVILRGGSESFHSSGAIHAALQDGLRQAGLPVDAIQRVPTRDRAAVAEMLRMVEHIDVIVPRGGKGLVGLVQAEARVPVFAHLEGICHVYADGEADLEKARRVVLNAKTRRTGICGSAECLLIDRAFLAKHGPVLIEDLLKAGVEVRAEGELAQVPGTVPAQPEDFGREFLDMIIAAKVVDGVDEAIAHIRRYGSSHTESILTENDATAERFFRRLDSAILMRNASTQFADGGEFGMGAEIGIATGKMHARGPVGAEQLTSFKYLVTGDGTIR

SEQ ID NO: 7827 - protein, 265 aa, Rhodobacter sphaeroides
RTVVWPEGAAGTVLIFSGRTEYAEKYGPAAEALRRRGFASATLDWRGQGLSDRSLRDPLVGHVDDFASYQQDVTAFVAALRAQGLPEPFHLLAHSMGGCIGLRALHEGLPVRAACFSAPMWGIRVHAALRIVAAALGALARATGLGHRYVPGTGTRSYVATAAFDTNVLTRDPEMFAWMQEQLVQAPELGLAGPSLDWLRAAFEETARLKRLPAPDLPALCIVGSAEKVVDLEEIQRRMEGWGRGELQIVPGAEHEVMMDRPEVR

SEQ ID NO: 7828 - protein, 390 aa, Rhodobacter sphaeroides
  unsure (1)..(390): unsure at all Xaa locations
RAEALAANATKDRFLAQMSHELRTPLNAILGIGHAELRGASDPVSRDRLGVLIRSAEGLSTMLDDILDMSAVQQGRMPVRPQTVSPREEIVASVELFRPLVEETGVALELVLGDLPKRARLDPQRLRQCLSNLLSNALKHTQEGRIRVEARIEGAGPRPLLRIEVSDTGDGILREEAEAIFDPFMPTGNGRLAGNGLGLSISRALARQMGGDLRLLAQPGPGARFALTIALQTVEAPASAPAAPRAEHRLGGRRVLVVDDISTNRLVAAAYLQLFGVRTIEAQSGPEALALLEREPVDLVLLDMNMPGMDGLETLRRIRAMPGPAASLPVVAMTADATEEQRDMYLGAGLTGYVAKPVTPDRMSAELSRVLGLAHPDESXEPRAESREPR

SEQ ID NO: 7829 - protein, 332 aa, Rhodobacter sphaeroides
MGYRVVVAGATGNVGREMLNILAEREFPVEEIAALASRKSLGTEVSFGDKTLTTKDLDTFDFTGWDIALFAVGSDATKIYAPKAAAAGCVVIDNSSLYRYDPQVPLIVPEVNADAIEGYKAKNIIANPNCSTAQMVVALKPLHDRARIKRVVVSTYQSVSGAGKAGIDELWNQTKGIYVPGQEVEPSKFTKQIAFNVIPHIDSFMEDGSTKEEWKMVAETKKILDPKVKVTATCVRVPVFVGHSEAINIEFEDFLDEEEARDILREAPGVLVVDKREAGGYITPVECVGDYATYISRIRQDSTLDNGLNLWCVSDNLRKGAALNAVQIAEVL

SEQ ID NO: 7830 - protein, 358 aa, Rhodobacter sphaeroides
VMSYNTFGHIFRVTTWGESHGPALGATVDGCPPGVAIEAEAIQHWLDRRKPGQNRFTTQRQEPDAVRILSGTFEGRSTGTPIQLMIENTDQRSKDYGEIARSFRPGHADIAYHWKYGLRDYRGGGRSSARETAARVAAGGVARAALAALVPGLRIEGYMVQIGPHAIDRARFDADEIERNPFWCPDPDTAALWADYLDGLRKAHDSVGAIVEVRASGVPAGLGAPIYGKLDSDLAAAMMTINAVKGVEIGEGMAAACLTGSANADEIRMGPEGPEFLTNHAGGILGGISTGQDVVVRFAVKPTSSILTPRRSVTTDGREVEVVTKGRHDPCVGIRAVPVGEAMMACVLLDHLLLDRGQ

SEQ ID NO: 7831 - protein, 843 aa, Rhodobacter sphaeroides
MNLEKFTERSRGFLQAAQTIAMRESHQRLASEHLLKALMDDDQGLASNLIRRSGGEPARVAETVELTIAKLPKVSGDAQPFMDPGLVRVLDEAEKLAKKAGDSFVPVERILMALAMVASKAKDALDAGAVTAQKLNAAINDIRKGRTADTASAEEGYDALKKYARDLTQAARDGKIDPIIGRDDEIRRAMQVLSRRTKNNPVLIGEPGVGKTAIAEGLALRIVNGDVPESLKNKRLLSLDMGALIAGAKYRGEFEERLKAVLNEVTSAAGEIILFIDEMHTLVGAGKSEGAMDAANLIKPALARGELHCIGATTLDEYRKHVEKDAALARRFQPLMVEEPTVEDTISILRGIKEKYELHHGVKIADAALVAAATLSHRYITDRFLPDKAIDLVDEAASRLRMEVDSKPEELDALDRQILQAQIEAEALKKEDDAASKDRLAKLEKELSGMTERAAEMTAQWQAERDKLEAARDLKEQLDRARAELEQVKREGNLARAGELSYGVIPQIEKKLEEAEAREGDLLVSEAVRPEQIAEVVERWTGIPTSKMLEGEREKLLKMEEELGRRVIGQRAALRAVANAVRRARAGLNDERRPLGSFLFLGPTGVGKTELTKAVAEYLFDDDQAMVRIDMSEFMEKHSVARLIGAPPGYVGYDEGGVLTEAVRRRPYQVVLFDEVEKAHPEVFNVLLQVLDDGVLTDGQGRTVDFKQTLIILTSNLGAYALSQLPEGADPAPARAAVMEAVRGHFRPEFLNRLDEMVIFDRLSRDDMGQIVEIQLGLLGKRLATRKIGLELDAAAKQWLADEGYDPVYGARPLKRVIQRHLQDPLAEMILAGDVLDGSVVQV

SEQ ID NO: 7832 - protein, 386 aa, Rhodobacter sphaeroides
GLDEELEMIRDQFRRFADERVAPHAHGWHMRDELIPMEIVEALAEMGVFGLTIPEEFGGFGLSKASMVVVSEELSRGYIGVGSLGTRSEIAAELILCGGTDAQKAAWLPKLASGEILPTAVFTEPNTGSDLGSLRTRAVKDGDEWVVHGNKTWITHAARTHVMTLLARTDLETTDYRGLSMFLAEKVPGTDADPFPTPGMTGGEIEVLGYRGMKEYEIGFDGFRVKAENLLGGVEGQGFKQLMQTFESARIQTAARAIGVAQNALEVGMQYAEERKQFGKALIEFPRVAGKLAMMAVEIMVARQLTYHSAWEKDHGQRCDLEAGMAKLLGARVAWAAADNALQIHGGNGFALEYQISRILCDARILNIFEGAAEIQAQVIARRLLD

SEQ ID NO: 7833 - protein, 527 aa, Rhodobacter sphaeroides
GRVNPAQTLDAQGITGLGEVHYNLIEPALVEAAVTRGEGRLGRGGAFLCSTGAFTGRSPKDKFVVRTPSVEDTIWWENNAPMDPAAFDRLHADMLEHMKGRTYFVQDLFAGADPELRLDVRMVTELAWHGLFIRHMLRRPERAELDSFVPDWTVINCPSFKADPERHGCRTDTVIVLNFERKLILIANTEYAGENKKSVFTLLNYILPGKGVMAMHCSANHALGDTDDAAVFFGLSGTGKTTLSADPSRTLIGDDEHGWSDRGTFNFEGGCYAKTINLSAEAEPEIYATTSKFATVVENMVYDEETLELDFNDDSLTANTRCAYPLDYISNASESGLGGHPKNVIMLTCDAFGVLPPIARLTPAQAMYHFLSGFTSKVAGTERGVTEPQPTFSTCFGAPFMPRRPEVYGKLLQEKIAKHGATCWLVNTGWTGGAYGTGKRMPIKATRALLTAALDGSLSGVQFRRDPNFGFEVPVDLHGVDAKLLDPRSTWADPAAYDQQAKKLVEMFANNFAQYVPFIDADVKAAA

SEQ ID NO: 7834 - protein, 289 aa, Rhodobacter sphaeroides
IRKVGVVGAGQMGSGIAHVFSLAGYEVLLNDISAEGLNKALSTIERNMERQVSRGKVSAEDKAAALGRIRTTQTLTDIARSDLVIEAATERETVKQAIFEDLVPHLLPHTILTSNTSSISITRLASRTDRPEKFMGFHFMNPVPVMQLVELIRGIATDDPTYQALLKVVQSLGKTAASAEDFPAFIVNRILVPMINEAVYTLYEGVGSVRSIDESMKLGANHPMGPLELADFIGLDTCLAIMNVLHDGLADTKYRPCPLLVKYVEAGWLGRKTARGFYDYRGETPVPTR

SEQ ID NO: 7835 - protein, 268 aa, Rhodobacter sphaeroides
KSVLITGCSSGIGLDAARGLAARGWRVFATCRQEADCDRLRSEGLESFRLDYDDPESLAAAVEEATRRTGGTLDALYNNGAFACPGAVEDLPREALRAVLETNIVGVHDLTRRVIPIMRRQGHGRIVNCSSVLGFVAYPWRGAYVASKFAMEGLTDVLRIEMADTPIRVILLEPGPIASRIRENSIPHFERWIDWRASARADQYRTLLGRLYEGGEDRWQLPPSAVTEKLVQALESPRPRARYRITVPSRTAWVLRRLLPTAALDRVL

SEQ ID NO: 7836 - protein, 394 aa, Rhodobacter sphaeroides
VLISGCIVLMLGFAIRASFGVFQIPIAEEFDWPRSDFSMAIAIQNLAWGIGQPIFGMLAEKFGDRRAIVAGALTYAAGLVLSSFAVTPLQHQFLEVLVGFGIAGTGFGVILAVVGRATAPEHRSLALGIATAAGSAGQVFGAPAAEILLGFYSWQTVFVIFAGVILAALFALPFMRAPVTATKAELEESLGTVLRRAFRDPSYTLIFVGFFSCGYQLAFITAHFPAFVTEMCGAIDPRGPLAALGITTTSALGALAISLIGLANIVGTITAGWLGKRYSKKYLLAAIYTGRTLAAALFILVPMTPTTVLLFSLSMGALWLATVPLTSGLVAHLYGLRYMGTLYGFVFLSHQLGSFMGVWLGGRMYDMTGDYTMVWWIGVGVGAFSAIVHLPIRE

SEQ ID NO: 7837 - protein, 495 aa, Rhodobacter sphaeroides
DWWRGSVTYQIYPRSFQDSDGDGVGDLRGIIERLDHVAWLGADAIWLSPIFPSPMEDMGYDVSDYTAIHPLFGSMEDFDALLARAHELGLKVIIDQVLSHSSSAHPFFRESRRSRDNPKADWYVWADAQPDGSPPNNWLSVFGGSAWEWDAQRRQYYLHNFLISQPDFNFHNPEVQDWLLDQMRFWLDRGVDGFRLDTVNFYFHDAELRSNRPNPQNGPIPPVNAYDMQDHAFSKSRIENIAFLLRMRKLLDDYPDRAMVGEVADGLRGLAIMAEYTSGTDRLHMAYTFEMLSRTFTAGHFRSRIEEFFATAPQGWPCWAFSNHDVVRHATRWAGHGAEDDVARLAAAMLLSFEGSVSLYQGEELGQTETELLYEELTDPRASGSGPRRKGRRLPTPMVWDDGPAGGFTTGTPWLPVKPPQLARNVASQKGIPGSLLETYRALLQFRRSQPALIRGRSRFFDLPEPMLGFTRTLDGQSLACFFNLGIEPVSATLP

SEQ ID NO: 7838 - protein, 243 aa, Rhodobacter sphaeroides
DLKGASVFLSGGGSGIGAALTEGFLRQGAQVAFVQRSDATAFCDRMEAETGARPLFLPCDVTDIPALRQALAEVAERQGPIQVLVNAAAHDDRHTTAEVTEDYWDRAQAVNLKHYFFAAQAVIPGMKAAGGGSIINFSSISYMMGNAGYPAYTTANSGINGLTRSLAREFGPDRIRVNALAPGWVLTERQKDLWVTEDGLQAHLDRQCLKEALVPADIVGGVLFLASEASRMMTGQALVIDGG

SEQ ID NO: 7839 - protein, 387 aa, Rhodobacter sphaeroides
DILVLSAVRTAIGGFGGALAAVPPGDLATTVTRAALERAGVEPGRVGHVVFGHVINTEPRDMYLSRVAAMQAGIPSEVPAMNVNRLCGSGVQAVVSAMQALMLGDAEVALAGGAESMSRAPYALTTARWGQKMGDTRALDMMTGALNCPFGTGHMGITAEIVAERHGISREDQDAFALESQTRTARAQEEGRFDGQIVPVEIASRKGPVSFSRDEHPKATTLEALAGLRPAFQKGGTVTAGNASGINDGAGALILAREGAVPDARPLGRLIGYAHAGVDPEVMGLGPIPAVKALCARTGLSVADFDVIESNEAFAAQALAVARALDFDPARVNPNGGAIALGHPVGATGAIITVKALHELHRTGGRRALVTMCIGGGQGIALALERV

SEQ ID NO: 7840 - protein, 368 aa, Rhodobacter sphaeroides
PAARPANPRFSSGPCAKIPAYSLDLLSDAPLGRSHRAAVGKAKLKEAIDLTREILGVPEGYRIGIVPGSDTGAVEMAMWSLLGARPVEMLAWESFGEGWVTDAVKQLKLDATVRKAAYGEIVDLAQVDFTRDVVFTWNGTTSGVRLPNGDAIPADREGLTICDATSAAFAMDLPWDKLDVVTFSWQKVLGGEGGHGMLILSPRAVERLESYTPAWPMPKIFRMTKGGKLIEGIFQGETINTPSMLAVEDYLVSLKWAQRIGGLKALVARAEANSKVVADFVAAHDWIANLAVDPATASTTSVCLKFTDPRIADGAAFAKAVAKRLEKEGVALDVGAYRDAPAGLRIWCGSTVETADVAALMPWIEWAF

SEQ ID NO: 7841 - protein, 263 aa, Rhodobacter sphaeroides
PPRGDAPDATPAIEARHLTKRFDDFTAVDDVSFTIPEGEIFGFLGSNGCGQSTTMKMLTGLQDATEGETRLFGERLGAADMQSRMRIGYMSQGFSLYGELTVRQNLTLHAQLYALPAARRAPRVAEVMAEFDLAEVADQKPESLPLGIRQRLQLAVATIHEPRILILDEPTSGVDPLARDDFWRKLIVLSRERGVTIFITTHFMNEAERCDRISLMHAGRVLEMGTPAEIVSRRGAATLEEAFIACLEEQTGSAGARRRPWCR

SEQ ID NO: 7842 - protein, 271 aa, Rhodobacter sphaeroides
  unsure (1)..(271): unsure at all Xaa locations
APSPAATGPPIWPXSCRTEGMESVAEIAGVSHRYGTVTALDAVSLAIPAGRMAGLIGPDGVGKSTLLALVAGVRRLQGGGLTVLGHDMTRRAERQAVAPRVAYMPQGLGRNLYPTLTVRENLEFFGRLFGQKAPERAQRIEMLLRATGLDPFPDRPAGKLSGGMKQKLSLCSALIHDPDLLILDEPTTGVDPLSRRQFWELIAAIRTHLPGMSVLVATAYMEEADRFDWLAAMDGGRVIATGSPAELRARTGAATLEAAFIRLLPGGADAA

SEQ ID NO: 7843 - protein, 252 aa, Rhodobacter sphaeroides
LMKGKRGLVMGVANDRSIAWGIARALAAEGAELAFSYQGEAFGKRVEPLAASVGSDFLVDVDVMDDASLDACFGALKDRWGTLDFVVHAIAYSDKTELAGRFINTSRENFRNSLTISCYSFIDIARRASELMPDGGALLTLTYQGSNRVTPYYNVMGVAKSALESAVRYLANDLGPQKIRVNAISPGPMKTLAGAAIAGARATFRHTEANAPLRANATLEAVGGTAAWLASDYGACTTGEIVRVDGGYHVLG

SEQ ID NO: 7844 - protein, 408 aa, Rhodobacter sphaeroides
MRRVVITGIGIVSPIGNNAAEVEASLRAGRSGISFSEDYAHHGFRSQIHGMPDLVLEDHVDKRDLRFMGAGAAYNFIAMEQAIKDSGLEATEVSNPRTGLVMGSGGPSTSNFFQAHKIVIEKGSPKRMGPFMVTRCMSSTNSACLATPFKIKGVNYSITSACSTSAHCIGNGTELIQMGKQDIVFAGGGEELDWTLSCLFDAMGAMSSKYNDAPETASRPFDATRDGFVIAGGGGVVVLEELEHALARGAKIYAEVTGYGATSDGADMVAPSGEGGERSMRLALGTLPEGRRVDYINAHGTSTPAGDVTEVRAIRRIFGEGKVPPISSTKSLTGHSLGATGVHEAIYSILMMQGDFIAASANVTQLDPEIQPDEIATTLREGVEIDSVLSNSFGFGGTNASLLLSKFN

SEQ ID NO: 7845 - protein, 369 aa, Rhodobacter sphaeroides
LTDEQRLVQEMARTFAREVLAPGAAARAKAKAIEPAVLAQMGELGFFGMTVPEEMGGVGADYMSYALALIEIAAGDGAVSTVMSVHNAPFNAILQRFASPAQRERVLRPAAQGAFIGAFALTEAHAGSDASALRSRARRAGGDYVIDGEKVFITSGRLAGWAILFARMEGSTGKEGITCFLTPTDTPGYEVVKVEDKLGQEASDTCALRFDSLRVPEALRIGAEGEGYRIALSSLETGRIGIAAQSVGMAQAALEAAVAYARERTSFGRPLIEHQAVGFRLAEAKTRLEAARQMVLHAARMKDAGQPCLTEAAMAKLFASEAAERIVSDAIQTFGGYGYSRDFPVERIYRDVRVCQIYEGTSDIQKMLI

SEQ ID NO: 7846 - protein, 381 aa, Rhodobacter sphaeroides
IVIAGAARTPMGAFQGALKGRTGVELGAAAISAALARAGLAPEAVEEVVMGCVLPAGLGQAPARQAALGAGLPLSVPCATLNKVCGSGMKAAMAAHDMIRAGSAGIVVAGGMESMSNAPYLLDKARGGYRIGHGRVLDHMFLDGLEDAYDRGRAMGTFAEDCAEAYQFTRDAQDAYALASLARAQAAIAEGRFAAEVVAVDGVAVDEAPGRARPEKIPQLRPAFREGGTVTAANSSSISDGAAALVIASAGAAEAQGLTPLATIRGHASHAQAPNLFTTAPIFAIGKLLERLGWSAAEVDLFEINEAFAVVAMAAMRDLDLPHDKVNVNGGACALGHPIGCSGARIVVTLIEALRARGLRRGVASLCIGGGEATALAVEVI

SEQ ID NO: 7847 - protein, 279 aa, Rhodobacter sphaeroides
ALVTCFHEDETVNYAATRAQVRRQLAAGNDLMVCGTNGDFSALTHDEKIRLVGEVMEEVAGRAKVIANVGCPATFETLQLARAVDGMGLHGIAVIAPYFISCTQDGLIRHFSTVADAVTTPVYLYDIPARTQNHIEPATVGTLARHGNIAGIKDSGGSTDTVRAYLDVARDVEGFEVYCAPDHLVLWGLEEGCAGVVSGLGNVAPGLLAQIIAGFNAGDMEAARAAQENFAGLRKDLYALGFPPALVKRALYLNDPSVGLSRQPALLPDAAQDAQILAI

SEQ ID NO: 7848 - protein, 359 aa, Rhodobacter sphaeroides
PAAVHFGEGSLARLPEWVAARGFRAPFVIADAVNAQRLDRLGLGSVGCFGTVVPEPDTANLQAAVAAAEGADLIVGFGGGSAMDLAKLVAVLVGTGLALSDISGPGRAPARRVGLVQVPTTAGTGSEVGTRALVTDPASLAKIATESAEMLADMAIVDPALTLSVPPAVTAATGVDAMAHCAEALTSKRAHPLVDAYALEGIALVGRFLRRAVEDGQDVEARAGLSLAAFYGGICLGPVNTTAGHALSYPLGTRHKLPHGIANALIFPHVLAANASAAPEKTARICEALGFAAGAEETVRAGALAFCAGLGLDMRLRAHGVPSEDLPVMATEAHGIRRLLDWNPRDLSVAEIEAIYRRA

SEQ ID NO: 7849 - protein, 255 aa, Rhodobacter sphaeroides
MRIATFNVNGVNGRLPVLLRWLEEARPDVVCLQELKAASARFPAAALEAAGYGAVWHGQKSWNGVAILARGAEPVQTRQDLPGVQDGESRYIEAAVEGVLVGCLYLPNGNPAPGPKFAAKLAWFDHLLNHAEEVLRHDVPVVLAGDFNVMPTDLDVHRPERWREDALCRPEVRAAFARLLAQGWTDSIRHLYPEDRIYTFWDYLRNAWERDAGLRLDHLLLSPSLLTRLKGAGVDRHVRGWEKASDHAPVWIAID

SEQ ID NO: 7850 - protein, 821 aa, Rhodobacter sphaeroides
ELIQLDARASSKEEAIAQAAAALVAAGCVRPGFEASMLRREAVSNTYLGKGIAIPHGTVEDRDLIQKDAIAVLQVRDGVEWNAGERARLVVAIAARSDGHIEILRRLTRLLQDEDRLAVLAATDDRQALSDALNGVAAGAAATAEPAGDFAQSFDWVLDYPTGLHARPATEWAEAARRFPCRIRIRHGAETADARNMISLLSLGLKSGDAITVSAEGQGAAEALATLKVTMTGLSAREKADAARAEEKRRATAAAGGWVPPSSPRAIEGVPAAPGLAIGRITRIATDGMEIPDEPVELARAADLLHAALGQTAEQLHSLADDTARRLGESDAAIFRAQAGLLADPDLITLASQWLVDGHGLAWSWHRAYEDMAARLSALRNPVLAARAADLRDVGQRVLAHIDPRFARSRLADLPEDTILVAEDISPSDAAGLDPAKVAGLVTALGGPTSHTAILARTLGLPAVVGTGAVVERLEDGACAIVDGHGGRLYLDPSEADLASARDWIAAEEARRARAAETRALPATTRDGHRIDIGANINLAEQAAFALGQGAEGVGLMRTEFLFLERSESPTEDEQAEAYAAMARALEGRPLVIRALDIGGDKQVAHLDLPREENPFLGVRGARLLLRRPDLLVPQLRALYRAAAGGAQISVMFPMVTSLGELLELRATCERIRQELDAPVVPLGIMVEVPSAALLAAEFAAHADFFSIGTNDLTQYALAIDRQNPELAPEADSLHPAVLRLIDLTVKGAAVHGRWVGVCGGIAGDPFGAALLAGLGVDELSMTPRDIPAVKERLRQSDRAGLRALAEHALACSDAEAVRAL

SEQ ID NO: 7851 - protein, 269 aa, Rhodobacter sphaeroides
MTEAFARAKINLTLHVTGQRPDGYHLLDSLVVFADVGDRVRAEPAEALSLAITGPQAANLPVADDNLVLRAARTLGGQGARLTLEKHLPVASGIGGGSADAAAALVALARLWQVPLPEPAAVLKLGADVPVCLEGRAVRMAGVGEILTPLAAPLPEGWLVLANPGVSVPTPPVFKALARRDNPPMPDDLPGWPTVEALAAFLATQRNDLEPPAIALAPEIARTRAALAAQRGCLLARMSGSGATCFGLFAAEEAARAAAEAIGAEHPGW

SEQ ID NO: 7852 - protein, 469 aa, Rhodobacter sphaeroides
GRMRRLRNVKIVATLGPASNDYATIRALFEAGADVFRLNMSHGSHDDIRARHQMLRQIEADTGTPVCILADLQGPKLRVGTFANGSEELVERGRFRLDLDPAPGTAERVNLPHPEIFAALEPGSSLLVNDGKIRLEVADCGPDFADCIVTVGGTISNRKGVNVPDVVLPLAALSEKDRRDLEFVCELGVDWLALSFVQRPEDVEEARSLARGRAAILSKIEKPAAVKAYDAILAVSDGIMVARGDLGVELPVQAVPPIQKRLVRGARAAAKPVIVATQMLESMIDSPMPTRAEVSDVATAIYEGADAVMLSAESAAGSYPIEAVMTMNNTAISVESDPVYRDIIEASRAAKRASVADAIVAAAREIAETTPIKAICCFTQTGKTVSLVARERPRVPILALTPLVETARRLSLTWGTHCVVTAPQERFKGAVICAARAALSDGFAQEHEQIAVVAGVPFNVRGTTNILRV

SEQ ID NO: 7853 - protein, 360 aa, Rhodobacter sphaeroides
MTALDTLRGKYIEAISSAADEAALEEVRLAALGKKGEISLKMRELGQMSPEERQTTGAALNRLRDEIDASLRARKQGLADAALDARLKTEWLDVTLPGRPRRAGTIHPVSQVMAELTAIFADMGFAVAEGPQVESDWFNFDALNIPPEHPARQEHDTFFMARAEGDDRPPHVLRTHTSPVQIRAMQAQGAPIRVIAPGRVYRMDMDQTHTPMFHQVEGLAIDRDISMANLKWVLEEFCRAFFEVPSVELRFRASHFPFTEPSAEVDIRCSWEGGQLRIGEGDGWLEILGSGMVHPKVLAAAGVNPDEWQGFAFGMGIDRIAMLKYGIPDLRAFFESDLRWLRHYGFAALDMPDLAGGLSR

SEQ ID NO: 7854 - protein, 831 aa, Rhodobacter sphaeroides
MTLTRRDLIKAQAAATAAAAAGLPVSALAQPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKRVLKEKGPKAVGMFGSGQWTIWEGYAASKLMRAGFRSNNLDPNARHCMASAATAFMRTFGMDEPMGCYDDFEAADAFVLWGSNMAEMHPILWSRLTDRRLSHEHVRVAVLSTFTHRSMDLADTPIIFRPGTDLAILNYIAHHIISTGRVNRDFVDRHTNFALGATDIGYGLRPEHQLQLAAKGAADAGAMTPTDFETFAALVSEYTLEKAAEISGVEPALLEELAELYADPDRKVMSLWTMGFNQHVRGVWANHMVYNLHLLTGKISEPGNSPFSLTGQPSACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRCADLVLPAAMWVEKEGAYGNAERRTHFWHQLVEAPGEARSDLWQLMEFSKRFTTDEVWPEEILSAAPAYRGKTLFEVLFANGSVDRFPASDVNPDHANHEAALFGFYPQKGLFEEYAAFGRGHGHDLAPFDTYHEVRGLRWPVVEGEETRWRYREGFDPYVKPGEGLRFYGKPDGRAVILGVPYEPPAESPDEEFGFWLVTGRVLEHWHSGSMTLRVPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 7855 - protein, 263 aa, Rhodobacter sphaeroides
IVVTGASGRMGQMLMKTVLASGKARLVGAVERPGSDWVGRDAGAAMGGAAVGVTVTDDPLAAFAQAQAVIDFTAPEATVQFAELAAQARAVHVIGTTGLEPAHLERLAWAAHHAVIVRAGNMSLGVNLLTRLTQKVAEALDEDWDIEVVEAHHRMKVDAPSGTALMLGEAAARGRGVDLAQARVSGRDGITGPRAPGSIGFSAIRGGDIVGEHDVIFAAAGERITLRHVATDRAIFARGALKAALWGQDRRPGQYDMMDVLGL

SEQ ID NO: 7856 - protein, 535 aa, Rhodobacter sphaeroides
AAFVGFFVNLLHLALPLYNAQVYDRVIGSANLDTLVALTGLVAILLVFGAVLDVLRARIFAILAARLAGQLGQPVFVAAVETALRGGPTAAAEGMRAVADLRSFLAGGAIALPIDLTFTPVLLLVLFALDPAYGLIGLGGAAALAGTGIVTEILARRPVASALAAGGSVQAETATALRSAEVIAAMGMLPDIARRWRRAQARSLAAADRGQARAKALSSLARFLRTAIQIAVICTGTTLVVDQAATIGTIVAAMAIMSRLLLPFEHLIDGWRQWMDAAEAHGHLRRLLREGGSPRSSLPAPVGRALLVADRVTYIPAGQDLPLLRNVSFRIEPGELLGVIGPSGAGKSTLARLTVGLWPPSAGGLFLDGQSTFLHERTSFGRAVGYLPQEPLLLDGSVRDNIARFRDAPMDEVIAAARQAGVHELIGRLPRGYGTRLADAGARLSGGQRQRIALARAIFGDPQLLVLDEPNASLDAEGEAALVSAVEQARARGAAVLVVAQRMSVLAKADRLLVLREGAVTHYGPRAEVMAAIGP

SEQ ID NO: 7857 - protein, 674 aa, Rhodobacter sphaeroides
  unsure (1)..(674): unsure at all Xaa locations
STAPRRGRGLWWRMPRRRLRPMGQRQEHXSRRRASSSRVKAEGKSMTDRPCTPTLDRVTLPVDIKGLTDRELRSLADELRAETISAVSVTGGHLGAGLGVVELTVALHAIFDAPRDKIIWDVGHQCYPHKILTGRRDRIRTLRQGGGLSGFTKRSESPYDCFGAGHSSTSISAAVGFAAAREMGGDTGDAVAVIGDGSMSAGMAFEALNHGGHLKNRVIVILNDNEMSIAPPVGALSSYLSRLYAGAPFQDFKAAAKGALGLLPEPFQEGARRAKEMLKSVTVGGTLFEELGFSYVGPIDGHDLDQLLPVLRTVKQRAHAPVLIHVITKKGRGYAPAEAARDRGHATNKFNVLTGAQVKPVSNAPSYTKVFAQSLIKEAEVDERICAVTAAMPDGTGLNLFGERFPKRTFDVGIAEQHAVTFSAALAAGGMRPFCAIYSTFLQRGYDQIVHDVAIQRLPVRFAIDRAGLVGADGATHAGSFDVAFLSNLPGIVVMAAADEAELVHMVATAAAHDEGPIAFRYPRGDGVGVEMPVKGVPLQIGRGRVVSEGTRIALLSFGTRLAEVQVAAEALAARGISPTVADARFAKPLDRDLILQLAAHHEALITIEEGAIGGFGSHVAQLLAEAGVFDRGFRYRSMVLPDTFIDHNSAEVMYATAGLNAADIERKALETLG

SEQ ID NO: 7858 - protein, 219 aa, Rhodobacter sphaeroides
VVHAMRYAVQGGKRLRGFLVLESARLHGIAPEAAVSAAASIEALHAYSLVHDDMPCMDDDDLRRGLPTVHRKWDECTAVLAGDALQTLAFELLADPALGPAAVRIELVASLAKASGAEGMVLGQALDIAAETAAVPLTLDQITHLQAGKTGALIRWSAEAGAILGQADRVPLRRYATALGLAFQIADDILDVEGDAEKAGKRLQKDAEAGKATFVSLLG

SEQ ID NO: 7859 - protein, 400 aa, Rhodobacter sphaeroides
KIKVANPVVELDGDEMTRIIWDFIKQKLILPYLDIDLHYYDLGIEERDRTEDRITVDAAHAIKQYGVGVKCATITPDEARVDEFGLKSMWKSPNGTIRNILGGVIFRQPIICRNVPRLVPGWTKPIVVGRHAFGDQYRATDFRFPGKGKLTLKFVGEDGAVIEREVFDAPGSGVTMAMYNLDQSIIDFARASMNYGLNLGWPVYLSTKNTILKAYDGRFKDLFQQVYEEEFAEKFKAAGITYEHRLIDDMVASALKWSGGYVWACKNYDGDVQSDTVAQGFGSLGLMTSVLMTPDGQTVEAEAAHGTVTRHFRQHQAGKETSTNSIASIYAWTGGLKHRAKLDGNADLARFAETLERVTVQTVEDGFMTKDLALLVGPDQKWLTTMGYLERVDEYLDRAL

SEQ ID NO: 7860 - protein, 491 aa, Rhodobacter sphaeroides
DGLAVGAPDRPWLTYAGLRELVGHTVTALHAAGVGKGDRVAIVLPNGPEMATAFVALAEGAVTAPLNPAYRLEEFEFYLSDLGAKAIVLAEGYDGPALVAANHLGLAVLRLGHDAADPAGSFTLRAESVAPGEPERATARPRDLALILHTSGTTSRPKIVPLRHGNLSASAHHIAGSLALTPHDRCLNMMPLFHIHGLVAAVSASLAAGASVWCAPGFDALKVFGWIEAARPTWYTAVPTMHQAILARAPRNAEVIERVPLRFIRSSSASLPAQVMEALSATFRAPVIEAYGMTEAAHQMTSNPLPPRPQKPGSVGVAAGPQVRIADEASDRLIEGTGEVVISGPNVTAGYEANKAANAKSFFEAEGERWFRTGDQGRFDAEGYLTITGRLKEIINRGGEKISPLEVDGVLMDHPAVLQVVTFALPHPKLGEEVAAAVVLREGMAADEAAIRAFCADRLAEFKVPRRVVLLDEIPKGATGKLQRIGLAEKL

SEQ ID NO: 7861 - protein, 349 aa, Rhodobacter sphaeroides
PFPLVAAEAQGARLTDLDGHRLDDFCLGDTGSMFGHSPAPVARAIRRQARQGLTYMLPTEATFEAGQLLNRTFGDFRWQVALTATDANRFALRVARAVTGRRKVLVFNGCYHGTVDDTMVMLENGRTRARPGLVGMVADLASKAVAVEFNDVAGVEAALATGEIAAILTEPVMTNSCMVLPEAGFHDALRTLSRRYGAVLILDETHTLSSGLGGYGRVHSLSPDILVVGKCVAGGTPTAVWGLTPDLGARFAAYNATRPAGHSGMGTTLSANPMQFACLCATLSEVMTPEAYAHMERGAKRLAKGLAAAIARVGAPWHVVRVGARVEFICAPGPLRNGTEAAAAHQPRL

SEQ ID NO: 7862 - protein, 539 aa, Rhodobacter sphaeroides
LPSWDLTQRQICDLELLMNGGFHPLKGFLTEADYDGVVENMRLADGRLWPMPVTLDVSEKFAEGVEPGQDIALRDAEGVILAILSVTDKWVPNKDREAEKVFGANDLAHPAVNYLHHTAGKVYLGGPITGIQPPVHYDFKMRRDTPNELRAFFRKMGWTRVVAFQTRNPLHRAHQELTFRAAREAQANLLIHPVVGMTKPGDIDHFTRVRCYEAVLDQYPSSTTTLSLLNLAMRMGGPREAVWHGLIRRNHGCTHMIVGRDHAGPGKNSEGKDFYGPYDAQELFKAHADEIGVEMVDFKQMVYVQEKAQYFPVDEVPEGSTVLDISGTELRRRLREGLEIPEWFSFPDVVSELRRTSPARSKQGFTVFFTGLSGSGKSTIANALMVKLMEMGGRPVTLLDGDVVRKHLSSELGFSKEHRDINIKRIGYVASEITKNGGIAICAPIAPYTATRRAVREMIEAFGAFIEVHVATPIEECERRDRKGLYKLAREGKIKEFTGISDPYEVPAKAELVVDTANVSVDHCAHQVILKLEQMGLIR

SEQ ID NO: 7863 - protein, 363 aa, Rhodobacter sphaeroides
SLLILAGDGIGPEVMAEVKRIIGWFGEKRGVSFDVSEDLVGGAAYDAHGTPLADETMARAQEVDAVLLGAVGGPKYDVLDFSVKPERGLLRLRKEMDLYANLRPAQCFDALADFSSLKRDIVAGLDIMIVRELTSGVYFGEPRGIFPDNEGGRFGVNTQRYTTEEIRRVARSAFELARRRNNRVCSMEKANVMESGILWREEVQWVHDNEYPDVELSHMYADNGAMQLVRWPRQFDVIVTDNLFGDILSDCAAMLTGSLGMLPSASLGAPMANGRPKALYEPVHGSAPDIAGQGKANPIACILSFAMALRYSFDMGEEATRLEKAVETVLADGVRTADLMGPEGGTPVSTSGMGDAVLAALDA

SEQ ID NO: 7864 - protein, 875 aa, Rhodobacter sphaeroides
  unsure (1)..(875): unsure at all Xaa locations
AMTAPRTLYDKIWDDHVVHQSEDGTCLLYIDRHLVHEVTSPQAFEGLRMTGRKVRAPEKTIAVPDHNVPTTEGRDTKIDNEESRIQVEALDKNARDFGINYYPVSDIRQGIVHIVGPEQGWTLPGMTVVCGDSHTATHGAFGALAHGIGTSEVEHVLATQTLIQKKSKNMKVEITGSLRPGVTAKDITLSVIGLTGTAGGTGYVIEYCGQAIRELSMEGRMTVCNMAIEGGARAGLIAPDEKTFAYVMGRPHAPKGAAWEAALAYWKTLFTDEGAQFDKVVTIRGEDIAPVVTWGTSPEDVLPITATVPAPEDFTGGKVEAARRSLEYMGLTPGQKLTDIKIDTVFIGSCTNGRIEDLRAAAEILKGKKVAPGMRAMVVPGSGLVRAQAEEEGLAQIFIDAGFEWRLAGCSMCLAMNPDQLSPGERCASTSNRNFEGRQGRNGRTHLVSPGMAAAAAITGHLTDVRDLMMAPAEPAXRRPGAQHSAPAQVCSKSGQNGMKGTSSLIVSGILALLGGIAALAFPLPVSLAVTVLAGCVFVASGAFGLWAAFSDRGMPSRGAAAFFSLVSLVAGVWMLANPLAGMVSLTLMLGALFLVSGVVRLGLSLATWRGTVMFWLMALSGLISAGLGLFILLRLPEASLVLLGTLVAVELIVMGATLVAMGFALRKSGNPXAMQEFTKVTGVAAPMPLVNIDTDMIIPKQFLKTIQRSGLGKNLFDEMRYNPDGSEIPEFVLNQPAYRDAQIIVAGDNFGCGSSREHAPWALLDFGIRCVISTSFADIFYNNCFKNGILPIVMPPEVVEVLMEDARRGANARMTVDLEAQTVTTSDGQSFPFQVDSFRRHCLMNGLDDIGLTLEKAASIDGFERDLATLRPWV

SEQ ID NO: 7865 - protein, 1151 aa, Rhodobacter sphaeroides
LRFTRLRLNGFKSFVDPTDLVIHEGLTGVVGPNGCGKSNLLEALRWVMGENRPTAMRGAGMEDVIFAGAATRPARNFAEVALVLDNADRLAPAGFNDADTIEIVRRITRDAGSAYKANTRDVRARDIQMLFADASTGAHSPALVRQGQISELINAKPKARRRILEEAAGISGLYQRRHEAELRLAATEQNLARVEDVLDQLAQQLSTLARQAKQAARYREIGEELRRAEGSLLYRRWREADVARTEALALLRERMTAAGQAEAVARKAAAARAEAEATLPPKREEEAIAGAVLQRLTVERDALAAEEDRARATIATLVSRVDQLGRDIEREAGLNRDAAETIGRLEWEREALETAHEGHEERLAEAAEAAREAGAALGEREEILSERTEDAARLSARHQSAQRMLVDSRTTLARSEAEAARARETVEAAAEAQERAAETWEEAAAAQEEAQERAEAAEEALVQADEARAEAQSREAEARAQRSAAEGEANALRAEVAALARLVDREAQAGSQLLDRIQVEPGFEAALGAALSDDLRAPEVAADAPSGWAALPDYDETAPLPAGAEPLAPHVGVPEVLRRRIGQIGLVGREAGAALQPLLQPGQRLVSLAGDLWRWDGFRAGAEDAPSAAALRLKQLNRLVALKRDLEEVAARAEGARQAHEALQARLRAAHPRRSGGPRGPPRRDARVTEASRAAARAEADRSISGGKLESARLAVKRYEDEAMEARARLREAEGVASALPDLEAARAGLEDLKMAVEAARIAMMSRRSLHDELRREGEARVKRRQEVTKDLSGWKHRLETAEKRSAELAERKAETEEALREAAEAPEEIAARREELAEAIEAAEERRARASDALASAEAALRAAQEAEREAERQAGESREARARAEARADAATEALQLAAERIREETERTPQQLLEALAVDPERIPTVEALETDVGRLKRQREALGAVNLRAEEDAQAVQTEHDTLKAEKTDLEEAVKKLRAGIQGLNREGRERLLTAFEQVNASFGTLFTHLFGGGEARLVMVESDDPLEAGLEIMCQPPGKKLSTLSLLSGGEQTLTALALIFAVFLANPAPICVLDEVDAPLDDANVTRFCDLLDEMTRRTETRFLIITHHAVTMARMDRLFGVTMAEQGVSQLVSVDLKRAEALVA

SEQ ID NO: 7866 - protein, 295 aa, Rhodobacter sphaeroides
MEMRVMIRGSIPALVTPFKNGELDLDTLKKLVDWQIAEGSTGLVPVGTTGESPTLSHEEHETVIEAVVKAAAGRVPVIAGAGSNSTAEGIRLIRFAETVGADAALVVTPYYNKPTQAGMIAHFTALHDCCSLPIVIYNIPGRSVVDMSPETMGTLARLPRIVGVKDATGKIERVSQQRASCGPDFIQLSGEDATALGFNAHGGVGCISVTANVAPRLCAEFQQATLAGDFAKALEYQDRLMPLHEAIFLEPGLVGAKYALSKLGLCSDEVRLPLVGLTDATKARIEAAMRHAGLI

SEQ ID NO: 7867 - protein, 278 aa, Rhodobacter sphaeroides
TDDPRTLVSTDWLAAHLRDPDLRLLDASWYLPQENRNPRAEYEAEHIPGARFFDIDEIADLRSALPHMAPPPEKFISRMRAMGVGDGHQVVVYDGSGLRSAARVWWTFRLMGKTDVAVLDGGLPKWKAEGHPVEDMPPVVRDRHMTVQRQAGLVKDVTQVAHASKLGEAEIIDARSAGRFKGTDAEPRPGLRAGHIPGSKNVPFTTLLAPDGTMKPPAELRAIFEAAGVDLSKPAITTCGSGVTAAVLSLALEILGHRNHALYDGSWSEWGMYDDLKV

SEQ ID NO: 7868 - protein, 391 aa, Rhodobacter sphaeroides
MLTALKPQPADKILQLIQMFREDARADKIDLGVGVYKDPTGLTPVMRAVKAAEKRLWEVETTKTYTGLADEPAYNAAMAKLILAGAVPADRVASVATPGGTGAVRQALELIRMASPEATVWISNPTWPNHLSIVKYLGIPMREYRYFDAETGAVDAEGMMEDLAQVKAGDVVLLHGCCHNPTGANPNPVQWLAICESLARTGAVPLIDLAYQGFGDGLEMDAAATRLLATRLPEVLIAASCSKNFGIYRERTGILIAIGEAAGRGTVQANLNFLNRQNYSFPPDHGARLVTMILEDETLSADWKAELEEVRLNMLTLRRQLADALQAETGSNRFGFVAEHRGMFSRLGITPAEVERLRTEHGVYMVGDSRLNIAGLNRTTVPVLARAVAKV

SEQ ID NO: 7869 - protein, 528 aa, Rhodobacter sphaeroides
LLGIDVGTGSARAGLFDRAGRMLASAKCDIAIWRAPGAMVEQSSRDIWQAVCRATRTALAEAGLPPEAVGGVGFDATCSLVVVGEGGAPLPVGPSEDPERNIIVWMDHRAVAQAERINAQGHEVLRYVGGRISPEMETPKLLWLAEHRPDIFARAWQFFDLADYLGWRATGDLARSTCTVTCKWTYLAHEHRWDAGYFRQVGLGVLADEGFARIGARVVEPGTPLGQGLTGEAAAELGLRPGTPVGAGLIDAHAGGIGTVGAEGTPERDLAYVFGTSSCTMTTTREPVFVPGVWGPYRSAMVPGMWLNEGGQSAAGAAIEQLVSFHPAAAEAARATEALGEALPVHLARLAAEGLADLSEVATRAEGLHVVPEFLGNRAPFADPHARAVIAGLGMERDLPSLVSLYVAGICGIAYGLRQILEAQERAGAPVERIAISGGAGQLDMVRQLLADATGKPVLASAVAEPVLLGSAILGAVAAGHEPDMTAAMQRMSRTAAHYEPAGGAIAALHDRRYAAFLALQEAARAAR

SEQ ID NO: 7870 - protein, 242 aa, Rhodobacter sphaeroides
MAELMQGKVAAITGAASGIGLECARTLVAEGATVVLIDRAEDRLKALCAEIGPRALPLVVDLLDGPQVSGMLPRILELAGSLDIFHANAGAYIGGQVAEGDPDAWDRMLNLNINAAFRSVHAVLPYMIERKSGDILFTSSVAGVVPVVWEPIYTASKFAVQAFVHSTRRQVAPHGVRVGAVLPGPVVTALLDDWPKAKMEEALANGSLMQPKEVAEAVLFMLSRPKGVVIRDLVILPHSVDI

SEQ ID NO: 7871 - protein, 442 aa, Rhodobacter sphaeroides
MNALIEGLGHHLAQLPHRQAPQVTGRVVRYDGLLLECAGFPVSPGALCRVATEDGREVQGEVIGFAQGRNLLFLDQMRAPVIAGARVRLVPGGQMAAVGPALLGRVIDAEGAPLDGLPAPDCMGEWPLAGRVMNPLARTAVSRPLDVGVRAINAALTVGQGQRIGIVAGSGVGKSVLIEMMTRYTAADVIVVGLIGERAREVGAFAASVMQGEAARKLCMVAVPADRSPLLRLRAARRATAIAEHFRSEGKQVLLIMDSLTRVAHAQREVGLALGEQPTAKGYPPSVVSMIPGLIERTGPGLPGEGAITAIYTVLADGDDTTNDPVVDTARAILDGHFVLSRRQTQMGLYPAIDIPHSVSRTMNDVVDDRHRRAAARLRQLIALYSDNRDLMLMGGYAAGQDADLDQAVQLWPRIRALIGQGPHEPADFEASRAALLELTGL

SEQ ID NO: 7872 - protein, 437 aa, Rhodobacter sphaeroides
FYGFTDLPSVHQRGTVVLTHGKGPYIYDVHGRAYLDANSGLWNMVAGFDHPGLIEAAKAQYERFPGYHAFFGRMSDQTVMLSEKLVEVSPFARGRVFYTNSGSEANDTMVKMLWFLGAAEGHPERRKIITRVNSYHGVTAVSASMTGKPYNSLFGLPLPGFIHVGCPHYWRFGQAGETEAEFTQRLARELEATIIKEGPDTIAGFFAEPVMGAGGVIPPSEGYFQAVQPVLKRYGIPLIADEVICGFGRTGNTWGCQTYDFMPDGIISSKNITAGFFPMGAVILGPELADRLQAASEAVEEFPHGFTASGHPVGCAIALKAIDVVMNEGLAENVRALTPKFEAGLAYLAENPNIGEWRGKGLMGALEAVKDKATKTPFPGDLSVSERIANSCTDHGLICRPLGQSIVLCPPFIMTEAQMDEMFEKLGAALKKVFAEV

SEQ ID NO: 7873 - protein, 448 aa, Rhodobacter sphaeroides
VALMDLSPGLEEKIRVCNSTYTVRFGVRLRGKIFTFTGYRSVHSEHMEPVKGGIRYALSVSQDEVEALAALMTYKCALVETPFGGSKGGLCIDPREWDEHELEQITRRFAYELAKRDLIHPAQNVPAPDMGTGEREMAWIADQYARMNTADINARACVTGKPINAGGIHGRVEATGRGVQFALREFFRHAEDKARAGLSGDLDGKRIIVQGLGNVGYHAAKFLTEEDGAKVTGVIERDGALVNPAGIPVEELRHWMMKTGSIRGFSQADFVEDGRKLLEEECDILIPAAMEGVITRENAARIKAPLIIEAANGPITFGADEILRQKGTVIVPDLYANAGGVTVSYFEWVKNLSHIRFGRMQRRAEEARSRALVEELERLSADQGLGWQLAPDFKQKFMQGSDELALVRSGLDDTMRIAYQSMREVWHGAEGAQDLRVAAYIVAIRRVA

SEQ ID NO: 7874 - protein, 422 aa, Rhodobacter sphaeroides
LRLGIAGLGTVGIGVVKIIQRHADLIAARAGRPVTITAVCARDRSKNRDADLSGYAWETDAVALAQRADIDVFVEVMGGSEGAARASTEAALAAGKDVVTANKALLAHHGQALAEMAEAAGLAIRFEAAVAGGIPVIKALTEGLAGNQMRRVMGVMNGTCNYILTRMETAGLPYDHVFEEARQLGYLEADPNLDVGGIDAGHKLSLLASIAFGTRVSFDDVQLEGIGQISIDDIRHAGDLGFRIKLLGVAQVSGRGLEQRMTPCLVPADSPLGQLQGGTNMVVLEGDAVGQIVLRGPGAGEGPTASAVMGDVIDLARGLRLPTFGRPATSLVEAVPAKVAAPAPWYLRMTLLDKPGALAKIATALGEAGISIDRMRQYGHEGGHAPVLIVTHKASRDDISHAISRFGATGVLVGEPVAIRIE

SEQ ID NO: 7875 - protein, 248 aa, Rhodobacter sphaeroides
FLQGLFSLTGRRAMVTGASRGLGQAIALGLAEAGADLVLTARAAGALEETAARIRALGREALCLALDQSDPASVAAPMEAAGRIDILVNNAGTEEVCPSEAVTPELWDRILDTNLRGAFFVTQAAARGMLARGQGSIVNLCSLTSFVGVPTAVPYGSSKSGLLGMTRALAAEWAPRGVRVNAIAPGYFRTALTEVFYQNEDWAQAMQARIPQGRFGEGRDLVGAAVFLASDASAYVTGQCLGVDGGYL

SEQ ID NO: 7876 - protein, 423 aa, Rhodobacter sphaeroides
LAELDAAGRAALLRRSETDLSMFLEKVGPILEAVRTEGDAALVRFGRELDRAEGLTREGLKVTEAEFDEAFGLVEPEIVAAIRFAIGNIRTFHEEQAPEPMWLKELRPGAFAGDRFTPIRSVALYVPRGKGSFPSVTMMTSVPAVVAKVPQIAIFTPPAPDGRVDAATLVAARLAGVETVYKVGGAQAVAAAAYGTETVTPALKIVGPGSPWVVAAKRLLAGVIDPGLPAGPSESIILADETVHGGLAALDLLIEAEHGPDSSAWLVTHSRQVAEEALAALPGHWSAMTPQRVDFSQAVLCGRAGGIVLTGSAEESHAFVNDYAPEHLQILSEKPFEHLGRITEAAEVLMGPHTPITIANFCLGPNAVLPTSRGARTWGPLSVHDFLRRSSVGYVTAPAYPELAEVAKRLAEYEGFSSHANAV

SEQ ID NO: 7877 - protein, 493 aa, Rhodobacter sphaeroides
  unsure (1)..(493): unsure at all Xaa locations
PRDGAVCDGMPIDFPARLAXELAGKSRSLRMTATRTETDSFGPLEVPADKYWGAQTQRSIQNFPIGWEKQPVAIVRALGVIKKACALVNVAQGDMPEELGQAIAAAATEVIEGRFDDNFPLVVWQTGSGTQSNMNANEVISNRAIEMLGGTMGSKKPVHPNDHVNMGQSSNDTFPTAMHVAIGMMARDVLLPGLEKLHAALVAKSEEFKDIIKIGRTHTQDATPLTLGQEFSGYAKQVEKGIARVKACLPDIYELAQGGTAVGTGLNTRQGWDSRVAAKIAEITGLPFVTAENKFEALAAHDAMVMFSGALKTVAASLFKIANDMRLLGSGPRSGLGELILPENEPGSSIMPGKVNPTQAEALTMVCTHVMGNDAAIGFAGSQGHFELNVYNPMMSYNVLQSMQLLGDAAGSFTDNMVVGTQANVARIDKLMKESLMLVTALAPTIGYDNATKVAKTAHKNGTTLREEAIALGLVDAETFDRVVRPEDMIGPK

SEQ ID NO: 7878 - protein, 292 aa, Rhodobacter sphaeroides
LSRLLRTRDWLMADGATGTNLFNMGLSSGEPPELWTVDRPDNIRSLYRAAVEAGSDIFLTNSFGGNAARLKLHEAQGRVGELNRIAAELGREVADAAGRPVVVAGSMGPTGEIFEPMGTLTHRMAVEIFHEQAEALKAGGADVLWVETISAAEEFKAAAEAARLAGMPWCGTMSFDTAGRTMMGITAAALVDLVTKLPNPPLAFGANCGVGASDLLRTVLGFAAQGIEVPIIAKGNAGIPKYHDGHIHYDGTPELMAEYAVLARDAGARIIGGCCGTMPEHLKAMRAALEGR

SEQ ID NO: 7879 - protein, 452 aa, Rhodobacter sphaeroides
IDAALGDIEAVLGERLSRSRPVREQHAQSETHLHAGPPDAVAFPRSTAEVARIAEICTAHRVPMVGWGAGTSLEGHALALKGGVTIDFAQMDRILELRPEDMIVRVQPGLTREGLNAALRDTGLFFPVDPGADASLGGMAATRASGTTAVRYGTMRDNVLGLEVVLSDGRVIRTGTAAPKSSSGYDLTALMVGSEGTLGLITELTLRLHGQPEAVSAAVCAFPDMGAAVGCVIETIQHGIPMARIEFLDAASVTACNAYAQMEMPAVPHLLIEFHGTEAGVAEQAERFGEIAAEHGSADFQWATRTEDRARLWKMRHAAYRACLALRPGAEGWVTDVCVPISRLAEAVEETQADLAASPVPGPILGHVGDGNFHAILLVDPQSAEELAEAKRLSGRMAERALRLGGTVTGEHGIGFGKLGYMEAEHGAGWAVMGAIKQALDPLGLLNPGKMV

SEQ ID NO: 7880 - protein, 545 aa, Rhodobacter sphaeroides
MLRSLDIRDMLIIDRLSLAFQPGLNVLTGETGAGKSILLDSLGFVLGWRGRAELVRAGADKGEVTAVFDLPPGHAARAVLDEAGIEAEDELILRRVNFADGRKTAWVNDRRVSGEVLRGLSDRLVELHGQHDDRGLLNPRGHRQMLDTFAGLDLSACRRAWTALGTARRTLLAAEEALAAVRAEEDFLRHAVAELDKLDPQPGEEALLDTRRREMQGAEKIRDDIARAHRALSAEGAETLLVDALRWLETASDRAGNRLEAPLAALSRALLELGEAQDGVEACLADLDFDPRDLEALEERLFAIRALARKHSVLPDELGTFAEELRGRLAALDGGTKQIDALRRALAEAEAAWEAEAAILSEARRGAAGRLDAAMAAELAPLKMERAVFETQVTEADPGPEGRDAVAFTVATNPGAPAGPLNRIASGGELSRFLLALKVCLTGDSPGLTLIFDEIDRGVGGATADAVGRRLKALAEGAQVLVVTHSPQVAALGAHHWRVEKRVAHGMTTSTVSPLGAGDRIEEIARMLAGDTITDAAREAARALL

SEQ ID NO: 7881 - protein, 264 aa, Rhodobacter sphaeroides
GLLAGKRGLIMGLANDKSIAWGIAKCCADQGAELAFSYQGDALKKRVEPLAASIGATEMVECDVSDEASLDRLFAHLKEVWGTLDFVVHAIGFSDKSELRGRYVDTTPANFRMTMDISVYSFTAVCQRACAMMPAGGSLLTLTYYGAEKVMPHYNVMGIAKAALETSVQYIAEDLGKDGIRVNAISAGPIKTLAASGIGDFRYIMKWNELNSPLRRNVTQEEVGKAALYLLSDLGSGTTGEVLHVDAGYHVVGMKAVDAPDIDA

SEQ ID NO: 7882 - protein, 245 aa, Rhodobacter sphaeroides
FRLDGACAAVTGAGSGIGLEICRAFAASGARLILIDREGAALDRAAEELGAAVASRIVADVTDAEAMTAAAAAAEAVAPVSILVNSAGIARLHDALETDDATWRQVMAVNVDGMFWASRAFGRAMVARGAGAIVNLGSMSGTIVNRPQFASSYMASKGAVHQLTRALAAEWAGRGVRVNALAPGYVATEMTLKMRERPELFGTWLDMTPMGRCGEPSEIAAAALFLASPAASYVTGAILAVDGGY

SEQ ID NO: 7883 - protein, 299 aa, Rhodobacter sphaeroides
RKTEIMPTYDVSSIGFYVCDILGRPVTRIPDGGRADYIQEIRMTVAGTAGATAADCAILGLKTLAVTTVGEDEMGDFMVAKLTRFGVDCAMVARDGSVQTSATILPVRPNGERPALHVPGTAATFRIPEGRLDAALDARIVHVGGTGLLKSFDGAPTVEALRRAKELGRITTFDLIQATPETFELVRPCLPYIDYFVPSIEEASEMAGTTDPAEVARFFKGLGVKNAILTMGGEGVYVSPEAGEDFRLPAHAIEVVDTTGCGDSFTAGVIVGLARGWDLRDCCRFASAVAARVAMGLGS

SEQ ID NO: 7884 - protein, 254 aa, Rhodobacter sphaeroides
PCGRTEDGRMTKTAVVTGAARGIGRALAVGLAEAGYDVAVTDLAAQADGLAETRALIEAAGRRAFVETVDVSDRAAVVAAMARIEDAAGGIDVLVNNAGILKPARLEDLSEADWDAHMDVNVKGVLSCCQAVLPGMRARKAGRIVNIASIAGRQGVPTQGHYAATKAAVITLTRVLAQEAGMDGITVNAICPGIILTEMGKNNLGSDEAIRHWEEVAALKRLGAPEDIVGPVLFFAGEQSAFVTGQALNVCGGI

SEQ ID NO: 7885 - protein, 468 aa, Rhodobacter sphaeroides
DRFFIGGAWTAPLGTDRHRLVNPATEEEIAAIPMASTEDVDRAVTAARAAFEGWQASSKEERLLLLRRLLDLYNEAYDELAELMTREMGTVARFSREAQAWVGRAHLEAAIEALEAESFEEMRGSTLISKEPIGVCALITPWNWPMNQLVVKVAPALAAGCTVVAKPSEFSPLSSIRFAELVEAAGFPPGVYNHITGAGPVAGEALARHPDVDMISITGSTRAGIAVARAAADTVKRVTQELGGKSANIILPDADLATAVRQGVLDCFGNAGQACKAPARMLVPAERMEEAAALAGAAAEALTVGAPEGEVDLGPVVNESQWRRIQSLIEAGIAEGARLVTGGPGRPDHLPRGWYVRPTVFADVAHGSTIATEEIFGPVVALIPYRDEEEAVRIANDSIYGLAGYIQTGDPETARRIARKLRVGMVYINGAGWDARAPFGGYKQSGNGREHGAWGLADYLETKATAGL

SEQ ID NO: 7886 - protein, 393 aa, Rhodobacter sphaeroides
RDAFLAGMRELLEGIEAEGLTKRERPILSAQGTHVRVGDRDLLNLCANNYLGLANHPALIEAARRGMDEHGYGMASVRFICGTQDIHRALEGRIARFLGMEDAILFAACFDANGGLFEPLLGPEDAVISDALNHASIIDGIRLCKARRYRYANSDMEDLRRQLAEARAEGARHILIATDGVFSMDGYLARLPEIVALAEEFGALVMVDDCHATGFMGPKGQGTPAHHGVTVDILTGTLGKALGGALGGYVAGPQPVIDLLRQRARPYLFSNALPPAVVAAGLAALDLVEAADDLRAALFENTAYWRAGLTEAGFRLLPGAHPIVPVMLGEARLAQEMAAALYDRGVYVSGFFFPVVPRGQARIRTQMNAALTRDDLDLALAAFREAGRAVGAI

SEQ ID NO: 7887 - protein, 340 aa, Rhodobacter sphaeroides
MRALVKAKAEPGLWMEERPVPEIGPDEVLIRVRKTGICGTDVHIWNWDDWAAKTVPVPLVTGHEFAGEIVEVGRDVRDLSPGQRCSGEGHLIGHHSRQVRAGRFHLDPETRGIGVNVPGAFADYLRLPAFNVVPLPDAIDDEVGAILDPLGNAVHTALSFDLVGEDVLVTGAGPIGIMAAAVARHVGARHVVITDVNADRLRLSTEVADVVPVNVATEDLRSVMGRLKIVQGFDVGMEMSGAPAGFDQMVEAMVMGGRIAMLGIPPGRSPVDWSRIVFKALTIKGVYGREIFETWYKMIAMLENGLDIRRVITHRFPVADFAEGFAAMRSGASGKVVLDW

SEQ ID NO: 7888 - protein, 641 aa, Rhodobacter sphaeroides
VSDYGAGGEFHQHAGEGDERLTTAQGVTIADNQNSLRSGAPGPTALEDFILREKIFHFDHERIPERVVHARGFGAHGLFECTKAIPEITRAAPFQKEGKITETFVRFSTVAGSKGSVDLARDVRGFAVKFYTDEGNWDLVGNNIPVFFIQDAIKFPDLIHSVKPEPDRGFPQAQSAHDNFWDFISLTPESMHMVMWQMSDRAIPRSFRFMEGFGVHTFRFINAEGQSSFVKFHWKPKLGMQSVLWDEALKINGADPDRHRRDLWEAITAGDFPEWELGLQIFDEEFANRFDFDVLDPTKIIPEELVPLTIVGTLTLDRVVDNFFAETEQVAFCTQNVVPGIDFTDDPLLQGRNFSYLDTQLKRLGSPNFTKLPINAPRGCPVHNFQQDGHMQTSNRKGRVNYEPNGWGKGPRAHPLEGYVSYAVRNEGEKRRLRPESFADHYSQARQFFLSQTPVEQGHIRDALVFELSKCQEIEIRARIVAHLLNIDGALAQAVADGLGLTEMPEPAPAARPTRTDLPPSDALSMLKNPPPNFAGRTVGVLAGNGVEAELLTELRSILQAEGAMMKLVAPRVGGVTDSAGTLHPADEKLGGGPSVIFDAVAVLPGSDAAMLAANPAAQDFLTDAHAHCKFIAHHGAGPLI

SEQ ID NO: 7889 - protein, 356 aa, Rhodobacter sphaeroides
IGSEIYRRSSYGGRHPLRVPRVSTVTDLGRALGWLPAASFRTAPRAKPAALTLWHDPAYVAALAAAEAGLAAPELLAAHGLGTLSNPVFPEMFRRPATGAGGVMLAAELLRGGGAIHVPGGGTHHGMRDRANGFCYLNDPVLGMLVLRRMGLRRIAYVDIDAHHPDGVEAAFAGDPEVLLISVHEEGRWPFTGALEDEGGGTCFNLPVPRGFNDTEMRAVLEELILPRLAAFRPEAVVLQCGADALEEDPLSRLSLSNNAHFEVVAALRPVAPRFLVLGGGGYNPWSVGRCWAGVWATLAGHEIPDRLPEAARAVLAGLDWGGGGRPPPAPPLIETLRDAPREGPVRPEIRERLAR

SEQ ID NO: 7890 - protein, 346 aa, Rhodobacter sphaeroides
MPRPVSLASLATAVPPHRVTQREAAEAAHGGFAARYDDFARLAAVFETSGIRTRHLVRPVEWYLQPLGWEARNAAYLEAAEALFIEAATAALERASLSAAEVDTVVTISSTGIATPSLEARVADRMGFRSDLERVPVFGLGCAGGVSGLGLGARLAAARPGSTVLVVAVELCSLSFRLDRLTKENIVATALFADGAAAAVLRAVDGPLTVEMAGQHSWPQTLDIMGWHVDDGGLGVIFDRAIPPFAEAHVAGAIEAILGRAGLTRAEVDRFACHPGGAKVITALERSLSLEQGTLDHEREVLAQNGNMSAPTALFVLARVLNAEPPPRTLLTAMGPGFTASCVSLQ

SEQ ID NO: 7891 - protein, 535 aa, Rhodobacter sphaeroides
WLIQPLFDRVFAPGGNNLLPWVGLAILGLFVLRAITSVASKAILTRVSQISSTAMQVDLLRHILTLDQGFFQKNPPGALMERVQGDTNAVQGVWSSVILGMGRDVVSLIGLFAVAVSIDPIWTLAALVGAPLLILPALVVQRYIRKKTRQMRVQAGARSTRLDEIFHGIQPIKLNRMETYQLDRFRRIVDVIVRGQLKMAVGRATMPALIDVITGIGFFAVLVLGGREIASGERTTGEFMSFFTAMALTFQPLRRLGDLSGFWQIAAASLERIYRLFDTEPQVLRRPVTATPKAGVPEILIEDVHFAYDDHPVLNGLSFRAAPGRMTALVGPSGAGKSTVFHLLTGLIEPRSGRVLLNGVDAADMALSDLRAQFAVVSQEAGLFDETIRENVTLGRDVPQDRLRAALEAAHVTEFVDGLPEGDLTPAGPRGSRLSGGQRQRVAIARALVSEAPVLLLDEATSALDAASEALVAEALSRLGEGRTTLVIAHRLSTVRQADRIVVMEEGRVVDQGTHEELLARGGLYAELHRLQFRN

SEQ ID NO: 7892 - protein, 183 aa, Rhodobacter sphaeroides
DAMLTVPREVYVPRPLREVAYMSENVAVAPNRVLLEPRTFAKLLDTLNIQPVESVLDVACGLGYSCAVIARLAEAVVGLEEDEQLAAEAQRTLSAEGVDNAAVIVGPLTSGAAKHGPYDVITVEGAVETVPQALLDQLKEGGRIGCIFMEGPLGVARIGYKVDGAITWRPVFNASAPVLPGFE

SEQ ID NO: 7893 - protein, 654 aa, Rhodobacter sphaeroides
DLVPCGRPHGTLLTFTGGSDDQSHPRPETPLLDRVCCPADMKALSDAELERLADEVRSEVISVVAETGGHLGSSLGVVELTVALHAVFNTPTDKLVWDVGHQCYPHKILTGRREQMRTLRQKGGLSGFTKRSESAYDPFGAAHSSTSISAALGFAMGRELGQPVGDTIAVIGDGSITAGMAYEALNHAGHLNKRLFVILNDNDMSIAPPVGALARYLVNLSSKAPFATLRAAADGLEASLPGPLRDGARRARQLVTGMPGGGTLFEELGFTYVGPIDGHDMEALLQTLRAARARTTGPVLIHVVTKKGKGYAPAENAPDKYHGVNKFDPVTGEQKKSVANAPNYTKVFGSTLTEEAARDPRIVAITAAMPSGTGVDIMQKRFPNRVFDVGIAEQHAVTFAAGLAGAGMKPFCAIYSSFLQRGYDQIAHDVALQNLPVRFVIDRAGLVGADGATHAGAFDVGFITSLPNMTVMAAADEAELIHMIATAVAFDEGPIAFRFPRGEGVGVEMPERGTVLEPGRGRVVREGTDVAILSFGAHLHEALQAAKLLEAEGVSVTVADARFSRPLDTGLIDQLVRHHAALVTVEQGAMGGFGAHVMHYLANSGGFDGGLALRVMTLPDRFIEQASPEDMYADAGLRAEDIAATARGALARGR

SEQ ID NO: 7894 - protein, 288 aa, Rhodobacter sphaeroides
MAFEQRIEAAMAAAIARGQGSEAPSKLATALDYAVTPGGARIRPTLLLSVATACGDDRPALSDAAAVALELIHCASLVHDDLPCFDDAEIRRGKPTVHRAYSEPLAILTGDSLIVMGFEVLARAAADQPQRALQLVTALAVRTGMPMGICAGQGWESESQINLSAYHRAKTGALFIAATQMGAIAAGYEAEPWEELGARIGEAFQVADDLRDALCDAETLGKPAGQDEIHARPNAVREYGVEGAAKRLKDILGGAIASIPSCPGEAMLAEMVRRYAEKIVPAQVAARV

SEQ ID NO: 7895 - protein, 495 aa, Rhodobacter sphaeroides
MRQIVPKVVVVGAGMGGLASAIRLARAGCEVTLLEAREAPGGRMRTLPSVAGPVDAGPTVLTLREVFDDIFEVCGQKLDHHLTLLPQPLLARHWWLDGSTLDLTTDLEANVEAVAAFAGAREARAFRRFHDLSARLYDAFDRPMMRAARPDLRAIATGALKAPRTWPALLPGMTLDRLLRLFFRDRRLRQLFGRYATYVGGTPYGAPGVLALIWAAEARGVWAIEGGMHRLALALARLADDQGVRLRYGAPVARILRQGGRATGVQLADGRTLPADHIVFNGDPAALLAGCLGDGPQDAVPEDRIHPRSLSAWVWSYAARASGPPLVHHNVFFADDPRREFGPIAAGQMPEDATLYICAEDRSGGQLPDGPERFEIIMNGPPGRPAKPEDFAQCRSRTFDRLRQFGLTFDPVPGETSLTAPSGFASLFPASQGSIYGLSPHGALASLKRPLARTALPGLWLAGGGAHPGAGVPMAALSGRHAAEAILADLASRSR

SEQ ID NO: 7896 - protein, 563 aa, Rhodobacter sphaeroides
  unsure (1)..(563): unsure at all Xaa locations
EQGSSALRVAKREGIVXRDRRQRQGXKMAEQQKGLTYADAGVDIDAGNALVERIKPAAKRTARPGTVSGLGGFGALFDLKAAGYQDPVLVAATDGVGTKLRIAIDTGEVDTIGIDLVAMCVNDLVCQGAEPLFFLDYFATGKLEVAQAARIIEGIAEGCAASGCALIGGETAEMPGMYHKGDFDLAGFAVGAMERGADLPQGVAEGDLLLGLGSNGVHSNGYSFVRKVVELSGLGWDAPAPFGGDSLGRALLAPTRLYVKQALAAVRAGGVHALAHITGGGLTENLPRVLPKGLGARIDLSAWELPPVFRWLAETASMAEPELLKTFNCGIGMIVVVAADRADEIAALLAAEGETVTRIGEVIAGEGVSYDGRLLXNGVAVLISGGGSNMLALLRSMEGAHPARPVLVASNDPAAAGLKRAAELGVPVAAVDHRPFRGDRAAFEAALLEPILAAEPDILCLAGFMRVLTPAFVARFEGRMLNIHPSLLPKYQGLHTHQRALEAGDAEAGCTVHEVTAALDDGPILGQARVPILPGDKAETLAARVLTREHALYPAVLRRFAAG

SEQ ID NO: 7897 - protein, 246 aa, Rhodobacter sphaeroides
MGKKMRKLAAGNWKMNGTEADLGEIDALLAAHPSPRCEMLICPPATLVARMAGRAAQGLMVGGQDCHPKTSGAHTGDVSAAMLADAGASHVILGHSERRADHGETDSLVRLKAEAAWGAGLVAIVCVGETEAQRDAGQTLDVIGAQLAGSVPEAATAANTVIAYEPVWAIGTGRTPTTAEIAEVHAFLRARLAERFSDAEGFRLLYGGSVKPSNAAEIFAVPNVDGALVGGASLKAADFGGIVAAL

SEQ ID NO: 7898 - protein, 549 aa, Rhodobacter sphaeroides
MYSYTDFDEAFVRTRVAQFSEQVRRRIDGSLTEDEFKPLRLMNGLYLQLHAYMLRVAIPYGTLDSRKMRQLAMIAERWDKGYGHFTTRQNIQFNWPKLGDVPEILSALADVGMHAIQTSGNCVRNVTADHFAGAAADEIEDPRPVAELLRQWSTDHPEFQFLPRKFKIAITGSPNDRAVTKSHDIGLRMVRNADGEPGFEVIVGGGLGRTPMIGRVVRDFLPKADLLPYVEAILGVYNELGRRDNKYKARVKILVHETGLEPLREIIEERFLETRAEFGGQDMALLAEIERAFAPPAFRQAPTAAYDDFYRADPIFRAWADTNLARHRNADYAIVTISLKAHGATPGDATAEQMRVMADLAERYGHDELRISHEQNVILPHVHKADLPAVHAALAQAGLATANVGLISDIIACPGMDYCALATARSIPVAQEIATRFDTLDLEHEVGPLKIKISGCINACGHHHVGHIGILGLDRAGVENYQITLGGDGTETAAIGEKTGPGFAYDEIVPAVERIVRAYLEIRSEPSETFLDTLRRVGHAPFKAALYEA

SEQ ID NO: 7899 - protein, 188 aa, Rhodobacter sphaeroides
SFGAESVVLLHLVSVIAPETPVIFIDTRMLFQETLDYQRELADTLHLCDIRTIRATQPRIAFEDPDGTLNRYNTDACCAVRKVEPLERALKHFDGWITGRKRYQSGTRAAVEFFEAEDDRRIKVNPLAHWGREDLEDYIVNNNLPRHPLVARGYPSIGCEPCTSPVAEGEDPRAGRWRGSAKTECGIH

SEQ ID NO: 7900 - protein, 500 aa, Rhodobacter sphaeroides
SQPVVLRLSGITKRFGALLANAGISLSLCRGEVVALLGENGAGKTTLMNILFGHYVADEGTVEVFGQPLPPGHPRAALAAGVGMVHQHFTLADNLTVLENILLGTAPLWRPSLGRRAARARIEALSRDFGLAVHPDARVGTLSVGERQRVEILKALYRDARILILDEPTAVLTPQETEALFRTLKLAVAKGLSIIFISHKLHEVMGVADRCVVLRHGRVVGEVATAETDRHRLAALMVGEEVVPPAVAPPQPGPVLLRLDRVTTPAQGSATGLRGVSLDLRAGTITGLAGVSGNGQAALSDLVSGLVRPSEGRLELAGADVAHWTPRTAVASGIARIPEDRHSTGTIADFTLTENAILEGYRSRFAKGGWMDWRAARGFAQSIIATYDVRCPGPETRIRLLSGGNMQKLILGRVLEPGPRIILANQPVRGLDIGAITYVHSRLLKARDEGAAVILISEDLDEIMALSDTVHVMSEGRLSPGFARGTMSQTELGLWMAGHG

SEQ ID NO: 7901 - protein, 303 aa, Rhodobacter sphaeroides
LAPAGRLLAQSGREALPADHPLQAAWRSWKDAFLLPAGRIVDGPQQNASHSEGQGYGATLAAIFGDEEALRRIVDWTEANLARREDKLLSWRWLPGVALAVPDENNATDGDLFYAWGLAMAAQRFGKADYAGRATELARAIALHCVRPHPDGSEQLVLLPGASGFETPDGVVLNPSYYMPRALTELAAFSGQDRLARCARDGADWIASLGLPPDWALVTPFGTQPAPGLSHNSGYDALRVPLFLLWSGLTANPALRRAVEAAGDAAAGDTPVRFDRDTGAVLERSADPGFRAVLALGDCALSG

SEQ ID NO: 7902 - protein, 464 aa, Rhodobacter sphaeroides
LRPARRRRRSCARRRPRERKIPAPTRSPPMNRDAMPNAFRPGAVDLPPREADLVARRQALLGPAYRLFYERPLHIVRGEGVWLYDADGTAYLDAYNNVASLGHCHPRVVDAVARQAGQLATHTRYLHEGVLELAERLLATLPTELGHAMFTCTGSEANDLALRLAFAATGGTGVIVTENAYHGVTMGVAALSPSLGPGVPLGVHVRTVPAPDQDKGADVTFGAAVAAAAADLARHGIRPAALILDTVFSSDGVFTHPTDTLAPAAAAIRAAGGLFIADEVQPGFGRTGEAMWGFLRHGVVPDMVSMGKPMGNGYPVAALALRPELAERFGAGARYFNTFGGNAVAAAAALAVLDTLEAEGLQAHALNVGGQFRADLSALSARDPRLGAVRGAGLFLGVEVLEPESRAPDARMAARIVNGLREARVLISATGPHGHVLKIRPPLVFSDANAAFFLERFESVLAAL

SEQ ID NO: 7903 - protein, 407 aa, Rhodobacter sphaeroides
MDYNLALDTALNRLHTEGRYRTFIDIERRKGAFPKAMWRKPDGSEKEITVWCGNDYLGMGQHPVVLGAMHEALDSTGAGSGGTRNISGTTLYHKRLEAELADLHGKEAALVFSSAYIANDATLSTLPQLIPGLVIVSDKLNHASMIEGIRRSGTEKHIFKHNDLDDLRRILTSIGKDRPILVAFESVYSMDGDFGRIEEICDIADEFGALKYIDEVHAVGMYGPRGGGVAERDGLMDRIDIINGTLGKAYGVFGGYIAASSKMCDAVRSYAPGFIFSTSLPPVVAAGAAASVRHLKGDVELREKHQTQARILKMRLKGLGLPIIDHGSHIVPVHVGDPVHCKMISDMLLEHFGIYVQPINFPTVPRGTERLRFTPSPVHDSGMIDHLVKAMDVLWQHCALNRAEVVA

SEQ ID NO: 7904 - protein, 462 aa, Rhodobacter sphaeroides
AKSFDMIVIGAGPGGYVCAIRGAQLGLNVAIVERENLGGICLNWGCIPTKAMLRSAEVYHLMHRAKEFGLKAEGIGYDLGAVVKRSRGVAKQLSSGVAHLMKKNRITVVMGDATLAGKGRVSVRTDKGTEELEAKSIVLATGARARELPGLEADGDLVWTYRHALEPKRMPKKLLVIGSGAIGIEFASFFNTLGADTTVVEVMERILPVEDAEVSAFAKKQFVKQGMKILEKATVKKLDRAGGKVTAHVETGGKTETMEFDTVISAVGIVGNVEGLGLEAAGVTVDRSHVVTDEYCRTGVEGLYAIGDIAGAPWLAHKASHEGVMVAELIAGGHPHPIKPGSIAGCTYCQPQVASVGLTEAKAKEKGYEIRVGRFPFIGNGKAIALGEAEGFVKTVFDAKTGELLGAHMVGAEVTELIQGYVVGRALETTEAELMETVFPHPTLSEMMHESVLDAYGRAIHF

SEQ ID NO: 7905 - protein, 496 aa, Rhodobacter sphaeroides
ELSHWIDGKRVKGTSGRFADVFNPATGEVQARVPLASKAELDAAVASAAAAQPKWAATNPQRRARVMMEVVRLLNRDMDKLAEALSREHGKTIPDAKGDVQRGLEVIEFCIGAPHLLKGEFTDSAGPGIDMYSMRQPLGVAAGITPFNFPAMIPLWKMGPALAAGNAFILKPSERDPSVPLMLAEIFQEAGLPDGVLQVVNGDKESVDAILDNPTIAAVGFVGSTPIAEYIYSRGCANGKRVQCFGGAKNHMIIMPDADLDQAADALVGAGYGAAGERCMAISVAVPVGDETADALIERLIPRIEKLKVGPYTAGNDVDYGPVVTAAARENILRLVQSGVDQGAKLVVDGRNFSLQGYEKGFFVGPHLFDHVRPDMDIYRKEIFGPVLSTVRAASYEEALSLAMDHEYGNGTAIYTRDGDAARDFAARVNVGMIGINVPIPVPLAYHTFGGWKKSAFGDLNQHGPDSFRFYTRTKTITSRWPSGIKEGSAFNFKAM

SEQ ID NO: 7906 - protein, 329 aa, Rhodobacter sphaeroides
MTVKVAINGFGRIGRNVLRAIIESGRTDIEVVAINDLGPVETNAHLLRFDSVHGRFPATVTTTEKTIDVGRGPMDVTAIRNPAELPWGHVDIVLECTGIFTDKEKAKVHLESGAKRVLVSAPSTGADKTIVYGVNHETLTKDDLIVSNASCTTNCLSPVAKVLNDTIGITKGFMTTIHSYTGDQPTLDTMHKDLYRARAAALSMIPTSTGAAKAVGLVLPELKGKLDGVAIRVPTPNVSVVDLVFEASRATSVEEVNAAIREAADGKLKGILGYTDQPNVSMDFNHDPHSSIFHLDQTKVMEGNMVRILTWYDNEWGFSNRMADTAVAM

SEQ ID NO: 7907 - protein, 671 aa, Rhodobacter sphaeroides
VDIQSLREQHPDHWKKACAIRALTLDAVAAANSGHSGMPMGMADVATVLYEKHMVFDARSPDWPNRDRFVLSAGHGSMLVYALLHLTGDPEFPIEQIRNFRQWGSKTAGHPENFLAKGIETTTGPLGQGLAMSVGLAMAEESLRARWGAKIIDHYTYCIAGDGCLMEGVSQEAIGLAGRHELSHLIVMWDNNGITIDGKVSLSDRTDQKARFAAAGWDVFECDGHDPADIDRALTAAKASKGPAFIACTTHIALGSSAQDTSKGHGALTDAKLIADTKAAYGWTSAAFEIPADVKKAWEAIGARGAEARKAWDERLAALSDGKRALFQQQFSCEPPKKLASAIRAVKKDAVEKMPKVATRRASEMVLEAVNPVMPETIGGSADLTGSNNTKTADLGVFDPINRKGRYVYYGIREHGMAAAMNGMALHGGLRPYGGTFMCFADYCRPAIRLSALMHMPVVYVFTHDSIGLGEDGPTHQPVEHLAMLRATPNMMVFRPADLVETAEAWEIALGAKATPSVLALSRQNLPAVRKNHTNKNLVAQGGYVLEEATGKRQVILIASGSEVEVALKAREALEADGIGTRVVSMPCMELFAQQDEAYRRKVLPAGAVRIAIEAGVRMGWDRWLLGERGREGKDGFVGMTGFGASAPAERLFQEFGITYEATVAKAKALL

SEQ ID NO: 7908 - protein, 744 aa, Rhodobacter sphaeroides
LEQAIHGALALANARRHELATLEHLLLALIDEPDASRVMKACSVDLDELRKTLVDFIDDDLSTLVTSVEGSEAVPTAAFQRVIQRAAIHVQSSGRTEVTGANVLVAIFAERESNAAYFLQEQDMTRYDAVNFIAHGVAKDPSYGEPRPVTGAEEHHETPKAEAGEAKESALSKYCVDLNVKARKGDVDPLIGREHEVERCIQVLCRRRKNNPLLVGDPGVGKTAIAEGLARKIVNGETPDILARATIFSLDMGALLAGTRYRGDFEERLKAVVKEMEDHPDAILFIDEIHTVIGAGATSGGAMDASNLLKPALQGGKLRCMGSTTYKEYRQHFEKDRALSRRFQKIDVNEPSVEDTVKILMGLKPYFEEHHDLRYTQDAIRTAVELSARYIHDRKLPDKAIDVIDEAGAAQHLLADSKRRKTIGPREIEAVVAKIARIPPKSVSKDDAEVLRDLEKTLKRVVFGQDRAIEALSSAIKLARAGLREPEKPIGNYLFAGPTGVGKTEVAKQLASILGVELLRFDMSEYMEKHAVSRLIGAPPGYVGFDQGGMLTDGVDQHPHCVLLLDEIEKAHPDVYNILLQVMDHGKLTDHNGRSVDFRNVILIMTSNAGAAELAKSAIGFGRDRREGEDTAAIERTFTPEFRNRLDAVISFAPLGKEIILQVVEKFVLQLEAQLMDRGVHIELSPEAAAWLGDKGYDDKMGARPLGRVIQENIKKPLAEELLFGRLVKGGVVKVGVKDDTIDL

SEQ ID NO: 7909 - protein, 255 aa, Rhodobacter sphaeroides
MPLELVTVPCLSDNYAFLVHDAGTGETSVVDVPEAGPILKALEERGWHLSQILLTHHHSDHVAGVEELRAATGARVAGAAADAHRLPPLDLELAEGDLVRVGASEGRVIEVPGHTVGHIAFHFPDSSLAFTGDSLMAMGCGRLFEGTAEAMWQSLRKLSALPPETMICSGHEYAASNARFAATLEPDSPMLIFRVGSIAAARKEGRPTVPSHLSDEIATNPFLRAGEASLKAAVGMVDAEDAEVFAEIRRRKDKF

SEQ ID NO: 7910 - protein, 186 aa, Rhodobacter sphaeroides
VSEPASISSGIAARYAAAVFELAKDEGALPALEKDMDALGAAWSESADLRDLATSPVYAREEQQKAIAAVAAKMGLSTVTANTLALMGSKRRLFVLPQMVADVQNRIATEKGEITAEVTAAAPLSPEQAARLAATLKARAGKDVKLKTTVDESLIGGLVVKLGSSMIDTSVKARLAALQNAMKEVG

SEQ ID NO: 7911 - protein, 494 aa, Rhodobacter sphaeroides
IQAAEISAILKEQIKNFGQQAEVAEVGRVLSVGDGIARVHGLDNVQAGEMVEFPGGIRGMALNLEVDNVGVVIFGDDRSIKEGDTVKRTKSIVDVPAGDALLGRVVDGLGNPIDGKGPIAATERRVADVKAPGIIPRKGVHEPMATGLKSVDAMIPIGRGQRELIIGDRQTGKTAIALDTILNQKSYNEAAGDDESKKLYCIYVAIGQKRSTVAQLVKKLEETGAIDYTLVVAATASDPAPMQFLAPYAATAMAEYFRDNGRHALIIYDDLSKQAVAYRQMSLLLRRPPGREAYPGDVFYLHSRLLERSAKLNKDHGAGSLTALPIIETQGGDVSAFIPTNVISITDGQIFLETELFYQGIRPAVNTGLSVSRVGSSAQTDAMKSVAGPVKLELAQYREMAAFAQFGSDLDAATQQLLNRGARLTELMKQPQYAPLTNAEIVCVIFAGTKGYLDKVPVKDVGRWEQGLLKHLRTNAKDLLADITNNDRKVKGEL

SEQ ID NO: 7912 - protein, 289 aa, Rhodobacter sphaeroides
MPSLKDLKNRIGSVKNTRKITKAMQMVAAAKLRRAQEAAEAARPFAERMTAVMTGLAGSVGSSESAPRLLAGTGSDKVHLLVVMTAERGLCGGFNSSIVRLARAHAAKLLTQGKTVKILTVGKKGREQLRRDLGQHFIGHVDLSEVKRMGYPVAQGIARDLLDRFDKGEFDVATIFFARFQSVINQVPTAQQVIPAVFEGEGEVSSLYDYEPSEEGVLADLLPRGVATQIFTALLENGASEQGARMSAMDNATRNAGDMINRLTIEYNRSRQAAITKELIEIISGAEAL

SEQ ID NO: 7913 - protein, 474 aa, Rhodobacter sphaeroides
ATASQGKVTQVIGAVVDVQFDGGLPPILNALETENNGKRLVLEVAQHLGESTVRTIAMDATEGLVRGARVTDTGSPISVPVGDATLGRILNVIGEPIDEKGDLGEASTRAIHQPAPTFAEQSTTSEILVTGIKVIDLLAPYSKGGKIGLFGGAGVGKTVLIMELINNIAKVHSGYSVFAGVGERTREGNDLYHEMIESGVIKIDNLSESKVALVYGQMNEPPGARARVALTGLTLAEQFRDQSGTDVLFFVDNIFRFTQAGSEVSALLGRIPSAVGYQPTLATDMGALQERITSTKAGSITSVQAIYVPADDLTDPAPATSFAHLDATTVLSRAISELGIYPAVDPLDSTSRILDPQIVGEEHYNVARAVQGILQRYKSLQDIIAILGMDELSEEDKLSVARARKIQRFLSQPFDVAKVFTGSDGVQVPLEKTIASFKAVVNGEYDHLPEAAFYMVGDIEDVIAKAQRLAAQAA

SEQ ID NO: 7914 - protein, 321 aa, Rhodobacter sphaeroides
MNEPKLISGNANLTLAKSIARRMSVHRGMAVSLVDARVERFNDQEIFVEVYENVRGEDMYVIQPTSNPANDNLMELLIIADALRRSSADRITAVIPYFGYARQDRRAKARTPISAKLVANLIVEAGIDRVLTLDLHAAQIQGFFDIPVDNLYSAPVFALDIEHHFKGQLQDLMVVSPDVGGVARAREIAKRINAPLAIVDKRREKPGEIAEMTVIGNVAGKKCIIVDDICDTAGTLCKAAEVLIENGAVEVHSYITHGVLSGPAVERVTKSVMKSLVITDSIEPSAAVRGAPNIRIVPTAPMFAQAILNIWSGTSVSSLFE

SEQ ID NO: 7915 - protein, 311 aa, Rhodobacter sphaeroides
  unsure (1)..(311): unsure at all Xaa locations
MIKVFGHKSPDTDSTGSPIIWAWYLTEVKGTPAKAVLLGEPNTEAAFVLKHWDLEKPEIISDVTADDSCVIVDTNNPAELPPSINEAKVVGIIDHHLLVGGIKTKSPIEITVRPLACTATIMHDLMGEDLARAPRGIKGAMLSCILSDTLEFRSPTTTAHDRAVAEKLAADLGVDIPAFAAELFAAKSDVSAFSDAELLRMDSKEYEIEGKQFRISVLETTAPQVLLDRKASLMASMPGVAQEDGADQVVLFIVDILREEATLLVPNDLVKTLAEKSFGATVTGDTVVLPGVMSRKKQIIPVLKLXPXPAA

SEQ ID NO: 7916 - protein, 95 aa, Rhodobacter sphaeroides
MAFKPLHDRVLVRRVQSDEKTKGGLIIPDTAKEKPAEGEVVSCGEGARKDSGELIAMSVKAGDRVLFGKWSGTEVTIDGAELLIMKESDILGILS

SEQ ID NO: 7917 - protein, 547 aa, Rhodobacter sphaeroides
MAAKDVKFDTDARDRMLRGVNILADAVKVTLGPKGRNVVIDKSFGAPRITKDGVSVAKEIELSDKFENMGAQMVKEVASRTNDEAGDGTTTATVLAQAIIKEGLKAVAAGMNPMDLKRGIDLATSKVVEAIKAAARPVNDSHEVAQVGTISANGEAQIGRFIADAMQKVGNEGVITVEENKGLETEVEVVEGMQFDRGYLSPYFVTNADKMTAELDDVYILLHEKKLSSLQPMVPLLEAVIQSQKPLLIIAEDVEGEALATLVVNKLRGGLKIAAVKAPGFGDRRKAMLQDIAILTGGQVISEDLGMKLENVTIDMLGRAKKISINKDNTTIVDGNGDKAEIDARVAQIRNQIEETSSDYDREKLQERVAKLAGGVAVIRVGGMTEVEVKERKDRVDDALNATRAAVQEGIVVGGGVALIQGGKALDGLTGENPDQNAGITIVRRALEAPLRQIAQNAGVDGSVVAGKVRESNEKSFGFNAQTEEYGDMFKFGVIDPAKVVRTALEDAASVASLLITTEAMIADKPEPKSPAGGPGMGGMGGMDGMM

SEQ ID NO: 7918 - protein, 272 aa, Rhodobacter sphaeroides
AMTATLEFHDGSRIPQLGFGLWQVPEDRTAEVVREALELGYRLADGAAIYGNEEGLGHGLRTSGLPRDKVFVTTKVWNDAQGFESALRAVEESLKRLGLDRLDLCLIHWPAPKRNLYVETWRALIRLRDEGRITSIGVSNFDLDQIDRLTAETGVTPVLNQIELHPMLQQAELRAGHAERGIVTQSWSPLGRGMAFETPAIREIAERTGRSPAQVVLRWHIELGCAVIPRSTRRAGLAENLALFDFELTEADHAAISALDAGTRTGPDPQSF

SEQ ID NO: 7919 - protein, 377 aa, Rhodobacter sphaeroides
ANWSYPTAVKFGAGRIAELAEQCKAVGLKKPLLVTDKALAALPITAAALDQLEAAGLGRACFSDVDPNPNEKNMEAGIAVYKAGGHDGVICFGGGSALDLGKMIALMHDQTVSVWDLEDIGDWWTRADAAKIAPILAVPTTAGTGSEVGRAGVLTNSETHKKKIIFHPKLLPAVTICDPELTVGMPKFITAGTGMDALAHCLEAYCSPFYHPMSQGIALEGMRLVFENLPKVYATPGDLEARAHMMSAAAMGAVAFQKGLGAIHSLSHPVGAVYNTHHGTTNAVVMPMVLDFNRPAIEEKIERAAAYLGIEGGFDGFRAKIMALRAELAIPETLSAMGVEASRLDELTEMALEDPSCGGNPVEMTRENTRALFEACL

SEQ ID NO: 7920 - protein, 460 aa, Rhodobacter sphaeroides
GNIMTKPIQLISPVDGRVYAERMPLSMADAKAMARRARAAQPAWAARPLEERIALVKAGVAKLNEMKDLVVEELAWQMGRPTRFGGEFGGVNDRTSYMAEIAAETLAPTVVEASDRFERRIVREAVGVVLIVAPWNYPYLTTINTLVPALIAGNSVVLKHASQTLLVGERLADAFHAAGVPEDVFQNVVLDHGTTEALIGARAFNFVNFTGSVSGGYAIERAAAGTFTATGLELGGKDPGYVRADADLDAAVDSLMDGAMFNAGQCCCGIERIYVHESLYDAFVEKAVAWVKALKLGNPFEPETTLGPMANVRFARVVREQVAEAVAAGAKPLIDPALFPADDGGAYLAPQILVNVTHDMRVMKEESFGPVVGIMKVSGDEEAIGLMNDSPYGLTCSLWTEDAEAAAEIGARLETGTVYMNRCDYLDPALCWTGCKDTGRGAALSALGYMSVTRPKSYHL

SEQ ID NO: 7921 - protein, 449 aa, Rhodobacter sphaeroides
LKARVAEVPLGPEIEETGRIATLADGLVEVEGLPGARLGEVVRFAGGAEGLVLTLDPETVQVALLDPGAALGSGTEVRRTGQLLSVPVGQGLLGRVVDPLGRPLDGLPAILPEARLEIERPAPGIVDRDMVAEPVETGLLVVDALFAVGRGQRELIIGERATGKTSLAVDAIVNQAASDIVCFYVAIGQRTTAVRRVIETVREKGAFARTVFVVAPATASPGLRWIAPFAATSMAEWVRDRGGHALIVYDDLTKHAAVHRELALLARQPPGREAYPGDIFYLHARLLERSAKLSAVNGGGSLTALPIAEIEAGNLSAYIPTNLISIADGQIVTSAALFAANQRPAVDIGLSVSRVGGKAQRGALKAVAGRVRLDYAQYLEMKMFSRFGGFGDAALRARLARGERIGALLAQPRTTPLSTPVQVALLAALAEGALDDVPLEDLARLKAAL

SEQ ID NO: 7922 - protein, 463 aa, Rhodobacter sphaeroides
MADFIVKDLSLADFGRKELDIAETEMPGLMALREEFGASKPLKGARIAGSLHMTVQTAVLIETLVALGADVRWASCNIFSTQDHAAAAIAASGVPVFAIKGETLEDYWAYTDKIFQFADGTCNMILDDGGDATLYILLGARVEAGETDLIAVPQSDEEVCLFNQIRKRMAETPGWFTKQRDAIKGVSEETTTGVHRLYDLHKKGLLPFPAINVNDSVTKSKFDNKYGCKESLVDGIRRATDVMMAGKVAVVCGYGDVGKGSAASLRGAGARVKVTEVDPICALQAAMDGFEVVVLEDVVQDADIFITTTGNRDVIRIEHMREMKDMAIVGNIGHFDNEIQVAALKNHKWTNIKDQVDMIEMPSGSRIILLSEGRLLNLGNATGHPSFVMSASFTNQVLAQIELWTKGADYQPGVYILPKALDEKVARLHLKKIGVKLTELRPEQADYIGVKVEGPFKAEHYRY

SEQ ID NO: 7923 - protein, 466 aa, Rhodobacter sphaeroides
YINGGWTAPAEARDCEVIDPSTEEACAVISLGDQADTDAAVAAAKAAFEGWAATPPAERLRLVKGILAQYEARKEEMAQAISLEMGAPIDLARNSQAPCLPWHLTNFLKAFEEIEWVRPLGPHAPNDRIALEPIGVVGLITPWNWPMNQVTLKVIPALLAGCTCVLKPSEEAPLSSLLFAEFVHDAGLPAGVFNLVNGDGAGVGTQLSSHPDVEMISFTGSTRAGRAISKAAAESLKRVTLELGGKGANLIFADADERAVERGVKHCFNNSGQSCNAPTRMLVERPLYDRAVEIAAEVAAKTRVASAHEEGPHIGPVVNKRQFEQIQSYIQKGIDEGARLVAGGLGRPDGLNRGFFVRPTVFADVTPGMTIEREEIFGPVLSILPFETEEEAVRIANDTPYGLTNYVQSEDGARRNRLARRLRSGMVEMNGKSRGAGAPFGGVKASGRAREGGVWGIEEFLEVKAI

SEQ ID NO: 7924 - protein, 422 aa, Rhodobacter sphaeroides
GRYMTQTDIAAPLAAALAAKGYESLTPVQEAVLAEGVAGRDALVSAQTGSGKTVAFGIAIADQILQGADRLLFADTPIALAIAPTRELALQVARELGWLYGEAGAHIATCVGGMDYRTERRALDRGAHIVVGTPGRLRDHIERGSLDLSGLRAVVLDEADEMLDLGFREDLEFILGSAPEERRTLMFSATVPKEIEALAKEFQQDAVRIQTAGERKQHADIEYRALTVSARDKEHAIFNVLRFYEAPSAIVFCKTRLAVNHLLARMGNRGFQVVALSGELSQQERTHALQALRDGRARVCIATDVAARGIDLPGLELVIHADLPTNSETLLHRSGRTGRAGSKGVSVLIAAPSEVRKAQRLLTGAKLVADWGKPPSADEVQERDDARLLEHPVLGQDLSDEMPLAEKLLERFGPAQMSAAFV

SEQ ID NO: 7925 - protein, 252 aa, Rhodobacter sphaeroides
TLIAVGDNCLDVYLSKDRMAVGGNALNVAVQWMRAGLKTRYFGLVGPDPEGDVVRTALCRAGLDPDDCEVRPGSTAVTLLLERDGDRRFLLEDLGVGLGYVPEGARYAALRAADWVHLGTHSAPELVRALVRDGARFSVDVSTHHDLLDLEGVPLVFASGPEDPSERVEPLLARFRERGAQATVVTCGSRGAFLEAGGTVTPVRARRVEVVDTCGAGDSFIARFIALWAIERRADAEALRGAADAATNTCLH

SEQ ID NO: 7926 - protein, 441 aa, Rhodobacter sphaeroides
FDAPALERMCALNEAHAAMLAARGLIPADCARDILRGIAQIRAEGPAAIDLDPQFEDSYFAFENRLGQVAGKAVAGWLHVGRSRNDIGSTLDRMAARETCLALLAAMEEARRACLAAAGRHVLTVMPGYTHLQPAQPITFGYYLANVARGMEREHERLAAVLDRLDACPLGSAALAGTSFAINRDETADLLGFAGPAAPGLDAVASRDFVTELLWAVTSAQVLFSRVAQDLYVFTTWEFGALTFPDRVAGTSSIMPQKKNMLPLEYFRAEAGRSIGALAGALAAVKGSNYSIGLDSVREGVADAWPAFARFEAGLSLLRLIFETATPDAEKLLARCKANFSTATDLADGLVRDFGISFRDAHHVVGRAVQMVLAAGGGAEELTVAVLNEAAEAEIGRSFDLPEERLRRWMDPVEAVRARTVPGGTAPEVVSALLAEMEARL

SEQ ID NO: 7927 - protein, 245 aa, Rhodobacter sphaeroides
FDLTGRVAVVTGAGRGLGAAMAEALAAAGATVVLSGRDPGPLERTAAAIRAAGGAASVTLCDITKRAEVEALVAETEARHGRLDVLVNNAGITGRSALTEVEDADWDLMLRTHMTGPFMACRAALPGMMRRGAGKIVNTVSVLGELGRPWVVPYAAAKGGLRMLTRALATEVAGANIQVNGIGPGYFETEMNAAIVQNEALHAERVARVPARRWGRPVELGGTAVYLASAASDYVNGQIIYVDGG

SEQ ID NO: 7928 - protein, 239 aa, Rhodobacter sphaeroides
LAGRKIVITGAGSGIGRESARQFAREGATLALIDRDEAAAQVTADETGGHVFALDVTDEAAVETVVGRAAEALGGIDGLLNSAGILTMKTVDDIGVEEFRRVVDVNLTGTFLVCQAALPWLRKEPKAAIVNIASAQALLPSLTGSAYAASKAAVMMFSKSIAKELAPAVRVNIICPGATETPMTDQGVAPDDVAGRKALAAVYAMNRLAQPEEIAAGILFLMSDEAAAITGVALAIDNG

SEQ ID NO: 7929 - protein, 267 aa, Rhodobacter sphaeroides
MSVGVIGTGFVGRGWAICLARAGHEVRLWDPAPDAAEAARTYIAEMLPDLAAADLLGGRAPDAVLERIRVAPDMATAVRGARHIQESAPEDLLLKTALFAELDALADPGAVIASSSSALLPSAFTEGLAGAGRCLVAHPVNPPHLIPLVELVPAPWTDEETLARTETLMREIGQSPVRLEREVDGFLLNRIQAAVLDEAFRLVDAGLASADAVDACLRDGLALRWVFMGPFETIDLNAPEGVRDYVARYQPMFRRLTDTMRESADWS

SEQ ID NO: 7930 - protein, 254 aa, Rhodobacter sphaeroides
DLTGKTALITAGAGGIGLAIARRFADLGAQLCLCDISETAIAEAQALLPEALILRADVARSADVQEVVDRLVERFGGLDILVNNAGVSGPTRPVDEITDAEWNDTLAVNITAMFYMVRAAVPLFRAAGGGAVINMGSVAGRVGMPLRLPYSVSKYAVRGLTETLAIELGEIGVRVNAILPGLVDGPRGRRIIAEQARERGLSPEDYTRLFLHNISMHSMVQMEEVADMAAFLASDLAPHVSGQMIGVCGNFESY

SEQ ID NO: 7931 - protein, 394 aa, Rhodobacter sphaeroides
MRALTWHGKHDVRVETHPDPEIVNPRDAIIEVTATAICGSDLHLYDGVIPGLMSGDILGHEFMGRVVETGPKSTLKKGQRVVVPFTISCGQCFFCEHQLFSACDNSNPAEKQDLSEPLYGHAVSGLFGYSHLTGGYPGGQAEYVRVPYSDVGPIVIPDGLEDEQVLFLSDILPTGWMAAENAGIEEGDTVAVWGCGPVGLFAIQSALLMGAGKVIAIDEYPKRLALARRLGAEVIDFRRTKVLEALMEMSGGLGPDAVIDAVGMEAHGFMPDTLMDNMKQRVGIGADSGHALREAILAVRKGGRVSVPGVYGGFLDKFPLGALMEKGLTVKTGQTHVQRYTEELLRRIGEGEIDTTFLISHRLPLEEAARGYENFRFNQNEWTKVVLKPGLTGA

SEQ ID NO: 7932 - protein, 282 aa, Rhodobacter sphaeroides
FEGIYTPVITPHREDGAIDRDAFAAAIEQLIAAGVHGLINGGSTGEYYAQSMEERAGMASLAREVIGDRVPLIVGTVAIRLEDSLRMAEHAAKIGAAAILVGSPPYAVPTERENALNALAIDRAADLPVMLYNYPGRMGVTMGAEFLDRVGRSRNFCAIKESSGDINRVHLLARDYPHIQMSCGMDDQALEFFAWGARSWVCGGSNFLPAEHLALWQACAVEGDFAKGRRIMSALLPLMRVLEQGGKFVQCIKHGCEMAGLRAGPPRPPLKPLTKEDKRELE

SEQ ID NO: 7933 - protein, 494 aa, Rhodobacter sphaeroides
RSPRRPEMTLLTTEDYKAIAAGLTLPTGAFIDGRFRPAQSGATFETRNPATGQLLAEVAACGPADVDLAVQKARDAFEDGRWSRLPPRARKEVLIRLAKLLKRHARELAVMESLDSGKTIYDCETVDLPETIHCLTWHAELIDKIYDQTAPASDDHLALVLREPVGVVGLVLPWNFPLLMLAWKIGPALAAGCSVIVKPAEETPLTALRVAELATEAGVPPGVFNVLPGHGPEVGEPIGRHMDIDAVSFTGSTETGRRFLRYAAESNLKEVTLEMGGKNPAVVLDDAENLDRVAAHVVTGAFWNMGENCSAASRLIVQSGVKEALIARILAHAREWPMGDPLDPANRVGALVSPAHLDKVRSYLAEGPTVLLGGKAHGAFVEPTILEITDREAAPAREEIFGPVLSVLTVESFDEAIALANDTPYGLAASIFTANVKKALRGARALRAGTVTVNSFGEGDITTPFGGFRQSGFGGRDNGIHAHDQYTQLKTIWI

SEQ ID NO: 7934 - protein, 230 aa, Rhodobacter sphaeroides
RVALVTGGGRGIGQAIARRLASDGARVFTAQRGADAGFEAIAADFADADAPARAVAEAVDRAGRLDVLVNNAGVMQEARVEEMALADWERTIRVNLTAPFLAIRAALPHLRAVRGAIVNVGSIEGLGANPRHAAYCASKAGLHGLTRAVAVDHGAEGIRCNAVAPGWIETELNEAFVEAMPDPEAFRRGIGRIHPVGRTGQPEEVAALVAWLASDEAAFVTGQVWTVDGG

SEQ ID NO: 7935 - protein, 234 aa, Rhodobacter sphaeroides
KVALVTGAAGGIGGAVVTALRAAGARVAVADRAVAGIAADLHLPGDLREAAYADGLPGAVAAGLGRLDIVVNNAGVISRGRITETTDADWSLSLGVNVEAPFRICRAAIPLMAAAGGGAIVNVASCWGLRPGPGHALYCLTKAALASLTQCMGMDHAPQGIRINAVCPNEVNTPMLRTGFAKRGFDPDRAVAELGRTVPLGRIAEPEDIADVVLFLASDAARYLCGSLVEVNGG

SEQ ID NO: 7936 - protein, 285 aa, Rhodobacter sphaeroides
VRVACVGGAVLDRVYEVAALPGTDGKSRASSYREFGGGMAGNAAVAIARLGGQARWWGRVGDDAIGAGVLAGLAAEGVATAEARVVEGAVSSHSLVLSDAEGRRAIVLYRSDGLDPDASWLPLAAVGGLDAVLADNRWIDGAVAALTAARAAGLPAVLDADAGADPRSREAVQAASHAIFSEPGLAEIYGTSDPDEGLRHAAADAPFVAVTLGEAGLRWRDARGGLASLPAFPVRAVETVGAGDVFHGAFALALAEGQPPEDALRFAAATAALKCRGSGGRASYP

SEQ ID NO: 7937 - protein, 349 aa, Rhodobacter sphaeroides
RRHAVALIPGDGIGPEVIDASLEVLEKVARLHGFALDMTRFDWSCDRYLATGRMMPEDGIDQLRPHAAILLGAVGWPARVPDAVSLHGLLLPIRKSFDQFANMRPHRLLPGATGPLKSEAFDILCIRENTEGEYSGAGGRIHVGTPAEVAVETSIFTRRGVERILRFGFEQARRRSGRLASVTKSNAQKYSMVFWDEVTEEVAADYPDVTVSRYHIDAIAARMVMAPETLDVVVASNLFGDILTDLGAAIQGGLGFAPSANINPDRSQPSMFEPVHGSAPDIAGRGIANPVATLWSAALMLDHLGEEAAGRSLLAALSAVTAEGRLRTPDQGGRACTTDVARAVADRLS

SEQ ID NO: 7938 - protein, 465 aa, Rhodobacter sphaeroides
ILVGGDWIQADAGGRIEVTNPATGAVIGTVPDAGAAETARAVAAAEAAFGPWRALTAAERATHLRRLAQAILDHREALAELLTEEQGKPLAEARGEVGMSAAYIQWFAEEARRVYGEVIPSPWPDRRLLVTRQPVGVVAAITPWNFPSSMLARKIGPALAAGCTVVAKPASQTPFSGLAWGVLGEMAGLPAGVLNIVTGSARAIGGELTANPSVRKITFTGSTPVGKVLLAQAAGTVKKMSMELGGNAPFLVFDDADLDRAVEGAIAAKFRNAGQTCVCTNRFYAQAGIHDEFVKRLAAATAALKVGPGAQDGSEIGPLIDAAAVAKTEEMVADATAKGGRIVTGGRRHTAGAGFYEPTVIADATDAMTFAREEIFGPVAPVFRFETEEEAIRRANATEYGLACYFYTSDLGRAFRVSEALDYGIVGVNEGLVTTEVAPFGGVKESGFGSEGSHHGMQDYLTLKY

SEQ ID NO: 7939 - protein, 959 aa, Rhodobacter sphaeroides
  unsure (1)..(959): unsure at all Xaa locations
DFGTPRSRATETVTLEIDGFPVTVPAGTSVMRAAAEAGISVPKLCASDTLDAFGSCRLCLVEIEGRAGTPASCTTPVAPGMKVRTQTPKLKQLRRGVMELYISDHPLDCLTCAANGDCELQDMAGAVGLRDVRYEAVENHFTPRSAAGDLNPQWMAKDESNPYFTYDPSKCIVCSRCVRACEEVQGTFALTIDGRGFDSRVSAGMASDSFLTSDCVSCGACVQACPTATLQEKSVIEIGTPERAVVTTCAYCGVGCSFKAEMRGDELVRMVPYKGGKANHGHSCVKGRFAYGYAAHKDRILKPMVRESIHDPWQEVSWDEALGFAARRLTAIQEKHGRQSVGVITSSRCTNEETYLVQKLTRAVFRNNNTDTCARVCHSPTGYGLGQTFGTSAGTQDFDSVEAADVVMVIGANPTDGHPVFASRLKKRLRKGAKLIVVDPRRIDLVKSPHIAAAHHLALRPGTNVAVVTAMAHVIVTEGLADEKFIRERCDWDEFQDFAEFAADPRHAPEAIESLTGVPAAECVRRPASMPPAGMPRSYYGLGVTEHSQGSTTVIGIANLAMLTGNIGRPGVGVNPLRGQNNVQGSCDMGSFPHELPGYRHVKSDAARAVFERLWGVEIDPEPGLRIPNMLDAAVEGTFKGLYCQGEDILQSDPDTRHVAAGLAAMECVIVHDLFLNETANYAHVFLPGSSFLEKDGTFTNAERRINRVRKVMAPKNGFADWEVTQMLANALGAGWGYTHPSQIMDEIAATTPSFAGVSYERLEEAGSIQWPCNEEHPLGTPLMHVEGFVRGRGKLIRTEYVATDEKTGPRFPLLLTTGRILSQYNVGAQTRRTANSVWHPEDVLEIHPHDAEVRGVAEGDWVRLASRAGETTLRARLTDRVSPGVVYTTFHHPTTQANVITTDFSDWATNCPEYKVTAVQVAPSNGPSDWQEDYRAQANLARRILPAAEXKRPAISCR

SEQ ID NO: 7940 - protein, 245 aa, Rhodobacter sphaeroides
ALVTGAGRRLGREMALWLGRRGTDVAVHYAGSADEAEAVAQEIAALGRRAVALRADLLVEAETQALVARAAEALGGPLDLLVNNASIFERDTISGATRESWDRHMESNLRAPFVLIQSFAAQAPAPVRDAQNEPVAQALVVNMIDQRVLHPTPDFATYTLAKVGLWTLTRLAAQELGPRVRVNGIGPGPTLQGAHQSPGDFADERAGTVLGRGANPSDITAALGYLLEAPAVTGQMICVDGGQHL

SEQ ID NO: 7941 - protein, 275 aa, Rhodobacter sphaeroides
IATARTLSEALPYLQRYAGAVVVVKFGGNAMGDEAAMAEFARDIVLMRQVGVNPVVVHGGGPMINELLGKLGIKSEFVRGKRVTDKATVEVVEMVLSGLVNKRIVQAINRSGGRAVGISGKDDDLMVCVADDPDLGFVGKPVEMNVQVLRDLYNAGIIPVVAPVATGMADNETFNVNGDTAAGAIAGALQADRLLLLTDVAGVKDASGEVLSQLTPSQVREMVASGTISGGMIPKTETALAALDEGVRAVVILDGRTPNACLIEIFTDEGAGTII

SEQ ID NO: 7942 - protein, 242 aa, Rhodobacter sphaeroides
GEQKTMVLTGASRGIGHATVKRFSREGWRVLTCSRQPFDPRCPWPGGEENHIQVDLANPDMTIRAIEAIKDKIDGRLHALVNNAGVSPKGPKGERLSTITTDLRTWGQVFHVNFFACVVLARGLQEELTAGKGSIVNVTSIAGSRVHPFAGAAYATSKAALAALTREMAHDFGPLGVRVNALAPGEVETAILSPGTDKIVEKLPLQRLGQPSEVADAIWFLRSDQSSYISGAEIEVNGAQHV

SEQ ID NO: 7943 - protein, 458 aa, Rhodobacter sphaeroides
  unsure (1)..(458): unsure at all Xaa locations
PLLGLAALSALPIVLKLARKGRXMERIETDLCVIGAGSGGLSVAAGAVQMGARVVLVEAGEMGGDCLNAGCVPSKALLAAGKAAQAMRTAGAFGIRPVEPEIDFAAVKDHVARTIAAIAPHDSQERFEGLGVRVLRDWGRFVSPTELRVGARTVVARRFVIATGSRPLLPPIPGLDRVKALTNETIFALRERPEHLIVIGGGPVGIEMAQAHRRLGSRVTVIAGEKALPKDDPELAAVLLDRLRAEGVEIVEGARAEAVQPLAHGLEVTAGDRRIAGSHLLVAAGRKPALDALDPAAAGVEVTEKGVKVGPDLRSSNRRIYAVGDAAGGPQFTHLAGYHASVVIRSILFGLPSKATALIPHVTYTEPELAQIGLTEAQAREIHGDRLEVLRVPVAGSDRAQAEAATEGLVKLMVARGRPVGVSIVAPHAGEMIGLWAMALASGAKLSTVAGLVLPYPT

SEQ ID NO: 7944 - protein, 500 aa, Rhodobacter sphaeroides
MANPLFDALFAPLEGRASDLIILKDGTRLSGDAFFRLLARTAHALRAEGLRPGDRIAVQVAKSPEALAVYGAAVALGAVFLPLNTAYTPAEVDYFLGDATPRIFLCDSAQAPALTPVAERHGARLLTLDADGTGDLAQRTRDRPEEIGAEPRDAEDLAALLYTSGTTGRSKGAMLSQRNLLSNAEALADLWRFTERDVLIHALPIFHTHGLFVASNVTLLTRGSMIFLPGFDLEAILRWMPAATALMGVPTFYTRLLSDPRLTRALAAGMRLFVSGSAPLLADTHAEFEARTGHRILERYGMTETNMSTSNPYEGERRAGTVGFPLPGVELRILDQGREVAPGEIGVIEVRGPNVFQGYWQMPEKTAEELRPDGFFVTGDLGCRDAEGYVQIVGRQKDLIISGGYNIYPKEVELLLDEQPGVLESAVVGLPLPDLGEAALAVLVPRPGVTLDPQAVLGAIADRLARFKQPRAAVLVEELPRNTMGKVQKTLLRARYAGLF

SEQ ID NO: 7945 - protein, 318 aa, Rhodobacter sphaeroides
QFQIVGIGNALVDVLSHCDDAFLAENGIAKGIMQLIDMGRAVDLYGRIGPAQEISGGSAANTIAGIAQLGGRTAYVGKVCDDQLGAIFAHDLRAQGAVYETPMAPKGGAQETGRCIILVSPDGERSMNTCLGWSEFLTPDDIDEAQMASTEWIYLEGYRFDGPESHAAFAKAIAACRGAGGRVSLTLSDPFCVERHRDAFRRMIREDVDLLFANRAEILSMYRTEDFGAALKAAAAEVAIVACTESEKGAHILADGQHWHVPALPTQIVDATGAGDLFAGAFLWGLTHGHGYETAGRMGCIAASEVISHLGARPEADL

SEQ ID NO: 7946 - protein, 443 aa, Rhodobacter sphaeroides
MFEKILIANRGEIALRVIRACQEMGIKSVAVHSTADADAMHVRMADESVCIGPASSTDSYLNKASIISACEITGAEAVHPGYGFLSENAAFAQALQDHGIEFIGPTADHIRIMGDKITAKDTMKALGVPCVPGSDGGVPDYETAIATARDIGFPVIIKATAGGGGRGMKVARNEQELEIAFRTARSEAKAAFGNDEVYMEKYLQKPRHIEIQVFGDGKGRAVHLGERDCSLQRRHQKVFEEAPGPVITPEMRAEIGRICADAVARINYIGAGTIEFLYEDGQFYFIEMNTRLQVEHPVTEAIFGVDLVREQIRVAAGLPMSFNQDALEINGHAIEVRINAEKLPNFSPCPGKVRVFHAPGGLGVRMDSALYGGYSIPPYYDSLIGKLIVHGRDRPEALARLHRALGELIVDGIDTTVPLFHALLAEPDIQNGDYNIHWLEKWL

SEQ ID NO: 7947 - protein, 415 aa, Rhodobacter sphaeroides
PDAVARPASTEEVSRLLALCHAAGMPVVAQGARSSLEGHHLAIRGGIALDLTGMDRVLAVHAEDLDAVVQPGVTRETLNAHLRDTGLFFPIDPGANATLGGMAATRASGTTAVRYGTMREAVLALEVVQADGTVIRTGSRARKSATGYDLTHLFVGSEGTLGIITELTLRLFGQPEAQSAAICRFPSVAEAVATVIATIQMGLPIARIELVDAMMVRGFNLHADAGLPEEPHLFVEFHGSERGVAETAALFGEIAADHGGQSFRWSQKPEERRALWSMRHNAHHATRRLRPGARTVSTDVCVPISALAEAVAVAQEEGRARGLMQAIVGHVGDGNFHCGILVDPEDAGEMKRVKEFTDLLSDLALRLGGVVSGEHGIGMGKIGKMEAQHGPALATMRAMKEALDPKGILNPGKLL

SEQ ID NO: 7948 - protein, 242 aa, Rhodobacter sphaeroides
LEGKRALVTAAGQGIGRASALAMAREGARVLATDLNAAALEGLAAEGLEVQPLDVRDPASIAAAVAAAGPLDVLFNCAGFVASGTILDCDEEDWAFSVGLNLTGMYRMCRAFLPGMIAGGGGSIINMASVVSAAIAAPNRFVYGTTKAGVVGLTKSIAADFIGQGIRCNAICPGTVESPSLEDRLRATGDYEAARRAFVARQPIGRIGRPEEIAALVVYLASDESAYTTGVAHVIDGGWSNI

SEQ ID NO: 7949 - protein, 372 aa, Rhodobacter sphaeroides
LSEEQQAIFDMARAFGAEEIAPHARAWEEAGTIPRTLWPKVAELGLGGVYVSEDHGGSGLGRLDATLVFEALAMACPSVAAFLSIHNMCAGMIDRYGSEELKARWLPGICALTTLVSYCLTEPGAGSDAAALRTRADATPEGYRLSGTKAFISGGGYSDAYLTMCRTGGAGPKGISTLLVPAGTPGLSFGGLEDKMGWRAQETRQVQFDECLVSTDLLVGEEGQGFAYAMAGLDGGRLNIAATALGGAQAAFDATRAYMAERKAFGQRLDGFQALQFRLAEMEVKLQQARIFLRQAAWKLDQGAPDATKFCAMAKLAVTDSAFEVANQCLQLHGGYGYLADYGIEKIVRDLRVHQILEGTNEIMRVIVARAL

SEQ ID NO: 7950 - protein, 316 aa, Rhodobacter sphaeroides
RLGANESLFGPSPHAVAAMAAAAAEVSLYGDPEIHALRTAIAAHHGVAPDQVTVGEGVDGLLGNLVRLLVDEGAPVVTSEGAYPTFAFHVAGFGGRLHKVPYQGDHEDPEALAAEARRVGARIVYFANPDNPMGSHHPAASVRALIEALPEGTLLALDEAYVELAPEGTAPEIAPEDPRVIRFRTFSKAYGMAGLRVGYAIGARDLIRAFDKVRNHFGVGRIAQAGALAALEDRAWLAHVQAEVQAARAEIGRIAEGCGLTPLPSATNFVTIDCGRDGAFARAVLTELVARDIFVRMPFVAPHDRCIRVSCGRAEE

SEQ ID NO: 7951 - protein, 330 aa, Rhodobacter sphaeroides
YAVKSNPEEVVIENLAAAGIRGYDVASPHEIRMIRRIAPDAALHYNNPVRSRSEIGVGVEMGVKSWSVDSASELAKLIELVPAEGCEIAVRFKLAVSGAAYNFGAKFGATVELAVELLRRVAEAGFIPSMTFHPGTQCTDPAAWETYIRTAAEIARDAGVTIARLNVGGGFPSHRLNGVEPELEAIFHLIDRVTDEAFGADRPLLVCEPGRGICADAFTLAARIKAVRDDAHVFLNDGVYGSLTELPMIGVIDRVAVLTPEGRRRDGETRDRIIFGPTCDSVDRLPGELPLAADVEEGDFLVFQGMGAYSAATNTRFNGFGELSMATVLS

SEQ ID NO: 7952 - protein, 426 aa, Rhodobacter sphaeroides
KSAKLTIGEKVIDLPIHSPTLGPDVVDIRKLYAEADVFTYDPGFTSTAACESTITYIDGDKGELFYRGYPIEQLADRSHYLEVCYLLLYGELPNAAQQADFEYRITRHTMLHEQIHYFFRGFRRDSHPMATMVGVVGAMSAFYHDSLDINDPWQREVAAIRMIAKLPTIAAMAYKYSIGQPFNYPQNHLDYAGNFLHMCFAVPAEPYTVNPVLAKAMDRIMMLHADHEQNASTSTVRLAGSSGANPFACIAAGIACLWGPAHGGANRACLEMLREIGTVDRIPEYIRRAKDKDDPFRLMGFGHRVYKNFDPRAKVMKESADEVLGLLGIENNPTLQVAKELERIALEDDYFVAKKLYPNVDFYSGIILDAMGFPTSMFTPIFAISRTVGWISQWKEMIGDPTQKIGRPRQLYKGETRRDYVDLRHR

SEQ ID NO: 7953 - protein, 458 aa, Rhodobacter sphaeroides
VVTRFAPSPTGYLHIGGGRTALFNWLYARGRKGTFLLRIEDTDRERSTPEATDAILRGLTWLGLDWDGEVVSQFARKDRHAEVAREMLERGAAYKCFSTQEEIEAFRESARAEGRSTLFRSPWRDADPTSHPDAPFVIRMKAPRSGETVIEDEVQGTVRFQNETLDDMVVLRSDGTPTYMLAVVVDDHDMGVTHVIRGDDHLNNAARQTMVYEAMGWEVPVWAHIPLIHGPDGKKLSKRHGALGVEEYQAMGYPAAGMRNYLARLGWSHGDDEFFTSEQAMDWFDLGGIGRSPARLDFKKLESVCGQHIAVMEDAELMREIAAYLAAARKPALTDLQAARLEKGLYALKDRAKTFPELLEKARFALESRPIVADDAAAKALDPVSRGILRELTPMLQAASWSKQDLEAILTAFASEKGMGFGKLAAPLRTALAGRTVTPSVYDMMLVIGRDETIARLE

SEQ ID NO: 7954 - protein, 384 aa, Rhodobacter sphaeroides
VLPTYNRAPLAFVAGEGSWLTAEDGSRYLDLGAGIAVNALGHANPALVEVISAQAAKLWHVSNLYRIPEQERLAEKLVEATFADTVFFTNSGTEAAELSIKMVRKYWSEKGQPDRIEILCFEGAFHGRSTGAIAAAGSEKMTKGYGPLMPGFRQLPFGDHEALRAAISEKTAAVMLEPVQGEGGIRVLPDVCLKGLRDACDAVGALLVFDEVQCGMGRTGRLFAHEWAGIEPDIMMVAKGIGGGFPLGAVLAKKAAAAAMTAGTHGSTYGGNPLGCAVGAKVMEIVADPAFLAEVNRKAALFRQKLEGLVAAHPQVFEEVRGAGLMLGLKCRAPNADLVKAAYGQHLLTVPAADNVVRLLPALNIPDEDIAEAVARLDRAAGTL

SEQ ID NO: 7955 - protein, 304 aa, Rhodobacter sphaeroides
LSVNHFLDIHKTDTAELRQMMDSAHAMKAARKGRPKGQLDEDQPLAGRMVALIFEKPSTRTRVSFDVGVRQMGGQTMVLSGKEMQLGHGETIADTARVLSRYVDLIMIRTFEEATLLEMAEHATVPVINGLTNRTHPCQIMADVMTYEEHRGPIAGRKVVWAGDGNNVCASFLHAAGQFGFDFTFTGPSTLDPEAEFVGYAREKGRRVSIERDPAKAVAGADLVVTDTWVSMHDPQSARERRHNQLRPYQVNETLMAQAKPDALFMHCLPAHRDDEATSAVMDGPHSVIFDEAENRLHAQKAIM

SEQ ID NO: 7956 - protein, 253 aa, Rhodobacter sphaeroides
LQGKRALITGGTQGAGAATLALFRELGAEVLTSARHRPGDLPEEMFVAADLTTPAGCGALAAAVRDRLGGVDILVHMLGGSSAPGGGFAALGEAEWQAELNLNLMPAVRLDRALLPGMVARGSGVVVHVTSIQRLLPLPEATTGYAAAKAALSAYSKSLSKEVAPKGVRVVRVTPGWIATEASLRLAERLAAEAGTDLEDGKRRIMASLGGIPLGRPSTPAEVASLIAFLVSDRAASITGTEHVIDGGTVPTV

SEQ ID NO: 7957 - protein, 242 aa, Rhodobacter sphaeroides
LNGKTIIISGASSGIGAAAARLFAAEGARLILGARRAALLEEITNEILAGGGEADFVVGDVEDSGFAAELVQRAEDRFGGLDGAFNNAGVTGEMCPIPDMPESNWHKVIAVNLSSGFYAAKHQIPAMRKRGGGSIVFTSSFVGHTIGLPGMGAYAAAKAGLIGMTQVLAAEHGPEKIRVNALLPGGTMTPMAGEDAGFHEVVRGFHALKRMADPSEIAQAALFLLSDQASFVTGTALIADGG

SEQ ID NO: 7958 - protein, 439 aa, Rhodobacter sphaeroides
MTTVTRFAPSPTGYIHVGNLRTALMNWAIARKSGGTFILRLDDTDRERSKQEYSDGIMEDLEWLGLTWDRLERQSDRLDRYAEAADELRRAGRFYECFESPTELDLKRKKLLNMGKPPVYDRAALKLSDEERARLREERGGYWRFLLDQERIEWTDGILGPISIDAASVSDPVLIRADGQVLYTFASSVDDIDMGVTFIVRGGDHVTNTATQIQIMQALGGTPPSFAHHSLLTGAQGEALSKRLGTLSLRDLRARGVEPMALLSLMARLGSSQPVELFRTHEELLAGFDVGTFGAAPTKFDAEDLFPLTRHYVQGLPFEAVRGRIAALGVPDDLAEPFWRVAKDNIGVLEDLGGWWTLFSEGAEPQIDPEDEDFIRQAMTLLPPPPYGPESWAQFTAAVKEATGRKGKGLFMPLRKALTGQAHGPDMSEVMPLLQKVRA

SEQ ID NO: 7959 - protein, 350 aa, Rhodobacter sphaeroides
IPVFDGHNDFLLRLLRNPANRETIWLKGDGTGHLDLPRMKEGGFAGGFFAIYVPSPQAHDAAHFEAMMDAPPFELPLPPMIRAEQAQPVALAMAGHLLWMERAARGRFKVCRTAAEVRSCHADGIVSGIMHMEGAEAIGADLDALHLFHSLGLRSLGPVWSRPTVFGHGVPFRFPGSPDTGEGLTEAGRRLVAECNRLKIMLDLSHLNEKGFDDVARLSDAPLVATHSNAHAVTPSTRNLTDRQLAMIRESRGMVGLNFATSFLREDGRRSAEMGWEPVLRHLDHLIDRLGEDHVGMGSDFDGATIPQGIADVTGLPALQAAMRAHGYDEPLMRKLCHENWYGLLERSWG

SEQ ID NO: 7960 - protein, 1165 aa, Rhodobacter sphaeroides
  unsure (1)..(1165): unsure at all Xaa locations
SRTGTRSSPFSSGASSTAGRPADSPAATXRKRVAPRGGKSITAPICAERRIRTILQPDRRGTIDVGPQMPKRTDISSIMIIGAGPIIIGQACEFDYSGAQACKALREEGYRVILVNSNPATIMTDPGLADATYIEPITPEVVAKIIEKERPDALLPTMGGQTGLNTALALADMGVLEKFGVQLIGANREAIEMAEDRKLFREAMDRIGLENPKATIIAAPKLENGRYDINAGVAEAMAAIEYVGLPAIIRPAFTLGGTGGGVAYNRDDYEAICRSGLDASPVAQILVDESLLGWKEYEMEVVRDRADNAIIVCSIENVDPMGVHTGDSITVAPALTLTDKEYQIMRNGSIAVLREIGVETGGSNVQWAINPADGRMVVIEMNPRVSRSSALASKATGFPIAKIAAKLAVGYTLDELDNDITKVTPASFEPSIDYVVTKIPRFAFEKFPGSKPELTTAMKSVGEVMAIGRTFHESMQKALASLETGLSGFDEIEIPGAPDKAAVIKAISAQTPDRLRLIAQAMRHGLTEDEIQAATAFDPWFLARIREIVEAEAEIRAKGLPVTEAALRRLKMMGFTDARLAKLTGRDEGQVRRARRNLGVKAVFKRIDTCAAEFEAQTPYMYSTYEAPAMGDVECEARPSGAKKVVILGGGPNRIGQGIEFDYCCCHACFALTAAGYETIMINCNPETVSTDYDTSDRLYFEPLTLEHVLEILRVEQDNGTLHGVIVQFGGQTPLKLAQALAAEGIPILGTTPDAIDLAEDRERFQQLLHKLDLKQPHNGMARSRDEAFRIAGEIGYPLVIRPSYVLGGRAMEIVRDDAQLERYIREAVQVSGTSPVLLDSYLSGAIEVDVDALCDGENVHVAGIMEHIEEAGVHSGDSACCLPPHSLSAETIAELKRQTVEMARALHVVGLMNVQFAIKDGVIFVLEVNPRASRTVPFVAKATDSAIASIAARLMAGEPLSAFPVRAPYPAGVGPDTDLPLADPLTLADPITPWFSVKESVLPFARFPGVDPLLGPEMRSTGEVMGWDRSFALAFLKAQMGAGTHLPESGRVFLSVKDADKTAALAKAAAGLTAMGFEIVATKGTAAWLTGQGIASTSVNKVYEGRPNIVDRLKNGDITLVMNTTEGAQAISDSRDIRRVALMDKIPYFTTAAASIAAVEAMQA

SEQ ID NO: 7961 - protein, 450 aa, Rhodobacter sphaeroides
FSTLGLSERLMQGLAKAQFTQPTPIQVEAIPYVMQGRDLMGLAQTGTGKTLAFGLPLLHRLLGVGHPPPPRTIRALILAPTRELVTQIATNLELFTKGTPVKVVTITGGASINRQTERLARGADIMVATPGRLIDLLDRNAVVLDHTGYLVLDEADQMLDMGFIHSLRKIARFLPLKRQTLLFSATMPKLIEELAHTYLREPVKVQVAPPGKPVEKIAQGVHFTPQGDKAKLLESYLQKHPGEQALVFGRTKHGSEKLMKLLVSWGFKAGSIHGNKSQNQRDRTLTEFRDGSLDVLVATDVAARGIDIPGVRHVYNYDMPNVPENYVHRIGRTARAGAEGSAVAFVAPAEMEEFRAVEKLLKQPIPVIGGAPWAADIVAAAPRPGQKPRQGGRPKTGAKPQGKPQAKAQPKPQGAAKAHSAGRAPGGRPRRPCGPEARGPRPAARRCRPR

SEQ ID NO: 7962 - protein, 253 aa, Rhodobacter sphaeroides
MSALGCFKAYDIRGRLGVDLDEGIAYRIGRAFARALDARTVVLGRDIRASSEALAARVAEGLGDEGCRVLDLGLSGTEEMYAATSHFGADGGICVTASHNPMDYNGMKMVRQGSAPLDAASGLARIRELAEAEDFGAARPGGAVMPVAEEARRAYVERVLSFVEVEALKPLKILVNAGHGAAGPTFDAIAARLEALGAPLSFERMHHAPDGTFPAGIPNPLLPRTGRTAGACANGADFGVAGTGFDRCLFDTR

SEQ ID NO: 7963 - protein, 305 aa, Rhodobacter sphaeroides
MILCCGEALIDMLPRETTAGEAAFAPYAGGAVFNTAIALGRLGAPAGFFSGLSTDLFGVQLAETLAASQVETDLCARSDRPTTLAFVRLTNGQASYAFYDENTAGRLLAPADLPALPDRVSTLFFGGISLVNEPAAATYEALMAREAPRRVTMLDPNIRPGFIADAAAYRARIGRMIALADILKLSDEDLHWLEGPGQILSLARGLLARGPKLVLVTEGAVGARAVTATEDRFCAATPVQVADTVGAGDTFNAGVLAALHEAGALSRSAVASLSPETLRRGPRARHAGRGGHRFAAGRQPALGGR

SEQ ID NO: 7964 - protein, 560 aa, Rhodobacter sphaeroides
EGAWADLGTPRTMHRFLGRAAAEHGDRPAVSFQLLSAPKSRAETLSWSQLHRRVTQAANLFRSLGVGERDVVAFVLPNCTETAVTLLGGAVAGIVNPINPLLEADQIAAILRETKARVVVTLRAFPKTDVAQKVAEAVRHAPEVRTVLEVDLLRYLGPPKSLIVPLIRPKLKPAHHARVLSFNAELDRQPATLAFPDPEIDRVAAYFHTGGTTGMPKVAQHKVSGMIYNGWCGQRLLFQPTDTVMCPLPLFHVFAAYPILMSMIASGAHVVFPTPAGYRGEGVFDNLWKLIERWRCTYLVTVPTALAALMQRPIDADVSSLRGAFSGSAPLPVELFNRFEKATGVQIVEGYGLTECTCLVSVNPPEGAKKIGSVGLPFPHTHVRILHSNGSGHVLKECGVDEVGEICVANPGVYEGSTYTELDKNHGLFAEDRFLRTGDLGRLDAEGYLFITGRAKDLIIRGGHNIDPAGIEAALMSHPAVSFVGAIGQPDAFAGELPCAYVELVQGAEVETAALFDHARAHIHERAAVPKHIEILPELPKTAVGKVFKPDLRRLAIARV

SEQ ID NO: 7965 - protein, 492 aa, Rhodobacter sphaeroides
ERVVADMRRALFDRMMGMSPAFFERIMTGEVLSRLTTDTTLLLSVIGSSISVALRNLLILIGGLVLLLFTSTKLTGLVMLLVPLVVVPIVILGRKLRRLSRENQDWIAQSSGNASEALLSVQTVQAFTHERQSRAFFGDVTEKSFLSAKDRIGTRALMTVIVIFLVFTGIVGVLWVGARDVRAGTMTPGEMVQFLIYAVMVAGSVGALSEIWSELQRAAGATERLNELLTAEDPVQDPATPVALPRPVKGEISFEGVRFRYPARPEVSALDGIDLVVRPGETVALVGPSGAGKTTILQLLLRFYDPQQGAVRIDGVDLRDMTRDDFRRAIALVPQDPVIFATSARENIRFGRPEATDAEVEAAAHAAAAHDFLSLLPQGYDTYVGERGVMLSGGQKQRVALARAILRDAKILLLDEATSALDAESERAVQTAVEALAQNRTTLVVAHRLATVKRADRIVVFDKGRIVATGTHDALVAEGGLYARLARLQFTD

SEQ ID NO: 7966 - protein, 195 aa, Rhodobacter sphaeroides
MRKAEISRKTAETDISVTVDLDGTGRYDIRTGVGFFDHMMDQARPARADRHHLRCEGDLHIDDHHTVEDCGIALGQALTRALGDKRGIRRYGSFHLAMDDALVRAALDLSGRPFLVWNLPFPTEKIGSFDTELVREFFQALATHGGITLHVDLIHGVNSHHIAEAAFKAVARSLREAVEPDPRRADAIPSTKGML

SEQ ID NO: 7967 - protein, 252 aa, Rhodobacter sphaeroides
MLKTRIIPCLDVADGRVVKGVNFVDLRDAGDPVEAARAYDAAGADELCFLDIHATHENRGTMYDLVTRTAEQCFMPLTVGGGVRTHQDVRALLLAGADKVSFNSAAVADPGVVPRRRPLRQPCIVVAIDAKTVAPGRWEIFTHGGRRATGIDAVAFACEMASRGAGEILLTSMDRDGTRAGFNLPLTRAISDAVPIPVIASGGVGTLDHLVEGVTEGGASAVLAASIFHFGEFTIGEAKAHMAAAGIPVRLA

SEQ ID NO: 7968 - protein, 99 aa, Rhodobacter sphaeroides
ERLAATVEARKGADPDSSWTAKLFAKGPEKCAEKFGEEAVEAIIEAVRGDRAKLASEAADVLYHLLVMLAARDVTLAEVMAVLEAREGTSGIAEKAGRG

SEQ ID NO: 7969 - protein, 375 aa, Rhodobacter sphaeroides
LLAGGRGSRLHELTSRECKPALPFAGPRRIVDFTLANAARSGLTRMIVATQYRPETLAHHLESRWASRFAGGSLRLREGTAVTGSPQGYGGTAAAVAANLAELQSEGVRELVVLAADHVYEMDYADMVAAHRASGASATVAVDTVPTDRASEFGVVRTSEGGRIESFLEKPAVVPADPAIPGRAQVSMGIYVFDLDWLASVLRIIPGATQDFGHDILPLAVALGEAHAYRVPGDNFYWRDVGTLDAYRLAQLEFQTGEAPCALPPRIAASEHEMKAATGELIQFAFRMQTGGIALHSPRLGGDLPGRWTMLDESVLLPGARVAPGVRLTRTIVAPGTSVPAGLVIGEDPDEDARWFRRTEEGTVLVTTPMLARRA

SEQ ID NO: 7970 - protein, 655 aa, Rhodobacter sphaeroides
PPLKFDMSSAHPNRLGADFDGEGTNFPLFSENATRVELCLFDETGQTQTHCLDLPSYEGGIWYGYLPGIREGQTYGYRVHGPHAPEEGHRFNPNKLLIDPYARELRGDLIWDDALFGYPIGGDDLELDPRDSAPFMPKAVVVDPAFDWEADKALRHRWQDTVIYEAHVKGLTMRHPGVPEEDRGTFKGLASPAVIDHLKAIGVTAIELLPIHGFLNDRHLIEKGLSNYWGYNTLSFFAPYRPYTKSGSMREVKRAIKRFHDAGIEVILDVVYNHTCEGNEKGPTLSFRGIDNASYYLLSPEAKRHSFDTTGTGNTLNVAHPMVLRMVMDSLRYWVEVMHVDGFRFDLASTLGREPEGFERGGTFFAAIRQDPVLSMVKLIAEPWDIGEGGYQVGGFPWPFREWNDKARDDLRAFWRRDPGLIGDVSQRLLGSPVQFSHSHRPATSSVNFIAAHDGFTAWDLVSYDEKHNEANGEDNRDGHSHNLSHNLGAEGPTDDPGILEARLRRVKAMLATLFLSQGVPMILAGDEFGQSQQGNNNAYCQDNEIAWLDWEEARDELIRAVADLAEFRKADGGISRARFAVGPDAVQHDTPVATWLHPAGREMEEGDWNEGELRLFALRLDLPRGRDLLVVLNAGDDGDFALPEGEWRLKIDTS

SEQ ID NO: 7971 - protein, 401 aa, Rhodobacter sphaeroides
MEFSQHFQKLIDDMRLDGRYRTFAELERIAGEFPTALWHGPDGQARRVTVWCSNDYLGMGQNAEVLAAMHRSIDLSGAGTGGTRNISGTNRQHVALEAELADLHGKESALIFTSGWISNLAALGTLGKILPECAIFSDALNHNSMIEGIRRSGAERFIFHHNDPVHLDRLLSSVDPARPKIVAFESVYSMDGDIAPIAEICDVAERHGALTYLDEVHAVGLYGPRGGGISDRDGLADRVTIIEGTLAKAFGVMGGYVSGPSLLMDVIRSMSDSFIFTTSICPHLAAGALAAVRHVKAHPDERRRQAENAVRLKVLLQKAGLPVLDTPSHILPVMVGEAHLCRSISEALLARHAIYVQPINYPTVARGQERFRLTPTPFHTTSHMEALVEALLAVGRDLGWA

SEQ ID NO: 7972 - protein, 228 aa, Rhodobacter sphaeroides
RVIAITGTRKGIGRALAETYLARGWTVVGCSRDASDLTHPAYRHYTLDVADERAVAGMMQDVRRTHGRLDALLNNAGIASMNHALLTPGSTVERVFATNVFGTFLFCREAAKLMGRRRTGRIVNFATVATPLKLEGEAVYAASKAAVVSLTEVLARELAPMGITVNAVGPTPVPTDLVGAVPEEKMRALIARQAIPRYGKMEDVLNVCDFFLRDESDFVTGQTIYLGG

SEQ ID NO: 7973 - protein, 544 aa, Rhodobacter sphaeroides
MTVKTVSTTPFSDQKPGTSGLRKKTPVFMRPHYLENFVQSIFDAIGGARGKTFVLGGDGRYFNDRAAQVILRMAAANGAARVIVGQGAILSTPAASHLIRLRKTDGGIILSASHNPGGPEEDFGVKFNTPNGGPAPESVTEAIFEATKTLSEYRIFEAQDVDLSVVGRTVLGDMQIEVVDPVADYAALMESLFDFPAIRAMFSDGFTMRFDAMCAVTGPYATEILENRLGAAKGTVVNGTPLPDFGGMHPDPNPTWAKALMDEMFSAEAPDFGAASDGDGDRNMVVGRGIYVSPSDSLAVLAANAHLAPGYKAGLKGVARSMPTSAAADRVAEALGVEEFETPTGWKFFGNLLDAGRATICGEESFGTGSDHVREKDGLWAVLLWLNILAVRKESVREILEAHWQQFGRNYYSRHDFEAIETARADAMMEELRGKLVGLTGAAFNGHLKVAEADDFAYTDPVDGSVSRKQGVRILFQDGSRIVMRLSGTGTEGATLRLYLERYAPGPEGLDLDPQEALGPIIAAAHEIAGIERHTGRREPDVIT

SEQ ID NO: 7974 - protein, 679 aa, Rhodobacter sphaeroides
PGRPWPLGASFDGEGVNFALFSAHAEKVELCLFAPDGRREALRLPLTERDGDIWHLKVNGLLPGQLYGYRVHGPYQPEQGHRFNPNKLLIDPYARKLEGRLRWSDAVMGYRVGSARADLSFDGRDSAFAVPKSVVVGHNFNWGPDAPPERALTETLIYEAHVKGLTALHPGVEDGLRGTFLGLASDPILEHLTRLGVTAVELLPVQAFLDDRFLVNRGLSNYWGYQTVGFFAPDPRYLAKGALWEFAAMVRRFHAAGIEVILDVVYNHTGESDELGPTLSFRGIDNRSYYRLTEGGRRYANMTGTGNTLDLSHPMVLRMVMDSLRYWVEVMHVDGFRFDLASTLGREEDAFDEQGAFFDAIRQDPVLTRVKLIAEPWDLGPGGYRLGGFPHPFLEWNDKFRDDVRRFWRGEGGMTGDLARRLLGSAERFDHHSRAATSSVNFVTAHDGFTLLDLVSHARKHNEANGEDNRDGHDDNHSDNMGLEGPTTDAGILAARALRRRNLLATLFLSQGTPMLLGGDEIGNGQGGNNNAYAQDNPIGWIDWDRPDETMLAFVARISELRRSLPVLRQKGFLHGRIREADGLRDVVWRLPDGREPGPQDWHSPAMSCLCVEIRMDADRPDAGESPVFAVFNAGEAVPLALPPVPESWSLVLDTTRPEAGPEPAAPGLEAPARSVLVF

SEQ ID NO: 7975 - protein, 484 aa, Rhodobacter sphaeroides
MKDRDRMETARGRVLSVASECVPLLKTGGLADVVGALPGALAAEGWEMRVLMPCYRPLKWRLEEMEEVFAEEDLFGGPGRVMAGEVAGRKMLLLDAPHLYDREGGPYAGPDGDWGDNAQRFAALSWIGARSRARGSGTAGRPDVVHAHDWQAGFTPAYMNYWGSGGASSVLTVHNIAFQGWAPASLLSALRLPPQEFHPAALEYYGGLSSLKAGLVSADHITTVSPTYACELMRPEFGMGLQGVIAQRAGQVTGILNGVDTDIWSPEVEERPYDAESLKAKAENRAVLSGAFKLSVPGPLAILVSRLTYQKGIDLIPEVLPDFIAAGGGLAVLGTGDAPLEAAMRELEVRFPGRVGVRIGYDEGLSHLMFAGGDAVLVPSRFEPCGLTQMYGLRYGAIPVVALTGGLADTIINANPAAMAAGCATGLTFHPTEPPAFAEALRRLIHLYADPAAWETVQRNAMRHPVGWETSAAAYAALYRELVA

SEQ ID NO: 7976 - protein, 423 aa, Rhodobacter sphaeroides
MKAQPPLRLTAQAMAFVLAGGRGSRLKELTDRRAKPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGIPGDEANALASMGIYVFDWAFLRDLLIRDAEDPNSSHDFGHDLIPAIVKNGKAMAHRFSDSCVMTGLETEPYWRDVGTIDAFWQANIDLTDFTPKLDLYDREWPIWTYSQIVPPAKFIHDSENRRGTAISSLVSGDCIVSGSEIRSSLLFTGCRTHSYSSMSHVVALPHVTVNRKADLTNCVLDRGVVVPEGLVIGQDAEEDARWFRRSEGGIVLVTQDMLDARARALN

SEQ ID NO: 7977 - protein, 519 aa, Rhodobacter sphaeroides
FFLTSAALQDILRRFKSGHGDLRALSRHVAIQMNDTHPAIAGPELIRLLVDEHGLSFDEALPVAQECLGYTNHTLLPEALERWATFTFGNVLPRHMQIVERIDGWHRRTFPARPHYVGIVKHHEVRMGELAFIMSHKVNGVSALHTDLVKANLFPELDRLHPEKIVNQTNGVTPRRWLKMANAPLARLIGETIGEGWEDDLDRLKGLEPHVKDQGFLGAFDAAKRQNKVTLSNWLGAECGVKVSPDALFDVQVKRIHEYKRQLLNILETVARWQAIRANPDAGWVPRVKIFGGKSAPGYAVAKEIIHLINDVAAVINADPLVGDLLKVIYPANYNVSMAERLVPAADLSEQISTAGKEASGTGNMKFMMNGAPTIGTLDGANVEILQEVGRENFFLFGLTAEEVMKRREDPDHARKAIEASQIMQNVLQAIAEGQFSPGQADRYHGLVHRVWHHDYFLVASDFDAYLAAQAEVDAAYKDRARWLTMAALNTARSGFFSSDRTIRGYMKEIWGVESALQD

SEQ ID NO: 7978 - protein, 795 aa, Rhodobacter sphaeroides
LRLHPDGMSCASCVARTERVLAAVPGVAEARVSLADESADIRYSDPATPEALAEALARAGYPARQERLTLSVEGMSCASCTGRVERVLKAQPGVIEATANLASRRAQVTLWEGAATAAALAQAVTKAGFAASPLTADAPDRRAEEMAMLRRDAWLAALLTIPVFLVEMGGHLVPAFHHWIAGTIGTQTSWIAQFLLTSLVLAGPGRRFYAKGVPALLRGAPDMNSLVAVGTFAAWAYSTVATFAPGLLPAAARSVYFEAAAVIVVLILLGRLMEARARGQAGAAIAGLLRLQPKTARVSRDGTETEVPIESIGPGAILLIRPGERIPLDGVVVAGESAVDESMLTGEALPVAKAEGADVTGGTVNGTGALTMRATRVGADTVLARIVAMVGEAQGAKLPVQALVDRITLRFVPVVMGVAALTVLVWLLFGPGLGEALVAGVSVLIIACPCAMGLATPVSIMVGTGRAAELGVLFRKGEALQRLSEIERVGFDKTGTLTEGRPQVTDVLPGEGLGREELLALAAAVEARSEHPLAGAIRRAAEDLPPLEAEGFSSRPGHGAEARVAGRRVRVGSLRMMEGLDPGPLGPEAARLEAEGRTPVWLALDDRIAGLIAVADRVKPTARAAVEALGRLGLPAAMVTGDAPGVARAIGRELGISDIHAGVLPGGKVEEVTAMGRAAFVGDGINDAPALAAAEVGIAIGTGTDVAIEAADVVLMSGDPVGVATAVALSRRTMRNIRQNLAWAFGYNVALIPVAAGVLVPFGGPQLSPMLAAGAMAFSSVFVLTNALRLRRAPA

SEQ ID NO: 7979 - protein, 140 aa, Rhodobacter sphaeroides
MAIERTLSIIKPDATRRNLTGKINAKFEEAGLRIVAQKRIHLSLAQAQKFYGVHKDRPFFGELTEFMASEPVVVQVLEGEGAIAKNREVMGATNPANADAGTIRKEFALSVGENSVHGSDAPETAAEEIAFFFSGLELVG

SEQ ID NO: 7980 - protein, 298 aa, Rhodobacter sphaeroides
GYAYENAFAGATSFLRRRYTKDLTGVDLAITGVAFDQAVTNRTGTRFGPRAIREASTLQPYDRPFGWGFDPLEELTVVDYGDLAFDYARTAEFPARLTAHVAGILAAGAGALTLGGDHSITLPILRAHAAVFGPLSVVQFDAHSDLWVDDDPGRIDHGTFMYKAVKEGLVDPARSVQVGIRTDTPDWLGMNVIDARTAHEQGPAAVAARVHAIVGHHPTYLTFDVDALDPAFAPGTGTPVWGGLASWQAAAILRDLAGLNLVGGDVVEVSPPYDPSGITAVAGAHVAYELICLYGWRR

SEQ ID NO: 7981 - protein, 363 aa, Rhodobacter sphaeroides
LQPSVVYASLDPDQLDAQYAGQVKGFTYAREGHPNAEVLARKIDALEGAEGGIVVGSGMAAVAAVLLGLLRAGDHVVGGDQLYGRSLRMMAEDLPRLGIATSLADATDAAAVEAALRPETKLVLIEVVSNPTLRVADLDGIAALCRARGILLAVDSTFSTPRGIRPFDHGADIVIHSVTKLLAGHSDVTLGYVACRTAELRRAVELFAVTTGLTPSPFDCWLAERGLLSFHLRYDRAEETAARLADHLAGLPGVRRVIYPLRADHPDQARAVALLGRRGGNMLSFELEGGRAAANALTRAMPAVAFAPTLGDVGTTLSHPASSSHRAVAPEVRARLGISEGFFRISVGVEEADLLIRDFTAGV

SEQ ID NO: 7982 - protein, 459 aa, Rhodobacter sphaeroides
AGGPVMTRGWTKTDWRAKPRIQMPDYPDAAAVKAVEGQLAKYPPLVFAGEARKLKAALAEAAEGRAFLLQGGDCAESFSEFSADNIRDTFRVLLQMAIVLTYGAKVPVVKVGRMAGQFAKPRSAPTEVINGMELPSYRGDIINGFDPSPEARIPDPQRMLQAYTQAAASLNLLRAFSTGGFADIHRVHSWTLGFCEQDKAERYRDISNRISDALDFMSAAGVNGSTSHNLSTVDFYTSHEALLLEYEEALCRIDSITGQPVAGSGHMIWIGDRTRQIDGAHVEFCRGVLNPIGLKCGPSTTVEDLKVLMAKLNPQNEAGRLTLIARFGAGKVGEHLPRLIRAVREEGAKVTWCCDPMHGNTIKAASGYKTRPFDSVLREVREFFSIHKAEGSIPGGVHFEMTGQDVTECTGGLRAVTDEDLSNRYHTACDPRLNASQSLELAFLVAEELTTMREAARRV

SEQ ID NO: 7983 - protein, 497 aa, Rhodobacter sphaeroides
ILVPGQATLAQLEAIWREGRRARLAPEARPAVEAAAARVAEAAAGTAPVYGVNTGFGKLASLKIAPADTAQLQRNLILSHCCGVGEPMPPSTARLMIALKLLSLGRGASGVRWEIVALLEGMLAAGVTPVIPAQGSVGASGDLAPLAHMAAVMIGEGEAEVGGRRLPGAAALAEAGLAPVALGPKEGLALINGTQFSTAYALAGLFEGWRAAQAALVISALSTDAIMGSTAPLRPEIHRCAAMRARSRRPATMRALLEGSAIRESHREGDQRVQDPYCIRCQPQVTGAAMDVLRMAAGTLATEANAATDNPLVLSDGRIVSGGNFHAEPVGFAADMIALALSEIGAIAQRRVALMVDPTLSFDLPPFLTPEPGLNSGLMIAEVTTAALMSENKHMAAPTVTDSTPTSANQEDHVSMAAHGARRLGRMVENLAVILGTEAICAAQGVEFRAPLATSAPLGAVLARLRAEVPRIAADRILAPDLAAAARLVRTGALARA

SEQ ID NO: 7984 - protein, 442 aa, Rhodobacter sphaeroides
RKLFGTDGVRGTANTHPMTAEMALRLGAAAGRYFRPVGAGSPRVVIGKDTRLSGYMLENALTAGLTSTGMNVLLLGPVPTPAVGFLTRSMRAALGVMISASHNPHEDNGIKFFGPDGFKLSDEAEAEIEAILAGEIQPAQPGNIGRAKRIEDGRGRYQEYCKTTFPSGLRLDGLKVVIDCANGAAYRAAPEVLWELGAEVIPVGVEPNGKNINLRCGSTHPQAAGEAVRAHGADVGICLDGDADRVIILDETGKEADGDQIMALFAARWADEGRLRDGTLVATVMSNLGLERFLGARGLRLERTPVGDRYVVEAMRRGGWNLGGEQSGHIVMTDFATTGDGLLAGLQFLAAMAQTGRRASDLARSFETVPQLLQNVRYAAGQEPLKAPGVQAVIRDAEVRLNGAGRLLIRKSGTEPLIRVMAECEDEALLRDVVEEIVAAVR

SEQ ID NO: 7985 - protein, 765 aa, Rhodobacter sphaeroides
LVSVRPSPENPDWGGPATVLNIGMNAARHAALARIHGEEAADAIYLGFIQSYAIHVARLDPEMFETGGSSSEALRAALHAWAEEMDEPFPQDPAQQLSEVLRSMARAWEGTTARLLRQAKGAPAEARLGLVVQEMAQDLGQGISGSGVIQFVDPATGVPQVTGRFFNRSRAWHGKAETLYLTQDPRGPSLEERAPEIFAALCRHGSVCRARLREEMQIEFTIEDSHLSVLDAVKVQRSSRAGLRIAVALADDQVITRSEALLRVEPRALSELLHPQVDPRGRRDRFARGIAASPGAAVGRIVFSSQAAQASAARGEPCILVRRETSPEDIRGMNCAAGVLTERGGVTSHAAVIARGLGLPCVVGASEIRLDARERRLVAPDGRVFREGDLITVDGTAGEALAGEAAMLAPALDSCFRKLLSWADEMRDIGVRANADTPADALVARQFEAQGIGLCRTEHMFFTDDRLVVMREMIFADSATDRAAALARLLPMQRADFVQLFEIMQGHPVCIRLLDPPLHEFLPHSREGLLELAEALDRPLSEVTRRVEAMAEFNPMLGMRGVRLGVAIPEIYDMQAQAIFEATLEVAGRGDPVVPEIMIPLVSARREVELVKTRIDAVAAAVHTKYGREFAYRLGVMVETPRAALRAGEIAQHAAFLSFGTNDLTQMTYGLSRDDAGRFMNTYVQSGVFPEDPFHILDVDGVGELLLIGAERGRATRPDLVVSICGEHGGDPESIEFCRRAGFDYVSCSPYRVPLARLAAAHLAI

SEQ ID NO: 7986 - protein, 380 aa, Rhodobacter sphaeroides
VHGGSRRSQYGEMAEAIFLTQGFVYDSAEQAEARFIETGADEFIYARYGNPTTRMFEERIAAVEGTEDAFATASGMAAIHGVLTSIVRAGDHLVAARALFGSCIYILEEVLGRFGVEVTFVDGTDLDQWRAAVRPGTKAVFFESVSNPTLEVADIGAIAEIAHAVGALVIVDNVFATPVFSTAVRQGADVVIYSATKHIDGQGRALGGVVCASQAFIRKVLEPFMKHTGGSMSPFNAWLMLNGMATLDLRCRAMADTAEKIARALEGHPQLGRVIHPALESHPQHEMAKAQMERPGTMIALDLAGGKEAAFRFLDALRIVKISNNLGDARSIATHPATTTHQRLSDAQKAHLGITPGLVRLSVGLEDADDLIADLKQALA

SEQ ID NO: 7987 - protein, 711 aa, Rhodobacter sphaeroides
LRRLRDSLALSGKGQDRLDRITSLIADSMRTEVCSIYLFRDPDTLELCATQGLNPEAVHQTRLKMGEGLVGRVARMASPINTGNAPSERGFRFMPETGEEIYSAFLGVPIQRVGEKLGVLVVQSREAREYSEDEVYALEVVAMVLAEMAELGVFVGEGEALSAKHTQPVLMRGSTGQEGAAEGHVWLHEARVVVTNPVGDDPVHETERIRAAVAQLRVSVDDLLSASTLDKDQRQVLEAYRLFAHSRGWLRRMEEDIMAGLSAEAAVQKEQSAARARLEQVPDAYLRDRLHDLDDLSHRLLRILTGQGRDTGAEMPENPVLVARNIGPAELLEYGRKLRGIVLEEGSVGSHAAVVARALAIPLVIHAERITTEALNGDHIMVDGDNGLVHLRPEASIAAAFRDKMAMQAKAQERYASLRNLPAQSKCGTVTGLMMNAGLMADLPSLDSSGAEGVGLFRTELQFLIRNQMPKRDELARLYARVMDAARGHRVVFRTLDIGSDKVLPYLKPQDEPNPAMGWRAIRVGLDKPGVLRMQLQALIRASAGRDLSIMFPFVSEHHEFMMARSHLLRELHRERSLGHPVPVNIRVGTMLETPSLAYAPRAFFETTDFISIGGNDLRQFFFAADRENERVRRRYDVLNVSFLTFLEHIVNRCAETATPLSFCGEDAGRPVEALCFAAMGIQTLSMRPASIGPVKALLRRVDLIEARKVI

SEQ ID NO: 7988 - protein, 416 aa, Rhodobacter sphaeroides
MPLLVMKFGGTSVADLARIKNAAQKVKREVERGYDVIVIVSAMSGKTNELVGWVEQTSPLFDAREYDAVVSSGENVTAGLMALTLQEMEVPARSWQGWQVPIRTTSQHSAARFLEIPRENLDAKFAEGFKVAVVAGFQGVSPEGRITTLGRGGSDTTAVAFAAAFAAERCDIYTDVDGVYTTDPRIASKARKLEKIAYEEMLELASLGAKVLQTRSVELAMRYKVKLRVLSSFEDTDETSGTLVCDEEDIMESKVVSGVAYSRDEAKMTLVTVEDRPGVAAAIFGPLAEAGVNVDMIVQNISEKDYGSHPGSVTDMTFSCPINQVARARKALEDAKAEGTIVYDDLVVDTEVAKVSVVGIGMRSHAGVAATMFKALAADGVNIKVIATSEIKISVLIDRKYMELAVQALHDAFALE

SEQ ID NO: 7989 - protein, 341 aa, Rhodobacter sphaeroides
TRILVTLPSEAASDPAIVRELVAAGADAFRINCAHDGPEAWAAMIGHIRKSERMTGRKLPISMDLGGPKFRVTKTGGPLPKRLQAGDRFAFVEKPSLAPEGRGWAMLGHPALLAALAPGVQVSVDDGKLWATVIQTGRGHALLEVDRVGERGLKLKPGRGVNLPGSHLDVAALTEEDLAALDVVVAEADLVAFSFVQTPGDVRALIAAMEARACHPRPLPAILLKIETPMGLHLLPELIVEAGGSLPVGVMIARGDLAVEIGFDRLSEIQEEILWLCEAAKVPVVWATQVLEGMVKEGQASRAEVTDAAMSQRADCVMLNKGPHVAAAIEFLRDILIRMDR

SEQ ID NO: 7990 - protein, 172 aa, Rhodobacter sphaeroides
VRDYIRTIVDFPHEGILFRDVTTLFADPRGFRIAIDQLLAPYAGMRFDKVAGLEARGFILGGAVAHRLSTGFVPIRKKGKLPGRTISVSYQLEYGEAVVEVHDDAIQAGEKVLLVDDLLATGGTAEAGIKLIEQLGGQVVGCAFVVDLPDLGGRKRLEAMGMEVHALCAFEG

SEQ ID NO: 7991 - protein, 483 aa, Rhodobacter sphaeroides
GLSPGARVERHPEVPMLNPADDAFLARLAGRLPPGSLTAPEPRHLTEPRGRRQGQAGALALPRDTAEVAAIVAACAAARVGIVPLGGGTGLVGGQVMETGPLPLLLSLERMNRVRGIFPEENVILVEAGAILAEVQAAAEAAGRMFPLWLASEGSCRIGGNLASNAGGTAVLRYGNARDLCLGLEAVLPDGSVFHGLKRLRKDNTGYDLRNLLIGAEGTLGIITAASLKLVRPPAAEGAALLAVRDPAAALELLGRAQRRLGPLVTGFELMHRQGFAFLAETMPERRLPFADLPDWTVLVDLGLTEGMDPAAELEALFAEAAEAGLVSDGALAQSLAQAADFWALRESIPEANRRIGAIASHDISLPLSEIARFVTEAGAAIGRLGDLRVNCFGHLGDGNLHYNVFPAAGRRREAYDDLRGEITRTVHDLVAAAGGSISAEHGIGRLKVEDLERYGDPAKLRAMRALKAALDPFGIMNPGAVL

SEQ ID NO: 7992 - protein, 398 aa, Rhodobacter sphaeroides
LPNGFRIVTEHMPGLHSASIGIWIAAGGRHERPEQNGIAHFLEHMAFKGTKTRSALRIAEEIEDVGGYINAYTSREMTAYYARVLEADTGLALDVIADIVLNPVFDPKEIEIERHVILQEIGQALDTPDDIIFDWLQEASYPGQAFGRTILGPEERVSTFGRADLTRFVGEHYGPDHMILAAAGGVDHGRIVAQAQALFGHLKPVGQRPMQPADFLGGERRELKSLEQVHFAMAFEAPNYRAPDVYAAQVYAMALGGGMSSRLFQKVREERGLCYSIFAQSGAYEDTGQITIYAGTSGEEVADLAGLTVDELKRATEDMSEAEVARARAQLKAGLLMGLESPSNRAERLARLLAIWGRVPGVDEAVEKIDAVTVGAVRDYAERMAQARSALALYGPAE

SEQ ID NO: 7993 - protein, 371 aa, Rhodobacter sphaeroides
ITAAVLERDGIAGNYAEERPLAIRELDLAEPGPGEVLIRVAAAGICHSDLSVINGTRRRPLPMVLGHEASGHVEALGEGVEDLEHGDHVVCIFAPGCGRCTPCAEGRPALCEKAARHHAVGELMTGHRRLSLGGRSVHHHLGISGFATHAVVARPSLVRVPREVPPHVSALFSCAMLTGAGAVFNTAQIRPGSKVAVVGLGGVGLSAILGAAAAGAAEIVAIDPFPAKMEAARAMGATLSVPADGDTVAAVRDLTAGGVDYAFELAGSVRALETAFAVTRRGGMTVTAGLPHPDDRMSLEALKLVAEERTLKGSYIGSCVPQRDLPRMLALHRRGLLPVEKMLTHRLKLDEINLAMDRLAKGSAIRQVVDL

SEQ ID NO: 7994 - protein, 882 aa, Rhodobacter sphaeroides
QKTRKTLSVGGSSYAYYSIPAAEEAGLGQFARLPAALKVVLENMLRFEDGKTVSVDDIRAFSEWGANGGRNPREIAYRPARVLMQDFTGVPAVVDLAAMRDGILGLGGDAQKINPLNPVDLVIDHSVMIDEFGNPRAFQMNVDREYERNMERYTFLKWGQKAFNNFRVVPPGTGICHQVNLEYLAQTVWTDRDQDGMEVAYPDTLVGTDSHTTMVNGLAVLGWGVGGIEAEAAMLGQPVSMLIPEVVGFKLTGQMIEGTTATDLVLKVVQMLRKKGVVGKFVEFYGEGLDHLPLADRATIANMAPEYGATCGFFPIDGETLRYLRQTGRDESRIALVEAYAKANGLWRDASYEPIYTDTLHLDMGEIVPAISGPKRPQDYLPLTDAKASFAREMETSFKRPVGKEVPVAGEDYTMSSGKVVIASITSCTNTSNPYVLIGAGLVARKARALGLNRKPWVKTSLAPGSQVVSEYLEAAGLQEDLDAVGFNLVGYGCTTCIGNSGPLQPEISAAINEGDLVAAAVLSGNRNFEGRISPDVRANYLASPPLVVAYALAGDMNIDLTSEPIGMGTNGPVYLKDIWPTNAEIAELVEKTVTREAFQKKYADVFKGDAKWQSVSTTDSQTYDWPASSTYIQNPPYFQNMSKEPGVITDITGARVLALLGDMITTDHISPAGSFKESTPAGKYLVERQVSPREFNSYGSRRGNHEVMMRGTFANIRIKNEMLDGVEGGYTLGPDGQQTSIFDASMAYQAAGTPLVLFGGIEYGAGSSRDWAAKGTALLGVKAVIAESFERIHRSNLVGMGVIPFEFTEGQNRKSLGLKGDETVSIQGLSGDLKPLSLVPCTITYGDGTVKTIQLKCRIDTEIEIEYVEHGGVLHYVLRDL

SEQ ID NO: 7995 - protein, 251 aa, Rhodobacter sphaeroides
KRAIVTGSNSGIGLGCAEELARAGAEVVINSFTDRDEDHALAEKIGREHGVSCRYIAADMSDGEACRALIETAGGCDILVNNAGIQHVSSIEEFPVGKWNAILAINLSSAFHTTAAALPGMRAKGWGRIVNIASAHGLTASPYKSAYVAAKHGVVGFTKVTALETAGKGITCNAICPGYVLTPLVEAQIPDQMKAHDMDRETVIREVMLDRQPSRQFATTGQIGGTVVFLCSGAADQITGTTISVDGGWTA

SEQ ID NO: 7996 - protein, 330 aa, Rhodobacter sphaeroides
MRPIQAAYPHARFRRTRRTDALRRLTQEYTLTTGDLIWPLFVRDGENIEEPIHSMPGVVRRSVDRIVAAAERSRKPRHPGGLPLSYTDPSLKTELCEEAWNPCNLANRAIRAIKAAVPELAVMTDVALDPYNANGHDGLVRDGIILNDETVEALVRMALAQAEAGADILGPSDMMDGRIGAMRTALEAAGHKDVAILSYSAKYASAFYGPFRDAVGASGALKGDKKTYQMDPGNSDEALRLIERDLREGADMVMVKPGMPYLDICRRVKDAFGVPTYAYQVSGEYAMIRGAADRGWIKGEAAMMESLLCFKRAGCDGILTYFAPEAARLL

SEQ ID NO: 7997 - protein, 1070 aa, Rhodobacter sphaeroides
MHVVFRESHGLEESATPFDPGQTPADLVVLSFSDSDLGAFAAGWHRAEGGLPSTRLLNLVALRHPLSIDTYAETVLAHAKAILIRLIGGESYWSYGLAEVQDLCRRRGIALAVLPADGREDPALDALSTLPVSTLRRLSALCDAGGAVAAQAALAQLALAAGLYAGPVPGEKRMPDMGWYDPARGVIPEPEAEGGPAIVVTFYRSYLTAADTGPVDALIFALRERGFRAFGLFAPSLKAPGAPDWIAAGLGRLRPAAIVNATAFSARGPEGSPLDGPGCPVFQVALSTARRRDWAVAERGLSPADLAMHVVLPEVDGRIFAGAVSFKSPGKRCPDLQYSRFAHRADPARVAAVADRVAAWHRLARTPAPERRLALVLSTYPGRPDQIAHAVGLDALASAEALAATLAAAGYATASGADLAEALLTERQSWPLAAYEAALATLPAPLQFALREAWGAPEADPDCRDGAFRFAALRRGHLLLALQPERGETAARDADYHDLARVPRHAYVAFYLWLRAHSLHAMIHMGAHGTLEWLPGKAVALSDACWPEALTGALPVIYPFIVNDPGEAAQARRRLGALTLGHMPPPLRESALPENLERLERLLDEYSTADGLDPARRGRLIGAIRDEARAAGVEEDLGLPPDATPAEAITRIDRFVCDLKESRYGEGLHLYGAAPGETEGLLAALDGRRVAAGPSGSPHRGRTDVLPTGRNLYSVDPRAVPSRAAHAQGVKLAEELLRRHLQDQGDWPKGLVIDLWGSASMRTAGEEFAMALHLAGLSPRWDEGSERVSGVEILPLALLGRPRIDVTLRVSGLFRDIFPGLAQLFETGAEALAAREEAPEDNPYLRRSPRVFGPKPGLYGVGVRSDDYSPEGRLSAGEAWIEGSSWAIGADGAGHARRGALEGRLRAADAFAHVQDLAETDLLMAQDHAAHEGGFAAALARLGREAALYHLDATRPDRPRARSLTEELSRIVRARIADPAWADGMMRHGFRGAAEIAASVDHLGSFANLTRAVPDGLFDLCFEATLMREDLVAFMARENPAALAALRDRFRALAEAGLWQPRRNSIAALL

SEQ ID NO: 7998 - protein, 360 aa, Rhodobacter sphaeroides
VELGARAYEVRIGPGLIARAGAEIAPLLRRPKVAILTDETVAGLHLDPFRQALAEAGIASSALALPAGEATKGWPQFARAVEWLLEEKVERRDVVVALGGGVIGDLAGFAAAVLRRGVRFVQVPTTLLAQVDSSVGGKTGINTAQGKNLVGAFHQPSLVLADIGVLETLPPRDFRAGYGEVVKYGLLGDADFYEWLEEAGPRLAADAEARQRAVRRSVEMKAEIVARDETEEGDRALLNLGHTFCHALEKATGYSGRLLHGEGVAIGCALAFELSQRLGLCAQEAPSRLRAHLRAMGMKVDLRDIPGDLPSAEALLALMAQDKKVVDGKLRFILARGIGQAFVADDVPGDVVRTLLEDAL

SEQ ID NO: 7999 - protein, 168 aa, Rhodobacter sphaeroides
MVGMMGAGKTAVGSALARGLNVPFLDSDEEIERAANRTIAEIFARDGEPFFREKESQVLARLLRGSPCVLSTGGGAFMAEGNRRMIREQGVSVWLKADLDVLWHRVRHKATRPLLRTPNPRETLRALLEARDPVYAQADLAVESGEGTVEQMAVRVREALATRPDVLE

SEQ ID NO: 8000 - protein, 779 aa, Rhodobacter sphaeroides
YPVLPLRDIVVFPHMIVPLFVGREKSVRALEEVMADDRQILLSSQIDPSVDDPATDGIYRSGVLANVLQLLKLPDGTVKVLVEGKSRVRITDFLSNDSFFEARAERLDEEPGDQATVDALLRAVAEEFERYAKIKKNIPEEALAAVSETRDAARLADLVAGHLGIDVAQKQALLETLDVAERLEKVYGHMQGEMSVLQVEKKIKTRVKSQMERTQREYYLNEQMKAIQKELGDGEDGQNEIAELEERIAKTELSKEARDKAEAEVKKLKSMSPMSAEATVVRNYLDWLLGVPWGVKSRTKKDLTKAQGVLDADHHGLEKVKERIVEYLAVQARSAKLKGPILCLVGPPGVGKTSLGRSVAKATGREFIRISLGGVRDESEIRGHRRTYIGSMPGKIIQALKKAKTTNPLILLDEIDKMGQDFRGDPASAMLEVLDPEQNSTFVDHYLEVEYDLSNVMFLTTANSYNMPSPLLDRMEIIPLSGYTEDEKREIAKQHLIPKQIENHGLKKGEFKVTDEALTETIRTYTREAGVRNLEREIAKMARKAVTEIVKGHTKSVEVTPEKLEGFLGVKRHRYGLAEKEDQVGVVTGLAWTSVGGELLSIEALRLPGKGRMKTTGKLGDVMKESIDAASSFVRSISPELGVKPPKFETVDIHVHVPEGATPKDGPSAGVAMVTSIVSVLTGVPVRKDVAMTGEVTLRGNVLPIGGLKEKLLAALRGGIKTVLIPEENAKDLAEIPDNVKEGLRIIPVSHVREVLREALVRMPEPVEWDEEAEEAAAA

SEQ ID NO: 8001 - protein, 395 aa, Rhodobacter sphaeroides
MGWKTLDDMDLAGKVVLVRVDVNVPMENGEVTDATRIEKIVPTVEDILKKGGKPVLLAHFGRPKGKVVDEMSLRLVLPALQNALPGTKVSFAADCVGPEPEQAVAAMLEGEVLLLENTRFHAGEEKNDPELAAAMAKLGQVYVNDAFSAAHRAHASTEGLARLLPSAAGRLMEAELKALEAALGHPERPVVAVVGGAKVSTKLDLLGNLVGRVDHLVIGGGMANTFLVAQGIEVGKSLAERDMADTAREILSKAKAAGCTIHLPLDVVVAREFKAGAANETVETAACPADAMILDAGPKTVAALSEVFASAKTLIWNGPLGAFEIEPFDAATNAAALQVAQLTKAGQLISVAGGGDTVAALNKAGAAEGFSYISTAGGAFLEWMEGKELPGVAAL

SEQ ID NO: 8002 - protein, 315 aa, Rhodobacter sphaeroides
SKEELVRYYREMLLIRRFEEKAGQLYGMGLIGGFCHLYIGQEAVVVGLEAAAKEGDKRITSYRDHGHMLACGMDAKGVMAELTGREGGYSKGKGGSMHMFSKEKHFYGGHGIVGAQVPLGAGLAFADRYLGNDNVTFTYFGDGAANQGQVYEAYNMARLWSLPVIFVIENNQYAMGTSVKRSTKSPSLWERGAAYGIKGESVDGMDVLAVKAAGEKAVAACRAGQGPYILEMMTYRYRGHSMSDPAKYRTREEVQRMRDEKDAIEHVRTWLIQGNLATDDDLKAIDKEIKAVVNEAADFAKESPEPALEELWTDI

SEQ ID NO: 8003 - protein, 463 aa, Rhodobacter sphaeroides
MATQVLMPALSPTMEEGTLAKWLVKEGDAVKSGQIIAEIETDKATMEFEAVDEGTVGKLLVAEGTSGVKVNTPIAVLVEEGESADEVQAPVPTQKEKQPEPAEASEGKAVDEPLVSSPGAPVPGKRDRSPDWPDGTQMKTMTVREALREAMAEEMRGDEHVFLMGEEVGEYQGAYKISQGLLDEFGDRRVVDTPITEHGFAGIAVGAAFGGLRPIVEFMTFNFAMQAIDQIINSAAKTLYMSGGQMGCPIVFRGPNGAAARVGAQHSQDYAAWYAQIPGLRVVMPYSAADAKGLLKTAIRDPNPVIFLENEILYGRSFEVPVMDDFTIPFGKARIWREGTDVTIVSFGIGMTYALEAADKLAAEGISAEVIDLRTLRPIDYETVIESVKKTNRCITVEEGWPVGSIGNHLAATIMQQAFDWLDAPVLNLTGKDVPMPYAANLEKHALVTTAEVVEAAKSVCYR

SEQ ID NO: 8004 - protein, 441 aa, Rhodobacter sphaeroides
MATEILMPALSPTMEEGTLAKWLKKEGDEVRSGDIIAEIETDKATMEFEAVDEGILGKILIAEGTAGVKVNTPIAVLVEEGESVDAVSSAKVPEPQEPADEAAPAQGAPKEAPAPAAKAPAAQAARSEGERVFASPLARRIAKEKGIDLAAVQGSGPRGRIVKADVEGAQPSAAPAAKADAAAPKAEAPAAAAAPVAAPAASAASVAKLFADRDYEEVTLDGMRKTIAARLSEAKQTIPHFYLRREVALDALMAFRADLNAKLESRGVKLSVNDFIIKACAVALQQVPNANAVWAGDRILRLKPSDVAVAVAIEGGLFTPVLRDAHQKSLSALSAEMKDLAARARTKKLAPHEYQGGSFAISNLGMFGVENFDAVINPPHGSILAVGAGIRKPVVGKDGAITTATMMSMTLSVDHRVIDGALGAEFLKAIVENLENPIAML

SEQ ID NO: 8005 - protein, 460 aa, Rhodobacter sphaeroides
MAPRFGTSGLRGLVTELTPDLVSAYVRAFLRACPQGAGLYLGHDLRPSSPALAGVVAEAARHAGVPVTDCGALPTPALALAARRAGARAVMVTGSHIPADRNGLKFYGPGGEISKADEAAILSGLGEPLPPRTPPAPLACDASAGEAWVHRYVTAFGPEALTGLRIGVWSHSAVSRDLLLAALRALGAAAVVELGRSTAFVPVDTEAVPEGVRARIKAWTAEHRLDALISTDGDGDRPLLADACGQIVPGDLLGQITAALVGAETVVTPVSSNTGVEAGGRFRRVIRTRIGSPFVIAAMEEAGGRSVGYEANGGFLLGFDAHLEGPLPQLPTRDSLLPLLAPLSLAQAAGGLAALVGREPARFTAADRLEGVPDGKAQALVAEFGASPEELAGFLAILGEEIRSLDRTDGLRATCASGRIVHIRPSGNAPEMRLYVEAETPAAARDLLERGLRKLELTLM

SEQ ID NO: 8006 - protein, 852 aa, Rhodobacter sphaeroides
TDPHSRPAEACLEALDVCPSGLTDAEAAARLARHGPNRLPEARTRGPVRRFLAQFNNVLIHVLLVASVVTAALQHWVDTGVILAVVLANAVIGFIQEGKAESAMAAIRGMLAPHAAVLRNGRRVSIDGAHLVPGDIVLLEAGDKAPADLRLIEARGLAAQEAILTGESVPVEKATYPVAADAPLGDRRSMLWSGTLVTQGAARGVVTATGAATEIGRIGGLLAGVEQLTTPLVAQMDHFARWLSFLILLVAALLLLWGYFVGHMVFVDLFMTVVAIAVAAIPEGMPAVMTITLAIGVQAMARRNAIVRRLPAIESIGSVSVICTDKTGTLTRNEMVVVAAETPQGAFRIAGEGYAPSGEITPPGDLTRLARAAALCNDAALHDRSGVWSAEGDPMEGALLAFAGKAASGPAATRLDAIPFDSRHRFMAVLTEGSGGRMIHVKGAPERVLSMCRDADHAHWHDRAEAMARRGLRVLALAEKPEDSAHIDAAVLEGGLSFLGLVGLIDPPRPEAVAAVAECRAAGIRVKMITGDHAGTAAAIAAQIGLENPHRVLTGADLDRLDEAQLALEVQGVDVFARTSPEDKLRLVTALQANGLSVAMTGDGVNDAPALKRADAGIAMGLKGSEAAKEAADLVLADDNFATLAAAVREGRTVYDNLKKVISWTLPTNAGEALVVITALVAGMALPMSAVQILWINLITGITLGLALAFEPTERGTMARPPRPREAPILSGELVWHVVLVAVLFLAAVFGMFTYALDKGYALPLAQTIALNTLVVLEICHLFFIRNIHGTSLTWAAVRGTKVVWIVVIAITLAQFAVTYVPFLQRILGTEAVPLADGLLVVAVGAIFLAIV

SEQ ID NO: 8007 - protein, 372 aa, Rhodobacter sphaeroides
MTKTALITGITGQDGSYLAEFLLEKGYEVHGIKRRASMFNTQRIDHIYEDPHARNPRLKLHYGDLTDSSNLTRILAQIQPDEVYNLGAQSHVAVSFESPEYTADVDAVGALRLLEAIRFLGLEKKTRFYQASTSELYGLVQEIPQRETTPFYPRSPYAVAKLYAYWITVNYRESYGIYACNGILFNHESPRRGETFVTRKITRGLSHIAQGLEPCLYMGNIDSLRDWGHARDYVRMQWMMLQQEKPDDFVIATGLQYSVREFIKWSAAELGITLRFEGQGVEEIGVVEDVCGDMAPEVTRGDVIVRIDPRYFRPAEVETLLGDPAKAKQKLGWVPEMTVREMCAEMVAEDLKSARRHRLLRENGLHLPVALE

SEQ ID NO: 8008 - protein, 443 aa, Rhodobacter sphaeroides
LPADAVIHDEAETRAYECDALTAYRCPPLAAVLPRSTAEVSAVLRICHEERVPVVPRGSGTSLAGGALPTADCVILGVARMNRVLETDYANRFIRVETGRTNLSVTGAVEVDGFFYAPDPSSQLACAIAGNIAMNSGGAHCLKYGVTTNNLLGVTMVLMDGTVVEIGGAHLDAPGLDLLGVICGSEGQLGVVTEATLRILPKPEGARPVLMGFGSNEVAGACVSDIIRAGILPVAIEFMDRPCIRATEAFAKAGYPDCEALLIVEVEGSPAEIDDQLARILEIARRHDPVELRESRSEEESRRIWLGRKSAFGAMGQINDYMCLDGTIPVTELPRVLRRIGELAAEAGLEVANVFHAGDGNMHPLILFDANRPGDLERCERLGAEILKLCVEVGGCLTGEHGVGVEKRDLMGVQFAPADLEAQMRVKDVFDPRWLLNPAKVFP

SEQ ID NO: 8009 - protein, 481 aa, Rhodobacter sphaeroides
LKDPSLLETRAFVAGEWVDADDGATFEVTNPARGDVICTVPDLGRAETARAIAAAEEAMKEWAARTGKERAQVMRKWFDLMMANQDDLGAILTAEMGKPLAEAKGEIAYGASFIEWFGEEAKRIYGETIPGHMRDKRITVLKQPIGVVGSITPWNFPNAMITRKCGPALAAGCGFVARPAAETPLSALALAVLGERAGLPKGILSVITSSRSSDIGKEMCENPIVRKLTFTGSTEVGRILLRQAADQVMKCSMELGGNAPFIVFDDADLDAAVQGAMASKFRNNGQTCVCANRIYVQSGVYDAFAEKLAAAVKKLKVGDGLVEGTEAGPLINEKAVAKVEEHIRDVLDGGGQVLTGGKRHALGGTFFEPTVVTGVKQEMKVSTEETFGPLAPLFRFETEDEAVGYANDTIFGLASYFYARDVGRITRVQEALEYGIVGVNTGIISTEVAPFGGVKQSGLGREGSRHGIEDYLEMKYICLSI

SEQ ID NO: 8010 - protein, 306 aa, Rhodobacter sphaeroides
RHLLGIEHLAPDEIRSVLDLADSYVDLNRRTMKQSDALAGMTQINMFFENSTRTQSSFELAGKRLGADVMNMAVAQSSVKKGETLLDTAMTLNAMHPDLLVVRHPASGAVNLLASKVNCAVLNAGDGRHEHPTQALLDALTIRRAKGRIQRLTVAICGDIAHSRVARSNLILLGKMENRVRLIAPPTLMPPGVGEFGCELYDDMKKGLEGADVVMMLRLQKERMDGAFIPSEREYYHRFGLDAEKLAFAKEDAIVMHPGPMNRGVEIDGTLADDINRSVIQDQVEMGVAVRMACMDLLARNLRAER

SEQ ID NO: 8011 - protein, 259 aa, Rhodobacter sphaeroides
MVQLTLPKNSKVRTGKTWPKPADAKNVRKFMIYRWDPDTGENPRVDTYFLDMDKCGPMVLDALIKIKNEVDPTLTFRRSCREGICGSCAMNIDGINTLACIYGLDEIKGDVKIYPLPHMPVIKDLIPDLSLFYAQHASIMPWLETKTVEPAKEWRQSVEDRAKLDGLYECVMCACCSTSCPSYWWNGDRYLGPAALLHAYRWIVDSRDEATPERLDMLEDPFKLYRCHTIMNCAKTCPKGLNPAKAIAEIKKMMVERVI

SEQ ID NO: 8012 - protein, 600 aa, Rhodobacter sphaeroides
MAAYTYETHDYDVVVVGAGGAGLRATLGMAEQGLRTACVTKVFPTRSHTVAAQGGIAASLANMGPDNWQWHMYDTVKGSDWLGDTDAMEYLAREAPKAVYELEHYGVPFSRTEEGKIYQRPFGGHTTQFGEGPPVQRTCAAADRTGHAILHTLYGQSVKNNAEFFIEYFALDLIIQDGRCTGVVAWKLEDGTIHVFNAKLTVLATGGYGRAYFSATSAHTCTGDGGGMVARAGLPLQDMEFVQFHPTGIYGSGCLITEGARGEGGYLTNSNGERFMERYAPTYKDLASRDVVSRCMTLEIREGRGVGEHGDHIHLHLNHLPPETLALRLPGISESAKIFAGVDLHKEPIPVLPTVHYNMGGIPTNYWGEVLAPTEGDPDRVFPGLMAVGEAGCASVHGANRLGSNSLIDLVVFGRAAAIRAGQIVKPHEFHPDVPKVQVDEILGRFDDLRHANGAVPTAELRLEMQRTMQADAAVFRTDKTLAEGVEKMKGIAAKLGDLKVTDRSLIWNSDLMETLELTNLMPNALATIVAAEARKESRGAHAHEDWPNRDDENWRVHSLAVVKGNEVTLTTRPVHLDPLTKQTEGGIDLKKIAPKARVY

SEQ ID NO: 8013 - protein, 320 aa, Rhodobacter sphaeroides
MARPKIALIGAGQIGGTLAHLAAIKELGDVVLFDIAEGTPQGKALDIAQSGPSEGFDAVMKGANSYEEIAGADVCIVTAGVPRKPGMSRDDLIGINLKVMKSVGEGIKAHAPNAFVICITNPLDAMVWALQQFSGLPAEKVVGMAGVLDSARFRHFLSVEFNVSMRDVTAFVLGGHGDTMVPLVRYSTVAGIPLPDLVQMGWTTQEKLDQIVQRTRDGGAEIVGLLKTGSAFYAPATSAIEMAEAYLKDQKRLLPCAAYVDGAFGLNGMYVGVPTIIGAGGIEKIVDIKLNDDEQAMFDKSVNAVKGLVEACKGIDSSLA

SEQ ID NO: 8014 - protein, 396 aa, Rhodobacter sphaeroides
MNIHEYQAKALLRSYGAPVSDGRVVLKADEAKSAAGELGGPLWVVKAQIHAGGRGKGKFKEPEAGEKGGVRLAKSVGEAAELAKQMLGRTLVTHQTGPAGKQVNRIYIEEGSDIARELYLALLVDRGTSRISFVVSTEGGMDIEEVAASTPEKIVSFSVDPASGLSDFHGRRVAFALGLEGAQVKQCVQLVKNLYRAFVEKDMEMLEINPLIVMTDGNLKVLDAKVGFDNNALYRQSDVMALRDETEEDPKELAASKFDLNYIALDGEIGCMVNGAGLAMATMDIIKLYGAEPANFLDVGGGATKEKVTEAFKIITSDPNVKGILVNIFGGIMRCDIIAEGIIAAVKEVGLQVPLVVRLEGTNVEKGKEIIANSGLNVIAGDNLSDAAQKIVKAVK

SEQ ID NO: 8015 - protein, 294 aa, Rhodobacter sphaeroides
MAVLVNENTKVICQGITGSQGTFHTEQAIAYGTKMVGGVTPGKGGSEHLGLPVFNSVYEAREVTGANASVIYVPPPFAADSILEAIDAEMELIVCITEGIPVLDMMKVKRALQGSSSRLIGPNCPGVITPGACKIGIMPGHIHKRGSVGVVSRSGTLTYEAVKQTSDLGLGQSSAVGIGGDPIKGTEHIDVLEMFLADPETQSIIMIGEIGGSAEEEAAQFLADEKKRGRWKPTAGFIAGRTAPPGRRMGHAGAIVSGGKGDAESKIEAMKSAGIVVADSPAHLGEAVMQALGK

SEQ ID NO: 8016 - protein, 984 aa, Rhodobacter sphaeroides
MTEQSPNAQFHASSFLQGQNAEYIDQLQARYAEDPASVDAGWAELFRSLGDSELDAKRQAHGPSWSRPDWPPMPADDLTAALTGEWPAAPAKEAKAAGQKIQAKAAEQGVSLSDAQVQRAVLDSIRALMIIRAYRIRGHLAADLDPLGLRNTTNHPELDPKSYGFTDADMDRPIFIDNVLGLQVASMRQIVDIVKRTYCGTFALQYMHISDPEQAAWLKERIEGYGKEIHFTREGRRAILNKLVEAEGFEKFLHVKYMGTKRFGLDGGEALIPAMEQIIKRGGALGVKEIVVGMPHRGRLSVLANVMAKPYRAIFNEFQGGSFKPEEVDGSGDVKYHLGASSDRDFDGNTVHLSLTANPSHLEAVNPVVLGKVRAKQEQAGDKTRHTVLPILLHGDAAFAGQGVVAECFGLSGLVGHRTGGTIHIVVNNQIGFTTAPSFSRSSPYPTDIALMVEAPIFHVNGDDPEAVVHAAKVATEFRQKFHKDVVIDIFCYRRFGHNEGDEPMFTNPSMYTSIKKHKTTLQLYTERLVRDGLIPEGEIEDMKAAFQAKLNEEFEAGKDFKPNKADWLDGRWKHIDRHGDEYQPGRTSISAETLQEIGQALTRVPEGFDLHKTVGRQLEAKKQMFETGRGFDWATGEALAFGSFVVEGYPVRLSGQDCTRGTFSQRHSAFINQSTEERYYPLNNIRSGQARYEVIDSMLSEYAVLGFEYGYSLAEPNALVMWEAQFGDFANGAQIMFDQFINSGESKWLRMSGLVVLLPHGFEGQGPEHSSARLERFLQMSANDNWIVANCSTPANYFHILRRQIHRNFRKPLILMTPKSLLRHPLCISNAEDFTTGSGFHRVLWDDAQKGHSETVLKPDEQIRRVVMCSGKVYYDLLAERDKRGIDDVYLMRLEQFYPFPALSLVKELGRFKNAQIVWCQEEPKNQGGWTFVEPNLEWVLTRIGASHTRAIYAGRSASASPATGLASRHKAEQDALVNDALT

SEQ ID NO: 8017 - protein, 405 aa, Rhodobacter sphaeroides
MIDVMVPALGESVSEATVSTWFKKPGDTVAQDEMLCELETDKVSVEVPAPAAGVLAEILVTEGTTVAAGSKLALISSDGQGVAAAPKAETPKKTEAAPAQEPAPKKDVEDAPSARKAMAEAGLSPDAVQGTGRDGRIMKDDVARAVSGASQAAAPTPAPQPALPRQPVPADDAAREERVKMTRLRQTIARRLKEAQNTAAMLTTYNEVDMSGVMGLRNEYKDAFEKKHGTKMGFMSFFVKACCHALKEVPEVNAEIDGTDIVYKNYVHMGVAVGTPSGLVVPVVRDADQMGFAQIEKKIAELGLRARDGKLSMAEMQGGSFTISNGGVYGSLMSSPILNPPQSGILGMHKIQERPVVEKGQIVIRPMMYLALSYDHRIVDGKGAVTFLVRVKEALEDPRRLLLDL

SEQ ID NO: 8018 - protein, 462 aa, Rhodobacter sphaeroides
MATFDVIIIGAGPGGYVSAIRCAQLGLKTAVVEGREALGGTCLNVGCIPSKALLHATHNLHEVHENFEKMGLMGAHPTVDWSKMQGYKQEVVDGNTKGIEFLFKKNKITWLKGWGSIPEPGKVKVGEEIHEAKSIVIATGSEPASLPGVEADESVIVTSTGALSLGRIPETMVVIGAGVIGLELGSVYARLGTKVTVVEYMEAILPGMDAEVVKTTQRILAKQGLSFVLGAAVKGATVSDGKATVTWAAKKDGKETSLTVDTVLVATGRKPFTEGLGLEALGVEMLPRGVVKIDDHFRTSVPGIYAIGDCVPGMMLAHKAEDEGVALAEILAGKHGHVNYGVIPGVIYTTPEVASVGRTEESLKEEGRAYKVGKFPFMGNARAKAVFQAEGFVKMIADKETDRILGCHIIGPAAGDLIHEVCVAMEFGASAQDLAMTCHAHPTWSEAVREAALACGDGAIHA

SEQ ID NO: 8019 - protein, 332 aa, Rhodobacter sphaeroides
MDPEKAHSLSLSALRSGLVPLPGPVTSPRLATVVGGLVLPNPVGLAAGYDKNAVALAALMRAGFGFLEVGAATPRPQPGNPQPRLFRLTEDRAAINRFGFNNDGAATICARLAMRPRGAVPVGLNLGANKDSPDRAADFAAVLAACGPHADFATVNVSSPNTERLRDLQGRQALTALLEGVMQVQAGFARPVPVFLKIAPDLSDADLAEIAEVALASGIAGIVATNTTLARDGLRSAHARETGGLSGAPLFERSTRVLARLSELTEGRLPLIGVGGVASAEEAYAKIRAGASAVQLYTAMVYQGIGLAARIARGLDALLLRDGFGSVAEAVG

SEQ ID NO: 8020 - protein, 534 aa, Rhodobacter sphaeroides
PRTVSAPVQTGSFDMKSTLLASAALVALTTGAARADFALTILHTNDFHDRFEPISKYDSTCPPEDNTAGECFGGIARLVTAISEARGQGGTRLLVDAGDQFQGSLFYSRYKGELAAEFMNALDYDAMTVGNHEFDDGPAVLTDFARKLEAPLLMANADLTGEPGLRAELQKSVVVEKGGEKIGIVGLTPLDTAELASPGPNVIFTEPVQAAQAEVDRLTDEGVTKIVLLSHLGYEADKEIASALKNVDVIVGGHSHTLLSNEDGAAAGPYPTMVGDVAIVTAYAYGKYLGELNVTFDDAGRIVSAEGAPMLLDASVAEDEATVARVKELAAPLEEIRSRVVAEVSAPIDGSRESCRSGECAMGNLVSDAMLDRVRDQGIQIAISNGGGLRASIDAGTVTMGDVLTVLPFQNTLSTFQVKGEAVVAALENGVSELEEGAGRFAQVAGLKYAFDPAAPVGARISDVMVMEEGGWQPIDLAKTYGVVSNNYVRQGGDGFAMFVDAANAYDFGPDLADVTADYLVAHAPYTPVIEGRI

SEQ ID NO: 8021 - protein, 240 aa, Rhodobacter sphaeroides
SALRDAPDEWALFLDIDGTLVDIAEQPHDVRVAASLPQDLARLADRLGGALALVTGRRVDWIDAHFGPHLFPAAGLHGVERRRASGELDRAGLAPSLNALRKDLGRRTARMPGVLLEDKVAAVALHYRQAPEREPDVRAMMEMALKVMGDGWVLQHGKMVVELRPASANKGTALEAFLTEPPFAGRRPVAIGDDVTDEEMFRVVNACGGLSVRICETEAPTLARARLASPQALRDLVAEL

SEQ ID NO: 8022 - protein, 463 aa, Rhodobacter sphaeroides
MSRLVVVSNRVPLPDENGNPPPGGLAVAVHAALRKNGGIWMGWSGRSTGEEEPQGLTTLEQDKISYVLTDLSQADLDEYYNGFANRVLWPIFHCRLDLAEYARQEMAGYFRVNRLFADRLVPMLEPDDVIWVHDYHLIPLAQELRKRGVRNRIGFFLHIPWPPADILTALPVYEIIMRGLAAYDLVGFQTDYDLDNFVGCLRREGWGDWSTPGWLRAFDKEVAAAAFPIGIETGDFARLAAKTDGLDLVTDMQQSLHGSSLIIGVDRLDYSKGIAARIDAFERYLMRNPDQAGKVTLLQVAPHSRSDVPEYLEMQGQVESHCGRVNGAHGTIEWVPIRYVNQSLTRPVLAGLYRLAKVGLVTPLRDGMNLVAKEYVASQDPADPGVLILSRFAGAARELDGAIFINPYDTEQTAGAIGRALSMPLDERIARWRRMMDHLESHDVLWWCRTFLAALNEAPEDNG

SEQ ID NO: 8023 - protein, 457 aa, Rhodobacter sphaeroides
MEGLAQANDLSEVIEADRAHMWHHLSQHKQYETVDPRIIVEGKGMRVWDAAGKEHLDAVSGGVWTVNVGYGRESIANAVRDQLIKMNYFAHSAGSIPASRFSKRLIEKMPGLSRVYYSNSGSEANEKVFKMVRQISHRHHGGKKGKILFRERDYHGTTITALATSGQPQRAEQYGPLTPGFVMVPHCLEYRKQWDVENYGERAADAIEEVILREGPDTIGALCLEPVTAGGGVIVPPAGYWERVQEICRKYDILLHIDEVVCGLGRTGTWFGYQNFGVKPDFVTMAKGVASGYAAISCTVTTEAVFDMFKDDPSDPMSYFRDISTFGGCTAGPVAALENMRIIEDEGLLENTLKMGARVVENLSALQEKHAVIGDVRGKGLFCGAELVADRATKEPMDEKRVAAVVADVMAQGVIIGMTNRSLPGFNNTLCLSPALIATPDDIDQITDAIDRALTRV

SEQ ID NO: 8024 - protein, 537 aa, Rhodobacter sphaeroides
WWKNAVFYCLDVETFQDSNGDGIGDFAGLTRRLDHLDRLGVSCIWLMPFYPSPNQDDGYDITDYYSVDPRLGTLGDFVEFLRAAHDRGMRVIADLVVNHTSREHPWFQASRADPDSPYRDWYVWRDEKPDEDAASLVFPGEENSSWTWDAKAGKYYLHRFYSHQPDLNVENRAVRDEIQRIVGFWLQLGLSGFRVDAVPFLLEQMSTVDTGFAPHRWLRDLRAFINRRSGDAVLLGEVNLDYPDVRRFFGDEDGDELHMCLDFNLNQAMALALAREDAGPIVHGLRHMPELAPDDGWAHFLRNHDEWSLDKLTEAERQEVFASFGPDPSMQLFGRGLRRRMPTMLKGNPDRLRMAYALMASMPGSPVIFYGEEIGMAENLEIPGRLAVRAPMQWDAGPHGGFSNASTEALHRPMVSDPQWGPGKVNAIDQQDRPDTMFHFMEHLLRRRRECPEIAFGEHAVLPFPEPEIFAIRHDWEGRTLIALANLGAKPQKVTLTLPKASGLGRLRPILGEGKVSLRKDELTVELGGYGLRWVRF

SEQ ID NO: 8025 - protein, 261 aa, Rhodobacter sphaeroides
LGFMKMHGAGNDFVVIDSRGRGGALVTAGLARALGDRHRGVGFDQLAEIRDQEGADCALDFWNSDGSRSGTCGNATRCVSDYLMRDLGRDEVNLVTARGRLHARRREDGLVAVNMGAPQLLWSEIPLARAMETDSLPLEGTPSAVGMGNPHCIYFVEDAEAVDLAGRGAAVETDPLFPERTNVEFASLIGPDRLRLRVWERGAGITLACGSGACATAVAAARRGLTGRQVRLEMDGGVLEVDWRDEGVWLSGPVARVFEGH

SEQ ID NO: 8026 - protein, 504 aa, Rhodobacter sphaeroides
MTAPKPVVLCILDGWGLRAEREANAVALAETPTFDRLMATCPNATLVTHGPDVGLPRGQMGNSEVGHTNIGAGRVVAMDLGAIDLAIEEGSFPQNPALRDFIGKVKAKSGTAHLMGVVSDGGVHGHIQHLISAVEVLAGEGIPVVIHAITDGRDVAPTSAGEFVGQLVRVLPEGARIGTVIGRYWAMDRDKRWDRVKRASDAMLHATGEHAPDAEAAVAAALARGETDEFIAPTVVGDYAGARDGDGFFCLNFRADRAREILAGLAQPGFDAYDTGARPDWSAFLGMVDYSKEHDRFMTTAYPKPVIRNTLGEWVASHGLRQFRIAETEKYPHVTFFLNGGREAPETGEDRYMANSPKVATYDLQPEMSAPDVSDHLVEAIGAGYDLIVVNYANPDMVGHTGDLKAAMAAVEEVDRGLGRAVEAVTKAGGAMIVTADHGNCETMVDPETGGPHTAHTTNPVPVILVNGPAGARLHAGRLADLAPTLLQLMQLPQPEEMTGRSLI

SEQ ID NO: 8027 - protein, 285 aa, Rhodobacter sphaeroides
PMTHHPKPPFPDQEQPMPGKTSRLDPQPDHGEKSYRGSGRLQDMKAVITGADSGIGRAVALAFAREGADVLISYLSEDEDAAETERLVTEAGRKAVLVRGDLQDAAHCRAVIDRAVEEFGRIDLLVNNAAHQASFSDLGDIPDDEWELTFRVNIHAMFYLSKAAVPHMGPNSAIINTASVNADSPSPHLLAYATTKGAIQNFTGGLAQMLAEKEIRVNCVAPGPIWTPLIPSTMPAEKVKNFGTQVPMQRPGQPAELATAYVMLADPLSSYTSGATIAVTGGKPI

SEQ ID NO: 8028 - protein, 506 aa, Rhodobacter sphaeroides
MPQSAEKVLDHKDLFKEPEYQAMLEKKRATYENATPAETVAETADWTKSWDYREKNLARSCVTINPAKACQPLGAVFAAAGYDSTMSFVHGSQGCVAYYRSHLARHFKEPSSAVSSSMTEDAAVFGGLNNMVEGLANTYALYSPKMIAVSTTCMAEVIGDDLNSFIIKSKEKESVPADFPVPFAHTPAFVGSHVDGYDNMQKGILSNFWKDAPRTAGEGLNIIPGFDGYCVGNVREMKRMLGLMGVEATVLGDASDVYDTPSDGEYRMYAGGTTQEEIKEALNAKATLSLQEYCTRRTLAFCEEVGQETASFHYPMGVKATDEFLMKVSDLTGKEIPEALRLERGRLIDAMADSQAYLHGKTYAIFGDPDFVYAMARFVMEMGGEPKHCLATNGGKDWEVQMKELLASSPFGEGCQVWAGKDLWHLRSILATEPADLLIGSSYGKYLERDCNVPLIRLTFPIFDRHHHHRFPTFGYQGAIQVLVKILDKIFDKLDDESDISFDLTR

SEQ ID NO: 8029 - protein, 288 aa, Rhodobacter sphaeroides
EVRVAVEACGVCASNLGPWSAPDWMTYPTEPGGMGHEGWGIVEALGPDVTGVTVGERAAFLGQRSYASHEIVPATHLVPLPEGTAFPAEPVACALNIFRRSGIGRGDRVAIIGVGFLGALLTRLAADAGAEVIAISRREETLALARRMGAARTVPMIDHHEIVDEVRELTNGSFCEVVIEAVGKQWPLDLAGELVAEGGRLVIAGYHQDGPRQVNMQQWNWRGIDVVNAHERRPETYLRGMHEAVEAVQKGWIDLSGLLTHSYPLEDLAAALDATRDKPEGFVKAVVT

SEQ ID NO: 8030 - protein, 293 aa, Rhodobacter sphaeroides
RIISVGECMVEMAPTGEGTFAMGFAGDTLNTAWYLRRASPPEAEVDYLTAVGTDAISDRMLGFLRDAGLGTSRVARIPDRTVGLYLIELTDGERSFAYWRGQSAARLLARDPAVLAAGFAGASMIYLSGITLAILEPADRSQLLAALSAARAAGSAVAFDPNLRPRLWPDAATMCAAIMEAARHADIVLPSHEDEAAFFGDEDAAATAARYAAAGAALVVVKDGAGPMVTLTPEGQQSHAPETVSQVVDTTAAGDSFNAGFLAAHIAGAPLAEAVRAGARLAARVIGQRGALV

SEQ ID NO: 8031 - protein, 239 aa, Rhodobacter sphaeroides
SFSLEGQRALVTGANTGIGQAIAVGLAGAGAEVIAAGRSSCAETVAMTGGRELRLDFADPMAARDVFEAERIDILVNNAGIIRRADAVEFTEEDWDAVMDVNLKALFFTCQAFGRAALARGTGGRIVNIASLLSFQGGIRVPSYTAAKHGVAGITKLLANEWAGRGINVNAIAPGYIETNNTEALRADEARNRAILERIPAGRWGKADDIAGAAVFLASPAAAYVHGAILNVDGGWLAR

SEQ ID NO: 8032 - protein, 406 aa, Rhodobacter sphaeroides
  unsure (1)..(406): unsure at all Xaa locations
MSKIKVANPVVELDGDEMTRIIWDFIKQKLILPYLDIDLHYYDLGIEERDRTEDKITVDAAHAIKQHGVGVKCATITPDEARVEEFGLKSMWKSPNGTIRNILGGVIFRQPIICRNVPRLVPGWTKPIVVGRHAFGDQYRATDFRFPGKGKLTLKFVGEDGAVIEREVFDAPGSGVTMAMYNLDQSIIDFARASMNYGLNLGWPVYLSTKNTILKAYDGRFKDLFQQVYEEEFAEKFKAAGITYEHRLIDDMVASALKWSGGYVWACKNYDGDVQSDTVAQGFGSLGLMTSVLMTPDGQTVEAEAAHGTVTRHFRQHQAGKETSTNSIASIYAWTGGLKHRAKLDGNADLARFAETLERVTVQTVEDGFMTKDLALLVGPDQKWLTTIGYLEKVDEYLDRALGAXA

SEQ ID NO: 8033 - protein, 217 aa, Rhodobacter sphaeroides
MIELRNVSKSYVLNGTRKVVARDLNFTFPSGESVGLLGRNGAGKSSLLRMLAGTMLPDTGEILSSGTISWPVGFSGSFHPELTGAQNVRFVARLYGVDTEAMIAFVRDFAEIGQHFHLPVRSYSSGMRSRLAFGISMAVPFDTYLIDEVTAVGDAAFSAKSNAILRARLEESGAVIVSHSMPLLKKLCRSGAVLHDGQLFYYERIEQAIRHHESMMR

SEQ ID NO: 8034 - protein, 289 aa, Rhodobacter sphaeroides
MSVRKGIILAGGSGTRLYPLTIGVSKQLMPVYDKPMIYYPLSVLMLAGIREIAIITTPQDQEQFRRALGTGAQWGISLTYLVQPRPEGLAQAYTIAEEFLAGSPSCMVLGDNIFFGHGLPDLLALADAKTEGGTVFGYHVADPERYGVVAMDERGRVTQIVEKPKVAPSNYAVTGIYFLDARAPDLVHGIRPSERGELEIVSLLEIYLEEGLLDVQRMGRGFAWLDTGTHASLLDAGNFVRTLQLRQGMQTGCPEEIAFARGWVDAEALTGMAAQLSKNDYGRYLQGLL

SEQ ID NO: 8035 - protein, 700 aa, Rhodobacter sphaeroides
  unsure (1)..(700): unsure at all Xaa locations
STLRAVFLVAAHHGVLLGPDELPPLETGDFAPDLLRLLGGKGLRCRLLADAGWRTASRLGQAYPALAELRGGHWAVLVHAGGAEGARTVALLDPRNEAQGVQPLPWEDFARDWTGRLILIGRPDRPRAAETAFGLRWFLPALAREKGLFLGVAVAVVIGNLISYALPLLMQAMIDRVIAYRAWNTLAAVAAVFVLLALFDAGFGYVRQRLSQIAGGRIDAHLGAESVAHLLSLPMTLFETTPAGVLARNIQQTDRIRQFLTGRLLQTLLDAALLPVLFATLAFLSGRLALVIAAYGIAIAGCIALMLPLLQRRLNAVYAVEAERQALLVETLHNMRAVKSLAVEPARGALWEESLALSVRRQWDLGRVSAVTSTLTSLLERLMRXAWWPSAWRWRSRARSTVGTLVAVLMLAGRVSGPLVQIVGLVNEWQEAALSIGMLRRIMDHPPERPDTAALARPALTGALEIRGVSFAYPGAATPALDQVSLAIEPGQVIGIVGRSGSGKTTLTRLIQGIETPQAGLILFDGIDIRSIALGPLRRQVGIVLQDNLLFRGTLRENIALARPEAGLEAVVRAAALAGADEFIRRLPRGFDTPVEEGGANLSGGQRQRVAIARALLTDPRILILDEATSALDPESEAVVNRNLAAIARGRTMIVVSHRLSSLVRADRIAVLDQGRLVAFAPHEALLAGCEIYAHLWRQQ

SEQ ID NO: 8036 - protein, 241 aa, Rhodobacter sphaeroides
IDLAGRVAVVTGGAQGIGRAVAERLIASGARVCLWDRDAGRAAATAAELGGNSFFQVVDQVDFTAVKAAADATEATGGRIDILIANAGIAGSNAPVADYPVEEWHRIIDINLNGVFHCCKAVVPGMKAHGYGRIVTVASIAGKEGNPNAAAYSASKAGVIALTKSLGKEVAGQDIAVNCVTPAAARTQIFDQMAQSHIDYMLSRIPRGRFLDLDEAAAMIAWLASAENSFTTGAVFDLSGG

SEQ ID NO: 8037 - protein, 236 aa, Rhodobacter sphaeroides
DMQEKTVLITAAGQGIGRACAERFLAAGARVLASDRDARLLDGLAAECHALDVRDGAAVEALVAGLGPVDVLVNCAGVVHGGTILDQTEAELDLALDINLRGTIRTIRAVLPGMLAAGSGSIVNIASVVSSLKGAPDRCVYGTSKAAVIGLTKSVAADFVSRGIRCNAICPGTVESPSLRERLGATGDAEAARAAFVARQPMGRLGTPEEIADLALWLACSGYTTGQAIAIDGGWT

SEQ ID NO: 8038 - protein, 777 aa, Rhodobacter sphaeroides
LTATLTAIVLALAGLGLLIPGAWLAVLGGSWFYLVAGALMLLTAWQVFRRSSSAEWIYGGLILGALVWSVWEVGFDWWELIPRGGIIALLGIWLYLPFMRRQLLTEDGRPAPGLPLALPLLAAIGAAIWSWTGDEAGHAGSLPTEVVSAEPDLGPSAPPGEWHQYGRTQYGQRYSPLEQINIQNVAELEQVWQYQTGDVKLPQDVTETTYQVTPLKVADRLYICTPHDLAIALDAATGKEAWRFDARSGLESDRQHQTCRGVTYWRDPARAEGELCAERVYLPTADARLIALDAKSGAVCTFFADEGTLHLENGMPYTPAGFYYSTSPPVAVGGRIIIGGAVNDNFSVYSQSGVIRAFDANTGALLWNWDSANPDKTAPIDWMNGETYTANSPNSWSVFSVDEERGLVYIPLGNQVPDQLGFNRSPAVEEHSSSVVALDVATGQKAWVFQTVHHDLWDMDVPAQPVLIDLDIDGQTVPALVQPTKQGDIYVLNRETGEPILPVTEEPAPQEGALREETPAPTQPTSALSFKPEALREKDMWGVTLYDQLACRIQYHRLNYEGRYTPPSLNGTIVYPGNFGTFNWGSVAVDPERQVMFGMPTYLPFTSQLVPAEDIPPPGADQKASEQGLNRNEGAPYGVIMGPFLGPLGVPCSAPPWGFVAGADLRTGEIAYMHRNGTVRDMTPLPLPFKVGVPGIGGPIVTRGGVAFLGAAVDDYLRAYDVTTGDQLWQARLPAGGQSTPMTYEQDGRQFVVIVAGGHGSVGTKPGDYVIAYALPD

SEQ ID NO: 8039 - protein, 510 aa, Rhodobacter sphaeroides
DLFIIGGGINGCGIARDAAGRGLSVTLAEMGDLAQATSSASTKLFHGGLRYLEYFEFRLVREALEERETLLVAMPHISWPMRFVLPWQPEMRFAGDTPTARLLGRLMPWARGRRPAWLIRLALETYDRLGGRKILPPARSVDLTRDPAGRALQPRFTKGWEYSDCWVEDSRLVVLNARDAEIRGATILTRTKVVGAERRGDLWHVTTEGARGRQVHRARALVNAGGPWVARIIRETLALPTTEGVRLVRGSHIVTKRLFDHDRCYFFQGTDGRIIFAIPYETDFTLIGTTDQDHRGAPDEARCTPEEQDYLCTFASDYFRKPVTREDIVWTYSGVRPLHDDGARSATAATRDYVLSLDSRGAPLLNVFGGKITTYRRLAESAMAKLAGHFPQARGAWTARVPLPGGDFPWDGAPALAEGLRRDYPFLTERWAMRLVRAYGTDARNLLGPARSALDLGRDFGATLTEAEVRWLMDREYAERAEDVVWRRSKLGLRLTPEEIAALDGWMKDA

SEQ ID NO: 8040 - protein, 318 aa, Rhodobacter sphaeroides
  unsure (1)..(318): unsure at all Xaa locations
ALKEMDHVWQDGGAYALLGASGCGKTTLLNIISGLLRPSQGRVLFGETDVTDAPTAARNIAQVFQFPVVYDTMTVRENLAFPLRNRGRDAAYIAARVEQIAAMIGMEAMLSSKARGLTADAKQKISLGRGMVREDVNAILFDEPLTVIDPHMKWELRTQLKQLHREFGHTMIYVTHDQTEALTFADKVVVMHEGRVVXTGTPEELFETPEHTFVGYFIGSPGMNLFEAEVEGPMARVMGHPVPLSESYPATRGRVQIGIRPEFVQLADEGLPVVITRVEDVGRHRILRGEPSASPXTCFCPRRSPPPRGPPSCGSRPR

SEQ ID NO: 8041 - protein, 482 aa, Rhodobacter sphaeroides
MNHILAIDQGTTSSRAMVFDEALTLKSVAQEEFPQIYPRPGWVEHDPSDLWSSVAATARAAVERAEIDGSLAAIGITNQRETVVVWERASGHPIHNAIVWQDRRTADLCHALAEAGHEPTITERTGLLLDPYFSATKLKWLLDHVEGARARARRGELLFGTVDSYLIWKLTGGRAHVTDATNAARTMLFDIGRGIWDPEICGLLDIPMEMLPEVRDCAAPFGMTRADLFGREIPILGVAGDQQAATCGQACFRPGMMKSTYGTGCFALLNTGEERVTSRARLLTTIAYQLGGKRTYALEGSIFIAGAVVQWLRDGLKIIREAGETQGLALSSDAAQDLVIVPAFTGLGAPWWKPESRGAVFGLTRNSGPAEFARAALESVGYQTRDLLEAMRADWAAGAEGVLRVDGGMAASDWSLQFLADIIGAPVDRPVVRETTALGVAWLAGMQAGLCPGPEEFAADWALERRFEPQMEASVREAKYDR

SEQ ID NO: 8042 - protein, 259 aa, Rhodobacter sphaeroides
LPMKIATFNINGVKARLEALLAWLEAAEPDVVLLQEIKSVDEGFPRAAFEDKGWHLETHGQKGFNGVAILSRLPLEDVVRGLPGDPEDVQARWIEATVVGERAVRVCGLYLPNGNPAPGPKYDYKLGWMERMKARAAELLATEEPVVLAGDYNVIPQAEDAARPEVWVTDALFLPESRAAFRRIVNLGYTEAFRARTFGPGHYSFWDYQAGAWEKNNGIRIDHLLLSPQAADLMTDVRIDREVRSGEKPSDHVPVWVEL

SEQ ID NO: 8043 - protein, 300 aa, Rhodobacter sphaeroides
LIGAPIDSGQRRPGCLMGPAAYRVAGLGRALADLGHAVEDRGDVALGPLPEMTPPEGPVHDLPETIGWTAALKTAVEEALGDGFPIVMGGDHSLALGTVAGAAAHAAAVGRPLFLLWLDAHSDFHTLQTTTSGNLHGVPVAYAAGRDGFDGFPPFPAPLPPERICLFGIRSVDPEEHAALLLHDVSIIDMRVIDEFGICAPMREFLEKVRAANGMLHVSLDVDFVDPAHAPAVGTTVPGGATVREAHLVMELLHESGLVTSLDLVELNPFLDERGRTARLMVELAASIMGRKVFDRPTRS

SEQ ID NO: 8044 - protein, 266 aa, Rhodobacter sphaeroides
FAPSPTGPLHLGHAFSALTVWQRAAGGTALLRIEDIDRSRCRPEWEAQIFNDLHWLGLAWPEPVLRQSDRGGAYRAALDRLTAMELTYPCRCSRADIRAALAAPQEGVPVGPDGIVYPGTCRGRPMAEAGPDDAIRLDMARAEEHAGGLRFHETGPEAEGWHAPQNLARSVGDVMLARRGFGTSYHLAVVVDDAAQGVTEVVRGADLFEATAIHVLLQRLLGLPVPDFHHHRLIRDAAGKRLAKRDDSKALGKYRAEGLSPAEVRA

SEQ ID NO: 8045 - protein, 323 aa, Rhodobacter sphaeroides
MTIRAVVRGVGHYLPDRVVPNSELEAIVETTDEWIRTRSGIERRHFAAEGQTTSDLAARAARAALEDAGLQPDDIDTLIVATSTADLTFPSAATMVQAALGMTRGFAFDVQAVCAGFVYALANADALIRSGQAQRVLVIGAETFSRLMDWNDRATCVLFGDGAGAVVLEGTESAGTSADRGILATDLHSDGRFKDLLYVDGGSSTGTTGHLRMQGREVFRHAVEKLAETAHTALEKAGLGAGDVDWIVPHQANLRIISATAQRMQVPMDRVILTVQDHGNTSAASIPLALSVGKARGQIKEGDLLVTEAIGGGLAWGSVVLRW

SEQ ID NO: 8046 - protein, 623 aa, Rhodobacter sphaeroides
  unsure (1)..(623): unsure at all Xaa locations
ISRNQHREEPMKMLKTGLVATLLLSSAPVFANDSVLKATDDPKQWAIQTGDYANTRYSELNQITRENVGKLQVAWTFSTGVLRGHEGSPLVVDGIMYVHTPFPNNVYALDLANDGKILWRYEPQQNPDVIGVMCCDTVNRGVAYADGMIFLHQADTTVVALDAKSGEVKWTVQNGDPAKGETNTATVLPVKDKLLVGISGGEFGVRGHVTAYDMKTGKQVWRAYSTGPDAEMLVDPEKTMVLGKPVGADSSIKSWEGDQWQIGGGTTWGWYSYDPDLNLVYYGTGNPSTWNPSQRPGDNKWSMTIMARDADTGMAKWMYQKTPHDEWDYDGVNENILVDQEIDGQMRKLLVNLDRNGFGYTLDRETGELLVAKKYDPAVNWATEVVMDKESDQYGRPQVVAEYSTAQNGEDTNTTGVCPAALGSKDQQPASFSPKTGLVYVPTNHVCMDYEPYRVSYSAGQPYVGATLSMYPAPNSHGGMGNFIAWDATKGEIKWSLPEQFSVWSGALATAGDVVFYGTLEGYLKAVDAETGELLYRFKTPSGVIGNVMTYEFNGKQYVGVLSGVGGWAGIGLAAGLTNPNEGLGAVGGYAALSDYTQLGGQLTVFALPDXARSXPCRSPRAP

SEQ ID NO: 8047 - protein, 376 aa, Rhodobacter sphaeroides
MRTRAAVAVEAGKPLEIMEVNLEGPKAGEVMVEIKATGICHTDEFTLSGADPEGMFPAILGHEGAGVVVEVGPGVTSVKPGDHVIPLYTPECRQCPSCLSQKTNLCTAIRGTQGQGLMPDGTSRFSMLDGTPILHYMGCSTFSNYTVLPEIAVAKVRPDAPFDKICYIGCGVTTGIGAVINTAKVEIGAKAVVFGLGGIGLNVIQGLKLAGADMIIGVDLNNAKKEWGERFGMTHFVNPSEIDGDVVAHLVNMTKTPFDQIGGADYTFDCTGNVKVMRQALEACHRGWGQSIVIGVAPAGAEIQTRPFQLVTGRVWKGSAFGGARGRTDVPKIVDWYMEGKIQIDPMITHILSLEEINKGFDLMHAGESIRSVVVF

SEQ ID NO: 8048 - protein, 404 aa, Rhodobacter sphaeroides
MRIAVLGGDGFVGWPTALHLSDLGHEIHIVDNLSRRWIDTELGVQSLTPMDSIQERCRIWHQETGQRLHFHLLDLREYDRIRAWLAEYRPEAIIHFAEQRAAPYSMKSDRHKVYTVNNNVNATHNLLAAMVETGIDAHLVHLGTMGVYGYSTVGAPIPEGYLDVSVETPAGPKELEILYPTRPGSVYHMTKSLDQILFQYYAQNDGLRITDLHQGIVWGTHTNQTRRHPQLINRFDYDGDYGTVLNRFLIQSAIGYPLTVHGTGGQTRAFIHIQDSVRCVELALSDAPKAGERVKIFNQMTETHRVRDLAELVAKMTGAKVSFLPNPRKEADENELVVRNDQFLALGLKPITLQEGLLGEVVDVAKKFAHRIDRSRVPCVSAWTKDIAQRVEHDPEGRRLRSVS

SEQ ID NO: 8049 - protein, 277 aa, Rhodobacter sphaeroides
QKVTTAIFPIAGMGTRFLPATKSIPKEILTLVDKPLIQYAVEEAREAGIEDFIFVTSRGKGALEDFFDVNQTLERALRAAGKTELLATLEATNIDSGHVTYVRQHEALGLGHAVWCARRLVGDEPFAVILPDDMVVADKPCLAQMIEAHEEVGGSIIATMEVPAEKASSYGVLDIEERQGALIRPRGIVEKPKAGTAPSNMAVIGRYILGPRVMQHLDRRTVGAGGEIQLTDAIAHELATHPGSVHGFRFQGERFDCGSKAGFLQATVALALEREDL

SEQ ID NO: 8050 - protein, 602 aa, Rhodobacter sphaeroides
  unsure (1)..(602): unsure at all Xaa locations
LGNVTEGISILLLLPILTLAGRGAPDYAIDLGGRHVMGYALPDVSVGLEFLLGAIVVLVALQAAFNRVKAVYLSDLLQDFANGTRAGLFSAVASARWETVVRMRRADLEHALTGEIDRITFSGFVSLNLMQIVVGLAIYFVLCLAVSVPMTLFAFGFGLIALLLLKPYRKLAERFGQKIQSARTVQARLVSEFISGLKTARSMNQEPMHVAQFERTLDATKADAHDYARRNALGNGLFQVALAIGAAGFVLLSLRIAGLEMSQMLVLLVILMRVTPRFQGVQAQVQALLVDLPAWWRVADLQQRLEANREGGRGFASAPVPVPRQEILLDRVTYRHKEGSEEAALSDCTIRLPVGQATALIGASGAGKSTVADIVMGLIRPEAGRFLVDGRELSEAERRGWREHLAYVPQETFLLHDTIRANLAIVAPGATEAEMREALADAAADRFVAALPEGLDTRVGDRGTLLSGGERQRIALARAFLRRPAVLILDEATSALDWESQSRVAEALARRAGSMTVLTIAHRPSMVAFADRVYTLEAGRVVEEGAMADLMRNGEGHLARMFAHEASEPGRRRLAQGAXASAVTGRCGTCSLRSYSGIASLL

SEQ ID NO: 8051 - protein, 223 aa, Rhodobacter sphaeroides
PAGRAGGAHRMTAEADGEDPAERKMRFLFAVRSRGVTDARVLAAMERIDRGAFVRGIFADRAYEDMPLPIACGQTISQPSVVGLMSQALAVNPRDKVLEVGTGSGYQAAVLSQLARRVYTVDRHRRLVREATEVFHRLSLTNITALIADGSFGLPEQAPFDRILVTAAAEDPPGPLLAQLKIGGIMVVPVGQTDAVQNLIKVTRLEQGYDYEELRPVRFVPLV

SEQ ID NO: 8052 - protein, 253 aa, Rhodobacter sphaeroides
MDLGIRGRRALVCASSKGLGLGCAAALAEAGVDLMMNARGAEALEAAAEDLRQRFGANVTTVAADIVSEEGRARVLEAAGAVDILVTNAGGPPPGLWSDWTRDDFIRALDANMLTPIALMTALLPAMIESGWGRVVNITSQSVRAPIPALGLSNSARTGLTGYVAGTSRQVAQHGVCINNLLPGIHDTDRAEALDRNAMKAQGITREEARAQRAASIPTRHYGRAEDFGAACAFLCSEHARFIVGQNLLVDGG

SEQ ID NO: 8053 - protein, 386 aa, Rhodobacter sphaeroides
WEDPFRMELQLSEEERMLRDGARAYAQERLMPRVTAAYREEQTDPAIFREMGEMGLLGATVPEEYGGLGASYVSYGLIAREIERVDSGYRSMMSVQSSLVMYPIYAYGSEDQRRRYLPGLAKGELIGCFGLTEPDAGSDTAGMKTVARKTAQGYVLSGSKMWISNAPIADVFVVWAKSEAHGGKIRGFVLEKGMKGLSAPKIGGKLSLRASITGEIVMEGVEVGEEALLPGVEGLKGPFGCLNRARYGISWGVLGAAEACLHAARQYGLDRRQFGRPLAQTQLYQLKLANMMTDIALGAQASLRVGRLLDEANAAPEMISIVKRSNCGKALEAARHARDMHGGNGIQEEFHVMRHMANLETVNTYEGTHDVHALILGRAITGLQAF

SEQ ID NO: 8054 - protein, 480 aa, Rhodobacter sphaeroides
AATGGSLSVLSPIDGAEIGRVRPTDPAAMPGLIARAQEAFRHWREVPAPRRGELVRLFGEELRAAKAELGALVTLEAGKITSEGLGEVQEMIDICDFAVGLSRQLYGLTIASERPGHRMMETWHPMGPCAVISAFNFPVAVWSWNAALALVCGNPVIWKPSEKTPLTALASMAIFGRALARFGDAPEGLAQLVMGGPEIGEALVLSPEVPIVSATGSTRMGRIVGPKVAARFGRPILELGGNNAMIVAPSADLDMAVRAIVFSAVGTAGQRCTSLRRLIVHHSVREELVGRLVKAYASLKIGDPRADGTLVGPLIDAASRDRMVAALDRARAKGGTVHGGKPVEGVPGGAYIQPALVEMPAQTGVVCEETFAPILYVMGYETLDEAIALQNAVPQGLSSCIFTLNLREAEAFVSAAGSDCGIANVNIGPSGAEIGGAFGGEKDTGGGRESGSDAWRGYMRRQTNTINWSAALPLAQGVRF

SEQ ID NO: 8055 - protein, 320 aa, Rhodobacter sphaeroides
ELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTIFAIWPAAATAEASFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 8056 - protein, 356 aa, Rhodobacter sphaeroides
MALITLRQLLDHAAERGYGVPAFNINNMEQGLAILAAARACDAPVILQASRGARSYAGDIMLRHIVEALAEMYPQIPICLHQDHGNNEATCLSAIRHGFTSVMMDGSLQADMKTVASYDYNVDITRRVTDAAHWVGASVEGELGVLGSLEKGEAEAEDGSGAEGKLDHSQMLTDPDQAVEFVQATRVDALAIAMGTSHGAYKFSRKPDGEILAMRVIEEIHARLPATHLVMHGSSSVPQALQDLINAHGGDMPQTYGVPVEEIERGIRHGVRKVNIDTDCRMALTGQFRKVAMESPKEFDPRKFMIPAMKEMEALVRDRFERFGTAGNASKITVIPMDDMAKRYASGALDPAVATA

SEQ ID NO: 8057 - protein, 230 aa, Rhodobacter sphaeroides
MIEAILFDVDGTLAETEELHRRAFNETFAALGVDWFWDREEYRELLTTTGGKERIARFLRHQKGDPAPLPIADIHRAKTERFVALMAEGEIALRPGIADLIAEAKRAGIRLAVATTTSLPNVEALCRACFGHPAREIFDVIAAGDMVAEKKPSPDIYRLALRELDVPPERAVALEDSLNGLRAAKGAGLRCIVSPGFYTRHEEFAGADRLLDSFAELGGLAGLDLTAPVA

SEQ ID NO: 8058 - protein, 273 aa, Rhodobacter sphaeroides
  unsure (1)..(273): unsure at all Xaa locations
LAGVIGSPIAHSRSPALHGYWLKRYGLKGHYIPMDVAQADLRDVLAAMPRMGFVGCNVTIPHKESVIGLADIVTDRAALIGAANTLIFGKDGKIHADNTDGTGFTANLRQNAPAWQPQSGPAVVWGAGGAARAVIAALIEVGVPEIRLANRSRARADALRSDFGAKVHVHDWVQAGNILEDAMTVVNTTSLGMVGKPEFRVPLDALNPKAVVTDLVYAPLRTRLLVEAEAAGCRTVDGLGMLLHQAAPGFERWFGVRPEVDEETRAAVLATXG

SEQ ID NO: 8059 - protein, 871 aa, Rhodobacter sphaeroides
DTVTPMMAQYLEIKAQNPGAILFYRMGDFYEMFFDDAALAAEALDIALTKRGKHRGEDIAMCGVPIHAAEGYLLTLIRKGFRVAIAEQMEDPAEAKKRGSKSVVRREVVRLVTPGTLTEDTLLEARRHNYLCAFAEIRDEAALAWADISTGELSVTACPLPRLMPELARLAPRELLVADERELDWIEEVGCALTPLSRASFDSASAEKRLCALFGVGTLESFGNFTRAELSAMGALVDYLDLTQRGKLPLLRPPVRETVGGTVQIDAATRRNLEITQALAGGRDGSLLSAVDRTVTAPGARLLERRLSSPTRDLGLIHERLGAVRWLTEEPRLREEMRASLRRVPDMDRALSRLALDRAGPRDMAAIRAGLAQAQEIAQRMPAEAPALVTRALEALGGHEALVDLLDQALVAEPPLLARDGGFIAQGFDADLDETRRLRDEGRGVIASMQAGFIEVTGIQSLKIKHNNVLGYFIEVTSTHAEKMLSAPLSERFIHRQTTAGQVRFTTVELSELETRILNAGNRALDLEKMHFAALRTAILDLAGQIGRAARSLAELDLISAFADLAVTEDWTEPEIDDSRAFAIEAGRHPVVERALRRTGTPFVANHCDLSTGETPAVWLITGPNMAGKSTFLRQNALIALLAQAGSFVPARRAHIGLVSQIFSRVGASDDLARGRSTFMVEMVETAAILNQADDRALVILDEIGRGTATWDGLSIAWATLEHLHDRNRCRALFATHYHEMTALAGKLKGVENATVAVKEWEGDVIFLHEVRRGAADRSYGVQVARLAGLPASVIERARTVLDALESGERESGGRRQTLIDDLPLFRAAPPPPAPAAPKTSPVEERLREIQPDDLSPREALKLLYDLRALL

SEQ ID NO: 8060 - protein, 394 aa, Rhodobacter sphaeroides
KKVVLAYSGGLDTSIILKWLQTEYGCEVVTFTADLGQGEELEPAREKAVMLGIKPENIFIEDVREEFVRDFVFPMFRANALYEGLYLLGTSIARPLIAKRLVEIAAQTGADAVAHGATGKGNDQVRFELTAYALDPAIKVIAPWREWDLTSRTKLLEFAEQNQIPIAKNKRGEAPFSVDANLLHTSSEGRVLENPGEEAPDYVYQRTVDPEKAPDAPEFVEIAFEKGDAVAINGEAMSPATILTKLNELGGKHGVGRLDLVENRFVGMKSRGIYETPGGTILLEAHRGIEQITLDSGAGHLKDSIMPRYAELIYNGFWYSPEREMLQALIDKSQEHVTGTVRVKLYKGFARTVARWSEHSLYSEKHVTFEEDAGAYDQKDAAGFIRLNALRLKL

SEQ ID NO: 8061 - protein, 614 aa, Rhodobacter sphaeroides
RPPMFRFFENLVDPYAPWDRTDTPPRRLWPFLKDYVRPFRKVFAITGLMSVLNASVEVLLIWYVGRLVDLLAEGAPQEVWASHGSEILAVALAILLIRPLVAGVDVALLHNTILPNFGTLIRWRAHNHVLRQPVGWFESDFAGRIANRIMQTPPAAGDAVFQTFDAGAFAITTVIGAVAVLADADPRLTLPLILWFALYALLVRWTIRHAGPAAKASSDARSAVTGRVVDAYTNIHSVKLFAHHDRELSYAREAIETARTTFQREMRIITRMDVALTLLNGALITSVTGWAILLWYQGQASVGIVAASTALVLRLNNMTYWIMWATSSLVQALGVVAEGMETIAQPIGLVDKPGARPLRLTQGGIALDQVSHHYGRGSGGLDRVTLAIAPGEKVGIVGRSGAGKSTLVKLMLRFYDPERGRILIDGQDVTEVTQESLRRAIGMVQQDSSLLHRSVRDNILYGRPDASEEEMILAAKRAEAHDFILTLEDPEGRRGYDAHVGERGVKLSGGQRQRIVLARVMLKDAPILILDEATSALDSEVEAAIQETLYRVMEGKTVIAIAHRLSTIAAMDRIVVLEEGRVAEIGSHAELLARGGLYARFWTRQSGGFIGTED

SEQ ID NO: 8062 - protein, 342 aa, Rhodobacter sphaeroides
LAHAPADHPELPQPKIGILLANLGTPDNYDYWSMRRYLNEFLSDKRVIDYPAWKWQPLLQILILSKRPFSSGANYKLIWNHDKGESPLMTITKDQTAAIAAEIRSLYGNRVMVDFCMRYGNPSTESRVRAMVEAGCEKILFFPLYPHYAGATSATANDEFFRAMMKEKRQPAVRTVPEYYDNPLYIDALAQSVERAYAQLDHRPDVLVASYHGMPKRYLMAGDPYHCQCAKTSRLLRERLGWEKGAIDTTFQSVFGPEEWLKPYTVEHVAELARAGKKRIAVIAPAFSADCIETLEEINGEIREAFEEAGGEEFTYIPCLNDDEAHIRALVSVIEDNLAGWL

SEQ ID NO: 8063 - protein, 468 aa, Rhodobacter sphaeroides
MYIGLDLGTSGLKGILIDEEQRVLAEAVAPLAVSRPHKGWSEQSPADWIAAAEAVMDQLAAHGLSDVKGIGLSGQMHGATLLDASDEVLRPCILWNDTRSHAEAAALDADPRFRAVTGNIVFPGFTAPKLVWVERHEPAIRERVAKVLLPKDYLRLWLTGEHVAEMSDAAGTSWLDVGARDWSDALLAATGLTRDAMPRLVEGSAVSGALRPALAARWGLPQGVAVAGGGGDNAASAVGVGVVRAGEAFVSLGTSGVLFAANDGYQPAPETAVHTFCHALPGAWHQMGVILAATDALNWYARLVGQEASALTKELGGLQAPGRTLFLPYLGGERTPLNDAAIRGAFTGLEHATDRAAGTRAVLEGVTFAIRDCRDALAATGTRLESLIAVGGGSRSDYWLSAIATALDVPVLLPAAGDFGGAFGAARLALMAATGAGAEIATLPPIARTLSPDRGLTAAFDDAHARHR

SEQ ID NO: 8064 - protein, 636 aa, Rhodobacter sphaeroides
MAKVIGIDLGTTNSCVAIMDGAQPRVIENSEGARTTPSIVGFTDSERLVGQPAKRQAVTNPSNTVFAVKRLIGRRVGDAEVEKDKKLVPYSIVNGGNGDAWVEVRGEKYSPSQISAFILQKMKETAEAYLGESVTQAVITVPAYFNDAQRQATKDAGKIAGLEVLRIINEPTAAALAYGLDKKDTKTIAVYDLGGGTFDITILEIDDGLFEVKSTNGDTFLGGEDFDMRIVNYLADEFKKEHGVDLTLDKMALQRLKEAAEKAKIELSSSQQTEINQPFISMDRNTGQPLHMVMKLTRAKLESLVGDLIKKSLKPCEAALKDAGVSKSDIDEVVLVGGMTRMPRVVEEVTKFFGKEPHKGVNPDEVVALGAAIQAGVLQGDVKDVVLLDVTPLSLGIETLGGVFTRLIDRNTTIPTKKSQVFSTAEDNQNAVTIRVFQGEREMAADNKLLGQFNLEDIPPAPRGMPQIEVTFDIDANGIVSVSAKDKGTGKSQNITIQASGGLSDEDIEKMVRDAEANAEADKKRRELVETKNQGESLLHSTRKSIEEHGDKVDPSTVEAIELAMGALEEALKSEDAGKIKGGIQNLTEAAMRLGEAIYKASQAEGGATPDEEGPRSVDDDIVDADFEDLGENKRK

SEQ ID NO: 8065 - protein, 382 aa, Rhodobacter sphaeroides
MAKRDYYEVLGVSRTASADELKKAYRTKAKELHPDRNADNPQAEAQFKEVNEAYDVLRDADKKAAYDRYGHAAFEGGMGGGARAGGGYGQQGDFASAFSDVFEDLFGDFMGGRGGAPRSRAQRGSDLRYNLRVTLDEAYRGVQKTINVPASVACDACKGTGAEGGAEAVTCPTCSGMGKVRAQQGFFTVERTCPTCNGMGQIVKNPCKVCHGAGRVEKERSLSVNIPAGVETGTRIRLAGEGEAGMRGGPSGDLYIFIEVREHALFQRDGVHLFCRVPVSIAAAALGGEVEVPTIDGGSSRVKIPAGSQTGKQMRLRGKGMPALRGGGAGDMLIELAVETPVNLTARQKELLREFEKLSEDNNPEGKSFFSKVKGFWDGMTG

SEQ ID NO: 8066 - protein, 396 aa, Rhodobacter sphaeroides
LPAIGGVEFSAVEAGVRYQNRKDVMLIRLAPGTAMAGVFTRSSTRAACVLDCQAKIGAASEAGAAIIVNSGNSNAFTGAVGVEAVEAVTRGVAEALGLPVERVFSSSTGVIGEPLPYERITAQIPALVEGLSGDAIEMAARAMMTTDTFPKGASATVEGEGGSIQIAGIAKGSGMIAPDMATMLVYIFTDAKIPQPLLQKMLSRQVEATFNAITVDSDTSTSDALLLAATGTSPAAELNGRSKAGRDFEAALGRVMLDLAQQVVRDGEGASKFVEVRVTGAASAEDAHKVAMAIANSPLVKTAIAGEDPNWGRIVMAVGKSGAAADRDKLSIRFGDILVAEKGWRSPDYREEDGAAYMKQAELVVAVDLGLGTDSRTVWTCDLTHRYIDINADYRS

SEQ ID NO: 8067 - protein, 835 aa, Rhodobacter sphaeroides
MSDTDGKKPLGLGGGSRSGQVKQSFSHGRTKSVLVETKRKRVVVPKPGASGSSTTTSSPSHLGDPAKRPAGISDAEMERRLAALRAAKLREVEDAKRRADEERQREEERQRRREELEAKEREERERAEALRQKAEDEERARREAEEAARRAEEAKRAPAPAAPQPAPAESRASAPPSAKPGLPPSRKEREREADRDRTTKKDDSRRSGKLTLNEALSGEGGRTRSLAAMKRKQEKARQKAMGFGHKAEKQVRDVQLPETILVQELANRMAERAADVVKALMKMGMMVTMNQSIDADTAELVIEEFGHRAVRVSDADVEHVIDTVEDKAEDLQPRPPIITIMGHVDHGKTSLLDAIRKTSVVSGEAGGITQHIGAYQVKTESGAVLTFLDTPGHAAFTSMRARGAQVTDIVVLVVAADDAVMPQTVEAIKHAKAAKVPMIVAINKIDKPDADPNKVRTDLLQHEVIVEKMSGDVLDVEVSAKTGLGLDELLENIALQAEILDLRANPSRQAQGAVIEAKLDVGRGPVATVLVQYGTLKRGDIFVVGQQWGKVRALINDKGERVDEAGPSVPVEVLGLNGTPEAGDVLNVVETEAQAREIADYREKAARDKRAAAGAATTLEQLMAKAKADADVAELPVVIKADVQGSAEAIVQALEKVGNDEVRVRVLHYGVGAITETDITLAEASQAAVIGFNVRANASARQAANQKSVEIRYYSVIYDLVDDVKKAASGLLKAEVREHFIGYAQIKEVFRITGVGNVAGCIVTEGVARRSAGVRLLRDNIVIHEGTLKTLKRFKDEVKEVQSGQECGMAFERYEDIRPGDVIEIFEREEVQRKL

SEQ ID NO: 8068 - protein, 254 aa, Rhodobacter sphaeroides
KAVFPVAGLGTRFLPATKSIPKEIMTLVDRPLIQYAIDEARAAGIKEFIFVTSRGKSALEDYFDNAPELEAALKKPGKEHLLDVLESTNMESGAIAYVPPAQGAGPWPAVWCARRLIGDEPFAVMLPDDVIAAEKPCLQQMVEAYEQTGGNMVAAMEVPPEKASAYGVLSVAEDMGSIVKVNGMVEKPKENPPSNLAVIGRYILTPQVLNNLNRKKEGAGGEIQLTDAIAEEIDESGKVYGFRFRGQRYDCGSK

SEQ ID NO: 8069 - protein, 397 aa, Rhodobacter sphaeroides
MAFLSDTLARVKPSQTIAVTNKARELAAAGRDVIGLGAGEPDFDTPDNIKAAAKRAIDAGRTKYTAVDGIPELKRAICEKFERENGLKYTPAQVTVGTGGKQILYNALVATLNPGDEVIIPAPYWVSYPDMVLLAGGTPVSVAAGMETGFKLTPEQLEAAITPRTKWFIFNSPSNPTGAAYTRAELAALCEVLMRHPQVWIMSDDMYEHLVFDDFDFTTPAQIEPGLYDRTLTCNGVSKAYCMTGWRIGYAAGPVELIRAMGTIQSQSTSNPCSIAQYAALEALSGPQEFLATNREAFQRRRDLVVSMLNEAKGVTCPNPEGAFYVYPDISGCIGKTSAGGAKITDDEAFASALLEETGVAVVFGAAFGLSPNFRISYATADEVLREACARIQAFCA

SEQ ID NO: 8070 - protein, 310 aa, Rhodobacter sphaeroides
MAAVNGLIRERMASKHAPRIPEVTAHLVEAGGKRLRPLLTLAAARLCGYEGPYHIHLAATVEFIHTATLLHDDVVDESHRRRGKPTANLLWDNKSSVLVGDYLFARSFQLMVETGSLRVMDILANASATISEGEVLQLTAAQDLRTTEDIYLQVVRGKTAALFAAATEVGGVVAGVPEAQVEALHAYGDALGIAFQIVDDLLDYGGVDAQIGKNTGDDFRERKLTLPVIKAVAQADAEERAFWQRVIEKGDQREGDLEQAHAIMSRHGAMEAARQDALRWVTVAREALGQLPEHPLREMLHDLADFVVER

SEQ ID NO: 8071 - protein, 240 aa, Rhodobacter sphaeroides
MSKVALVTGGSRGIGAAISVALKNAGYTVAANYAGNDEAARKFTEETGIKTYKWSVADYDACAAGIAQVEAELGPVAVLVNNAGITRDSMFHKMTRDQWKEVIDTNLSGLFNMTHPVWSGMRDRKFGRIINISSINGQKGQAGQANYSAAKAGDLGFTKALAQEGARAGITVNAICPGYIATEMVMAVPEKVRESIIAQIPTGRLGEPEEIARCVVFLASDDAGFVTGSTITANGGQYFV

SEQ ID NO: 8072 - protein, 391 aa, Rhodobacter sphaeroides
MTNVVIVSAARTAVGSFNGAFASTPAHDLGAAVIEAVVARAGIDKADVSETILGQVLTAGQGQNPARQAHIKAGLPQESAAWSINQVCGSGLRAVALAAQHVQLGDASIVVAGGQENMSLSPHVAHLRAGQKMGDLSFIDSMIKDGLWDAFNGYHMGQTAENVAAKWQISRDMQDEFAVASQNKAEAAQKAGRFADEIVPFVIKTRKGDVTVDADEYIRHGATLDAMAKLRPAFIKDGTVTAANASGINDGAAAVLVMSAEEAEKRGLSPLARIASYATAGLDPSIMGVGPIHASRKALEKAGWKVGDLDLVEANEAFAAQACAVNKDMGWDPSIVNVNGGAIAIGHPIGASGARVLNTLLFEMQRRNAKKGLATLCIGGGMGVAMCLERP

SEQ ID NO: 8073 - protein, 457 aa, Rhodobacter sphaeroides
YRAPLADFRFLLGHVVGLDQVAATERFAEATPETVEAILAEAGKLCEEVLAPLQRPGDLHPARLENGVVRTSPGYAEGYRAIADGGWVGIAASPEHGGMGLPMAVTTAVNEMMSSACLSLQLNPLLTQGQIEALEHHASDALKALYLPKLISGEWSGTMNLTEPQAGSDVGAVRTRAEPLEDGTYAITGQKIYITWADTDFNANVCHLVLARLPDGPQGTRGISLFLVPKFLPDAEGRPGPRNAVTVVSLEEKLGLHGSPTAVMDYDGAKGWLVGAPHKGMAAMFTMMNNARLGVGVQGVGVAEAATQAAVAYAMERRQGGPGGIIEHADVRRMLAVMKAETFSARAIALACAVALDMGRATGQPEWQARAALLTPIAKAYGTDVGIEVASMGVQVHGGTGFIEGTGAAQFLRDVRVTAIYEGTNGIQAMDLVGRKMMDGGEAAFRLLQEIEDAAET

SEQ ID NO: 8074 - protein, 419 aa, Rhodobacter sphaeroides
MDHFLYRNGSLHAEEVPLSDIAATVGTPFYCYSAATLERHYRLFTEALTPLPHLVCFAIKSLSNLAVLKLLGDLGAGMDVVSAGEYLRARAAGVPGDRIVFSGVGKTREEMRIALEGGIRQFNVESEPEMRALSEVASSMGLRAPIAVRVNPDVDARTHEKIATGKKENKFGIPIERASEVYAEAAALPGLEVMGIDVHIGSQLTELEPFEQAYLKVAELTGRLRAEGHEIRRLDLGGGLGIPYTRSNEAPPLPTDYGALIKRTVGHLGCEIEIEPGRLISGNSGVLVSRVIYVKNGEGRDFLILDAAMNDLVRPSMYGAHHDIVPLAEAAPGTESQPYDVVGPVCETGDTFAKARALPPMAEGDLVAFRSAGAYGAVMASEYNSRPLVPEVLVRGDHFAVIRARPTFDEMLGRDSIPE

SEQ ID NO: 8075 - protein, 454 aa, Rhodobacter sphaeroides
MWGGRFAAGPDAIMQAINASIGFDKRLYAQDIRGSRAHAAMLAAQGILTSRDAEAIGEGLLTVLSEIEAGGFPFRVELEDIHMNVEARLKELIGEPAGRLHTARSRNDQVAVDFRLWVRDQCDAAISGIEALMRAFLAQAEAGADWVMPGFTHLQTAQPVTWGHHMLAYVEMLARDRSRFVDARARMNECPLGAAALAGTGFPIDRHMTAAALGFDRPTANSLDSVSDRDFALEFLSASAICALHLSRFAEELVIWSSAQFRFVRLSDRWTTGSSIMPQKKNPDAAELLRAKMGRVLGAAVALFTVMKGLPLTYSKDMQEDKEQVFDAADTLMLGLAAMTGMVGDMQANRESLAAAAASGFSTATDLADWLVRELNLPFRDAHHVTGTLVARAEARGCDLPDLSLAEMQEVHPGIREDVFAVLGVENSVRSRTSYGGTAPDNVRAQAARWKELL

SEQ ID NO: 8076 - protein, 204 aa, Rhodobacter sphaeroides
MELDAVSRSYKRWAPIYDFSFGKVSESPRRRTAAHVNARGGRVLEVGVGTGLSLPLYSHRVAVTGIDFSHEMLARAREKVEEMGLEPVKELRQMDARELDFPDETFDTVVAMFLVSVVPEPERVVSEMARVCRKGGEVVIVNHFARDKGPLAAVEKALARFENTLGWHSDFAIERVTADPRLEVVEQTPMSPGGLFTFLRFQRR

SEQ ID NO: 8077 - protein, 423 aa, Rhodobacter sphaeroides
AGPAGGRLVLSLPTAHCAACMTTVEGGLEKLAGVRSARVNLTLRRVSVDAEPEVTAAQLVEALSRLGYEAHELDAGMLSATETDRQGRDLLMRLGVAGFSMMNVMLLSVAVWSGAEAATRDLFHWISAAIALPTVVFAGQPFFRNAWTALRAGRLGMDVPISLAIILASSISLFETFHSGHHAYFDAAVMLTFFLLAGRYLDHRTRAVARSAAEELAALEVPRAMLLRDGEEVTVPIAELAAGDLVRVRPGGRMPVDGVVAEGFSELDRSLLTGESLPVPAGPETVVSAGEVNLTGPLTVRVTAAGRDSSLHRMADLVAVAESAKTRYTSLAERASRLYSPLVHILSFTAFGVWMWITKGDVRTSINISAAVLIITCPCALGLAVPAVVTAASGRLFRKGLLIKDGTALERLAEVDTVVFDKT

SEQ ID NO: 8078 - protein, 255 aa, Rhodobacter sphaeroides
GKTAIVTGAAAGIGLAVARHFVDKGANVMFVDMDEERLADQIGEEARAEGPVRMFAGDLREKLTITNLLSATMDAFDRVDILVNASRQVALSDPLCPEEDAVETLLQQNMLTSLRLTQLTAKRMIARAEKSDEKPTQVGSIINLSSIAAIRTQPELLAYSISCAAVEQMTRSMAVALASKGIRVNAVSFGSVMSASLQTALKDSPAMRAQITERTPMKRIASPAEIVETVQFLASDAAAFMTGQVVTLDGGRSLI

SEQ ID NO: 8079 - protein, 282 aa, Rhodobacter sphaeroides
KARASEWFRELRNRILAAFEGLEDAATGGSPADAAPGRFEMTETSREAGGGGLMSVMRGGRVFEKVGVNVSTVHGTLASRAQQAMAARGVPGMAEDPRFWASGISLVAHMQNPHAPAVHMNTRMFWTPHAWWFGGGSDLNPCLDYPEDTKHFHATLRHACEAHGADYYPRFKAWADEYFFIPHRGRARGVGGIFFDDLNTDDWEADFAFTRAVGEAFLPAFVPLVERRMETPWTEADREAQLIHRGLYAEYNLVYDRGTKFGLETGHDANAVLMSLPPLAKW

SEQ ID NO: 8080 - protein, 339 aa, Rhodobacter sphaeroides
KTMLRALKGETLPTPPIWLMRQAGRYLPEYRATRAQAGDFLSLCYTPDLAAEVTLQPIRRYGFDAAILFADILLLPQALGADLWFETGEGPRMSTITDMAGVTALKGRDDIHETLAPVYETCRILARELPKETTFIGFAGMPWTVATYMIAGRGSKDQAAAHKLKDTDRPAFEALMDRVTEATIEYLAKQVEAGCEVVKLFDSWAGSLKGQDFEDFAVAPAKRIVSELKARFQGLPVIAFPREAGEGYIGFAEKTGADCVAIDNSVSPEWAAEKVQAGRTCVQGNLDPKYMVTGGEELVQATKRVVEAFRNGPHIFNLGHGITPEADPENVTLLVETIR

SEQ ID NO: 8081 - protein, 301 aa, Rhodobacter sphaeroides
LKIGTRGSPLALAQAYETRSRLSAAFSLPEEAFEIVVIKTTGDKVLDRPLKEIGGKGLFTREIEEALLSGGIDIAVHSMKDMPTLQPEGLILDTYLPREDTRDAFITFAEGGLADLPQGATVGSSSLRRRAQLLNKRPDLQVVEFRGNLQTRLKKLNDGVARGTFLAMAGLNRLKMNEVPRVPIESEEMLSAVAQGAIGIERRTDDPRAQEMLAAIHDVPTGHRLAAERSFLLKLDGSCETPIAGLAILEGDQLWLRGEILRPDGSESISGEIRGAIADAAALGSELASELLGRAPADFFS

SEQ ID NO: 8082 - protein, 633 aa, Rhodobacter sphaeroides
  unsure (1)..(633): unsure at all Xaa locations
NARNIAFWVVLFLLILALFNLFSGGQTTSSSRTISYSDFIARVDNGEVSSVTLDGERVMVRGKDGTQYVAIKPQGEEVTDRLINHGVEVRAEAQEQSGFFSLISLWLPFLVLIGIWIFFMNRMQGGGRGGAMGFGKSRAKLLTEKQGRVTFDDVAGIDEAKEELEEIVEFLRNPQKFSRLGGKIPKGALLVGPPGTGKTLLARAIAGEAGVPFFTISGSDFVEMFVGVGASRVRDMFEQAKKNAPCIVFIDEIDAVGRARGVGIGGGNDEREQTLNQLLVEMDGFEANEGVIIVAATNRKDVLDPALLRPGRFDRTIHVPNPDIKGREKILSVHARKVPLGPNVDLRLIARGTPGFSGADLMNLVNEAALLAARVGRRFVTMDDFENAKDKVMMGAERRSMVLTADQKEKTAYHEAGHAIVGLNLPKCDPVYKATIIPRGGALGMVVSLPEMDRLNMHKDEGKQKIAMTMAGKAAEIIKYGEEAVSSGPAGDIQQASALARAMVMRWGMSDVVGNIDYAEAHEGYQGNTAGFSVSAETKKMIEAEVKRLIDEGYQTAYRILTEKSEEFERLAKGLLEYETLTGDQIRRVIAGEPIDSDDDADRPVGGGSVAAIPKTRPKVIKADGGLEPSVXA

SEQ ID NO: 8083 - protein, 299 aa, Rhodobacter sphaeroides
MTAKRIDGKAFAAGVRARVAEEVARLKEGHGIVPGLAVVLVGEDPASQVYVGAKGKQTVEVGMASFEHRLPAGTSEAELLALIDRLNHDPAVHGILVQLPLPAHLNADLVINALDPAKDVDGFHISNVGRLGTGQKSMVPCTPLGCLMMLRDHLGALSGLNAVVVGRSNIVGKPMAQLLLGESCTVTIAHSRTRDLAAVCRGADILVAAVGRPEMITGDFVKPGATVIDVGINRIERDGKTKLVGDVDYASAAEVAGAITPVPGGVGPMTIACLLANTLTACCRANGLPEPQGLTPDAR

SEQ ID NO: 8084 - protein, 436 aa, Rhodobacter sphaeroides
  unsure (1)..(436): unsure at all Xaa locations
MKIAMIGTGYVGLVSGVCFSDFGHEVVCVDKDATKIAKLRDGKVPIFEPGLEALMARNVAAGRLSFTLDLAEAMRGADAVFIAVGTPTRRGDGHADLTYVMAAAEEIAHALDHYAVVVTKSTVPIGTNRKVAETIRAANPAADFDVASNPEFLREGAAIDDFMRPDRVVVGVETERAKKIMADIYRPLFLRDFPVVYTGLESAEMIKYAANAFLATKITFINEIAALCERVGADIKAVSKGMGLDGRIGNKFLHAGPGYGGSCFPKDTKALARMGQDHASPIQIVESVIKVNDEIKRRMIEKIEDLCEGSCRDKVIAVLGVTFKPNTDDMRDAPALTIVPALVGAGAKVRVVDPEGRREGEHLLPGVRWMEDAYSAAEGASVLVILTEWNEFRALDLQRLARGMADARMADLRNVYAPADARAAGFTHYVGVGRXD

SEQ ID NO: 8085 - protein, 325 aa, Rhodobacter sphaeroides
QRVLVTGGAGYIGSHACKVLKRAGFEPVTFDNLSTGWEQAVKFGPLARGDLMDRASIDAALETWKPVAVMHFAALSLVGESMRDPGTYWRVNVTGALNLLEATVAAGVKNFVFSSTCATYGDQDGVVLDEDTPQRPINAYGASKRAIEEMVANFGAAFGLNHTIFRYFNVAGADPEGEVGEQHDPETHLIPLMLDAVAGRRPALTVFGTDYPTRDGTCIRDYVHVMDLAQAHVLGLNRLLDGGPNRVFCLGTGRGFSVREVIEQSRAVTNREVPILFGDRRSGDAAALVCGSERAVRELGWEPELSTLPHMIADAWRWHRAPKFH

SEQ ID NO: 8086 - protein, 420 aa, Rhodobacter sphaeroides
MDSILVKGNGELRGQIPIAGAKNACLALMPATLLSDEPLTLTNAPRLSDIRTMTQLLQSLGAEVASLQGGQVLALSSHALTDHRADYDIVRKMRASILVLGPMLARDGHAVVSLPGGCAIGARPVDLHLKALEAMGAELDLRDGYIHAKAPAGGLKGARVVFPLVSVGATENALMAATLAKGTTVLENAAREPEIVDLARCLRRMGAQIEGEGSSIMTIQGVDRLGGATHPVVTDRIELGTYMLAPAICGGEVELLGGRIELVGAFCEKLDAAGISVEETERGLRVARRNGRVKAVDVMTEPFPGFPTDLQAQMMALLCTAEGTSVLEERIFENRFMHAPELIRMGARIEVHGGTATVTGVEKLRGAPVMATDLRASVSLILAGLAAEGETIVSRVYHLDRGYERVEEKLSACGAQIRRI

SEQ ID NO: 8087 - protein, 400 aa, Rhodobacter sphaeroides
VAGIIADVRARGDAAVIELTARFDRLELTPERLAFSEAEIEAEIATVSAEDRAALELAAERIRAYHARQMPENARWTDAAGAELGWRWGPIASAGLYVPGGLASYPSSVLMNAIPARVAGVERLVVACPTPGGVVNPLVLLAARLAGVDAVYRIGGAQAVAALAYGTETIRPVDKITGPGNAYVAAAKRRVFGRVGIDMIAGPSEILVIAEGAVDPDWIALDLLSQAEHDESAQSILVTPDEALGRAVVQAVEARLETLERRAIAGASWRDYGAVIVTRDLEEAAALSDRVAPEHLELCVADPEALAARIRHAGAIFLGGWTPEAIGDYVGGPNHVLPTARSARFSSGLSVMDFLKRTTLARMTPAALRAVGPAAERLAISESLEAHGLSVRARLDRLNE

SEQ ID NO: 8088 - protein, 262 aa, Rhodobacter sphaeroides
LHLEGKIALVTGSSKGIGAGIARGLARAGAVVMVHGRDREQATAVARQIRQDGGTAHVVTGDLTEEAEVDTLLAEVRAIGDIDILVNNAGGSGGNSDWATTKAGAWAATYDANVLAAMRIAKAVLPQMRHAGWGRIINISSLAALMPPAGNPDYSAAKAAMLAMSASMAKAVAADGVTVNTVSPGTIHSEKLDRKFREVAQQRGIAPEAPWEVVEAEALPLFASVPTGRVGTLDEIADAVAFLASPRASYITGSNLRLDGGM

SEQ ID NO: 8089 - protein, 499 aa, Rhodobacter sphaeroides
QPNILILMVDQLNGTLFPDGPADWLHAPNLKRLADRSLRFSNSYTASPLCAPARASFMSGQLPSRTRVYDNAAEFASDIPTFAHHLRRAGYQTTLSGKMHFVGPDQLHGFEARLTTDIYPADFGWTPDYRKPGERIDWWYHNLGSVTGAGVAEITNQLEYDDDVAHQAIQKLYDLSRGADPRPWCLTVSFTHPHDPFVARRKYWDLYEDHPMLEPPASIPYEAQDSHSRRLMDACDFKAFDITPEQVRRARQGYFANISYVDDKIGEILAVLEASRQEAIVVFVSDHGEMLGDRGLWFKMSFFEGSARVPLMIAAPGLPAGRIAAPVSTIDVTPTLCALAGIDMGEIAPWTDGISLVPLAEGELRPEPVFMEYAAEGSITPLVAIREGRWKYVRCLADPEQLFDIEADPGERTDLAADPAHADTLARLRSLSQARWDLAAFDAAVRESQARRWIVYEALRQGGYYPWDYQPLQKASERYMRNHMDLNILEESKRFPRGE

SEQ ID NO: 8090 - protein, 304 aa, Rhodobacter sphaeroides
LINDATLREGNQASGVRFSVHDSVAIATALDGIGVDMIEIGHPLAGPYEHQRTEAVAKLGLGAKIIAHARAHRTDIEAVSRTGATWVGIFLGVNDITTKARVIGRSTTELIRMVADAVKVAKDCGLNIRYSCEDASRTNTLFLVDVFGAAIDAGADRICYADTLGIAEPAEVARKVTLMKSEFPDAEVEVHLHDDRGLAMANSLAAIDAGVDSISVSVNALGERCGITDLATLLVNLGFRGERALPDISELRALSRLVAMSSNTPFDALRPIVGDNAFKHGSKLHQRATQYEPRAYDWIKEFIY

SEQ ID NO: 8091 - protein, 402 aa, Rhodobacter sphaeroides
SLVAPIYQTTAFELPEADEAAALFALEKLTPIYARTDNPTTRVLEERMRAVEQGEACICFATGKAAIVAAICAVTGAGDNIVASRNLFSGTMAMFSATLKNLGINVRFTEQDTAEAFEALSDERTKLWYAETLSNPLLKVFPIASVARRSHSLGIPLVIDNTLGVGLCQPLAFGAAVSVVSLSKYVAGDGSTMGGALSEGNFEWASARDRFTWLFQPDPAFAGVVWADLARKHRTTPYMLRLRFVMLRDFGATLSPLSAFLLSQATETLALRIQRHAESARRVATFLDGHPRVRSVCHPTIGTADEVRRNADTIPGGACGMVSVDIHGGQVAGQRFVAGLTLFRHVATAGSSASLAIHPYSTQLRQLTEDERRRTGVPEGFVRLSIGLEDPDMLIDDLQQSL

SEQ ID NO: 8092 - protein, 332 aa, Rhodobacter sphaeroides
RIAINGLGRMGKLLLRELIDRGMGDGIMLLNDAEGDPAQHALLMEFDSVHGRWTTPVTHDAESLTLAGHRIPLRRERRIEDLPLGELGVDLVVDCTGVFKTAAKIAPYFEAVKKVVVSAPVKDGGALNLVYGINHQLYDGSQRLVTAASCTTNCLAPVVKVIHERLGIRHGSITTIHDVTNTQTIVDRPAKNMRRARSALANLIPTSTGSATAIGLIYPELKGRLNGHAVRVPLLNASLTDCVFEVERPTTAEEVNALFAEAAAGPLKGILGYEERPLVSSDFLNDPRSAVVDAASTMVVGGTQVKIYAWYDNEWGYACRMADITRLVAESL

SEQ ID NO: 8093 - protein, 341 aa, Thermobifida fusca
DVTVSEPAPDEVLIRVAASGVCHTDRTMQQGANDLPLPLILGHEVAGIVERVGSAVTAVEPGDHVVTCASAFCGTCRWCMRGELQHCAHKRRSRDPGQPPRLSQGDTPVEPFVGLGGFAEQVLVYEGAVVKLPEEMPLDRAALLGCSVITGMGAVRNAAQVQSGQTVAVIGCGGVGLNVIQGARLCGAAQIIAIDRLADKLDLARQFGATHTIDASTTDPVEAVRELTGGGVDHAIEVVGIAATMEQAFRMLDTKGTATVVGVAHPEVQVSIRATDLLLEKRLQGSKMGSARPRIDIPFYCQLYLDGRLKLDELLTARVPLSEVNSALAALDNPLGARTVL

SEQ ID NO: 8094 - protein, 613 aa, Thermobifida fusca
MARAVGIDLGTTNSVVAVLEGGEPTVIANAEGARTTPSVVAFAKNGEVLVGEIAKRQAVTNVERTIRSVKRHMGTDWKTHIDGKDFTPQQISAFVLQKLKRDAEAYLGEEVTDAVITVPAYFSDAERQATKDAGKIAGLNVLRIINEPTSAALAYHLEKEGEATILVFDLGGGTFDVSLLDVGDGVVEVKATHGDNHLGGDDWDQAVVDWLVERFKSSNGIDLSKDKMAMQRLREAAEKAKIELSSSTETSINLPYITASAEGPLHLDEKLTRAEFQRLTSHLLERTKGPFFQVIKDAGISVDQIDHVVLVGGSTRMPAVVDLVRELTGGKEPNKGVNPDEVVAVGAALQAGVLKGDVKDVLLLDVTPLSLGIETKGGVFTKLIERNTAIPTKRSEIFTTAEDNQPSVQIQVYQGEREIAKYNKKLGVFDLTGIPPAPRGVPQIEVTFDIDANGIVNVTAKDLGTGKEQSVTITGGSALPKEDIERMIREAEEYAEQDRKRREEAETRNNAESLVYQTEKVISENEDKIPEDVKNETKEALDGLKKALEGSDIEAIRSASEKVALASQKIGSAIYSQSQQASGAAAGGQQNAEDAEVVDAEIVDEEPKREGNS

SEQ ID NO: 8095 - protein, 367 aa, Thermobifida fusca
MSTKDYLEKDYYKVLGVSKTATADEIRSAYRKLARKYHPDANKGDAQAEKKFKEISEAYSVLSDEKRRKEYDEARSLFGGAYRPGGGGIGDFNLGDLFGHTTTGGERLTDLFGGLFGGRGRATQSRRGADLETETTLSFTEAVSGTTKSFTLTTTVSCPTCRGSGAKPGTTPRVCPRCAGTGHESTNLGGFSLSEPCALCKGRGYLADDPCLTCSGTGNVKGTRTVQARIPPGVSDGQRIRLRGKGEPGERGGPAGDLFVTVRVTPHPVFGRSGDNLTLTLPVTFPEAVFGAEVRVPTLSGPPVTVRIPPGTRNGRVFRVRGKGATRRDGTTGDLLVTVEVAVPQNLNSEAREALQRFQAATADHNP

SEQ ID NO: 8096 - protein, 852 aa, Thermobifida fusca
TRKSQEALSAAIRRATADGNPQVEPVHLLSALIGQAEGVVRPLLKEVGADPGRLSTKVEEEIARLPRASGSTVNAPASSRQLIISLNTAAQRAKQMEDEYVSTEHLLVGLAADGGTAATLLREAGATPEALLDAFSRVRGSARVTSETPEDTYQALEKYGVDLTQRAREGKLDPVIGRDAEIRRVIQVLSRRTKNNPVLIGEPGVGKTAVVEGLAQRIVAGDVPESLRDKRLISLDLPAMVAGAKYRGEFEERLKAVLNEIKQSEGQIITFIDELHTVVGAGAAEGAMDAGNMLKPMLARGELRMVGATTLDEYRERIEKDPALERRFQQVMVNEPSAADTIAILRGLKGRYEAHHKVQIADSALVAAATLSDRYITARFLPDKAIDLIDEAASRLRMEIDSQPVEIDELQRVVDRLKMEEMALSKESDAASKQRLERLRADLADKEEQLNALIARWEQEKAGLNRVGELKEKLDELRGQAERAQRDGDFEEASRLMYGEIPQLERQLEEALSEEDSAEHATMVKEEVGADDVADVVSSWTGIPVGRLMEGESAKLLRMEEEIGKRLIGQRRAVAAVSDAVRRARAGISDPDRPTGSFLFLGPTGVGKTELAKALAEFLFDDERAIVRLDMSEYSEKHSVARLVGAPPGYVGYEEGGQLTEAVRRRPYTVVLLDEVEKAHIEVFDTLLQVLDDGRLTDGQGRQVDFRNTLLILTSNLGSQFLIDPTLDDAQRHEKVMQVVRNTFKPEFLNRLDDVIVFDALSTDDLTKIVDLQVDRLARRLADRRLKLEVTPAAREWLALAGYDPVYGARPLRRLVQTAIGDPLARELLAGNLVEGDTVRVDVDESKDSLTV

SEQ ID NO: 8097 - protein, 265 aa, Thermobifida fusca
KRAAVLGSPISHSLSPVLHTAGYTALGIADQWHYGRYECDEHGLAAFLDQCDESWAGLSLTMPLKKVALTLADEVEDTAAAVGGANTIIFDKGRRHAYNTDVTGITEALREAGIHRLDTVTILGAGATAASALAAVRRLGATEPGAVTVLARDLSRTRDLAAAAERMGAQVKFALLTEIDQHVHADLVVSTLPAGAADQWAEPVAAAKTPVFDVVYAPWPTVLGSAAAAAGAVVVGGFPMLLHQAVAQLTLMTGYEAPVEAMRAA

SEQ ID NO: 8098 - protein, 291 aa, Thermobifida fusca
MQLGMIGLGKMGGNMAARLRDKGHEVIGYDVNPELRDVDSIAELVERLSAPRTVWLMVPAGEPTRNTIRELADLLDEGDLVIEGGNSHYRDDRVHADELARRGIEYLDAGVSGGIWGRENGYGIMVGGSAENVARAKPIFDALTPEAGSGFVHAGEIGAGHFVKMVHNGIEYGMMQAFAEGYELMAASGIVKDVPGTLASWRQGTVVRSWLLDLLVRALEEDPELEQLRGYAEDSGEGRWTVQAAVDHAVPAPVITAALYARFASRQEDSPAMKVIAALRNQFGGHAVVKK

SEQ ID NO: 8099 - protein, 342 aa, Thermobifida fusca
MGYTAAVAGASGYVGGELLRLLLAHPDIEIGALTAGGNAGTRLGEHHPHLTPLADRILTETTPETLAGHDIVFLALPHGHSAALAAQLDADTLIVDCGADFRLADAAAWQKFYGSEHAGTWPYGLPELPGARAALAQTRRIAVPGCYPTCGTLALMPAFAEQLVEPEVVVVAASGTSGAGKAAKPHLIASEVMGSVSVYGVGGAHRHNPEFVQNLSAVAETPVRVSFTPVLVPMPRGILATCSAPLKPAIGLDEVRAAYQRHYDAEPFVHLLPEGQWPTTAMTLGANTAAVQVTVDEAAGRLVAVAAIDNLTKGTAGGAIQSANLALGLPETTGLPMTGVAP

SEQ ID NO: 8100 - protein, 381 aa, Thermobifida fusca
VTAPLGFRAAGVAAGIKDGGQRDVAVVINDGPHHSAAAVFTKNRVKAAPVQWSQQAVADGQVRAVVLNSGGANACTGAAGFQDARTTAEHLAAALNDSADRIVVCSTGLIGERLPMPKLLAGVDAAVAEAARDGGLNAADAIRTTDTVSKIAFRRGSGYTIGGMAKGAGMLAPSLATMLSVLTTDAVLTPEQCTALLRAATEVTFDRLDTDGCTSTNDTVVLMASGASGTTPDEAEFSRLLTEVCQDLCRQLLADAEGATKAIAIEVVGAASTDDAVTVGRAIARNALFKCAIYGEDPNWGRVLAAVGTTDAVFEPDNINVAINGVWVCRGGSVGDDRAKVNLKPRDVTVTVDLSAGSASATVWTTDLTVDYVHENSAYST

SEQ ID NO: 8101 - protein, 288 aa, Thermobifida fusca
TRQEALDKAKTLIEALPWLSALHGKTVVVKYGGNAMTDPDLRARFAENIVFLRYAGLRPVVVHGGGPQINAHLERLGVESTFTAGLRVTTPETMEIVRMVLVGQVNREIVGLINEHGPFAVGMSGEDAHLFTAERKYAMVDGEPVDIGLVGEVVDVQPGAVRSLLDDGRIPIISSIARSAEGGVYNVNADTAAAALAVALGAAKLIVLTDVEGLYADYPVNSELISHMTASELEEMLPTLSSGMVPKMEACLRAVRGGVPQAHVLDGRIPNAMLLEIFTDEGVGTMVL

SEQ ID NO: 8102 - protein, 392 aa, Thermobifida fusca
SATEQLQKRFEAVLMPNYGIPPVALVRGEGCRVTDADGKTYLDLIAGIAVSSLGYGHPALVAAVTEQAATLIHTSNLFLHEREVELAEKLVSLLGGSARVFFANSGTEANEAALKLVRRAAGPERTYYVSTVAGFHGRTSGSLALTGKPAIRDPFGPFNLDVRFVPHGDVAALREAVTDQCIAVFVEPVQGEAGVVPARPGYLAAVREICDATGAAFVLDEIQSGIGRTGHWFAHQAEGVRPDVLTLAKGLGGGLPIGACVGFGRYGTAFAKGDHGSTFGGNPVAAAAALAVLTTIEQDRLLESVTELGELLAAEITGIGHPLVAAVRGVGLWRGIQLTAPAAAHVQTRAAEAGFLVNAVTPEVVRLAPPLIITRAEILEFTRALPDILNAA

SEQ ID NO: 8103 - protein, 395 aa, Thermobifida fusca
MTERVVLAYSGGLDTSVAIGWIAEETGAEVIAVAIDCGQGGEDMEVIRQRALACGAVEAVIADAKEEFANDYCVPAIQANALYMDRYPLVSALSRPLIVKHLAEAARYHGATMVAHGCTGKGNDQVRFEAGLAALFPELKVLAPVRDSGMTRDKAIAFAEEKGLPIDVTKKSPYSIDQNLFGRAVETGFLEDIWNGPIEDIYDYTQNPAEPREPDEVVITFTAGVPTALDGKELSPLEIIQELNRRAGAQGVGRIDMVEDRLVGIKSREVYEAPGAITLITAHQELENVTVERELARFKRWVDQRWGELVYDGLWFSPLKNALDKFILEANKHVTGDIRMVLHGGRAVVTGRRSEASLYDYHLATYDSGDTYDQSLARGFIDIWSMPAKIANMRD

SEQ ID NO: 8104 - protein, 458 aa, Thermobifida fusca
LWGGRFSGGPSEALARLSQSTHFDWRLARYDIAGSRAHARVLHAAGLLDDAELAQMLRGLDQLEADVASGAFTPSPDDEDVHTALERGFIERVGPELGGRLRAGRSRNDQIATLVRMYLREEARAITALLLDLVAALADQAEANLDVPMPGRTHLQHAQPVLLAHHLMAHAWPLIRDIERLRDWDRRADMSAYGSGALAGSSLGLDPEAVAAELGFSRSVPNSIDGTAARDVVAEFAFVAAMIGVDLSRISEEIILWATKEFSFITLDDAFSTGSSIMPQKKNPDIAELARGKAGRLIGDLAGLLSTLKGLPLAYNRDLQEDKEPVFDAVDTLKVLLPAFTGMVATLTVNRERMAELAPQGFSLATDIAEWLVRQRVPFREAHEIAGACVRVCEERGIDLPDLSDADLAAISPHLTPQVREVLTVQGSLESRAARGGTAPARVREQLAELRKAIDDHR

SEQ ID NO: 8105 - protein, 464 aa, Thermobifida fusca
WLGVDLGTSGVKVVVVDSESAVVGEGEASYPVRSPRPGWAESDPGDWWEATVAAVRQALAAAGQPRIRAVGVDGQMHGLVLAREDAMPLRSALLWADRRAAAELAAWRGLADTEREALANPLVPGMTGPLLAWIARHEPRLLAEARWALLPKDWLRLRLTGKAATDPSDASATLLWDVPADTWSLPALRAAQLPADLLPPLAASDDVAGVLTGDAAAELGMDPGTPVAVGAGDTPAALLATAAGEEQAQLTVGSGAQIVAATTDPSPVPGVHVYRTAERAGWYRMAAVQNVGVVVEWVRTLLGATWEEVYAAAGEEPDRGGVVFLPHLTGERTPVLGMTGVLAGLRLDTDRTAVLRAAVEGVAFTIRHAAMMLPGGLPPVVRLAGGGSRDPRFRALLANVLGVELRPVRLRSASAVGAAHLAARAVGAGVARPELHYEPVVSPTHHKEIYDVKFEVYLHHLRRN

SEQ ID NO: 8106 - protein, 339 aa, Thermobifida fusca
VDAELAAFVASRRPLLLEIGAEWEPVLAALEAMISGGKRLRPAFCYWGWRGAGGGEEPGLYTAAAALELLQACALIHDDVIDNSDTRRGQPAVHRRLAALHRESGWHGDPDEFGRGAAILLGDLCLAWCEDMYQSSALPAEALAAGRGPFDLMRTEVVAGQYLDLVEQARGADTVEAALRVMRFKSAKYTIEQPLHLGAALAGRYAELAPAYTAYGIPLGIAFQLRDDVLGVFGDPEETGKPAGDDLREGKRTVLVAETLRRAAADDAEQFRRLLGDPELGAEEIAWMRSVIVDSGALEACEARIADYVADATQALENDVIADDARSALADLIVAATAR

SEQ ID NO: 8107 - protein, 334 aa, Thermobifida fusca
MVIVMAPDAPSDTIDSIVDLVASVGGEAYVTRGVSRTIIGLVGDVERFETLNLRALPGVADILRISTPYKLVSRENTTERSVVQVAGVPIGGDHMTLIAGPCAVETPEQTLEAALMAKRAGAALLRGGAYKPRTSPYAFQGLGETGLKILSDVRAETGLPIVTEVVDASDVELVASYADMLQIGTRNMQNFALLQAVGDAGKPVLLKRGMSSTIEEWLMAAEYIAQRGNLNIVLCERGIRTFEKATRNTLDVSAVAVAQRLSHLPVVVDPSHSGGKRELVLPLSRAAIAVGADGLIVDVHPAPETALCDGPQALTHADLAELAHVVTALPPLVG

SEQ ID NO: 8108 - protein, 350 aa, Thermobifida fusca
SRRFKEYTQMRVGVLTGGGDCPGLNAVIRAVVRKGIKEYGYEFVGFRDGWRGPLEGDTMPLDIEAVRGILPRGGTILGSSRTNLMKIEGGVERVKDNMAALGVDALVAIGGEDTLGVARQLHDHGVNVVGVPKTIDNDLNATDYTFGFDTAVNIATEAIDRLHTTAESHHRALVVEVMGRHAGWIALHAGMAAGANVILIPERPFDIDEVVAYIESRFKTNYAPIIVVAEGAHPKEGQLTLASAERDSFGHVRLGGIGQRLAEEIEARTGKEARSVVLGHVQRGGTPSAFDRVLATRLGLHAITAVHDKDFGKMVALRGTEIVRVDLSEATDQLKTVPVERYEEAEVFFG

SEQ ID NO: 8109 - protein, 598 aa, Thermobifida fusca
VREYTTPAVKELDPDTRLTDTVFTRAAQEPNAVMFRRLVDGAWRDVTCAEFHRDVMGVAKALIAAGINHGDRVALMSRTRYEWTVIDYAIWTIGGVTVPIFDTSSEEQVEWILRDSGSTLAFVENDEHAERVRAVSAQLLEPDRIVQIESDSFPAFVATGADVADSVVEERRAATGLDDLATLIYTSGTTGRPKGCELTQRNLAFDVMSVNSGPMKDVFTMEGRSTLLFLPLAHSLARIIQVGCVETKTVMGHFPSTGPDLLDALASFRPMFLLAVPRVFEKVYNKAEQKAIASGKGDIFRKAAETAIAYSKALDTGKVSLGLRLKRAVFSLLVYRKILAAVGGQAKYAVSGGSALGERLGHFFRGIGLTVLEGYGLTETSAPTTANAPDTNKIGTVGRPIPGTSIRIADDGEILVKGDNVMRGYWNNPKATKEAFTEDGWYRSGDIGELDEEGFLRITGRKKEIIVTAGGKNVAPAVIEDRIRSHAIVSQCMVVGDNRKFVAALITIDPEAFEFWKKQHNKTGTIAELVDDPDLRATVQKAVDDGNKAVSRAESVRKFAILPVDFSEAEGHMTASLKLKRHVIEKQFSAEIEALYAE

SEQ ID NO: 8110 - protein, 416 aa, Thermobifida fusca
WPAPTVSRPVDATVSLPGSKSMTNRALILAALSETPSVVRAPLYSRDTTLMVGALRALGIGVHEADGDWEVTPTPPQGPAAIDVGNAGTVMRFVPPLAAMARGEVSFDGDPRARERPVGPLLAALRTLGAEIDDGGRGALPMVIRGRGELPGGTVTLDASGSSQFVSALLLSGARFSKGVEVRHVGPPVPSQPHLNMTVQMLRDAGVEVDTDTPDVWRVAPGPIRVTEITVEPDLSNAAPFLAAALVTGGRVTVRGWPRHTTQPGDALRTLFAEMGGRVEFTDEGLTLHGTGEIRGLTADLRDVGELTPTIAAVAALASTPSRLTGIAHLRRHETDRIAALVREINRLGGDAEELPDGLVIRPRPLHGGVFHSYDDHRMATSGAVIGLVVPGVEVENIATTGKTLPDFPRLWSEVL

SEQ ID NO: 8111 - protein, 329 aa, Thermobifida fusca
MAKAPVNVTVTGAAGQIGYALLFRIASGQLLGVDTPVRLRLLEIPQAIKAAEGTAMELDDCAFPLLAGVDIYDDPRKAFDGVNVALLVGARPRTKGMERRDLLEANGGIFGPQGAAINDGAADDVRVLVVGNPANTNALIAQAHAPDIPADRFTAMTRLDHNRALSQLAAKLNVSVSDIKKLTIWGNHSATQYPDIFHAEVNGRSAVEAVNDEEWLRDTFIPTVAKRGAAIIEARGASSAASAANAAIDHVYDWVNGTPEGDWTSVALPSDGSYGVPEGLVSSFPVVSRNGSWEIVQGLEINEFSRERIDASVRELEEEREAVRALGLI

SEQ ID NO: 8112 - protein, 604 aa, Thermobifida fusca
IVTTAVHGNNVAPTSHQELVDWVREIAELTQPDEVVWCDGSDAEWERLTSQLVEQGTLIRLNEELRPNSFYCRSDPSDVARVEDRTFICSERQEDAGPTNNWVDPAEMRATLKEIFTGCMRGRTMYVVPFCMGPLGGKISQLGVEITDSPYVVVSMRIMTRMGAPALRLIEERGTFVKAVHSVGAPLEPGQKDVPWPCNSTKYITHFPETREIWSYGSGYGGNALLGKKCYALRIASVMARDEGWLAEHMLIIKVTPPSGEPRYIAAAFPSACGKTNLAMLQPTIPGWKVETIGDDIAWMRFGEDGRLYAINPEYGFFGVAPGTGESTNANAVKALWGNSIFTNVALTDDGDVWWEGLTDEPPAHLTDWRGRDWTPDSGEPAAHPNARFTTPASQAPTIAPEWEDPNGVPISVILFGGRRATAVPLVVEAFNWQHGVYLGANVASERTAAAEGKVGELRRDPFAMLPFCGYNMGDYFGHWLKIGRQTDPDKLPRIYYVNWFRKNDEGKFIWPGFGENSRVIKWIIERLEGKAAAQDTPIGRVPTPEALDTEGLDISQEDLELLLSVDREVWRQEADLVPDFFNSFGDRLPKELWDEYEALRQRL

SEQ ID NO: 8113 - protein, 241 aa, Thermobifida fusca
RTALVTGAASGIGRACATRLAAAGATVRLVDLNREALDELAQRGIGEPHHVDLTDLDAVDTVARGVDIVVNNAGVQTVCPVHEFPPERFSMMVKLMLEAPFRIVRAALPHMYARNWGRIINISSVHGLRASAYKSAYVAAKHGLEGFSKVVALEGAPHGVTSNCINPGYVRTPLVEQQIADQARAHGIPASDVVETVLLARSPIKRLIEPAEVAEMVAYLCCPEASFINGASLTIDGAWSA

SEQ ID NO: 8114 - protein, 461 aa, Thermobifida fusca
PLVAGVDSSTQSTKIVVRDAETGALIRQGRAPHPDGTEVNPHVWWHALLKAAEGGLLDDVAAISIAAQQHGMVALDADGTPVRDALLWNDTRSADAATDLINELGGPAAWSQAVGSVPVASFTVTKLRWLAQHEPDNAARAESILLPHDWLTQRLTQATEPVTDRGDASGTGYYDPATNTYRTDLLTLAFGRELRTPRVAAPAEVVGSVTTPELPAIDVVGPGTGDNMAAALALNARPGDVVVSIGTSGTAFAVAEKPTADPTGTIAGFADATGRFLPLVCTLNAARVLTAGAAALGVTLEEFNQLALTAPPGAGGLVLLPYLDGERTPDLPNATGRLDGLTRANLTPANLARAFVEGMLCGLADAVDALVHQGVPVNRVLLIGGGARSAAVRAIAPQILGRPVTIPAEGEYVADGAARQAAWALSGKPTPPEWEDAGTVVSEADPTPQVRERYAEARNRL

SEQ ID NO: 8115 - protein, 462 aa, Thermobifida fusca
RRAKIVATLGPATSSPEVLRKLVDAGLDVARLNLSHGTHDDHQTMYRNVRAAAEASGRNVGILADLQGPKIRLGTFVDGSVTLSPGDEFTITIDDVPGDRHRVSTTYKGLPGDVRPGDRVLIDDGRVVLECVKSTSTDVHTRVIVGGPVSNHKGLNLPGVSVAVPALTEKDERDLRWALEQGVDMVALSFVRSPADAEDVHRVMDEMGVHVPLIAKIEKPQAVERLQDIIEAFDGVMVARGDLGVELPLENVPMVQKRAIERCRDKAKPVIVATQMLESMIHNPRPTRAEASDVANAVLDGADAVMLSGETSVGKYPVETVQTMARIIAAAEQESLRASHILHRVPETVGGSIARAAAEVGATVGAKALVAFTSSGETARRLARYRSPIPLLAFTTEPATRAQLSLTWGVETHLVPWVDNTDDMVRQVENELLDMDYQKGDKVVIVAGSPPGTRGSTNMLRV

SEQ ID NO: 8116 - protein, 1186 aa, Thermobifida fusca
VLGAVAEQVILPAIMEQRTTVAAVATASAVVFAVGFLKALGLGARRFYAGLMQYRMQARYRRAVARRYLELPLAWHQRHPAGQLLSNANADVEATWQPLAPLPMAVGSTAMLVIAAGAMLATDLVLALVGFVVFPLLAIANLVFQRRVSPAATHAQALRSQVSEVAHESFDGALVVKTLGREDMETERFTRAAERLRDAQIRVGRMRAAFDPLLEALPNLGVLVVLLIGLIRLQRGDVTAGDIVQIAYLFTLLSLPIRSLGWLLGDLPRSVVGWRRVSAVLNAQGGTDYGKERLHGEGGLAVSVRNLSFSYADTSPADLGRDTLEGGRGLDATGNEETPRITVLRDVTLDLAPGKVTALVGPTGSGKSTLTMLLARLVDPDHGDVLVNGVDARRYAPGELACAIALVPQTTFIFDDTVRDNITLGLDVDDTEVWQALRLAHADSFVAALPRGLDTRLGERGTSLSGGQRQRLALARSLVRRPRLLILDDATSAVDPQVEARILGGLREADLAGATVVVVAYRRATIELADEVVYLEQGTVRDRGTHEELLARSPGYRRLVTAYEQAAQRRAARRVPIRRPGGCPMSAPTRTRTSPAQAPAEASTPAPTAPALHRSTESAWATLRRGVALSPEFTRGLPVTVALAVVATLGKVIVPLAVQQIIDNGLLAEGGPDIGFVVATVALCTALVVVTALCSYLMNARLYQSTESGLATLRRTAFRHVHDLSVLTQNSERKGALVSRVTSDVDQISTFMQWGGILLIVSTGQLAIATVLMAVYSWQLTLLVWVCFLPLLFGVRWLQRLLSKAYLKVRERTGEMLGVIGETVVGAAVIRAYGTEERTARRIDRTVLATRNAQVKAQRLSMAVSPLAELVSAFTYAVVIAVGIWLGVIGSLTAGQLVAFLFLINLFVAPMTMATEIFNEAQNAIAGWRRVLGVLDTEPDIADPGASGTPLPHGPISIRFDHVNYAYPGGPRVLDDITVEIAPGSRVAVVGETGSGKTTFVKLLTRLMDPDEGKILLNGVNLREVAFSSLRSRVVLVPQEGFLFDSTLADNIRFARPEATDEQITEAITQLGLSEWLAGLPHGLATPVGQRGESLSAGERQLVALIRAYIADPDLLILDEATSAVDPATEVRIQHALDLLTRGRTSVAIAHRLSTAEAADEVLVFDRGRIVQRGTHAELVARPGVY

SEQ ID NO: 8117 - protein, 652 aa, Thermobifida fusca
  unsure (1)..(652): unsure at all Xaa locations
RIAIVNRGEAAMRLIHAVRDIAAETGTRIETVALYTDVDRTAAFVREADIAYDLGPASARPYLNLEVLQRALVDTGADAAWVGWGFVAEDPAFAELCEQLGVTFIGPSPHAMRQLGDKIGAKLLAEQVGVPVAPWSRGPVTTLDEAIAAARTIGYPLMLKAAAGGGGRGIRIITTEAELVDTYERARQEAARAFGSDTVFLESLVTGARHVEVQVIADGQGTAWALGVRDCSVQRRNQKIIEESASPVLSPVQAADLKAAAERLALAVGYRGAATVEFLYRPDDKLFAFLEVNTRLQVEHPITEATTGFDLVKAQLWVASGGKLEGEPPIEQGHAIEARLNAEDPDRDFAPSPGRIVHLELPTGPGIRVDTGFTEGDVIPSDFDSMIAKIIAHGRDREEALSRLRRALAHTTVLIEGGTTNKSFVLDLLNQPEVVNATADTGWIDRVRSEGRLVSHTHSAIALIAAAIEAYEEEERVEQQRLLTTAFGGRPQVQHDSGQPLDLKLRGTTYRLRVARVGAHRFRAAIDTGGVVRTADVELDRFGPHSDVSPSTAPATGSXPAPTGPRSSSKSTGSPTGSAGTKAGVLRSPTPALVVATPVAVDAEVEAGDPVLVVESMKMETVLRAPFKARVKKCLVTVGTQVESGAPLMRLE

SEQ ID NO: 8118 - protein, 262 aa, Thermobifida fusca
LVIATVNVNGLRAAARKGFVEWLAGTKADVVCLQETRAELDQLPPEVAEPDGWHVVLVPAATKGRAGVAVYSRMKPDAVRIGFGSAEFADSGRYVEADFGPVSVASLYLPSGQVGTPLQEEKERFMAEFLPYLVRRRTEVEAQGRELAVCGDWNIAHQEADLKNWRGNRKNSGFLPEERQWLSRVYEEAGYVDVVRALHPDQDGPYTWWSYRGRAFDNDAGWRIDLQVATPGLAARAQEAWVERAPSHDQRWSDHAPVTVVY

SEQ ID NO: 8119 - protein, 458 aa, Thermobifida fusca
TFGDLSRRAAHLSAVLASHGVTPGDRVATLLPLGIDLTISAVAVWRLGAVLVPLPPVLAASAIDWRLRQVNATAVLAPADQTSKLTTGSWTVIDPHKEAATPPPDPATVGPDDPLLISHTPGISGPPRQITVPVRALAAFHIHHHYGLHISDDDIYWCFSEPGDPHGLYYGLVSPLLAGHTCLHLRAGFDPELTLDVMETFQVTRLAAAPTIYRALRTATKTLPPGIMVQGLATNGDEFRTDLSEWALGTFGVGISDHYGHPESGIVAVNDGHGGPLTALPGFRLTVLEPLSDTPAETGVPGRVAIDTHNSPAWWFAGYPDDPLATAQHFSPDGRWYLTGDTGTVDDTGAVHLTRHNGEVIITSGYRIGPYDVESVLLEHDAVDEVAVYGIPDPLRGALVAANVVLTPDASPSDELAEELKRLVAERFAETAAPHQVTFVPHLPKTASGKLRRNRLRA

SEQ ID NO: 8120 - protein, 1189 aa, Thermobifida fusca
  unsure (1)..(1189): unsure at all Xaa locations
LHRKYLADPNSVDKAWWNFFADYSPEPPPTGQPPLLRAPXPATVLAARSEPAASKAAARPATATTPDGSDDALAVSQERLRGASARTAANMESSLTLPTATSVRAVPVKLLFDNRIVINNHLRRARGGKVSFTHLIGYAMVKALESVPVMNYSYTEIDGKPAVAKPKHVNFGLAIDLAKPDGSRQLVVPNIKAADTMNFKEFWSACEELVRKARSNKLTVADFQGTTITLTNPGGIGTVHSVPRLMPGQGTILGVGAMEYPAEFQGASPATLNELAVSKVMTLTSTYDHRIIQGAESGEFLRRIHQLLLGEDGFYDEIFESLRIPYEPVRWVQDISVNRDNQLDKATRVQELIHAYRVRGHLMADTDPLEYKQRRHPDLDVLEHGLTLWDLDREFPTGGFGGKPVMKLREILGILRDSYCRTVGIEYMHIQSPEEREWIQARVEREPEKLSREEQLHILKLLNSAEAFETFLQTKYVGQKRFSLEGGESLIPLLDGVITKAARAQLDEVVIGMAHRGRLNVLANICGKSYAQIFGEFEGNLDPRSAHGSGDVKYHLGTEGTFTTITGEKIAISLAANPSHLETVNPVAEGIVRAKQDILNKGATGFTVLPILIHGDAAFAGQGVVAETLNLSQLRGYRTGGTIHIIVNNQVGFTTSPKDSRSSVYATDVARMVQAPIFHVNGDDPEAVVRVARLAFAYRQEFNKDVVIDLVCYRRRGHNEADNPSFTQPLMYDIIDAKRSTRKLYTEALIGRGDITLEEAEEALRDYQEQLERAFAETREAAKKPIEPGSVIKPEVFTEAPIDHSATPTAVSEEVIKRVAETQVTFPEGFTVHPRLLPQLQRRVRMVEENAIDWAMAETLAFGSLLIDGHPVRLVGQDSRRGTFGQRHAVLVDRKTGEEYTPLKVFDRGTAKFHVHDSLLSEYAALGFEYGYSLERPDALVAWEAQFGDFVNGAQTVIDEYISSGEQKWGQKSSVTLLLPHGYEGQGPDHSSARIERFLQLCAQENMTVTIPTTPANYFHLLRWQVKSPYRRPLIVFTPKSMLRHKAAVSAVSEFTSGSFRPLIPDTSGIAPEDVRRVILCAGKIYYELDAARKRTGDQHTAIIRVERLYPLPIDEIRQQLRSFPNAGEVLWVQEEPANMGPWPFVALVFAEQLDRPFTRISRSASSSPATGSAKRHEVEQQALVNTVF

SEQ ID NO: 8121 - protein, 165 aa, Thermobifida fusca
  unsure (1)..(165): unsure at all Xaa locations
SIVIRPARPDDVPVITALVRELAEYEKEPQSATATEEDFAAALFGPNPAVFAHVAEHTAEDGSPMVVGMALWFLNFSTWTGRHGIYLEDLYVRPEFRGRGYGKALLTELARICVARGYRRLEWSVLDWNTPAIEFYKSLGAVPMDGWTVYRLTGEALTALGQQXP

SEQ ID NO: 8122 - protein, 579 aa, Thermobifida fusca
MSTPVTMPDLGESVTEGTVTQWLKQEGDTVEVDEPLLEVSTDKVDTEIPSPVSGVLTKILVGEDETVEVGAQIAIITPAGEAPPAQPAPETAAEPAAQPEPEPEPAPQPAAEARTEPAAPVADAGAATPVTMPNLGESVSEGTVTQWLKQEGDTVEADEPLLEVSTDKVDTEIPSPVSGVLTKILVGEDETVEVGAQIALISPAGQAAAPAAPAAPQPAPEPKPEARPEPAPQPAAQPEAAARTEPAPQPRRTRDDETPTVDLETISGTGQVLGTDATSEGYVTPLVRKLAAQEGVDLSQVKGTGVGGRIRKQDVLEAARRMREQRQRAAAAPAPAAADTALRGRTETMSRLRQTFAEQIVESLHTAAQLTQVVEVDVTAIARLREQVGERFAAETGVELGFFPFFALAVVEALQRHPKLNAVIDGTEVTYHDTENLAVVVDTEQGVLAPVVKDAGRLSLRELARRIDDLGARARTARLVPDELSGGTFTMVDSGAYGALVETPIIHQPQVAVLSTGTVVKRPVVVEEPQLGEVITVRSMVYLSLSFDHRLIDGADAARFLSDVKRRLEEGAFEDAVGL

SEQ ID NO: 8123 - protein, 483 aa, Thermobifida fusca
  unsure (1)..(483): unsure at all Xaa locations
RTLXAASGLATGVXSHRRKRSVLPVSESGGTFDLVILGGGSGGYSAAIRASELGMRVALIEKDKLGGTCLHYGCIPTKALLHAGEVADTVRASEKFGVRASFDTIDMARVHEYKDKVVSGLHRGLTGLIKARGITLVEGEGKLTGVDEVTVNGVAYKGRHIILATGSQARSLPGLEIDGERIITSYEALRLDRVPKSAIILGGGVIGVEFASVWRSFGAEVTIVEALPHLVPAEEESSSKLLERAFRKRGIKFELGSPFESVKLTETGVSMTLASGKTVEGELLLVAVGRGPVSQGLGYEEVGIRLERGFVQVDENLHTGVGNIYAVGDLIPTPQLAHVGFAEGIFVAEHIAGLNPVNIDYDGIPRVTYSDPEVASVGITSKTAAERGIETTEFVYNLAGNGKSQILQTQGAVKVIAAKDGPVLGVHMVGSRVGELITEGQLIYNWEALPSEVAQLIHAHPTQSEALGEAHLALAGKPLHVHD

SEQ ID NO: 8124 - protein, 319 aa, Thermobifida fusca
MEFRHLGKSGLVVSEIAYGNWITHGSQVEEETAIACVHAALDEGITTFDTADVYAQGRAEEVLGKALKGQRRDGIEIFSKVYWPVGPGKNDRGLSRKHIIRGVEESLRRLGTDYLDLYQAHRFDYATPLEETLRAFDDLVRQGKVLYVGVSEWRAEEIEQALKIADEMGFDRIVSNQPQYNMLWRVIEAEVVPLCKREGIGQIVWSPIAQGVLTGKYKPGQPPPSGSRATDEKSGAQFIRKFLDNQQLLERVQQLLPLAAEAGLTPAQLAVAWVLQNSNVSAAIIGASRPEQVRDNAKAAGVKLDAELMRRIDEILGDA

SEQ ID NO: 8125 - protein, 136 aa, Thermobifida fusca
TVLLLNGPNLNLLGLRDPAQYGTTTLAEIEKRVVSLGAELGVDVVCAQSNHEGELIDRIHAARELDGIVFNPGAYAHTSVALRDAIDAVPTPCVEVHISNIYAREPFRHTSMTAPVVNGIIGGCGVHGYELALRHI

SEQ ID NO: 8126 - protein, 488 aa, Thermobifida fusca
  unsure (1)..(488): unsure at all Xaa locations
TFPKRPPRSPACDALPWAPEPVHMRACTSYQERXXATTTSPSSRPDFWFGAATASYQIEGAVHADGRGPSIWDTYSHTPGLVLNGDTGDVACDHYHRYPEDVELLRRLGVDAYRFSIAWPRVMPTGSGDVNQRGLDFYDRLVDALLEAGITPVPTLYHWDLPQALEDAGGWRSRSTAEHFAAYTRAVVARLGDRIRHWITLNEPFCSAFLGYAVGRHAPGARGRHACARRRAPPAPRPRPGSAGTARCRCGRGRHHPQPRPDPARLRQCGRPRGCRPRGNPAQPGLVRPAVRRPLPRERSRRVGRARGRLVPARRRPGDHRPAAGLPRHQLLPAAQSRRRPADRSRPGTPHRRRHPRHQQRFDGVRHTAMDWPVVPESFTDLLLDLTERYPNLPPIYITENGSAEHDVVSPDGRVHDTDRIAYLNDHLHALAAAIRAGVDVRGYFVWSLLDNFEWAFGYERRFGIVRVDYDTLERLPKDSYFWYQRLI

SEQ ID NO: 8127 - protein, 621 aa, Thermobifida fusca
ASLWFGGDYNPDQWPEPVWDEDMRLMRQAGVTLATVGVFSWSLLEPEEDRYTFDWLDRVLDLLHANGISACLATPTASPPPWFTLAHPDALPVTADGVRLTHGSRDTYDVCAPAYREASLRITRALAERYAHHPALALWHVHNEYGTHTYGEHAARAFRTWLRGRYGSLATLNDAWTTAFWGQRYSDWEQIHPPRATQYLPNPAHLLDFRRFLSDAMRGHYCAQRDILRAANPDVPVTTNFAFGSWVPVDPWRWAADLDLVAVDVYPDATGEAAAHQHAFAADLARSWGRGRPWLLMEQATGYLGARVRPKAPGEIIRHSLSHVARGSRGAMFFQWRASVGGAEQWHPAMLPHTGADSPVFAEVCELGALLGRLAEVQDTRVVEDAAVVWDPESWWALQSPSLPSPDLDYLAAVRQVHRVLWRQGRTVAFVSPHSPMPDLPLLVVPLLYLTSAATARFLADYAEQGGILVVTYGSGTADEHARVWPGGYPGALRDLLGVRALQHYPLDPAVDAVTVCGEDGEYWGRARRWSEELDVADAKVVARYADGPFAGRAAVTRVGRGAGQAWYVSCDLEDAGLGKVLSRAGLSGGTATPPAVEVVHRDSRDEQWVFVLNHGNGPVT

SEQ ID NO: 8128 - protein, 658 aa, Thermobifida fusca
SPTREIHLKAATTTGETLTASITASAPGVIRVRLSAQPDAAPRATRALTMVHPHPDATADVTINDDHIVIASGPLHAHLTLDPWHLRFTDDTGRLLTEQDRGHVDISGRCRTLPFGRSTVDGVTAYHDSFTLASDERLGGLGERFTPFDLRGRRVRMWNFDAFGAESDRAYKNVPLYISSRGYGLLLHTGSPAEFDMGQSTHSSVQLLVPDDILDYHVIAGPSPRDILDRYNQLTCRPALPPKWAFGTWISSGFIHDTQQRVMERARTIRERGIPCDVLHLDCYWQAEGHWSDLDWDRNAFPNPEQMLADLADLGFRVCLWINPYISHLSPHFEKAAKHGYFLRRTTGEVYLADAWHGSHPPVGIVDFTNPEATEWYTARLRTLLQQGVAVFKTDFGEGVPADAVAANGMTGTDLHNVYTLLFNDAVAQVTRDVKGYDLVWARSSYLGGQRHSAQWSGDSQCTFPAMAATLRGGLSHGLSGVPFWSHDAGGFNGTPDTVLYARWAQFGAFSPLVRFHGTTTREPWRFAPEAEDAAREALHLRYRLMPYLYSAAAVAARTGTPLMRALCVDYPDDPLAWQAELEYLLGPDLLVAPVCGPEGIRNVYLPPGHWVDYWSGRLHDGGRTVKLHSPLNRFPLFVRLGALIPVVEATTTIPDGP

SEQ ID NO: 8129 - protein, 880 aa, Thermobifida fusca
MSVTEPPPRRRGRHSRARRFLTSLGATAALTAGMLGVPLATGTAHAEPAFNYAEALQKSMFFYEAQRSGKLPENNRVSWRGDSGLNDGADVGLDLTGGWYDAGDHVKFGFPMAFTATMLAWGAIESPEGYIRSGQMPYLKDNLRWVNDYFIKAHPSPNVLYVQVGDGDADHKWWGPAEVMPMERPSFKVDPSCPGSDVAAETAAAMAASSIVFADDDPAYAATLVQHAKQLYTFADTYRGVYSDCVPAGAFYNSWSGYQDELVWGAYWLYKATGDDSYLAKAEYEYDFLSTEQQTDLRSYRWTIAWDDKSYGTYVLLAKETGKQKYIDDANRWLDYWTVGVNGQRVPYSPGGMAVLDTWGALRYAANTAFVALVYAKVIDDPVRKQRYHDFAVRQINYALGDNPRNSSYVVGFGNNPPRNPHHRTAHGSWTDSIASPAENRHVLYGALVGGPGSPNDAYTDDRQDYVANEVATDYNAGFSSALAMLVEEYGGTPLADFPPTEEPDGPEIFVEAQINTPGTTFTEIKAMIRNQSGWPARMLDKGTFRYWFTLDEGVDPADITVSSAYNQCATPEDVHHVSGDLYYVEIDCTGEKIFPGGQSEHRREVQFRIAGGPGWDPSNDWSFQGIGNELAPAPYIVLYDDGVPVWGTAPEEGEEPGGGEGPGGGEEPGEDVTPPSAPGSPAVRDVTSTSAVLTWSASSDTGGSGVAGYDVFLRAGTGQEQKVGSTTRTSFTLTGLEPDTTYIAAVVARDNAGNVSQRSTVSFTTLAENGGGPDASCTVGYSTNDWDSGFTASIRITYHGTAPLSSWELSFTFPAGQQVTHGWNATWRQDGAAVTATPMSWNSSLAPGATVEVGFNGSWSGSNTPPTDFTLNGEPCALA

SEQ ID NO: 8130 - protein, 419 aa, Thermobifida fusca
TMTDIERDVRKVAERARDAAADLAPLSRDAKDEALTAVADALRERTEEIVAANAKDVAQARENGISEAMIDRLTLTPARITAIADAVHEIVELPDPVGEVVRGKTLPNGLELRQIRVPLGVIGIIYEGRPNVTVDAAALCLKSGNAVLLRGSSSAYSSNTVLTDVIRQALASTRVPVDAVQMVPGKSRESVKHLMRARGLVDVLIPRGGASLIQTVVNESTIPVIETGTGNCHVYVDEAADLDQALKIVLNSKTQRCSVCNASETLLVHAGIADAFLPRALAELREAGVTIHGDERVRSYDSSVVPATEEDWATEYLSLDLAVRVVDSLDEAVAHIRAYSSAHTEAIITDSQAAARRFVSLVDSAAVMVNASTRFTDGGEFGFGAEIGISTQKLHARGPMGLPELTTTKYVVTGEGHVR

SEQ ID NO: 8131 - protein, 473 aa, Thermobifida fusca
  unsure (1)..(473): unsure at all Xaa locations
GEVGEQXTVSLPRPTSPTTSTRCTSCAAPMRGCPPTSPVRLAKTTSNLFRFRSRDDAARLDVSAFTSVISIDTEARVAEVGGMTTYEDLVAATLRHGLMPPVVPQLRTITLGGAVTGLGIESSSFRNGLPHESVEEMEILTGSGQVVVARRDNEHRDLFYGFPNSYGTLGYALRLRIQLEPVRPYVHLRHLRFTDAAAAMAALEQICADRTHDGETVDFVDGVVFARNELYLTLGTFTDRAPWTSDYTGTDIYYRSIPRYAGPGPGDYLTTHDYLWRWDTDWFWCSRAFGLQHPVVRRLWPRSLKRSDVYRKLVAWDRRTDASRLLDYYRGRPPKEPVIQDIEVEVGRAAEFLDFFHTEIGMSPVWLCPLRLREDTADDTEPVWPLYPLKPRRLYVNFGFWGLVPIRPGGGRTYHNRLIEKEVTRLGGHKSLYSDAFYDEDEFWELYNGEIYRKLKAAYDPDGRLLDLYTKCV

SEQ ID NO: 8132 - protein, 509 aa, Thermobifida fusca
LLEDGARNRPERDAIVFGDMRLNYALVNMIANQVANLLVSRGIRPGDKVALACPNVPYFPFVYFGALKAGAVVVPLNVLLTPREIEYHLRDSGAKALFAFTGTPELPLGERAWQAFQEVAECELYIDLPAAAGATTSAIPGAETFWAALNGQPGEFESVRTEGDDVAVIIYTSGTTGQPKGAQLTHTNLLFNAVASSALFDQAPDSHDVFLTVLPLFHIFGQTTMMNAALYRHGTMVLMPRFDGDEALSLMEKEKVTIFAGVPTMYWGLLNAQGDHDIKQISQTLHTAVSGGASLPAEVARKVKEKFGIEILEGYGLSETSPVVSFNNPKRKAKPGSIGLPIWGVEMKLVDENFNTIEGEGPGEIAVRGHCVMKGYHNRPEANAQVMRDGWFRTGDIARRDEEGFYFIIDRSKDMIIRGGYNVYPREIEEVLMTHPQVSLAAVVGVPHDTHGEEIKAFVIPAEGATLTEDELIAWAKERLAAYKYPRIVEFRTELPMTATGKILKRELR

SEQ ID NO: 8133 - protein, 934 aa, Thermobifida fusca
MTETVSGSATRKGRKPRRGVKIQRVFTTPGVHPYDTVEWERRDVVMTNWRDGSVNFRQDGVEFPKSWSMNATQIVASKYFRGALGTPQREWSLKQLIDRVVDTYTAAGREHGYFASDEDAEIFDHELKYALVHQMFSFNSPVWFNVGTSSKAQVSACFILSVDDTMESILDWYKEEGLIFKGGSGAGVNLSRIRSSKELLSSGGTASGPVSFMRGADASAGTIKSGGATRRAAKMVVLDVDHPDIEEFIECKAREERKIRVLRDAGFDVDLGGADIISVQYQNANNSVRVSDKFMRAVENDEDFDLIARTTGEVISKVRARDLFRKMAQAAWECADPGIQYDDTINDWHTTPESGRITASNPCSEYVHLDNSSCNLASINLMKFLDEDGSFRVEEFERLTELVITAMDISICFADFPTEKIAETTRAYRQLGIGYTNLGALLMATGHAYDSDGGRSVAAAITSLMTAAAYRRSAELAGVVGAYEGYAKNAEAHKRVMRKHAAANDALRPVGQLEKPIHDAATRAWKECLELGERHGWRNAQASLLAPTGTISFMLDCDTTGIEPDFSLVKIKKLVGGGSMKIVNQGIPRALRTLGYNEDQIQAIVDYVAEHGHVVDAPELRPEHYEVFDCATGKRYIRPMGHVEMMAAVQPFLSGAISKTVNLPEEATVEDFERLYFEGWKKGLKALAVYRDNCKVGQPLSTTKKEEEKKEESRPVELRSPVRRRLPKRRPSQTISFTVGGAEGYITAGSYPDDGLGEVFLKLGKQGSTLAGIMDAFSIAISIALQYGVPLQTYVEKFTNMRFEPAGMTDDPDIRMAQSVVDYIFRRLALDYLPYEERAALGVFTAEERAAQAAGEDPAQVAAQVVTYAQSAPVTETLTAPPEPEPKPRSTVESTESRKEFSADAPLCVSCGTKMRPSGSCYVCEGCGSTSGCS

SEQ ID NO: 8134 - protein, 477 aa, Thermobifida fusca
MSVLALGLSHRSAPVTLLERVALSGEVRLKLMTEMVNTSAVNEAMVVSTCNRTEVYADVDQFHPGVAAICELLSQYTGVSQEELTQHCYVHYEERAVQHLFSVACGLDSMVVGEGQILGQVRNALKDAQHVGTLGRVLNDLGQRALRVGKRAHTETHLDKAGASMVSFGLTVAGRFLTPDREPQPSAAAAVCPVDGDTGVEVSAALPDPQLLTGRRIMVLGAGSMSALAANTVARHGASTILIANRTFDRAQRLAECLTEGYESVRSSAVPFEDAARHLADIDLVISCTGAQGIVLTAEQVAAGGDRATRPLVFLDLALPHDIDKAVRKLPGVHLVDIEELRDAAEDGTATGQVADLTAVRDIVAEEVAEYQAVRSAERVAPTVVALRSKAQKVVESELERLNGRLPGIDDRTRAEITRTVRRVVDKLLHQPTVRVKQLATGPEGAVYAEALRELFDLDPAIPSAVVKPGTALGEER

SEQ ID NO: 8135 - protein, 314 aa, Thermobifida fusca
MSTTPARLGTRRSTMATNQSRRVAEILTARTGVPVELVLITSFGDITRAHLTQLGGTGVFVSALRDALLAGEVEFAVHSLKDLPTAPTEGIVLAAVTERDDPRDALCARDGLKFADLPPGATVGTGSPRRVAQLAALRPDLRYVPIRGNAETRLGKVASGELDAVVLAYAGLHRVGRLDDVTDVFDVDQVLPAPGQGALAVECRTADFTGPLRYLTAVDHLPTRAAVTAERVILAELEAGCAAPVGAYAEFVAEDRLRLRAAVVATDGSQAVRAEQTVTVTEFPDAVQAATALGRQLAHDMIEQGADQIVADAA

SEQ ID NO: 8136 - protein, 323 aa, Thermobifida fusca
FPLARPRRLRTTAAMRRLVAETRVRPEELILPMFVKEGIDAPQEISSMPGVYQHTLDSLRKSAEEAVEAGVGGIMLFGVPAVKDERGSAADDPDGIVQVALRKLTADLGNAVVVMTDLCLDEYTSHGHCGVLTEGNEVDNDATLERYASIAVAQAEAGTDVVAPSGMMDGQVGAIRAALDGAGYTGVAILSYAAKYASAFYGPFRDAAECAPQFGDRSSYQQDPANAKEALREVELDLAEGADMVMVKPGLAYLDIVAKVAEAVTVPVSAYQVSGEYAMVEAAARNGWLDRERVIVEILTSYRRAGAGQILTYWATEAARLLR

SEQ ID NO: 8137 - protein, 422 aa, Thermobifida fusca
SHELFNRARSVIPGGVNSPVRAFKAVGGTPPFMVSGKGPYLTDADGNTYVDLICSWGPLILGHAHPAVVEALAKAAAQGTSYGAPTEAEVELAEEIVSRTPVEKVRLVNSGTEATMSAIRLARGATGRAKVVKFAGNYHGHVDALLAAAGSGVATFALPDSPGVTGASAADTIVLPYNDIAAVEAAFAEAGDEIACVIAEACPANMGVVPPRDGFNAKLREITARHGALLILDEVLTGFRVSPSGWYGLEGVAPDLMTFGKVMGGGLPAAAFGGRADLMDQLSPEGSVYQAGTLSGNPLATAAGLATLRNATPEVYAHIDAAAARVSAAVSEALTAEGVPHRIQHGGNLFTVFFTDTEVVDFDGARAQNTARYAAFFQAMLEQGVYLPPAAFEAWFFSAAHDDAALDRVVSALPAAAKAAAQ

SEQ ID NO: 8138 - protein, 274 aa, Thermobifida fusca
MSRADVLVDADWVEAHLDDPNVVIVEVDEDTSAYDKGHIRNAIKLDWRKDLQDPVRRDFVDKAGFEALMSERGIANDHTVVLYGGNNNWFAAYAYWYFKLYGHEKVRLLDGGRKKWELDSRELVTEVPERPKTNYVAKEQDTSIRAFRDEVVDAIGKKALVDVRSPDEFVGKLLAPAHLPQEVSQVPGHIPTARNVPWAKVVNEDGTFKSDEELRKLYEEAGVDLDKEIIAYCRIGERSSIAWFALHELLGLPNVKNYDGSWTEYGSLVGVPVE

SEQ ID NO: 8139 - protein, 472 aa, Thermobifida fusca
  unsure (1)..(472): unsure at all Xaa locations
SAPCAFRPPTPLRRRVPRKDYRQWAEXPPXRDDCVPEAAAIAIGASALIPLTSSPAAASGTADWLHTDGNRIVDSAGNEVWLTGANWFGFNTSERMFHGLWAANIEDITSAMAERGINIVRVPISTQLLLEWKNGQAGPSGVNEYVNPELAGMNTLEVFDYWLQLCEEYGLKVMLDVHSAEADNSGHYYPVWYKGDITTEDFYTAWEWVTERYKNNDTIVAADIKNEPHGKANETPRAKWDGSTDIDNFKHVCETAGKRILAINPNMLILCEGIEIYPKDGQDWSSTDGRDYYSTWWGGNLRGVADHPVDLGAHQDQLVYSPHDYGPSVFEQPWFEGEWNRQTLTEDVWRPNWLYIHEDDIAPLLIGEWGGFLDGGDNEKWMTALRSLIIDEKLHHTFWALNPNSGDTGGLLNYDWTTWDEAKYAFLKPALWQDANGKFVGLDHDVPLGGVGSTTGVSLNQYYGGGGPSQPP

SEQ ID NO: 8140 - protein, 281 aa, Thermobifida fusca
  unsure (1)..(281): unsure at all Xaa locations
PDRSTAHYWATXEGCDSMIAIIGAGRMGEALLAGILHTGRDAAEVLISEAREDRAAELCQRYGVAAASPAEAAARADTLLLAVKPQDMVAALNEIAPALPPGRLVISVAAGITTAVLEKHLPAETAVVRAMPNTPALVGQGMTAIAAGTHTLEEHLDRAETLLRSVGEVVRVPEKHLDAVTALSGSGPAYFYLVAEAMIEAGVLLGLPRPTAERLVTQTAVGSAAMLRDSGDHPTLLREAVTSPGGTTAAALRELERHGLRSAFADAVEAACRRSAELAEG

SEQ ID NO: 8141 - protein, 365 aa, Thermobifida fusca
LAPVRVELTMELCRRLGVFDAPGVSFAPVEPADDALLELVHSRDYIAAVKQAGKTLEPNMKYALGTSDNPVFPDMHEASALVAGASVAAARAVWQGEAEHGANIAGGLHHAMPNKAWGFCVYNDAAVAIAWLLEQGAKRVAYVDVDVHHGDGVQEMFYNDPRVLTISLHESPLTLFPGTGYPEEIGGPDAEGYAVNVALPAGTNDAMWLRAFHAIVPPLLREFQPEVLVTQQGCDTHTLDPLANLTLSIDGQRRTYEALHELAKETAAGRWVLLGGGGYELVQVVPRAWTHLLAEAAGTPIDPETRTPDEWHEFVKERTGEVPPLHMTDGRKADYVPFEAGFDPADAVDRAIRATRAAVFPCHGI

SEQ ID NO: 8142 - protein, 506 aa, Thermobifida fusca
MRTVSGPTDHVVVVGAGLSGLAATLHLLGAGRRVTVFEREEYPGGRAGQLDLDGFHIDTGPTVLTMPDLLDEALAAVGESLSDRLDLVQLSPAYRAVFPDGSVLNVHTNADAMADEVARVCGSHDAKGYLRLRAWLRELYELEMARFIDTNFDSPFTLLSPELVRLAALGGFRSLSAAVGRFVRDERLRRIFSFQSLYAGVPPHRALAAYAVIAYMDTVAGVYFPRGGMRSLGEALAAAATKAGAELHYGRTVTRLERRGNRVRAVVLADGERVPCDAVVVTVDLPLAYRLLGRTPWRIVPLQFAPSAVVLHAGTDRTWPVLDHHTLLFGTAWRRTFTEITRLGKPMSDPSLLVTQPTVTDRSLAPPGRHLLSVVAPCPNLRTGRIDWVSFGPRYREQLGAVLEDRGLTGFSESVRVERLVTPHDWSHMGHAFGTPFATAHTLFQTGPFRPRNLVSGIANAVLAGCGTTPGVGLPTVLISGKLAAARITGCTSPRGPRSPVRGDGG

SEQ ID NO: 8143 - protein, 531 aa, Thermobifida fusca
AFPNREDWALPTVLRHRAAQAPDAIYLDTPEEGRRWTYAETLATAEKVGRSLLAHGEPGDRVLIMARNSSAFIFTWLGSAMAGMVEAPINTAYKGDFLTHQVRVARPRWAVIDAELADRFTDVADEIEDIERFWVIDNGDVDQAIDKLRKAGWQAERWEDLTVDRDGELPEVSPRSLASIFFTSGTTGPSKGVAMPHAQMFFFAAETACLTRLTDKDAAMAVTPLFHGNAQFMSAYPALISGARFVLRSRFSASRWIDQIRESQVTVTNFIGVMMDFVYKQPRRPDDADNPLRCIFAAPTASSILEDFKKRFGIEAFVEVFGLTETSAPILSPYGEDRPAGAAGLVADDWFDVRLVDPETDEEVPVGEVGELVVRPKVPWITSLGYYGMPEKTAEAWRNLWFHTGDALRRDEEGWFYFVDRYKDALRRRGENISSYEVEQAILGYKSVVECAVVAVPADVDAGEDEVMACVVVREPTTPEELWEWCDSRLPAFAVPRYLRFVEALPKTPSEKVQKAVLREQGVTTDTHDRE

SEQ ID NO: 8144 - protein, 240 aa, Thermobifida fusca
LNGKVALVTGASRGIGAAIARGYAERGALVVGAARSTDQLRELEATNPERISTATVDLRDAESLNSLVDLVVERHGRIDILVNNAGVAPAADFATEPIEQWRTTFEVNVIAPMTLAQAAGRYFIPQRSGKIINIASTTGIRGKPGLVGYSASKGAVARFTEALAAEWARHNIQVNCIAPGAFATDAQSAVLESPDLLHRRVRRIPAKRMGDVSELVPLACLLAAPGSDFITGSIFVIDGG

SEQ ID NO: 8145 - protein, 458 aa, Thermobifida fusca
AGETWDVYNPATEEVIATVSGATKEQVDEAIRAARTAFDTWSKMSGEERSAAMHSLADRLEARWEELLASIVNEVGTPVSTAEFLQVKMGLGHLRWFADAAKKDRTVHLGPYDVPVPTMSDVDHYPVGVVAAITGYNYPLNLAGFKYGAALAAGCTVVLLPSPRTPLTTLLLGEIIRESDLPDGVINVVLGGADIGQYLSSHPGVDKVSFTGSDAVGAKIMEQAAANLNDVVLELGGKSANIVLPGCDVESFAVDMHMRWSRNSGQGCAALARLLVHEDLFDRFMKAGAEAFPKMKVGDPWDPETHIGPLIRPDHRDRVNGFITEALEQGGKALLQVETPLPEKGWYVNPILLGNLPHSARAVQQEIFGPVAVVLTYKDVDEAIRLANDTAYGLAANVWAPTLEEGRRVAEQLRAGTVWINGGGAMRPDAPFGGSGRSGIGRELGEWGIQEFLEPRHI

SEQ ID NO: 8146 - protein, 388 aa, Thermobifida fusca
MDFSKDTVHEDIRQAVRDLCAKFPDEYWMKHDQSQEFPWEFYNAIVEAGWLGLTVPTEYGGGGLGVTEAAIVEQEIAASGAGMNGCSAVHIGIFGFEPIIKYGSEDLKQRFLPRLVSGDLHVSFAVTEPDAGTDTTNLSTFARKVDGGWLVSGKKVWITKAQEAERLILLARTTPRDQVAKKTDGLTLFFAPMDRERVTVRPIPKMGRNAVDTNELFIDDLFVPDEDVIGEVGKGFKTILAGLNAERVISANAAIGIGRAALRRATNYAKERVVFGRPIGKNQGIAFPLAEALIKLDAADLMCQQAAWLIDNGYPAGRQANAAKFLAAEAGFFAADAALSVHGGYGYSKEYHIERYFREARLMRIAPISQEMVLNYVAEHVLGLPRSY

SEQ ID NO: 8147 - protein, 246 aa, Thermobifida fusca
RIAAIVGGGSGMGRAISHRLASEGATVYVADLSEESAKKVAEEITAQGGKAVPVQVDATNNDSLRALFDRIRSDHGVLHVLHAQVGMPGPGGIETSDEEWQKNIDVNIKSAYYTCTLGYDLLKSANGKGSITMTSSTSALVGSPFSPIYSLTKGSLVPFARALALKGAPDGIRVNVICPGTVQTPMLAQFFGREPGADVSELTKDFIKNIPLGRGAQPEEIASVIAFLASDDASYVTGVTIPVDGG

SEQ ID NO: 8148 - protein, 372 aa, Thermobifida fusca
FDLGPRHREIQRIARSVAERVEEYADEADAAVEVHQGVAEILRESGLARHVVPAAYGGESDVLDPLAIAVIREALMYTSAHLDSLFGMQGVGSYSLAVGGTEELKREWLPKVARLEAIAGLALTEPDIGSDLRGVTTTIEATPTGVRVSGRKSFITNGGAADFYCVLGREGEGYSMVLVPADTPGLTVERGDDLIAPHILGELHFDGAEVPENHRLGVPGKAFSLMLQTLAVFRVTVAGSAVGLAQAALDEALRHAKTRTQFGRPLLELGAVSQSLALSWTEVETARAITYRAAALAKNDPLAHLDYSSIAKVSATEAAGRVVDRAVQAMGRFGLIRGSKIERLYRNARPLRIYEGATEVLLDSLARRLAKR

SEQ ID NO: 8149 - protein, 372 aa, Thermobifida fusca
EYTEIRELASKVAREVYGPIAEQLDVERKPISREERIRLGELGFLGIAHQERYGGAGAPLAQALAVIEEFARVCRPAAFQIFEANTGPAQVINYLGTEEQRERWLPDIISGEKTMAVAISEPDAGSAATDMRTTARPSGDGYVITGTKRWISNGGEADLYLVYARLTDEPGSKGIGALVVEKGTPGLSFGPPERLMGFRGIPSADVILDEVWVPKENLVVPAGGFGKLFGVFSIERLGNTTMSLGIGQEALDRTIAYVQEREQFGKPLIEFQSVQITLADMVMQVDSARLLQQRAAASAEGGKLPDPLQVSLAKCAANEMAKRVTDMAMQLHGGNGYTEEYGIERLHRDAHGWAIAGGTPNMQRIRIVSELL

SEQ ID NO: 8150 - protein, 388 aa, Thermobifida fusca
VIVDAVRTAAGRGREGGALADVHPVDLLAQTLRQLISRHDLDPGTVDDVIIGCVSQVGEQSATPGRMAWLGAGFPTHVPATTIDRKCGSSQQAVHFAAQGIMAGVYDIVVAGGVESMSRVVMGSARMGADPYGTLVAKRYHPGLVSQGVAAELVAARWNLDRTALDEYSVRSHTLAAQTQEAGLFDREIIPVETPSGTVNRDETIRPNSTVEKLATLKTVFGTPELSERFPEIEWRITAGNSSQITDGASALLLMSRAKCEELGYTPRARIHSMAVCGDDPLLMLTAPIPATRKVLERSGLSLSDIDHVEINEAFAPVPLAWLSEFDIDIDKVNPRGGAIALGHPLGASGARLMTTMLHALEDNDQQFGLQLMCEAGGMANATIIERI

SEQ ID NO: 8151 - protein, 345 aa, Thermobifida fusca
PTLAVVGATGAVGTVMLDILSTRKNVWGEIRLVASARSAGKRLTVRGEEVEVQAISPEVFDGVDVAMFDVPDEVSKEWAPIAAERGAVVVDNSGAFRLDDDVPLVVPEVNAEQVRNRPRNIISNPNCTTLSMIVAIGALHRAYGLTDLVVSSYQAASGAGQQGVDTLYDQIAKVATDRTLGTRAGDVRAAVSDLGPFPAPLALNVVPWAGSLKDDGWSSEELKVRNESRKILGLPDLRVSATCVRVPVVTTHSLAIHATFSTEVDADEARRLLASSPGVVVQDDPAKGEFPTPIDVVGTDPTWVGRIRRSLDDPRSLDLFLCGDNLRKGAALNTAQIAELLAEEF

SEQ ID NO: 8152 - protein, 423 aa, Thermobifida fusca
VALIVQKYGGSSVADADAIKRVAERIVAQKKAGYDVVVVVSAMGDTTDELLDLAKQVSPLPPGRELDMLLTAGERISMALVAMAIGNLGYEARSFTGSQAGVITTSLHGNAKIIDVTPGRIRDALAEGAICIVAGFQGVSQDSKDITTLGRGGSDTTAVALAAALNADLCEIYTDVDGVFTADPRIVPSARRIPQISYEEMLEMAASGAKILHLRCVEYARRYNIPLHVRSSFSQKPGTWVVSEVEETEGMEQPIISGVAHDRSEAKITVVGVPDRVGEAAAIFKALADAEINVDMIVQNVSAASTSRTDISFTLPADSGQNALAALKKIQDKVGFESLLYNDRIGKVSLIGAGMRSYPGVTARFFDAVAREGINIEMISTSEIRISIVVAQDDVDAAVAAAHREFQLDADQVEAVVYGGTGR

SEQ ID NO: 8153 - protein, 379 aa, Thermobifida fusca
PREPARGAIKPKNPRPAAPQPPWSPPRVQPPRWKQLITKKPVAGILTAVATAGLVVSFLVWQWTLPETPLRPDSSTAPSESADPHELNEPRILTTDREAVAVAFSPGGSLLAGGSGDKLIHVWDVASGDELHTLEGHTDWVRAVAFSPDGALLASGSDDATVRLWDVAAAEERAVFEGHTHYVLDIAFSPDGSMVASGSRDGTARLWNVATGTEHAVLKGHTDYVYAVAFSPDGSMVASGSRDGTIRLWDVATGKERDVLQAPAENVVSLAFSPDGSMLVHGSDSTVHLWDVASGEALHTFEGHTDWVRAVAFSPDGALLASGSDDRTIRLWDVAAQEEHTTLEGHTEPVHSVAFHPEGTTLASASEDGTIRIWPIATE

SEQ ID NO: 8154 - protein, 298 aa, Thermobifida fusca
DSSLVPRFAGPATFARLPRTDEVAKTDIAVVGIPFDSGVSYRPGARFGPAAIREASRLLRPYNPGLDVSPFAEVQVADGGDIAVNPFAIKEAIATVEASASELLSQGTRLVTLGGDHTIALPLLRAVHRVHGPVALLHFDAHLDTWDTYFGEPYTHGTPFRRAVEEGILDTEALTHVGIRGPLYGKKDLEDDRRFGFGIVTAADVMRRGVDEIADMVRQRIGNRPLYVSVDIDVLDPAHAPGTGTPEAGGLTSRELLELLRGLASCNLVGADVVEVSPAYDHAQITATAAAHVAYDLV

SEQ ID NO: 8155 - protein, 377 aa, Thermobifida fusca
VTRLMPSQETADLVELVREVASRELAPHVAEAEETERFPREAFRTLGKLGVLGLPYPEEYGGGGQPYEAYLNILEEIGAVWASVGVGVSVHVLSCYALAVYGTEAQRQRWLPDLLSGDLLGAYCLSEPHAGSDPAAMTTRARRDGDHYILDGVKAWITHGGQADFYTVMARTSDDRSRGISCFLVPADTPGLSADRPERKMGLTASHTTMLRFDGVRIPADQRIGAEGQGLSIALSSLDAGRLGIAAVATGLAQAALDTAVDYARQREAFGKPIIEHQGLAFLLADMAAAVETARAATLRAARLKDSGLPYSKEASIAKLIATDNAMRVTTDAVQVLGGYGYTRDFPVERYMREAKVMQIFEGTNQIQRLVIGRHLA

SEQ ID NO: 8156 - protein, 277 aa, Thermobifida fusca
VGVVGLGTMGAGIVEVFARAGFTVTGVEIDDAALERGRTHLEKSLAKAVAKGKLTEDEQRAILGRVTFTTSRDDLADAHLAVEAVPERLDIKRSVFADLDRILPPAAILATNTSSLSVTEIAALTSRPGKVIGLHFFNPAPVMRLVEIVTTVVTEPHVRETATQVVTRLGKTPVAVGDRAGFVANALLVPYLNHAVAVYEQGLATREQIDAAITSAAGFPMGPLTLMDLVGLDVLLDVMDVLWDEFRRPRYAAAPLLRRMVAAGLLGRKSGRGFYDY

SEQ ID NO: 8157 - protein, 386 aa, Thermobifida fusca
VIVGGARTPIGKLLGALSGFAAVDLGAIAIKAALQRAGISGDQVDYVIMGQVLQAGQGQIPSRQASVKAGIPMSVPSLTINKVCLSGLDAIALADQLITAGEFDVVVAGGMESMTNAPHVLPKARHGYKYGSIEVLDATAHDALTDAFDHVSMGLSTERYNARHGMTREEQDAFAARSHQRAAAAIEAGLFKDEIVPVEVPRRKGDPTIVDTDEGVRPDTTVEALARLRPAFDPDGTITAGSSSQISDGACAVVVMSRTKAEELGCEILAEIQAHGNVAGPDNSLHCQPANAIKHALAKAGRDVADLDLVEINEAFASVAIQSMRELGVSEDIVNVNGGAIALGHPVGMSGARIVLHLVHELRRRGGGLGAAGLCGGGGQGDALLL

SEQ ID NO: 8158 - protein, 567 aa, Thermobifida fusca
  unsure (1)..(567): unsure at all Xaa locations
VVGSAAHPSSLWKELSRFGQLSGCRWAALGRTSTAPXPHVSXPGGRMHSIPSPWSTSHPWGALILTPSMLSWVNPAGAGASAASRTPPXVASGSGTGGRSDEAESESSLHPVIARAPAAKAAIRRTGRRLRGASNRDRLGMPDMRFPSLHAXPQRRXRANLTFCATLCDTDRPDARGPPVRIIGYFPQWGIYDRHYFLRDVHSSGQAAKLTHLTYAFGELDEKGVCVMTDEATGDAWADYQCRFSTAQSVDGRGDSYEQPLAGNFNQLRKLKKRHRHLKVGISFGGWNASRYFSNAARTPASRAAFASSLVSLYFDGNLPILPGEPQGGPGVAAGIFDYVDFDWEWPGSPGHEHNVVRAEDRRNYTLLVAETRRQLDAFTARTGRPVEISAYLPADPERAAAGIEPELFDYLDFGIVQGYDFNGDWDLTTNHASQLYTPPDDPSPRKLSLDVGVVTYLEMGVPPEKLVISVPGFGRGWRGVPRGRRNGLYQRAREVAPGTWEPGDEDYKTLARRPGRRFRDREYGALWLYDGNEFWSYDDPEIIRMKAAYAKDLGLGGLSLWSLDND

SEQ ID NO: 8159 - protein, 557 aa, Thermobifida fusca
VPDTFTHAKPRDPYWYKHAVFYEVLVRGFYDSNGDGTGDLRGLIEKLDYLQWLGIDCLWLLPIYESPLRDGGYDVSDYMKILPEFGRISDFVELVEKAHQRGIRVITDLVMNHTSDQHPWFQASRHDPDGPYGNFYVWSDTTERYSDARIIFIDTEQSNWTYDEVRGQYYWHRFFSHQPDLNFENPDVQDAILEVMRFWLDLGIDGFRLDAVPYLYEREGTNCENLKETHEFLKRIRAEVDRLYPDRVLLSEANQWPADVVDYFGDYESGGDECHMNFHFPLMPRMFMAVRREQRYPISEILAQTPPIPRNCQWAIFLRNHDELTLEMVSDEERDYMYSEYAKDPRMRANMGIRRRLAPLLENDLNQIKLFTALLLSLPGSPVLYYGDEIGMGDNIWLGDRDSVRTPMQWTPDRNAGFSRCDPGRLYLPVIMDPIYGYQAINVEAQQNNPNSLLNWTRNMIQIRKQHPVFGTGDFTELHASNPSVFAFVREYGDDRMLCVNNLSRFPQPVELDLRRFEGITPIECTGGVHFPPIGELPYLLTLPGHGFYWFQLPPVA

SEQ ID NO: 8160 - protein, 349 aa, Thermobifida fusca
ARTVKLAVIPGDGIGPEVVAEGLKVLSAVAPRHGLTLDTTEYELGAQRWHATGEVLPDAVEEELRQHDAILLGAVGDPTVPSGVLERGLLLRLRFNFSHYVNLRPVRLYPGVTTPLAGVAPEDIDMLVVREGTEGPYAGMGGVLRKGTPHEIATQDSVNTRLGVERVVRYAFAKAAERPCHKLTLVHKDNVLTYAGELWQRVVREVGAEYPQVEVDYLHVDAATMFFVTQPRRFDVVVTDNLFGDIITDLGAAVAGGIGLAASGNINPEGDFPSMFEPVHGSAPDIAGQGKADPTATILSVSLMLEHLGYADAAAQIDQAVAEDLQERAKNGGVRSTTQIGDDIAQRVA

SEQ ID NO: 8161 - protein, 477 aa, Thermobifida fusca
LNSVTDKAIRTRFAPSPTGMFHVGGARSALFNWALALQQPEGKFVLRIEDTDAARNRPEWTEGILRALSALGIDERDPHFEGPYFQSAYADKHREVAEELYRKGRAYYCDCTREQIQERRGNPHLGYDGYCRDRGLEPGPGRALRFRVPEGGPTVVDDKIRGRVEFDHSAIEDFVIARSDGSPLFVLANVVDDVEMAITHVVRGEEHLSNTPKQQLLWEALGQTPPVWAHLPVIVNEKRQKLSKRRDKVALEDYLAEGYLPEAMVNYLMLLGWGPGDDREIMPFSEMVPLFRLEDVNSSSAFFDEKKLRAFNGEYIRALDTTEFVERCAPWLGSEKAPWPAENFDAQVFEAVAPLAQTRISVLSEIVSYVDFLFLDRPVEDEKSWAKAMKPGVGEEMLTAALERFSDPNLEWRAEPLKAALEEVAAAQGLKLGKAQAPVRVAVTGRTVGLPLFESLELLGRSRVQERLRAALEKLKA

SEQ ID NO: 8162 - protein, 388 aa, Thermobifida fusca
ERIIVVDGARTPVGSFGGAFKDVPAHELGAVAARAALQRSGIAASDIDEVVMGCIGQVGPDAYNARRVAIAAGLPESVPAYTVNRLCGSGLQAVWSGAMQIRWGAADIVLAGGDENMSRMPFYDFGARSGYRLGDRTLVDGTVAMLTDPFSNVHMGCTAEAVARKYGVSRAEQDEFALESQRRAAADAARAAFAEEITPVEVGGRKPVVVEVDEHPRPDTTLEGLARLRPVFEKDGTVTAGNASGINDGAAALVLARESVVRERGLKGLAVVESVATAAMDPQLMGYAPVLALRKLFEQTGTSPAVVDVVELNEAFAAQAVAVIRDAGLDPEKTNPYGGAIALGHPVGATGAILTLRVARDLVRRDLELGVVTMCIGGGQALAALLRR

SEQ ID NO: 8163 - protein, 404 aa, Thermobifida fusca
ARPSAAGGQGRMDSDGSPRPGKAAMERTLFEPAHVEFRDAVREFLRRHAVPHYARWEAEGIVDRELWRQAGRAGFLGTAIPAAYGGGGEPDFRYNAILTEECARAGMLSLSSGFGVHNDVVTPYLLSLASEEQKQRWLPGLCSGDLVTAIAMTEPGAGSDLKAVRTTAVRDGDSYVLNGTKTFITNGIHADLVIVVAKTDPSAQARGISLVVVERGMPGFRRGRNLAKVGLHAQDTAELVFEDVRVPAANLLGEENQGFGYLMRNLPQERLSIAVIAVAAARAAVEWTIRYCRERTAFGQEIGRFQHNKFQLAEMATEVDIAQTYVDRAVLAHNAGRLSPVDAAKAKWWTTELLKRTADTCLQLHGGYGYMDEYPISRLWRDARVHTIFGGTTEIMKEIIGRDL

SEQ ID NO: 8164 - protein, 371 aa, Thermobifida fusca
ADAVERDRAGQTPYAEVQLLKDSGLVTLLGPVEYGGGGQTWETAYRVTREVSKADGSIGQLLGYHYLWSWAVRFLGTPQQIAAVEELATTNRYFFGGAVNPRDDDLVITEDGDTLVFNGRKTFSTGSKVSDLTVLEGVLEGTDQHIFAIVPSAQDGIVFADDWDNIGQRLTESGSVRITNVRISWDDAAGYVNREFRPLVYNTLNLPAIQLVFTNLYLGIAQGALETAAAYTRSTTRPWPYGGDNKESAVDEWYILEAYGDLQSKLWSVEALTDQVGTQLSQILHGDREAVTARQRGEIAVRVAAAKQRAIDVGLEVTSRIFEVTGARATASSVGLDRFWRNLRTHSLHDPVAYKRREVGRYTLLNEIPEP

SEQ ID NO: 8165 - protein, 327 aa, Thermobifida fusca
IPAPVAGPGQVVLEVTAAGLCHSDLAVMSRPPEALPYKLPITLGHEAVGVVVDVGAGISGLAEGDTVAVYGPHGCGACRTCRSGAENHCPHARAAGILPPGLGADGALADYLLVPHSRHLVPLRGLDPVRAAPLTDAGLTSYHAVRSALPRLPPDGTALLIGIGGLGHLAVQILRALSSAQIIAVDMAADKRELALRCGADTALPSTDTVPDQVRDLTEGVGADVVFDFVASDATLRMAARSLRPGGEISIVGVGEGRLPVAVNLVPLGAVVRTPYWGTQSDLVDVLALAREGRITVEVEEYALEETPLAYERLARGNVRGRAVVNP

SEQ ID NO: 8166 - protein, 254 aa, Thermobifida fusca
LTDKRVLVTGAGGGIGREIAVEAARQGAAWVTVADLNPAAAAETAEMVAGVGARAHAVAVDLADSAQVRRMVEEAVAAGGGLDTLVNNAGVLDSAFTDTPTVEELPEEAWDRVYAVNVKAVWLATKFAAPHLRASERGPSVVNAASVAGMTGYGSPAYASSKGAVIQLTRSMAIALSPQVRCNAYCPGSIETPMSRAHLEASEDREARLRSMIGAHLIPRFGRPSEVAKVVCFLASDDASFVTGGIFPVDGGTT

SEQ ID NO: 8167 - protein, 254 aa, Thermobifida fusca
MTQRLRGRVAAITGGASGIGEATVRRFHTEGASVVIADIQAEAGRRLADELGDRAVFVRTDVSEEADVAALVDTAVDRFGQLDIMVNNAGIMGALGPIDATRMSDADLTIAVNLRGVICGMKHAARVMKPRRSGVIISTSSPAGVLGGIGPHIYSAVKVGIIGLSNSVAAELRQHGIRVNTIIPGSVVSPMTAGIVVDDAHNLAGAQEVLGRTALLGRPIQPADVAAGILYLASDDAAFVTGAVLPVDAGLTGA

SEQ ID NO: 8168 - protein, 475 aa, Thermobifida fusca
LFIGGRWVDSKGGRKVDVHNPATGAYVGSTVLASTADIDAAVASARASFNSGVWANTPPEERAAVLHRAADLLEERAPELAKLITSELGCPIWFSERAHVPNPIRHLRYYGTLAKDFAYDERRSDGTNTSLVTQVPVGVVAAITPWNGPLSTPSLKVAPALAAGCSVILKPPPETPLTAYNLADALSQAGLPDGVLNIVPADREEGAYLVSHPDVDKVAFTGSSAAGKKIMAACAERIARVTLELGGKSAAIILDDADVDTVVPALLPMAFMVNGQACIAQTRLLVPRSRKDEFIDAFAQAVAAQRVGDPIDPATQIGPMVSRRQQERVEGYIATGRQEGARVVVGGERPSLPSELAGGWFVAPTLLAEVHNSMRVAQEEIFGPVLAVIEYDGDDEAVAIANDSVYGLSGSVWSSDEERALAIARRMRTGMVSINGRPQAANSPFGGFKQSGIGREMGPEGFHAYLETMSIAVGS

SEQ ID NO: 8169 - protein, 378 aa, Thermobifida fusca
AERFRAEVRALLAEHRTVDEHGREEYDREGLRAAMAERGLFSLGWPEELGGRRAGVAERAVLNEEMKYACGPVDRAMSATMLLGHSILRHGTPQQQAEFLPLIRRGELRFCLGYSEPEAGSDLASLRTRAVRDGDHWVINGQKVWTTRAHTASHVWLAVRTDPDAVPRHAGITIFLVPMDTPGITVQQHTALSGEVSCTVFYDNVRVPDSMRVGEVNGGWRVITDALAAERVVMGGVAATLLRQLDDLLGYLRADPQRLLGAEDSAARDRLEGLAARLQATRALVLEATRAMAEGKASDLAAPMAGVLGGELAEDFGQGVLELLGPEAALGAEVPGVPGHGVFERALRTSPMFVIGGGTNDIQRAIIARGLGLPREER

SEQ ID NO: 8170 - protein, 252 aa, Thermobifida fusca
RLTDKIALITGAGSGFGRASALRFAAEGASVVCVDRNADAAHSAADDIAAAGGTALALTADVSSAADAERMTTTTLEHFGRIDIVFANAGIPGSGDAHTTTEEEWDRVIAINLKGVWLTSKYALPHMVERRSGVITNQASVGGLIGIPGIFPYAAAKGGVISMTRQMAAAYAPHNIRVNAICPGGVYTPLVELSRQKRGLTASSVEEANAIAARNYPLGRLGTVEEIASLALFLASDEAAWITGGIYPVDGG

SEQ ID NO: 8171 - protein, 318 aa, Thermobifida fusca
MIHASALTKHFTTRKRTVEAVRGIDLNVEAGEMVAILGPNGAGKSTTLRMLTTLLLPTSGTAQVAGADIRTQPRQVRSRIGYVGQGTGSGYNQRGRDELISQGRAYGMSTDQARRRAEELIASLDLSNVADRRSSSLSGGQKRRLDIALGLMHTPPLLFLDEPSTGLDPQNRANLHEHIRELRSRHDTTIVFTTHYLDEADQLAERVVVIDHGTIIADDTPERLKAEYAGDRITLTFDRADDAKRAFGHLMARAESARGTHDGVRVVLEVDGGSRLAPALLRELEEADLPVAAVEIARPTLDDVFLNLTGRSLRDAAA

SEQ ID NO: 8172 - protein, 540 aa, Thermobifida fusca
SFADLGLRPELLDALAEVGYEEPTAIQREAIPSLLEGRDLLGQAATGTGKTAAFSLPILHRLPDSDRGDTPSALILVPTRELALQVSEALHRYGRHLKARILPIYGGQPIGRQLRALERGVDVVVATPGRALDHIGRGTLVLDTVRTVVLDEADEMLDMGFAEDIEAIIEEVPENRQTVLFSATMPDRIEGIARRHLTDPVRVRIARTSPAPGEEPKVRQNAYIVARPYKPAALGRVLDMESPTAALVFCRTREEVDQLTETLNARGYRAEALHGGMSQEQRDRVMARLRGGTADLLIATDVAARGLDIEHLTHVVNYNVPSATETYVHRIGRVGRAGREGVAITLVEPREHRMLKTIQRSTSGPISVEKLPTVADLRARRVELTRAALHEALKEEDDDREAFRVVVESLAEEFDIMEIALAAVKLAHEASGAVTEEEEIPEPVLRPERSERRERRGRRGGPGRGERRGRGPSDGMTRLFVGIGRNARVRPQDLVGAIAGETALSGRDIGAIEIADRFSLVEVPESTADGVIAALKKSTI

SEQ ID NO: 8173 - protein, 174 aa, Thermobifida fusca
TDVSTLIDRYVRDIPDYPQPGVVFKDITPLLSHPTALRTAIDALAEPLLGSEIDLVAGLEARGFIFAAPVAVRLGAGFVPLRKAGKLPAETLAESYDLEYGTATVEMHADAVPPGSRVLIVDDVLATGGTGRAAVDLIRRAGGTVVGLSVLLELGFLKGREKLADVELRALATV

SEQ ID NO: 8174 - protein, 174 aa, Thermobifida fusca
  unsure (1)..(174): unsure at all Xaa locations
MGVSGSGKTTVARGVAQELGLPFADADDFHPEANIAKMARGIPLTDEDRLPWLQALAAWISEREREGTSSVVTCSALRRSYRDLLRRSAPGVFFLHLHGSAELIGKRIRERRGHFMPPQLLDSQFATLEPLAPDEAGAVLDVSASPEDLIAEAVRIVTGLRNAQAXQSRRRSDR

SEQ ID NO: 8175 - protein, 448 aa, Thermobifida fusca
YRIERDSMGEVKVPVEAKWRAQTQRAVENFPISGQGLEAAHIAALGHIKAAAAKVNAELGVIKEDMAEAIREAALEVAAGKWNDQFPVDVFQTGSGTSSNMNANEVIATLATERLGQPVHPNDHVNASQSSNDVFPSSIHIAATSALINELIPALKHLEETLSAKASEFATVVKSGRTHLMDATPVTLGQEFDGYAAQVRYGIERIEASLPRVAELPLGGTAVGTGINTPEGFSAKVIAEIARATGLPLTKARNHFEAQGARDALVELSGQLRTIAVSFCKIANDIRWMGSGPRTGLSEIFLPDLQPGSSIMPGKVNPVLCESMLQVASQVVGNDAAVAFGGSTGNFELNVQLPLIARNVLESIRLLANISRVFADRCVAGITANEERCREYAESSPSIVTPLNRYIGYEEAAKVAKQALAERKTIRQVVIERGYIAQGKLTEAQLDE

SEQ ID NO: 8176 - protein, 301 aa, Thermobifida fusca
SPPAISLRGVVKRFGDITAVNGLDLDVPQGVVLGLLGPNGAGKSTTMRILTAQSTVDEGHVSVLGHPIPQKSKWARSLMGVVPQHDNLDEELTVEENLRSFTYLYRVPRRERDAAVERALRIAHLEHRRHEFTEKLSGGMRRRLLIARGLVHRPRVLLLDEPTVGLDPQVRQELWGLISALRDEGVTVLMSTHYIEEAERLSDEVALMAKGRIVERGEPADLIAKYAGKTVEEYQIGAEGVEELEKVIHHAGFTTRRTGSTLSVLRAEELPDSLRDRLGTGMRRASNLEDVFVTLTGETVE

SEQ ID NO: 8177 - protein, 664 aa, Thermobifida fusca
QISPDGQRVAFLRSRDGTDTATCLWVAEPDGTERIIADPRTIGDTGEDLPPEERARRERLRESGSGIVSYSVDKAFTRAVFSLSGRLYSVELDGSGTPRELPAASPAIDPVLDPTGRLVAYVHKGAIHVLDLADGLDRVVAAPDGKNITWGLAEFIAAEEMGRHRGMWWSPDGTFLLATRVDTTPVRRWHISDPGNPEAVPQTVAYPAAGTDNAEVRLAVLRADNTGEPVWVEWDRDAFPYLVTAGWTQRLKGTSTIVFTVQDRAQRTLRACTADPLTGHLHELWTETSDTWVEIMPGVPEFDASGAALRFGVDSSGERALYLGDRMVNSPGQYVRAVLDVDGCCVLYSASPLGEPHIVRLWLYDSRTDTRTEMSFPGADGPSGVHSGLLRGDTLVIQRRDLSSPGVRTAIVRGVHEEQSVTEVESRAERPDLPGVHVQLQRLGEREIPAALVLPSWYTPDSDPLPVLLDPYGGPHAQRVLCAQSAYLTAQWFAEQGFAVLIADGRGTPGIGLAWEQAIHRNMAETVLEDQVAALHAAPEAFGVRLDLTKVGIRGWSFGGYLAALAVLRRPDVFHAAVAGAPVTDWRLYDTHYTERYLGHPDDDPECYERESLLVDAPKLQRPLLLIHGLADDNVVFAHTQRLSSALLAAGRPHTVLPLSGATH

SEQ ID NO: 8178 - protein, 436 aa, Thermobifida fusca
TFRDLGVIDDIADALEAEGIVAPFPIQSMALPLALTGADIIGQARTGTGKTFAFGLPLLQRVHTQPGSAKRPRALVVVPTRELAIQVAADLATASKRIDVRIATVYGGRAYEPQISALRKGVDIVVGTPGRLLDLVKQRHLILSEVTALVLDEADKMLDLGFLPDIERILAKTPDQRQTMLFSATMPSEIVALSRKYLRRPTHIRAEDDPLDTGSGQVTQHVFRTHPLDKLEMLARLLQARNRGLTMVFCQTKRECHHVSTELCRRGFAAAAVHGDLGQGQRERALRAFRNGKVDVLVATDVAARGIDVDDVTHVVNYECPDDEKTYTHRIGRTGRAGRSGTAVTFIDWQELLRWKLINRALGLPFADPPETYSTSPALLRRSRHSAGRQGSARQGGAGPGRSGSGRSRGHSGRPGGPPAPRTGSVRGSRRSRPRK

SEQ ID NO: 8179 - protein, 350 aa, Thermobifida fusca
LASATAAQTDLDRRVPPETIDLLTDAGFFRWSVPADYGGAAGSFTDLARHVVHLSRHCPSTGWLASLFGHSGRYVACLPEEGRKEVWGSSPDVRIVSVVKPLGRATRVAGGWRLSGRWTYASGVEYSDWALLAGPAQGPGSDGGPPRFFAVPRSDYTYEDTWHTLGMRGTGSHDIVIDDAFVPDHRTCLREDAMQGRTAEGDRRYAPTRAVNGLTFVTPALGAALGALDAALPLLKGPAAGPRAASHQAYQIAYARAAGQIDAARLLLDRVAETADAGRFTPELVQRSRRDSALALEMLTSAVDALARTGGTRGQADSHPLQRYWRDVRSVSGHAVMQFEQAGLAYTQSL

SEQ ID NO: 8180 - protein, 321 aa, Thermobifida fusca
APPVALLLPGQGAQYRRMGAALHGYDRVFTEVMDEFLELLGADGERLRELWLTGEPADGVHDGLNAQPLLFGVAYAAAKSLEHRGLRPAVLLGHSIGELCAATLAGVWDLPAAARILAARSSSLGKAPRGGMLAVAAAPDTVEPLIPAECARAGVAVGAVNGAAQTVLAGPEAELAATDAVLKAKGMTTRAVRTAQPFHSPAMAEAARVFQEAIAAEQRNSPAIPLVSSLTAEPVTEQQALDPGFWASQMSRPVLFWPALQALDRRGAHTYVEVGPGKGLAAAARRLPTVLEGSSRVVSTLPSERGDTVATWESALAALAS

SEQ ID NO: 8181 - protein, 449 aa, Thermobifida fusca
RVLIANRGEIAVRIAHACREAGLVSIAVYADADRDALHVRAADEAYALHGETAADTYLNISKLLAVAAASKADAVHPGYGFLAENAAFAQAVREAGLTWIGPSAETIALLADKVAARRIACDVGVPVMPGTGRPVTTAAEVADFARSHGYPVAVKAAHGGGGRGMRIVHDTRQIPELLEAAVREAASAFGRGDCFVERYVARPRHVETQCLADAHGNVAVLSTRDCSIQRRHQKLVEEAPAPGLTPHQWELLREGSAAILRTTGYVGAATCEFLLAEDGTLSFLEVNTRLQVEHPVTEEVTGVDLVQEMLRIADGQRLERTDFPVHGHAVEFRITAEDPHRGFAPVAGRLDQLVFPTGPGIRVDTGYQQGDTVPPHFDSLIAKLIVRGDTRAHALARARRALADVTVAGVPTLLPFHRALLDTPEFTADVPRIHTRWVETSFPFHLLEE

SEQ ID NO: 8182 - protein, 256 aa, Thermobifida fusca
RTAIVTGATSGIGLAVARELANRGHRVFICARNGERVAETAKQLSDNGNLPVDGQACDVRSLDDIRAMVRAAVERFGTIGILVNNAGRGGGGVTADIPDDLWDDVLATNLTSVFRVTREVLTTGGMREASWGRIINIASTAGKQGVVLGAPYSASKHGVVGFTKALGNELAPTGITVNAVCPGYVETPMAEAVRQRYAQAWQISEDEVLAKFQAKIPLGRYSTPEEVAGLVGYLTTETAASITSQALNVCGGLGNF

SEQ ID NO: 8183 - protein, 395 aa, Thermobifida fusca
VVTGLGVIAPTGLGVDDYWKATLEGRNGIAPITKFDASGYPSSLAGQVVGFHAADHLPGRLLPQTDHMTRMALAAAQWAWDDAGLDPAQLPEFSAGVVTASSSGGYEFGERELRNLWAKGASYVSAYQSFAWFYAVNTGQISIRHQMRGPTGVLVSDQAGGADAIAHARRQIRKGARVMLAGGVDSSLCSWGWIAHLASGRVSTADDPRRAYLPFSADARGHVPGEGGALLVLEEETAARARGARIYGVVAGHAATLDPPPGSGRPSTLEAALRGALADADVHPDEVDVVFCDGAAIPELDRIEAAAINAVFGEGAVPVTVPKTMTGRLFSGAVALDAAAALLSIRDGVIPPTINATAAPDLGLDLVTETPRSLPVRIALIVARGIGGFNSALVL

SEQ ID NO: 8184 - protein, 415 aa, Thermobifida fusca
RRVVITGIGVIAPGGIGTQAFWNLLTEGRTATRPISLFDASVFRSRIAAEVDFHPEEHGLTAQQARTMDRAAQFAVVATREAMADSGLTIDRPDRVGVVVGSAVGASTSLENQYRLSSDDGQLDPVRYDPAVTDLYRHFVPSSFATDVAWEVGAEGPATVVSTGCTSGLDSVGYAADLVREGIVDAVVVGSTDAPLTPITSACFDAIKATSPRNDTPATASRPFDRTRNGFVLGEGCAMFVIEEREHARARGARIYGELAGYATRSNAYHMTGLRADGHEMAEAIRVALHEARVNPDDIDYINAHGSGTKQNDRHETAAFKKALGSHAYRTPVSSIKSMIGHSLGAIGSIEIAACLLAMRDNIVPPTANLTEPDPECDLDYVPITAREHRVDTVLTVGSGFGGFQSAMVLTTADR

SEQ ID NO: 8185 - protein, 281 aa, Thermobifida fusca
LLRIAVPNKGQLSEPAIAMLREAGYRQRKDSRDLVLLDPDNGAEFFFLRPKDIAVYVGEGILHVGITGRDMLIDSGAPVEEVLALGFGNSTFRFAARNGSSMTVEDLAGKRIATSYEGLLTSYLKKRGIEARVIHLDGAVESSIQLGVADAVADVVSTGTTLRQAGLEPFGEPILESEAVVIRRKGEPDDPKVEQLLRRLRGVLVARDYVMMDYDVHAEHLEEAIALTPGMEGPTVSPLHREGWVAVRAMVPRRDAQRIMDDLWEIGARAILVTDIYACRL

SEQ ID NO: 8186 - protein, 264 aa, Thermobifida fusca
  unsure (1)..(264): unsure at all Xaa locations
TALITGASTGIGEEYARXLAERGYSLVLVARSADRLAALAAELTDRYGVPAQCLPADLTDDKDLATVEERLRVTGDTADAPIDLLVNNAGQAHGGDFATIPVSAIEDTLALNIRALTRLAHAVLPVQIERARQLREAGSSRPLGMINVASMAGLLPAAPGGAVYSASKAYVLSLTDTLAVEAARHGVRVTAVLPGYVRTDMTRSLQEKGAPDIAFVPRERVVTDSLRGWASGRTRVVPGAQYKAVNALLHALPPGLFHAVAKRT

SEQ ID NO: 8187 - protein, 362 aa, Thermobifida fusca
RQVSDSTVREEPELIQLLTPDGEYVPHPDYPFEPATAQVRDLYRDLVLVRRLDAEAVALQRQGELGLWASLLGQEAAQIGSARALEPQDMAFPSYREHGVAWCRGVRPRDLLAMFRGVTNGGWDPYEHNFHLYTIVIGSQTLHATGYAMGVQRDGALGEDGTAVITYFGDGATSQGDTNEAFNYAAVNNAPVVFFCQNNQWAISEPNDRQSKAPIYQRAAGFGFPGIRVDGNDVFACLAVTRKALQHAREGQGPTLIEAFTYRMGAHTTSDDPTRYRTSAEIEEWRRKDPIARLRAYLVREGKADDGFFDAVEAEAEKLGEQVRAECRALPDPAPLDIFREVYAEPHRELDRQRAEFADYLA

SEQ ID NO: 8188 - protein, 320 aa, Thermobifida fusca
LTLGKAINAGLRRAMENDPKVLVMGEDVGRLGGVFRVTDGLYKDFGADRVIDTPLAESGIIGTAIGLALRGYRPVCEIQFDGFFFPAADQTFTQLAKLRARSEGRLSLPVVIRIPYGGGIGAVEHHSESPEAYFTHTAGLRVVTVATPEDAYWMIQQAIACPDPVVFLEPKRRYWDKAPVRTDGSVDTATPMGEARIVRPGTDVTLVAYGPMVKVALHAAEADTERSIEVIDLRSLSPVDYDTVYESVRRTGRLVVTHEAPVTSGLGAEIAARVTEACFYHLEAPVIRVGGFDTPYPPSRLEEYYLPDLDRVLDGVDRTF

SEQ ID NO: 8189 - protein, 445 aa, Thermobifida fusca
MTHQGIQQFVLPDVGEGLTEAEILTWHVQPGDQVDVNQVICEIETAKAVVELPSPFAGRVEALLVEAGETVPVGTPIIAVDTGGAAGEPRPEPAPAAAPAEPPAEEKREPVLVGYGVKSGATKRRARRRTPSAVPAQTVGQRTVVLAKPPVRKLAKDLGVDLRTVVPSGPNGVITRDDVRRHAEQNQPQPSAPRVPEPAAPAPAASPAPERDVREERIPVKGVLKHMAAAMVDSAFTAPHVTEFLQVDVTKTVKVVQKLRQRPEFADVKVSPLLLVARALLIAVRRHPRINASWDEANQEVVVKHYVNLGIAAATDRGLVVPNIKEADRLPLPDLARALTDLTEKARAGQTAPADLTGGTITITNIGVFGIDGGTPILNRGEAAILALGQIRDMPWVHKGKIKIRKVTTLSLSFDHRLVDGELGSKVLRDVATILEDPEEMVLAW

SEQ ID NO: 8190 - protein, 170 aa, Thermobifida fusca
RRAVLEGPEISRALTRIAHEILERTKGGHDLTLLGIRTGGVPLAQRLAERIERVEQRPVPWGALDITMYRDDLRLAPARALGSTDIPPEGVDGRTVVLVDDVLFSGRTVRAALDALNDLGRPRAVQLAVLVDRGHRELPIRADYVGKNLPTSLRESVTVLLEELHGRDAV

SEQ ID NO: 8191 - protein, 309 aa, Thermobifida fusca
QHLLSAGDLTRDEALLILDTARELSQVSERSVKKLPTLRGRTVVNLFYEDSTRTRISFEAAAKRMSADVINFSARGSSVSKGESLKDTALTLQAMGADGVVIRHSAPGAARRLADWVDGVVINAGDGTHEHPTQALLDAYTMRERLGRVEGLRVAIVGDIRHSRVARSNVLLLTTLGAEVTLVAPPTLLPVSVDTWPCAVSYDLDEVLPKSDVVMMLRVQAERMHSSFFPSAREYSRRYGLDADRLARMADHAIVMHPGPMVRGMEISAEVADSARSTVTEQVTNGVSVRMAVLYLLLGGAIHRPGNQG

SEQ ID NO: 8192 - protein, 367 aa, Thermobifida fusca
AILVLEDGRVFHGVSFGAEGETFGEIVFHTGMTGYQEVLTDPSYHRQIVVMTAPHIGNTGVNDDDAESHRIWVSGYVVREPSRIVSNWRAQRTLEEELRRQGVVGIALSGTRALTRHLRDKGVMRAAISTVETDPDKLRERVLASPQMVGANLAGEVTTAEPYTVRPPDGVPVRFTVAAVDLGIKAMTPQRLAERGCEVRVLPAHTTAEQILALNPDGVFFSNGPGDPAAADAVVETMRGILDAGTPLLGICFGNQILGRALGLETYKLPFGHRGANHPVRETRTGRVYITSQNHGFAVRAPLDGPFDTPYGRAEVSYIGLNDGVVEGLRLLDRPALSTQFHPEAASGPHDAADVFDTFVEMMTAHR

SEQ ID NO: 8193 - protein, 1090 aa, Thermobifida fusca
MPRRTDLSSVLVIGSGPIVIGQACEFDYSGTQACRVLKAEGLRVILVNSNPATIMTDPEFADATYVEPITPEMVEKIIAKERPDALLPTLGGQTALNTAVALHEAGVLDKYGVELIGANIDAIQAGEDRDSFKRVVERVGGESARSVICHSIEECLAAAEELNYPVVVRPSFTLGGAGSGFAHNEEELRRIAGQGLALSPTTEVLLEESILGWKEYELELMRDANDNVIVVCSIENLDPMGVHTGDSITVAPAMTLTDREYQRLRDLGIAIIREVGVDTGGCNIQFAVHPETGRTIVIEMNPRVSRSSALASKATGFPIAKIAAKLAVGYTLDEITNDITAKTLASFEPTLDYVVVKVPRFAFEKFPGADSGLTTTMKSVGEVMAIGRSFPEALQKAMRSLEKKGSSFTWTGDPGDKEELLRAVRTPSEHRLRQVQQALRAGATVAELHEATKIDPWFLDQILRLDEKARELAAAPRLDADLLRSAKQLGFSDAQIGEITGRSEEVVRELRDALDVHPVYLAVDTCAAEFPATTPYLYSSYDEETEVPPSSKPKVIILGSGPNRIGQGVEFDYSCVHASFALSEAGYETVMVNCNPETVSTDYDTSDRLYFEPLTLEDVLEVVRAEQQTGEVVGVIVQLGGQTPLGLAKKLKEAGVPIVGTSPEAIDLAEDRGEFGRVLAKAGLPAPKHGTAQSFDEARAIAEEIGYPVLVRPSYVLGGRGMEIVYNEAMLADYIERNAEVSAEHPVLVDRFLDEAIEIDVDALYDGTELYLGGVMEHIEEAGIHSGDSACALPAITLGQEDIERIRYSTEAIAAGVGVRGLINVQYALSAGELYVLEANPRASRTVPFVSKATAVPLAKAAARIMLGATIQELRDEGLLPRHGDGGTLPPDAPVAVKEAVLPFNRFIDRHGQGVDTVLGPEMRSTGEVMGLDVDFGTAFAKSQLATYGTFPTSGTVFVSVANRDKRTMIFPVRRLADLGFEILATEGTALALRRHGVQARVVRKHSEGPGPDGEPTIVQRIHNGEVDLIVNTPFGGPGQSGPRLDGYEIRTAAVARGVPSVTTVQGLAAAVQAIESLVNGRIQVRSLQE

SEQ ID NO: 8194 - protein, 299 aa, Thermobifida fusca
LRVRLGELELANPVVTAAGCAGAGRELARFFDIARIGAVVTKSVTVEPRAGWPAPRIAETPSGVLSTVGLQGPGIDVFVQRDLPWLLSRGARAVVSVAGGSVDEYVTLAQRLSEAPGVTAIEVNLSSPDLSRGGEHFTADPEAAAQVVAAVRETARSDIPVFAKLSPDVADLVALAGKCVAAGADGLALVNTVRGMVIDVDTMRPAVAGGMGGLSGPAIRPIAVACVYQVHAAYPEVPIIGMGGIGTGRDALEFLLAGASAVAVGTALFHDPSACMRVLRELERELIDRGVERVESLIG

SEQ ID NO: 8195 - protein, 396 aa, Thermobifida fusca
VSRRLFTSESVTEGHPDKIADQISDAILDSMLRDDPHSRVAVETLITTGLVHVAGEVTTSTYVDIPTIIREKILEIGYDSSAKGFDGASCGVSVSIGGQSPDIAQGVDNAYEAREEEIFDDLDRQGAGDQGLMFGYANNETPELMPLPITLAHALSQRLAEVRRDGTIPYLRPDGKTQVTVEYDGNRPVRLDTVVVSSQHAPDIDLRELLTPDIKEHVVDPVVARYNLEADNYRLLVNPTGRFEIGGPMGDAGLTGRKIIVDTYGGYARHGGGAFSGKDPSKVDRSAAYATRWVAKNIVAAGLADRVEVQVAYAIGKAHPVGVFLETFGTEKVAPEQLEKAVLEVFDLRPAAIIRDLDLLRPIYSQTSVYGHFGRELPDFTWERTDRVDALKAAVG

SEQ ID NO: 8196 - protein, 390 aa, Thermobifida fusca
PAAPDPLDFLAVDSSLSAEERAVRDTVREFGRRELLPHVAEWFAAGTIPDPHGLARKFGQLGLLGMHLDGYGCPGAGAVAYGLACRELEAVDSGLRSFVSVQGSLAMTAIHRYGSEEQKQQWLPRMAAGEAIGCFGLTEPDSGSDPGAMRTRARRVGADWVLTGTKMWITNGSVADVAVVWAGTEEGIRGFLVPAGTPGFTATVIERKLSLRASITAALSLDEVRLPDSARLPLAAGLRAPLSCLTEARYGIVWGAAGAARACYEAALEYATSREQFGQPIAAFQLTQRKLAEMVVDVNQASLTALHLGRLKEAGACHHYQVSFGKLANVAAAQRVAAKARSVHGANGITLDYPVLRHLLNLETVATYEGTEEIHTLSLGQAVTGISAFR

SEQ ID NO: 8197 - protein, 393 aa, Thermobifida fusca
MLRWLTAGESHGPALVAILEGLPAGVSVTSDDIAAALLRRRAGYGRGARMKFEKDEVSIIGGIRHGRTLGGPVAIQVGNTEWPKWQKVMSPDPVPAEELEGVARNAPLTRPRPGHADLVGMQKYGYDEARPILERASARETAARVALGEVARQFLRQALGVEIVSHVVAMGSVSVPDDAPIPAPEDLARVDADPVRCFDPETSARMVAEVDDTRKTGDTLGGVVEVIAYGLPPGLGSHVHWDRRLDARLAGALMGIQAIKGVEFGDGFRTAARRGSAAHDEIDVGPDGIRRRSNRAGGVEGGMSTGDPLRVRAAMKPIATVPRALDTIDVSTGQPAQAHHQRSDVTAVPAAGVVAEAMVALVLADAALEKFGGDSVAETVRNLRGYLDSLIVR

SEQ ID NO: 8198 - protein, 344 aa, Thermobifida fusca
PYDVVVGNGILGELPALVGERAQRVAVIHPDTLEEKARPVCEILRTAGYDVFPLPVPDGEAAKDVSVAADLWARLGQAAFTRTDVIVGVGGGATTDLAGFVAATWLRGVRAILVPTTLLGMVDAAVGGKTGINTAEGKNLVGAFHPPAGVVCDLDTLPSLPREDYIGGLAEVIKAGFIADPVILDLVEADPEAATRPDGAHTRELIERAIAVKAEVVSADLRESGRREILNYGHTLGHAIERAENYTFRHGYAISIGMVFAAELARLDGRIDAALVARHRRILESVGLPVRYRADAWPALRDTIRVDKKTRGATLRFVVLDDVAAPAILAGPSDALLAQAYQAV

SEQ ID NO: 8199 - protein, 266 aa, Thermobifida fusca
EEPEQIGGHRIVERIGTGGAAAVYAALDSAGHWVAVKVLHPMVAANTTCRNRFAREVALLREVADTYTAPLLDADIHTERPWLAMRYIAGPTVGRRVDAEGPLMGVELLEFAAGLAEAVAALHRAGIVHRDLKPGNVLLAGDGPKIIDFGIARRTSETGDADSGKILGSPGWISPEQFHHRVPGPAADVFAWGGLVAYAATGRRPFGSGTLRQTVERVLHGEADLRGTPSLLLPWVQAALDTDPDRRPAAAELAAAIGALRDGHQP

SEQ ID NO: 8200 - protein, 427 aa, Thermobifida fusca
VISRIDLRGNPADPRASLPRAEIDVASAVEKVRPICEDVRHRGVEALIELGERFDGVRPAHIRVPADALETALAGLDRTVRAALEEAIRRARIVHRDQRRTDTTTRVVPGGTVTERWVPVDRVGLYVPGGRAVYPSSVVMNVVPAQEAGVPSLAVASPPQAEFGGLPHPTILAACALLGVDEVYAVGGAQAIAMFAYGAGECAPVSMVTGPGNIWVAAAKRLLKGIIGIDSEAGPTEIAILADDTANPAYVAADLISQAEHDVVAASVLVTPSTALADRVEAELARQVPAAKHRERITQALGGPQSGIVLVDDIDHGLDVVNAYAPEHLEVMTADAQSVAARVRNAGAIFIGDHSPVSLGDYCAGSNHVLPTGGVAVHSSGLSVQSFLRGIHVVEYDRAALAEVAHHVVALAEAEDLPAHGAAVTAR

SEQ ID NO: 8201 - protein, 352 aa, Thermobifida fusca
FSIDDLPLRDDLRGQAPYGAPQLTVKAVLNTNENPYPPSPELVEAIGRAAAEAAVGLNRYPDREATALRQALADYLGHGVDAANVWAANGSNEILQQILQAFGGPGHKALGFEPSYSMHPIIARGTATEWVSVPRTADFDVDADAAVAAVKEHEPSVVFLTSPNNPTGTALPLATVEAIAAAAPGVVVVDEAYAEFRREGTPSALSLLRTYPNVIVSRTMSKAFAMAGVRLGYLAAHPAVVDALQLVRLPYHLSTVTQAVALTALRYADELLSAVATLRAERDALVDWLRAHGFEVADSDANFVLFGRFPDRSAVFQHLLDQGVLIREVGPPEWLRVTVGTPEEMAIFREAL

SEQ ID NO: 8202 - protein, 197 aa, Thermobifida fusca
MSRIGRVERATNETKVFVEVNLDGTGAADISTGVGFYDHMLHQIAKHGLFDLTVRTEGDLHIDAHHTMEDTALALGAAFREALGDRSGIRRFADAKVPLDEALAEVTVDISGRPYLVHSEPEGMAPMIGRDYDTTMTRHIFESFVAQARITLHVHVPYGRIPHHIVECQFKAVARALRSACERDPRVTGVPSTKGTL

SEQ ID NO: 8203 - protein, 256 aa, Thermobifida fusca
MSLAVRVIPCLDVDGGRVVKGVNFQNLRDAGDPVELARRYDAEGADELTFLDVTASSSNRETTYDVVRRTAEQVFIPLTVGGGVRSTEDVDRLLRAGADKVSINTAAVRRPELIREIAQEFGSQVLVLSADVRRTVNGTATPSGFEITTHGGRQGTGIDAVEWVQQAEELGAGEILLNSMDADGTKSGFDLELIRAVRKAVNVPLIASGGAGAVEHFAPAVDAGANAVLAASVFHFGEITISDVKAELRAKGYPVR

SEQ ID NO: 8204 - protein, 762 aa, Thermobifida fusca
SRAPQEDPRQDTPAISAPTRSAAGIPAVINSLRVVSRQSGAARGLATLRDVNQKTGFDCPGCAWPEGKRRHLAEFCENGAKAVAEEATRRAVTPEFFARYSVAELATRSGYWLGQQGRLTHPVFLDKGATHYVPVSWERAFSLIAEELAALDSPDEAVFYTSGRTSNEAAFLYQLFARKFGTNNLPDCSNMCHESSGVALTETLGVGKGSVLLEDLYQADLIIVAGQNPGTNHPRMLSALEKAKRGGTRIITVNPLPEVGLMRFKNPQKARGIVGGGTRLTDLFLQIRLGGDLALFRAWNRMLVEADRDNSGSVLDREFIAEHTHGFDAFVDELCADSDEKFWADVDTATGLPREQITEALEMIQASKRIVVCWAMGLTQHKHSVPTIREVVNFLLLRGNVGRPGAGVCPVRGHSNVQGDRTVGIVEKPKEEFLDALGAEFGFEPPRHHGYDTVRAIRAMRDGKVGVFFAMGGNFVSASPDTLVTEDAMRRCRLTVHVSTKLNRSHVVTGARALILPALARTDRDLSGGKEQFVTVENSMGMVHSSRGSVRPLSDQMRSEVSIVAGLARRVFGPDDPVPWEDFARDYDLIRDRIERVIPGFANYNERARRPGGFLLPHAPRDSRRFPTATGKANFTVNRMTPLTVPEGRLLLQTLRSHDQYNTTVYGLDDRYRGVRGGRRVVLVNPEDAQRLGLADGSYTDIVSEWPDGVERRAAHYLVVYYPTAPGCAAAYYPETNVLVPLDSTAEGSNTPTSKSIVVRFE

SEQ ID NO: 8205 - protein, 297 aa, Thermobifida fusca
NGILFFPLTPFDERGDVNEAAFEQHVASGLDHGAGGVFAACGTGEIHALSAEEHARVVRRAVAVTAGRVPVIAGAGGSVSTAIEQATAARELGADGVLLLPPYLVHAPQRGLVEYVRAVTSAVDIPVIVYQRGTMVFTPDSAAELAEIPTVVGFKDGVGDVGTMRQIVLTVRQRRGDNFVFFNGLPTAELTFHAYQGIGVPLYSSAAFAFVPEVATAFYRAAHAGEELADRLLRDFYDPLVRLRDRVPGYAVSLIKAGARLRGADVGGVRPPFVDPSEEHLAELRTIIDTGLALLKE

SEQ ID NO: 8206 - protein, 338 aa, Thermobifida fusca
PLGAVTIILPPTWALAVLATSLPHALVAGNTVIVTPSPTAPLTVVRTLQLLAERLPAGVLNVVTGSDEAVSPTIRDPRVRRIVFTGSPEAGRTILRVAADTITRVTLQLGGNNPAILLDDVALDAVTIERIAVGAFMIAGQLHRGVKRLYVHRSRYQELVEALSAQLANHRIGHGLHPDTTMGPLINARDRDHARDLSDRARAIGCEVREFGEIGEETQQSGGYFLRPALVLDPPLDESIVVEAQSGPVLPILPYDDVDRVVAAVNQDRAGLCSSVWSTDLDRAGEVAARLRTGTTWINGAGVLAEDDRAPSGGFRQSGIGLQKGIEGLMEMSETHTV

SEQ ID NO: 8207 - protein, 266 aa, Thermobifida fusca
  unsure (1)..(266): unsure at all Xaa locations
VPTVTLNNGVTMPQLGFGTWQVGYDAVAAALAAGYRCFDTAEMYRNETAVAAALADSGLDRSDVFITTKLWNNHHGFQPALDAFHASRRRLGLDVIDLYLIHWPNASDAVNVETWRALEQLYAEGVVRAIGVSNFSPAQLAVLLEACDVVPAVNQIELNPSRPRLEERVYHARHGIATQAWAPLAKGGALLTHPVITEIAEAHQKTPAQVVLRWHLQHGILVIPRSATPERIRSNFAVTDFSLAPQEMAAVDALGAXHARSGSGPC

SEQ ID NO: 8208 - protein, 242 aa, Thermobifida fusca
GKVAVVTGASRGIGFAVARRIVDEGGRVVVTARGAEALAEAVTQLGGPEHALGIAGRAHDQAHRAEVVQRTLDTFGRVDVLVNNTGINPVFDSILKVDEAAMAKIFEVNVIAAVGWVREVYNAWMGEHGGAIVNVASLAGQHPSPGIGIYGASKAALINLTQQLAYELAHRRIRVNAVAPAVVKTRFAEALYAENEEKVAAGYPLGRLGEPDDIAAAVAYLASSDASWVTGQVITLDGGKTL

SEQ ID NO: 8209 - protein, 466 aa, Thermobifida fusca
VSTTGEAPSSGEVNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESM

SEQ ID NO: 8210 - protein, 464 aa, Thermobifida fusca
GAPAASDRNSLSVGSNGPLLLHDVRLVETLAHFNRERVPERNPHAKGAGAFGVFETTEDVSQYTKAALFQKGARTEMLARFSTVAGEQGSPDTWRDVRGFALKFYTSEGNYDLVGNNTPIFFVRDPMKFPHFIRSQKRMPDTGLRDNNMQWDFWTLNPETAHQVTYLMGDRGLPRTWRHMNGYGSHTYMWINAKGEKFWVKYHFKTDQGIENMTNEEAERLAGVDADFHRRDLVEAIERGDYPSWTLYVQVMPYEDAKTYRFNPFDLTKVWPHSDYPLIKVGKMTLNRNPENFFAEIEQAAFAPSNLVPGIGVSPDKMLLGRVFAYADAHRARIGTNYFQLPVNKPRVKVNSYTFDGHMTYEHSGKAPVYAPNSYGRPWSDQTGPVEDSWEADGELVRSAYELHAEDDDFSQAGTLVREVFDDAQRDRLVETVADHLSKGVVEPVLSRAFQYWKNIDETIGERI

SEQ ID NO: 8211 - protein, 381 aa, Thermobifida fusca
SDFDLYRPTEEHEALREAIRSVAEDKIAPHAADVDEQSRFPQEAYEALRASDFHAPHVAEEYGGVGADALATCIVIEEIARVCASSSLIPAVNKLGSMPLILSGSDEVKQRYLPELASGEAMFSYGLSEREAGSDTASMRTRAVRDGDDWILNGQKSWITNAGISKYYTVMAVTDPDGPRGRNISAFVVHIDDPGFSFGEPERKLGIKGSPTRELIFDNVRIPGDRLVGKVGEGLRTALRTLDHTRVTIGAQAVGIAQGALDYALGYVKERKQFGKAIADFQGIQFMLADMAMKLEAARQMVYVAAAKSERDDADLSFYGAAAKCFASDVAMEITTDAVQLLGGYGYTRDYPVERMMRDAKITQIYEGTNQIQRVVMARQL

SEQ ID NO: 8212 - protein, 223 aa, Thermobifida fusca
PRPLHEIMESGWAEALEPVADRIAQMGDFLRQEVAEGRTYLPAGENVLRAFQQPFDQVRVLLVGQDPYPTPGHAVGLSFSVSPEVRRLPGSLRNIFLEYTQDLGYPMPSSGDLTPWAERGVLLLNRVLTVTPRKPGSHRGKGWEAVTDQAIRALAARGKPLVAILWGRDARSLRPLMPDVPCVESAHPSPMSAHHGFFGSRPFSRANALLEQQGAEPMDWRLP

SEQ ID NO: 8213 - protein, 249 aa, Thermobifida fusca
GAERLHVRAWAPAAGDPAFLVVLVHGYGEHIGRYEHVARWLCEHGAVCYGVDHRGHGTSSGERVLIDDFAGIVEDVHRVVTQARTAYRALPLVVVGHSMGGLIAARYVQTHPEEVSGLVLSGPVLGEWAVVDELLAHDEIPEVPIDPATLSRDPEVGAAYAADELVWHGPFKRPTLEAFRVELARATAAGKVEAPLLWLHGSDDALVPLEGTVRGILTLAGPDTTARIFPGARHEVFNETNRDEVLGEV

SEQ ID NO: 8214 - protein, 373 aa, Thermobifida fusca
GRPDQPPNILFILADDLGWADLGCYGSTTIRTPNLDQLAAQGIRFTHGYAGSPWCSSTRISLYTGRYPGRLQAGLEEPLVTRSPENGIPEGHPTLSSLLVEAGYATAMFGKWHCGWLPWYSPLRIGFETFFGNFDGALDYFEHVDTLGKADLYEGETPVEEVGYYTEIISERAAEYITAHRNRPFYVQLNYTAPHWPWEGPDDHEVGQEIRRRYQQRWEHSPLMHLDGGSIAKYGELVEAMDAGIGQVLAALDRAGAADNTIVVFSSDNGGERWSKNWPFVGEKGDLTEGGIRVPLIVAWPEAIAGNQVSDHPVITMDWTATLLAAAGTEPHPDWPLDGVDLLPWLVDGADFPAHDLFWRTSNQGALRRGRFK

SEQ ID NO: 8215 - protein, 448 aa, Thermobifida fusca
LDEKLSPIYEEILRRNPGEVEFHQAVREVLECLGPVVAKNPDISHAKIIERLCEPERQLIFRVPWMDDSGEIHVNRGFRVEFSSSLGPYKGGLRFHPSVNLSIIKFLGFEQIFKNSLTGLPIGGAKGGSDFDPKGRSDAEIMRFCQSFMTELYRHLGEHTDVPAGDIGVGQREIGYLFGQYKRITNRYESGVFTGKGLSWGGSQVRREATGYGCVLFTAEMLRARGDSLEGKRVSVSGSGNVAIYAIEKAQQLGAHVVTCSDSNGYVVDEKGIDLELLKQVKEVERGRVSDYAKRRGSHVRYIDSSSSSVWEVPCDIALPCATQNELTGRDAITLVRNGVGAVAEGANMPTTPEGIRVFAEAGVAFAPGKAANAGGVATSALEMQQNASRDSWSFEYTEKRLAEIMRHIHDTCYETAERYGRPGDYVAGANIAAFEIVAEAMLAQGLI

SEQ ID NO: 8216 - protein, 390 aa, Thermobifida fusca
SEDLIHIRDWVHEFARDVMRPAAAEWDEREETPWPILQEAAKIGLYSLDFFANQMFDPSGIAIPVVYEELYWGDPGIALALTGTTLAAVAVSANGTQEQILEWTPQMFGTPDDIKLGAFCVSEPDAGSDVGAIRTRAVYDEAKDEWVLNGTKTWITNGGIADVHVVVASVDPELGTRGQASFVIPPGTKGLSQGQKFSKHGIRASHTAEVILDDVRIPGRCLLGGKEKLDQRLARAREGRRSKGQAAMKTFEASRPAVGAMAVGCARAAYEYARDYVRQREQFGRPIGDNQAVAFTLADMATRIDAARLLVWRASWMARYGKEFANAEGSMSKLYASETATWVTQNAIRLLGGNGYTRDYPVERWHRDATIFTIFEGASEIQRLIIGRAI

SEQ ID NO: 8217 - protein, 748 aa, Thermobifida fusca
QLLEGLNELQRAAVLHHGSPLLIIAGAGSGKTRVLTHRIAYLLAERGVRPSEVLAITFTNKAAAEMKERVERLLGERTASAMWVMTFHSACVRILRREAARLGYPSSFTIYDSADSQRLMQLVCRELDLDPKRFPPKSFSAQVSSLKNELVDYDTFAGRAETVQERALAEAYQLYQQRLYEAGAMDFDDLIMVTVHLLQMFPEVAEHYRRRFRHLLVDEYQDTNHAQYALIRELVGDGDPATPGPELCVVGDADQSIYAFRGATIRNILEFERDYPQATTILLEQNYRSTQTILSAANAVIAHNTERRPKNLWSAQGEGEPIVGYVADDERDEATFVVQEIDALTDAGTCTPGDVAVFYRTNAQSRVLEEVFVRTGMPYRIVGGVRFYERKEIRDILAYLRVLANPEDSVSLRRILNVPKRGIGERAEQVIEQFAAQERITFAQALRRADEAPGIATRSLKAIKEFVALLEELEELAATRSPAETIEAVLERTGYLEELVNSKDIQDESRVENLEEFVGVAREFESSFDAALAAEGADGETGRDGAEPTLVDFLEQVSLIADTDQLPDEDDQGGAVTLMTLHSAKGLEFPVVFLTGLEDGVFPHLRALGDRSALEEERRLVYVGITRAQERLYLTRAATRSSWGAAAYNPPSRFLDEIPAELVTWRRAESTTEALRRSVSPARTSRPTRKAERPVLALRPGDKVNHDSFGLGTVLSVDGTGDRTRARVDFGAGVGQKDLMVKFAPLEK

SEQ ID NO: 8218 - protein, 465 aa, Thermobifida fusca
RHVVSSTGRTVVTTAPFTGEPLATLPQSSASDVTEAFRRARAAQREWAQRSPRQRIAPFLRFSDLLLDRQTEILDILQWETGKARKNAFEEVCDAALGTLHYARHAPRLLRRRRAPGAIPLATRTRVNYQPKGVVSVITPWNYPLTLPVADAVPALLAGNAVVAKPDTQTALSALWAIDLLVEAGLPRDLWLVVLGEPAEIGDPLVDEADYVAFTGSSATGARIAQRAASRLIGCSAELGGKNPMIVCADADLDRTVHGAVAACFSNSGQLCISMERLYVHDSIYDAFVEKFVAETKNLRLGADLDYSADLGSLTSQRQFDRVVAHVEDARSKGATVLAGGRPRPDVGPLFYEPTVLTGVDESMTLCAEETFGPVVSLYRFTTEDEAIERANHTPYGLNASVWTRDVARGRRIAERLKAGTVNINEGYGAAFASYGAPMGGMKRSGLGRRHGVEGILRYTEAQTV

SEQ ID NO: 8219 - protein, 568 aa, Thermobifida fusca
DPAHQMTAARLGPQERDAALRAMADTELDVLVVGGGIVGAGVALDAVARGLSVGLVEARDFASGTSSRSSKLIHGGLRYLEHLDFPLVREALTERGLLLSRIAPHLVRPVPFLFPLRSHWERPYIGAGVALYDALALSGTRTRGLPGHRHLSRRAALRIFPALRRDALVGAVQYWDAQVDDSRYVVMVLRTAATYGAHIASRTQAVGFLREGEHVTGARVVDLETGREFAVRAKQVVNAAGVWTDEIQEMVGGRGQIHVRASKGVHLVVPRDRIHASSGLILRTEKSVLFVIPWGRHWILGTTDTAWDLDKAHPAASRTDIDYVLNRVNAVLKTPLTRDDVEGVYAGLRPLLAGESEETSRLSREHTVAHPVPGLVLIAGGKYTTYRVMAKDAVDAVAHGMGGGVPPSVTDRLPLVGADGYFALWNQRRILARRTGLHVSRIQHLLRRYGSLIHEVLGLIAEQPDLKQPLTGADDYLRAEVVYAVRYEGARHLDDVLSRRTHIAIETWDRGLAAAEEAAQLMAGPLGWDDAQIAREVEYYRARIEAERAAQEQDSDQEADAVQHGAPD

SEQ ID NO: 8220 - protein, 364 aa, Thermobifida fusca
VEIGLGKAGRRAYELDEIGIVPARRTRDPEEVSLSWQIDAYRFDTPLMVSPMDSVVSPKTAIAIGELGGLAVLDLEGLWTRYEDPEPLLAEIRELDDATATRRLQEIYAEPIKEELIGRRIEEIRRAGVVTAARLSPQRTAQYHKAVIEAGVDIFVIRGTTVSAEHVSGRTEPLNLKQFIYDLDVPVVVGGCATYTAALHLMRTGAAGVLVGFGGGSGHTTRSVLGVAVPMATAIGDVAAARRDYLDESGGRYVHVIADGGMTRSGDIAKALACGADAVMVGSPLARAVEAPGGGYHWGSEAHHHQLPRGQRLKVGTIGTLEEIVRGPASTSDGSMNLMGALRRTMATAGYTDVKEFQRVEVVV

SEQ ID NO: 8221 - protein, 616 aa, Thermobifida fusca
MCGIVGYVGPKPALEVVVEGLARLEYRGYDSAGVAVLSDGKLQTEKRAGKLANLRAALQANPRSADGIGIGHTRWATHGAPTDGNAHPHVDEMNRVAVVHNGIIENFAQLRMELEERGCKFRSETDTEVVAHMLSEQLTEHNGDLGAAMRSVCRRLEGAFTLVAISEDDPGLVVAARRNSPLVVGRGNGENFLASDVAAFIAHTRDAIELGQDQVVELRADSITITDYDGAPAQVREYHVDWDASAAEKGGYDYFMLKEIAEQPRAIADTLLGRVAVDGTLTLDEMRLAPEELRQISKIVIVACGSSYHAGLIAKYAIEHWCRIPCEVEVASEFRYRDPILDPQTLVIAISQSGESMDTLMAVRYAREQQSRVLAICNVNGSTIPRESDGVLYTHAGPEVGVAATKTFLTQLVACYLVGLYLAQVRGLKFGDEINAIIGQLARMPEQVEKVLNTVQPVRDLARSLAEAKTVLFLGRHVGYPVAMEGALKLKELAYMHAEAFAAGELKHGPIALIEDGLPVVVVVPSREGRSVLHDKIVSNIQEIRARGARTIVIAEEGDESVRPYSDTLIEIPAVPTLLQPLVATVPLQVFACELALAKGNDVDQPRNLAKSVTVE

SEQ ID NO: 8222 - protein, 443 aa, Thermobifida fusca
RLFGTDGVRGLAGRDLTAGLTLELAIAAAEVLPERGIPGKRPRAVVGRDPRASGEFLEAAVVAGLASAGVDVIRLGVLPTPAVAFLTGELDADFGVMLSASHNPAPDNGIKFFARGGHKLSDEVEDEIERRLGRAVAGATGRDVGRVTDDTDSVERYITHLVNSLPNRLDGLKVVVDCANGAAAGIAPEALRRAGADVIAIGDKPDGFNINEGCGSTNLDALRAAVLEHGADAGIAHDGDADRCQAVAADGSVVDGDQIMAVLALELYEANALHNNTLVVTVMSNLGLKLAMKEAGITLVETQVGDRYVLEAMRAGSYSLGGEQSGHIILLDHATTGDGLLTGMHLLAAVNRRGVALAELAKVMNRLPQVLVNVSGVDKTRVATSERIAAEVAAAEAELGDSGRVLLRPSGTEPIVRVMVEATSQDRAQAIADRLADVVRDEL

SEQ ID NO: 8223 - protein, 274 aa, Thermobifida fusca
MGIRKYKPTSPGRRGGSVSTFAEITRSKPEKSLVRPLHSKGGRNGHGRITARHQGGGHKRAYRLIDFRRHDKDGIPAKVAHIEYDPNRTARIALLHYVDGEKRYILAPVGLKQGDRVENGPAADIKPGNCLPLRNIPTGTFVHAVELKPGGGAKLGRAAGAAIQLLAKEGAYATLRMPSGEMRQVEVACRATVGQVGNVEHANISWGKAGRMRWKGKRPSVRGVAMNPIDHPHGGGEGRTSGGRHPVSPWGKAEGRTRKKGKPSDRLIVRRRSK

SEQ ID NO: 8224 - protein, 222 aa, Thermobifida fusca
MFGFVKTDMVDPAKALPGRDTPMPVPERHEVLGTPLAPPYPEHAQLADFGMGCFWGVERIFWRLGAENGIITTAAGYAGGYTPNPTYEEVCTGRTGHAEVVRVVFDPERISYTDLLKVFWENHDPTQGMRQGNDVGTQYRSIILYHNEEQRAAAEASRDAFQPVLTRMGYGPITTEIVPATPFYFAEPYHQQYLSEAKNPHGYCGVSGTGATCPVGVARTSG

SEQ ID NO: 8225 - protein, 319 aa, Thermobifida fusca
DETLAREIQAELEQVEKVLRDAVAESDPLLREAASHLLEAGGKRFRAILVLLSARFGDATNPDLVSAAAVVELTHVATLYHDDVMDEAELRRGSPSANRRWGNTIAILTGDYVFARASEILADLGTEAVRLQAQTFGRLVRGQILETAGPRPGVDPMKHYLDVIADKTASLIASSARFGAMVGNADPEVVETLTRAGDALGMAFQLSDDILDVASETEESGKTPGTDLREGVLTLPMLYALQGTEPEHARLRSLLGRPLNDEEAAEALALLRAHPAMDEARADLAAWGERAQAELATLPECPAKTAFLAICDYVVNRKG

SEQ ID NO: 8226 - protein, 795 aa, Thermobifida fusca
VPPEDLVTVTIDGFEIQVPKGTLLIRAAELLGIQIPRFCDHPLLDPVGACRQCLVEITDMGNGRGMPKPQASCTITVTDGMVVKTQLTSPVAEKAQRGVMEFLLINHPLDCPICDKGGECPLQNQALSHGQGESRFVDVKRTFPKPIPLSTQILLDRERCIQCARCTRFSAQIAGDPFIDLMERGAKEQVGIAEGQPFQSYFSGNTVQICPVGALTGAAYRFRARPFDLVSTPSVCEHCASGCAQRTDHRRGKVTRRLAGDDPQVNEEWNCDKGRWAFTYATQPDRLKHPLVRDEDSRALEAASWPEALQVAARGLAAARGRVGVLTGGRLTLEDAYAYAKFARVALHTNDIDFRARPHSAEEAEFLAARVAGHGIEVTYTDLEKAPAVLLVGFEPEDESPIVFLRLRKAARKNGTRVFSIAPYASRGLTKTNGTLIPTVPGGEASAMTSLGTVAPEALEALHSPGAVILAGERLAEVPGALSAVARLADTTGARLAWVPRRAGDRGAIEAGALPNLLPVGRPVTDAVARAEVARVWAVSDLPATEGRDTAGILAAAAAGELDALVIAGVDLDDLPDPEAARAALAKVPFIVSLELRASNVTDRADVVFPVAAVAEKSGTFVNWEGRGRPFGTALQVPGAMSDLRVLAAIADEMDVHLGLPDPAAARRELAELGAWKGTPLPTPVVRPADVAIPQPGQAVLATWDQLLGQGRMQDGEPHLAGTARPAVARLSAATAAEIGLADGQTLRVEGPAGAVRLPAVITEMPDRVVWLPTNAAGCAVRRDLGASTGTVVSL

SEQ ID NO: 8227 - protein, 415 aa, Thermobifida fusca
ADVIVVGAGPAGSTAAHYLATAGLDVLLLEKTAFPREKVCGDGLTPRAVKQLVAMGIPINEEDGWIRNRGLRIIGGGTRLELPWPELSEYPGFGLVRTRYDFDQILARHAVKTGVRLLERTNVTAPIIDERSNRVVGVQAKDAEGRIRSFRAPLVLAADGNSSRLAIALGIRRRDDRPMGVAVRTYFTTPRHNDDYLESWLELWDTTDGKQVLLPGYGWIFGVGDGTSNVGLGILNSTPAFQKIDYRKLLRRWTQSMPEEWGFTEENQKGPIRGAALPMGFNRTPHYARGMMLVGDAGGMVNPFNGEGIAYAMEAGRIAADVAVQALSRPTPRDRERTLLRYPEILRDTYGGYYTLGRYFVKLIGNPYFMKYATKYGLPRPLLMRFTLKMLANLTEPSHGDALDRLINGLSKIAP

SEQ ID NO: 8228 - protein, 634 aa, Thermobifida fusca
SQVFPPDEAFVAQANATADLYGEAEADREAFWEKQAERLHWETRWNQVLDWSNAPFAKWFVGGRLNVAYNCVDRHVENGYGDQVAIHWVGEPGDTRDITYAQLKDEVCKAANALSSLGLKPGDRVAIQMPMIPEAIVSMLACARLGLVHSVVFGGFSPSALRSRVEDADAKVVITTDGQYRRGKALPMKANVDEGIEGIDAVQNVIVVRRTGMDVPWTEGRDLWWHDLVDSQSAEHTPEAFDSEHPLFILYTSGTTGKPKGILHTTGGYLTQAAYTHHVVFDHKPGKDVYWCTADIGWITGHSYIVYGPLANRATQVVYEGTPNTPHEGRHWEIVQEYKVTIYYTAPTLIRTFMKWGEEIPARYDLSSLRLLGSVGEPINPEAWLWYRKHIGGDKTPIVDTWWQTETGAIMISPLPGALSLKPGSALRALPGVSAKVVDEKGNEVSHGSGGYLVLDKPWPSMLRGIWGDEKRYRETYWARFADKGFYFAGDGAKYDDDGDIWLLGRVDDVMNVSGHRISTTEVESALVAHPTVAEAAVVGASDPTTGQAIVAFVIPRAGVAQDEASGEEAIKTLREHVAKEIGPIAKPRQIIVVPELPKTRSGKIMRRLLRDVAENREIGDVTTLADSSVMDLI

SEQ ID NO: 8229 - protein, 735 aa, Thermobifida fusca
ERVELLIGGMTCASCANRVERKLNKLAGVRASVNYATEKASVEFDSGVTIDDLITTVEKAGYTAALPAPPCAAQDTEDQAADPVAALRTRLLVSAVLSIPVIAMAMIPALQFTYWQWASLVLAAPVVVWGALPFHIAAVKNLRLGEATMDTLVSMGTLAAFAWSLYALFFGEAGMPGMTHPFEFTISRTDGSAAIYLEVAAGVTTFILAGRYFEARAKRRAGAALRALLELGAKEVTVVRGGRETRIPVEQLAVGDRFVVRPGEKIATDGVVEEGASAVDASMLTGESVPVEVGVGDAVVGATVNVGGRLVVRATRVGADTQLAQMAKLVEEAQSGKAEVQRLADRISGVFVPVVIALAVATLGFWLGAGGPVEAAFTAAVAVLIIACPCALGLATPTALLVGTGRGAQLGILIKGPEVLENTRRVDTVVLDKTGTVTMGTMALVDVAAADGEDADEVLRLAGAVEHASEHPIARAIARSAADRVGNVPPVTDFAATAGLGVRGVVDGRTVLVGKAALLAQEGVAVPEAVARKAAQAEAAGHTAVLAAWDGKARGVLVVADTVKPTSAEAVAQLRQLGLTPILLTGDNAAVARTVAEQVGIDEVIAEVLPADKVDVVKRLQDEGRVVAMVGDGVNDAAALAQADLGLAMGTGTDAAIEAADLTLVRGDLRVAADAIRLSRRTLATIKGNLFWAFAYNVAALPLAAAGLLNPMIAGAAMAFSSVFVVSNSLRLRGF

SEQ ID NO: 8230 - protein, 422 aa, Thermobifida fusca
FETKQIHAGAAPDPATNARATPIYQTTSYVFRDTQHGADLFSLAEPGNIYTRIMNPTQDVLEKRVAALEGGVAAVAFASGSAAITAAVLNLAGAGDHIVSSPSLYGGTYNLFRYTLPKLGIEVTFIKDQDDLDEWRAAARDNTKLFFAETLPNPANNVLDVRAVADVAHEVGVPLMVDNTVPTPYLQRPIDHGADIVVHSATKFLGGHGTTIAGIVVDAGTFDFGAHGDRFPGFVEPDPSYHGLKYWEALGPGAYAAKLRVQLLRDTGAAISPFNSFLILQGIETLSLRMERHVANAQALAEWLESRDEVAKVYYPGLPSSPYYEAAKKYLPKGAGAIVSFELHGGIEAGRAFVDGTELFSQLVNIGDVRSLIVHPASTTHSQLTPEEQLASGVTPGLVRLSVGLEHVDDLRADLEAGLRAA

SEQ ID NO: 8231 - protein, 869 aa, Thermobifida fusca
WDTVPDSAARRAGTAMVMTREPQADPLQGRPVPVRSGLTGPDAARRLGHDGRNLVPPPQRTLPFLLLASSFTHSFALLLWAAAALAFIGGLPEAAWAVVTVIVVSGLVGFVLDYWSDRIGQRLRRRAPAAVRVIRDGRQARVNADELVVNDVVLLRAGDRVPADIRLTEVHDFVVVEVGVTGMREMLRCDEGTTVFAGTHVAAGEAEGVVVTTGMWTRLGQDSPLLRHARRPSGPLVENLRDLTAAAAAAATGTALVVFLLTLLVGVPPAEGFLPAVGLAVALVPLGLRSIVHLCLAWAAQRMADAHALVRHSAAVQQLGTVTFLCIPAAGVLTRGEPVAVEVWTPEGTVQVTGTGYAPEGALVGDAAAVAAAHDLALSAALCSSDGYFFTDGQWRPVGDPVEAACHVLAARAGVDVSLAAVERRYPFDPHRRRASAFAKGSVHVKGAPDAVLPRCRAVAGAADASAAMADRGLRVLAVARRDLAAPPEQAEDAERDLTLLGLIGLADPPRSDARTAVTRCRRLGIRLALVTGEDPRTALAVARATGLARPGAPVLHGAELPDDLREIGELLDSDGAVVSRVTPEDRRRVTVALQHRGYTVATTAGGAADDAALRRADVGIAPGYAGADTARDSADLVLLDSGIATVAAALGAGRAIRVTLRRALTYRLTGVVAMATPFLVWAVTGGAVPPALTLGQVLAIGVGVDLLPALALGVGPRGWRALRDPPPDGEFLVDRRLAVRVGGVLGPVEAVTALFTFGVVLWVNGWQWGQSPAPLLLAQASGAAFATIVLGQVAAALACRSETRPFDAVPWRSDPLPRGLGAQLLLLWLFFTAPPLAGWLGSTVPPGFVWPGVVCVVPALLAADTIHK

SEQ ID NO: 8232 - protein, 315 aa, Thermobifida fusca
MRALTVVPTQPGSLEVRDLADPVAGAGELLVDGIALGICGTDHEIVHGVYGSAPAGTDRLVLGHESLGRVREAPPDSGFTPGDLVVGVVRRPDPVPCGACAHGYFDSCRNGQFTERGIKKRHGYGSEQWTVEAEYAVRLDPSLEEVGVLLEPASVVAKAWEQIEQIGERSWFVPQRLLVTGAGPIGLLAALLGMQRGLDVHVFDQAAHGVKPELVAGLDAAYHTGDLAAVAATVKPDVLIETTGVPRLVVDALTTTAVFGIVCLVGLSSEGASIPVDAGALNRTIVLGNHAFFGSVNANLHHYELAARALSWADL

SEQ ID NO: 8233 - protein, 559 aa, Thermobifida fusca
SATENYRRARDTLLGLSGDHRTAVETFRWPDLGPRFNWAIDWFEVYARDNDTTALWIVEEDGSEAKYSFAEMVHRSDQVAAWLAEQGVRRGDRVMVMLGNQVELWETMLAVMKLGAVILPATTALGPADLADRIERGGAKHVVTSAANTAKFAEVPGDYGRIVVDGDVPGWADYRAAATIAEPKIAHPETAPDDPLLLYFTSGTTSRPKLVQHTQASYPLGHLTTMYWIGVRPGDIHLNISSPGWAKHAWSCFFTPWIAEATVFVYNYSRFDAAALLAHIRRAGVTTFCAPPTVWRMLINADLSGGPGALREIVAAGEPLNPEVIDQVRRAWGLTLRDGFGQTEMTAVVGNTPGSPVKPGSMGRPLPGCPVVLIDPRSGQPAEEGEICLDLSARPVMLMRGYQDDPERNAEAMEGGWYHTGDIARRDADGYITYIGRTDDVFKASDYKISPFELESVLIEHPAVAEVAVVPAPDPVRLAVPKAYVALAPGYEPTRETALSILRYARENLAPFQRVRRLEFAELPKTISGKIRRVELRQQEQERAEGTGQASQEWRDDEF

SEQ ID NO: 8234 - protein, 358 aa, Thermobifida fusca
RSLLAPGRYVQGRGVLADLGTYVAAIGSVPLILADPVVRQLTEATVTESFRQAGLAVRFEEFGGIPTAAEARRVADVLSDRGCDVIIGLGGGSTIDTAKAAGDNAGIRWVSVPTVASTDAPTSALSVVYSEEGVFETYRFYSRNPDLVLVDTQLVANAPARFLVSGIGDALATWIEARAVQRANGPTLAGGMATHTGIALAKLSWDLLWENALPAVEAVRSNLVTPAVEAVVEANTLLSGLGFESGGLAAAHSVHDGLTVVPHTHHLMHGEKVNIGSITQLILEAAAAEEIREFIEFTARLGLPTTLTEAGLGHVDDEVLRMVVEAALAPEETIHNLPFSVSENDLLDALKMVEELGR

SEQ ID NO: 8235 - protein, 337 aa, Thermobifida fusca
SAVAGGGHHLEQDYPDPFTHDGKYRSILAQQFSSVSPENQMKWEYIHPEPDRYDFAMADKIVDFAERNDQKVRGHTLLWHSQNPEWLEEGDYSPEELREILRDHITTVVGRYAGRIHQWDVANEIFDEQGNLRTQENIWIRELGPGIIADAFRWAHEADPNAELFFNDYNVEGINPKSDAYYELIQELLDDGVPVHGFSVQGHLSTRYGFPGDLEQNLRRFDELGLATAITELDVRMDLPASGKPTPKQLEQQADYYQQALEACLAVEGCDSFTIWGFTDKYSWVPVFFPDEGAATIMTEKYERKPAFFALQQTLREARCADSPKPGPGKPKPGKGP

SEQ ID NO: 8236 - protein, 344 aa, Thermobifida fusca
MHAVQYREVGQPPRVVDVDVPTPGPGQILLRVTAAGICHSDLTVMHWDAKTLPYQLPLTLGHEGAGVVEAVGENVNAVSVGDSVVVYGPWGCGTCHACSQGRENYCPRAARLGIMPPGLGRPGALAEYLLVDSERHVVPIGDLDPVKTVPLTDAGLTPYHAIKRSMSKLEPGSVAVVIGAGGLGHVGIQLLRLMSAATVVALDIREESRELALRSGAHHALPSDSKAVGLVRELTDGAGADVVFDFVGAQVTLDLAAQMAGLDSHINIIGIGGGSLPVSFDSLPYGTRVSTSYWGTRSELIELVELAKQGAIDVHVERYELEEGPEVYKRMEAGKIQGRAVLVP

SEQ ID NO: 8237 - protein, 452 aa, Thermobifida fusca
ILGGGGFRVPLIHRALLADARHPDPPITELVLFDTAPERVAVIRTILEQQREAHRAVYGEPPLTVRVADTLDEALRGSAIVFSAVRVGGAEGRVRDERVALAAGVLGQETVGAGGISYGLRTVPVAVAIAQHVARLAPQAWVINFTNPAGLITEAMTQILGDRIIGICDSPVGLGRRAARALGLDPARVHFDYAGLNHLGWLRGLHADGRNRLPDLLADEAALTSFEEGRLFGAAWLRALGALPNEYLHYYYLARETREEIARTLAAGGHTRGEQLVVQQKEFYRLAAARPRDAYDLWEQTRREREETYMADNRRAAGGVERDEADLDGGGYEQVALAVMRAILRDEPARLIVNVRNRGALPGVDADAVVEVPCLVDASGARPLAVDPLAPHQLALVHAVKAVEREVLHAVRTGSRTAALRAFATHPLVDSVAVAQRLLDGYLQAFPELARI

SEQ ID NO: 8238 - protein, 256 aa, Thermobifida fusca
SCPGGVANMAVAASRLGLRTAVAAAFGEDVYGDFCWETLANQEMVDLSAVSADSQLAFPVHGVAGLTGVTAAWSPTSIRHRSRCRDMARDLPQARAAFVSLSNEDGVPEWAQEQAKNGTLIFADVGWDDSQRWSPSVLEQLRHCHAFMPNAIEAMAYTRTGSPALAVAALAEHVPVAVVTDGPRGAIAIDQTTGEEAEVEGIVIDAVDTTGAGDVFGAGFIMGTLAGWPLEQRLRFANLCAALSVQHTGGSLSAPG

SEQ ID NO: 8239 - protein, 564 aa, Thermobifida fusca
AQRMTEDRMEPDRGCSPAAGEQTLTGVAASPGKATGPVAVLAAPPTLPPRRPAVTDPDAEIARATAALHQVADQFRRQAATVDGEAREILEAQALMASDPQLAAGIAERVRNGLAAEWALDEAVASYQELLRGAGEYVAGRAADLGDIRNRALAVLLDVPMPRPPVPGHPFVLVADDLAPADVARLDADTVLAIVTRVGGATDHTAILARSLGIPAVVGCAEAHQLCEGTPVTVDGDQGTVVVHSSAQQCTTQRHSRPQAARGLATGPGRTKDGQRVELLLNLGGEDPERAARHDCEGVGLLRTEFLFMDRVAEPTGAEQSAAYARVFRAFGGRVVTVRTLDVGADKPLAFLAQENEPNPALGVRGFRMVRTSPEVLRRQLAAVARAAQETRTRVRVMAPLVATPQEAADFVALAREAGIAEVGVMVEVPSAALLADRVVREVDFVSIGTNDLAQYTLAADRTRPALSDLLDPWQPAVLHLVGRVGAAGREAGRPVGVCGEAAADPLLALVFVGLGVTSLSMAAAALPVVRGALARHTVADCRKLAALAMDAAGPCEARETVRA

SEQ ID NO: 8240 - protein, 268 aa, Thermobifida fusca
MRFAKGHGTENDFVILPDPDGELDLDAATVAALCDRRAGLGADGVLRVVRTKALDEPLTGEAATAQRCEWFMDYRNADGSVAEMCGNGVRVFARYLQEAGLVGAAAFEVGTRAGARHVVLEPDGNITVDMGPVRILGPGSARLADGPVHGTRISVGNPHLACRVARPVAEVDLSAPPLLRAEEFPQGANVEVFREVASGVLEMRVYERGAAETRSCGTGIVAAAAAATPPGEDARWTVRVPGGECTVVLESGAARLSGPAVIVAEGDV

SEQ ID NO: 8241 - protein, 524 aa, Thermobifida fusca
WWRHAVIYQIYVRSFADSNGDGEGDLNGIRERLPALVSLGVDAIWLTPFYVSPLADGGYDVADYRDVDPRFGTLADFDALLATAHDLGLRVIIDIVPNHTSSAHRWFRDALAAGPGSPERDRYVFRPGRGENGELPPNNWQSIFGGPAWTRVTEPDGTPGEWYLHLFDVEQPDLNWENPEVRAEFADILRFWLDRGVDGFRIDVAHGMIKDPALPDIAEGQKADMLDGHTRLPYFDQDGVHEIYREWRAIVDSYPGERALVAEAWVENAERVARYLRPDELHQAFNFEYLTADWDAATLRAVVDRSLAANNAVGAPTTWVLSNHDVTRHVTRFGGGAQGLARARAALLLMLALPGSVYLYQGEELGLPEVTDLPEEALQDPTWKRSGYTERGRDGCRVPLPWEGDEPPFGFGCSAERSWLPVPAEWRSLTREVQERDPDSTLSLYKKALRLRRELLLPAEDALHWADAPQNVLAFRREPGFTCAVNFGADPVTLPFEGEVVLSSGPVEQDGTHLVLPGDTAVWL

SEQ ID NO: 8242 - protein, 379 aa, Thermobifida fusca
VARDYYEILGVRRDATQDEIKKAYRRLARELHPDVNPDPETQERFKEVAQAYEVLSNPEKRRMYDMGVDPFARGGAAGGGATGFGAGFPFDDLMNAFFGGSTGTRAARERMRRGRSIKVRVELDLEETAFGVTKDITFPTAVVCNTCQGEGTAQGTHPETCDMCGGRGEVSQVTRSFLGQVMTTRPCPQCAGQGTIIRNPCPDCAGEGRVRERVTRKVQIPAGVEDGTQIQLAGEGEVGPNGGPRGDIFLEIVERPHPIFERRGDDLHCTVTVPMTAAALGATLTIDTLDGPEEIDLRPGTNSGQVITLQSKGCHHLNAPGRGDLHIHVTVETPTRLDEEQEALLRKLAELRGEDRPPGKFSPGQGNFFSRIRDAFGAR

SEQ ID NO: 8243 - protein, 894 aa, Thermobifida fusca
  unsure (1)..(894): unsure at all Xaa locations
VPKYVYDFTEGNKDLKDLLGGKGANLAEMTNLGLPVPPGFTITTEACRHYLEHGTMPPGLDAQIEEKLAALEATMGKRLGQPDNPLLVSVRSGAKFSMPGMMETVLNIGLNDESVKGLAAQSGNERFAWDSYRRLIQMFGKTVLGIDGDLFEDAIDDLKARKGVTSDLDLDAADLAGLVDTFKTIVREATDAEFPTDPREQMRLAIEAVFKSWNAPRAVLYRRQERIPSDLGTAVNICSMVFGNLGMDSGTGVAFTRDPATGQQGVYGDYLQNAQGEDVVAGIRNTIPLTELERIDPKSYAELLEIMEKLERHYRDLCDIEFTIERGKLWMLQTRVGKRTAAAAFRIANQLVDQGLITLEEAVNRVSGEQLAQLMFPRFDEKAERDLLGRGMNASPGAAVGRAVFDSATAVAWSRNGEKVILCRRETNPDDLEGMLAAQGILTSRGGKTSHAAVVARGMGKTCVCGAEELDIDTKNRQLTAPDGRVIKEGDVISIDGTTGEVFLGEVPVVASPIVRYFEGELDPSSAEADDLVRAVDRIMRYADAKRRMAVRANADTPEDAARARRMGAQGIGLCRTEHMFLGDRRALVERLILADTDQERDEALAALLPLQREDFTGIFEAMDDLPVTVRLLDPPLHEFLPDITELSVRVAVAEARGEKNEGDLRLLQAVHRLHEQNPMLGLRGVRLGLVVPGLFTMQVRAIAEAAAARIKQGGRPRPEIMIPLVGTVQELEIIREESVQVIREVAAEHGVELDIPIGTMIELPRAALTAGQIAESAEFFSFGTNDLTQTTWGFSRDDVEASFFSTYLEKGVFGVSPFESLDVDGVGRLVRIAAEEGRATRPGLKLGVCGEHGGDPASVHFFHEVGLDYVSCSPFRVPVARLEAGRAALRXPA

SEQ ID NO: 8244 - protein, 462 aa, Thermobifida fusca
  unsure (1)..(462): unsure at all Xaa locations
RDXXWYVADIPSRGGIRXNHGGSTPDSSSTAPVPLHPPGSCCWSRPAWWPCAAGSSCSSARAWGTGGPGPRRSGSPTFADWNTANRGYTIKDVDESGAAALLDRLIWAFGDVSEDGLCPHPRXGGPAVADLPARYEAAESVDGQADTYEQPLAGSLNQLRKLQQKYPDLRASISLGGWNWSTYFSEAVRTQESRERFVASCIDLWLRGNLPRLEGEPQGGEGVAAGIFDGIDLDWEWPGGNGHPDNVEHPDDKRNFTLVVQEFRAQLDALERETGREYTLSASLSHDPKIMRDSYEPEVFDYLDFATVQGYDFTGSWRDITGHHAQLYAPDQDPDQPSVDRAVRQYLDYGLPAEKLVLGIPGYGRGWRGVPPGPNGDGWLVEAEQPAEGGYGEATHAYETLEQHPGERFFDRETGAAWIYDGDEWWSYDTPEVVRRKGAYAVRHGLRGLVLWNLDMDPEGEL

SEQ ID NO: 8245 - protein, 391 aa, Thermobifida fusca
MTDVYILDAVRTPFGRYGGALSGIRPDDLAAHVLRALAERSPGLDPAAVDDVFFGDANGAGEDNRNVARMAALLAGWPTSVPGVTLNRLCGSGMESVIAANRAIAVGDASLAVAGGVESMSRAPWVLPKPAQGFPTGHETLYSTTLGWRMVNPAMPEQWTVSLGESTEQVAATYGISRAEQDAFALRSHERAARAWAEGVFDAEITQIPGAELERDESIRETSAEKLAALKPAFRPDGTITAGNASPLNDGAAALLIGDAAAAERVGREPLARIVSRGVAAVDPDVFGIGPVQAAEIALRRAGIGWDDLSVVELNEAFAAQSLACLKLWPDLDPEIVNPNGGAIAIGHPLGASGARIVGTLAHELHRRGGGWGLAAICIGVGQGLAVVLHR

SEQ ID NO: 8246 - protein, 279 aa, Thermobifida fusca
GLHVKNGRLYEANGQEFIIRGVSHPHNWYPQHTQAFADIKSHGANTVRVVLSNGVRWSKNGPSDVANVISLCKQNRLICMLEVHDTTGYGEQSGASTLDQAVDYWIELKSVLQGEEDYVLINIGNEPYGNDSATVARWASDTSAAIQRLRAAGFEHTLVVDAPNWGQDWTNTMRNNADQVYASDPTGNTVFSIHMYGVYSQASTITSYLEHFVNAGLPLIIGEFGHDHSDGNPDEDTIMAEAERLKLGYIGWSWSGNGGGVEYLDMVYNFDGDNLSPWG

SEQ ID NO: 8247 - protein, 466 aa, Thermobifida fusca
MAKSPAARKGGPPVAVAVTAALALLIALLSPGVAQAAGLTATVTKESSWDNGYSASVTVRNDTSSTVSQWEVVLTLPGGTTVAQVWNAQHTSSGNSHTFTGVSWNSTIPPGGTASFGFIASGSGEPTHCTINGAPCDEGSEPGGPGGPGTPSPDPGTQPGTGTPVERYGKVQVCGTQLCDEHGNPVQLRGMSTHGIQWFDHCLTDSSLDALAYDWKADIIRLSMYIQEDGYETNPRGFTDRMHQLIDMATARGLYVIVDWHILTPGDPHYNLDRAKTFFAEIAQRHASKTNVLYEIANEPNGVSWASIKSYAEEVIPVIRQRDPDSVIIVGTRGWSSLGVSEGSGPAEIAANPVNASNIMYAFHFYAASHRDNYLNALREASELFPVFVTEFGTETYTGDGANDFQMADRYIDLMAERKIGWTKWNYSDDFRSGAVFQPGTCASGGPWSGSSLKASGQWVRSKLQS

SEQ ID NO: 8248 - protein, 265 aa, Thermobifida fusca
PTLSFDGVTPYAHYTAVSTLLSLQRPRTEEPAETTFLVATQVMELLFALIRHEWEQARDAVDADDVPAALAALRRGHKAQDVLAESWELLAPMTPTEFNRFRDQLGEASGFQSYGYRHLEFLLGNKSAAMIRPHRADPHVSAELERALAEPSLYDAVLRLLHRRGFPVPAERVERDWTQPAEPHPQVVRVWELVYADDRPDNELLALAEALLDTAERVTLWRHRHAMAVKRTMGAKAGTGGSSGLQWLMRNVQKDVFPELWQLRT

SEQ ID NO: 8249 - protein, 354 aa, Thermobifida fusca
LLRRVDAERAHRVSFAGLRALAAVPGTTRLMRRVLGPREPELRVRVFGREFPGPLGLAAGFDKNARGVAALTALGFSHVEIGTVTGQPQPGNPRPRLFRLVADRAIVNRMGFNNEGSQAVSERLRAHRARRARDLIVGVNIGKTKVVPDSDAVADYVTSARRFADLADYLVVNVSSPNTPGLRDLQATERLRPLLSAVRRTLDEAGRPDLPLLVKIAPDLADEDIDAVADLAVELGLDGIIATNTTVSRDGLATDPEEVAALGAGGLSGAPLKERALQVLRRLRARVGDRLVLIAVGGIETPEDAWARIRAGATLVQGYTGLIYGGPLWPRRIHRGVAALARRDGFASIAEAVG

SEQ ID NO: 8250 - protein, 311 aa, Thermobifida fusca
LITVVGEALIDLISSESGTYRSVPGGAPANTAVALARLGVPSSLLARMSTDRFGQQLRAYVGSRGVSTRDIVVSDEPTTLAIATLDETGRATYDFYVKGTVDWQWRPEELPDPLADDVTAIHVGSLAMAMPPGAAVVEEWVARQRGRAVISYDPNIRPALAGTPASARERVERQVALADLVKVSDEDVYWLYEQDPATGSADLLVEVGRSWLRRGPSLITITCGGDQTLVLVRGREDRPLSVAPEPVDVVDSIGAGDAFCAGLLDALGQAGALGADGRERLAALTDAQLTVCVAHAHRVAAHTCRRVGADP

SEQ ID NO: 8251 - protein, 446 aa, Thermobifida fusca
FVWGVATASFQIEGSTTADGRGPSIWDTFCATPGKVENGDTGDPACDHYNRYRDDVALMRELGVGAYRFSIAWPRIQPEGKGTPVEAGLDFYDRLVDCLLEAGIEPWPTLYHWDLPQALEDAGGWPNRDTAKRFADYAEIVYRRLGDRITNWNTLNEPWCSAFLGYASGVHAPGRQEPAAALAAAHHLMLGHGLAAAVMRDLAGQAGRSVRIGVAHNQTTVRPYTDSEADRDAARRIDALRNRIFTEPLVKGRYPEDLIEDVAAVTDYSFVQDGDLKTISANLDMMGVNFYNPSWVSGNRENGGSDRLPDEGYSPSVGSEHVVEVDPGLPVTAMGWPIDPTGLYDTLTRLANDYPGLPLYITENGAAFEDKVVDGAVHDTERIAYLDSHLRAAHAAIEAGVPLKGYFAWSFMDNFEWALGYGKRFGIVHVDYESQTRTVKDSGWWY

SEQ ID NO: 8252 - protein, 382 aa, Thermobifida fusca
MSYRLSDEHEELRRTVAEFARTEVAPVIGDYYERAAFPYEIVAAMGRMGLFGLPFPEDVGGMGGDYLALCLALEELARVDSSVAITLEAAVSLGAMPIYRFGTPEQQATWLPRLCSGEALGAFGLTEPEGGSDAGATRTTARLDAGEWVINGTKSFITNSGTDITALVTVTAVTGQRPDGRPEISAIIVPAGTPGFTIGQRYSKVGWCASDTNELVFTDCRVPEANLLGERGRGYAQFLSILDEGRIAIAALAVGLAQGCVDECLRYVGQRVAFGREIGRYQAIQFKIADMAARVHTARLAYYDAAARLLAGQPFKKEAAIAKLVASHAAMDNARDATQIFGGYGFMNEYPVGRFYRDAKILEIGEGTSEIQRMVIARELGL

SEQ ID NO: 8253 - protein, 660 aa, Thermobifida fusca
VLVANRGEIAVRIIRTLRQLALPAIAVYTDQDADAPHVRAADSALRIPDYLDGDAIIAAAHASGAALIHPGYGFLAENAGFARACTAAGLVFVGPTPDSIAAMGDKIRAKQTVAAAGVPVLPGFAEDPGHPLSATDLTAAAAQIGYPLLLKPSAGGGGKGMRLVHSPDELADAAAAARREARAAFGDATLLAERYVARPRHIEVQILADTHGTIVHLGERECSLQRRHQKIVEEAPSPLLTPEQRNAMGQAAVAAARACGYVGAGTVEFIVPGDDTDRFFFLEMNTRLQVEHPVTEAVTAIRGTRGIDLVEAQLRIALGEALPFTQDDITWQGHAIECRIYAEDPARNFLPTGGRILHVAEPHGPGIRVDSGISEGTTVTSAYDPLLAKLVVWDHDRASALRRADAALARTTLLGCGTNTAFLRALLAHPDVAAGQLSTGLVEHLHPELAPALQAGPDVLAAAALDRHLDLVATSDPANRFTIPDGWRLGEPAWTVWRLHSPGSDPVTVRVRADHDHPHRFHVRVADADPHEATAVRSPDGRSLHVTYAGQARHYTRATDGHDLWLGHAGAAWCFRDAPRTAPLRRTSGHADGAVRSPMPGTVLDVPVAVGDTVRAGQTLAVVEAMKMEHPVAAPVDGTVTELHARPGQSVPLDALLAVV

SEQ ID NO: 8254 - protein, 590 aa, Thermobifida fusca
RRSLAALLAALLGCATSLVALTVAASPAHAAPSGNRDVIVHLFQWRWKSIADECRTTLGPHGFGAVQVSPPQEHVVLPAEDYPWWQDYQPVSYKLDQTRRGSRADFIDMVNTCREAGVKIYVDAVINHMTGTGSAGAGPGSAGSSYSKYDYPGIYQSQDFNDCRRDITNWNDKWEVQHCELVGLADLKTSSPYVQDRIAAYLNELIDLGVAGFRIDAAKHIPEGDLQAILSRLKNVHPAWGGGKPYIFQEVIADSTISTGSYTHLGSVTEFQYHRDISHAFANGNIAHLTGLGSGLTPSDKAVVFVVNHDTQRYEPILTHTDGARYDLAQKFMLAHPYGTPKVMSSYTWSGDDKAGPPMHSDGTTRPTDCSADRWLCEHRAVAGMVGFHNAVAGQGIGSAVTDGNGRLAFARGSAGYAAFNATNTAWTRTFTTSLPDGVYCDVANGTFVDGVCDGPSYQVSGGKFTATVPANGAVALHVEAPGSCGPDGCGTPPGGGDDCTTVTARFHATVTTWYGQEVAVVGSIPELGSWQPAQGVRLRTDSGTYPVWSGAVDLPAGVGFEYKYVKLNPDGTVEWEQGGNRIATVDDSG

SEQ ID NO: 8255 - protein, 471 aa, Thermobifida fusca
TAAPTTVTGRIARVIGPVVDVEFPVGSLPPIYNALKTEVTLGGETRTITLEVAQHLGDNLVRAISLNPQDGLVRGAEVRDTGAPIRVPVGDGVKGHVFNALGEPQDIPKSELQVKEYWPIHRPAPAFDQLEAKTEMLVTGIKVIDLLTPYVRGGKIGLFGGAGVGKTVLIQEMITRIARNFGGVSVFAGVGERTREGTDLFLEMQEMGVLPDTALVFGQMDEPPGTRLRVALSALTMAEYFRDVQKQDVLLFIDNIFRFTQAGSEVSTLLGRMPSAVGYQPNLADEMGLLQERITSTRGHSITSMQAIYVPADDYTDPAPATTFAHLDATTELSRPISQKGIYPAVDPLTSTSRILDPQYVGQEHYEVAQRVKEILQRNHDLQDQIAILGIDELSEEDKIIVHRARRLERFLSQNMFVAEKFTGTPGVFVPLEETIASFKAICDGEYDHLPEQAFLNVGNIEMAVEKAKKL

SEQ ID NO: 8256 - protein, 304 aa, Thermobifida fusca
MGAQLRVYRRRIRSTKSMAKITRAMELIAATRITKAQRAAEAAAPYAREITRAVSAVAARVSDHPLLTEAENPTRAAVLVITSDKGLAGAYTANAIKEAERLTALLNEQGKEVLTYMVGRKGIGFYKFRERPLADSWEGFTERPSYMHAMEISSALMEKFIQETAEGGVDEIHIVSTEFISMINQRARASRILPLEVEEVDSKVLEAEQGPLPLYEFEPGAEEVLDQLLPKYVTNRIYFALLESAASQHASRRAAMKAATDNAEELVKTLTRQANQARQAEITNEISEIVGGADALAAASAGSE

SEQ ID NO: 8257 - protein, 507 aa, Thermobifida fusca
LTIRPEEIRDALQRFVQSYEPDAAAREEIGTVTYSGDGIARVSGLPSAMANELLEFEDGTQGIAQNLEIGEIGVVVLGDFTNIAEGQTVRRTGQVLSVPVGDAYLGRVVDPLGRPIDGKGEIETTERRELELQAATVMQRKPVHEPLQTGIKAIDALTPIGRGQRQLIIGDRQTGKTAVCIDTIINQKANWESGDPNKQVRCIYVAVGQKGSTIAGVRAALEEAGAMEYTTIVASPASDPAGFKYIAPYTGSAIGQHWMYQGKHVLIVFDDLTKQAEAYRAVSLLLRRPPGREAYPGDVFYLHSRLLERCAKLSDEMGAGSLTGLPIIETKANDVSAYIPTNVISITDGQVFLESDLFNQGQRPAINVGISVSRVGGAAQTKAMKKVVGSLRVGLAQYRDLEAFAAFGSDLDAASKAQLERGARLMELLKQGQYSPFPMEEEVVSIWAGTTGHLDDVPVEDIRRFESEFLAYLRREHSKILDVIRETEDFGDDTAEALTDAIKEFKK

SEQ ID NO: 8258 - protein, 421 aa, Thermobifida fusca
VALLGCGVVGSQVVRLLNEQSRELAERIGTPLEIGGIAVRRLDRARGTGVDPDLLTTDAMGLVTRDDIDLVVEVIGGIEPARSLILAAIQKGKSVVTANKALLAEDGATIHAAAREAGVDVYYEASVAGAIPLLRPLRDSLAGDRVNRVLGIVNGTTNYILDRMDSLGAGFTESLEEAQALGYAEADPTADVEGFDAAAKAAILARLAFHTPVTAADVHREGITEVSAADIASAKAMGCVVKLLAICQRSDDGSSIGVRVHPVMLPREHPLASVKGAYNAVFVEAESAGQLMFYGAGAGGVPTASAVLGDLVAVARNRLARTFVADGRADAKLPVHPMGETITSYHVALDVADRPGVLAGVAKVFAANGVSIKHVRQEGRGDDAQLVLVSHTAPDAALARTVEQLRNHEDVRAVASVMRVE

SEQ ID NO: 8259 - protein, 434 aa, Thermobifida fusca
DLLELHPRVWPSTATRVDGEITIGGVGVTELARKFGTPLYVIDEADFRARARDYRLAFEDADVYYAGKALLTKAVARWVAEEGLKLDVCTGGELAVALAAGFPPERIGMHGNNKSAAELARAVEVGVGRIIIDSFDEIDRLERIAAERGRVPEVLIRVTTGVEAHTHEFVATAHDDQKFGLSLSNGAAAEAVRRLLTSPHLRLVGLHSHIGSQIFDTAGFEVAARRLSTFLTQIYAEHGISLPELDLGGGLGIAYLPDDDPLDPKSIADSLRSIVEHECAAQNLPVPRIAVEPGRAIAGPAGITLYEVGTVKDVEGIRTYVSVDGGMSDNIRTALYGAEYTCVLASRHSDAEPMLSRLVGKHCESGDIVVRDLYLPADLRPGDLVAVAATGAYCYSMASNYNHVPRPAVVAVREKNARVLVRRETEEDLLRLDV

SEQ ID NO: 8260 - protein, 499 aa, Thermobifida fusca
  unsure (1)..(499): unsure at all Xaa locations
VIRTGSGDVRGSKENGIAVFRGIPYAEPPVGAHRFTAPRPPRPWDGVRDATEFSATAPRPPYPEAIGALLIERFIPGDDYLTLNVWTPDPNAVGLPVMVWIHGGAFTNGSGSEPVYDGAAFARDGVVFVSFNYRLGIIGFADLPDAPSNRGLLDQIAALEWVRDNIARFGGDPGNVTVFGESAGAMSVCTLMATPRARGLFRRAILQSGAGNMAVAAEDATTIAAVIAHRLGVEPTAAALAHVPVAQLLDVQQQVAQEIQGAPDPAVWGERIAGGSVLLPFAPVIDGELLSQRPAEAIAGGAGHDVDLLFGTTTDEYRLFLAPTGLLPFITGDYVTTHLAKSGLDADAAKAYTAEGRGEEPGDILASIITDQVFRIPALRIAESRVDAPARTFGYEFAWRTPQLDGILGACHAVELPFVFRTLDRAASLVGTNPPEELAETVHNAWVRFATSGDPGWPAWNPETRSVMRFDHPVSEMVTDPYPATRALWDGVPLXPGPR

SEQ ID NO: 8261 - protein, 479 aa, Thermobifida fusca
VRFLNDQVPTHDLTYGDVFMVPQRSSVGSRMNVDLTSHDGTGTTIPIVVANMTAVAGRRMAETVARRGGLVVLPQDIPTDVVADVIQWTKTRDLVHDTPITLAPTETVGHALNLLPKRAHNAVIVVDEERRPIGVVTEADCVGVDRFTQLHEVMSTELLTLAAGTDPQEAFAILHDSRHRLAPVVDSNGALVGVLTRTGALRATLYRPAVDAQGRLRVAAAVGINGDVAGRAAKLLEAGVDTLVVDTAHGHQEKMLEVLRQVRALDPQVPVVAGNVVTAEGVRDLVEAGADIVKVGVGPGAMCTTRMMTGVGRPQFSAVVECAAAARELGKWVWADGGIRHPRDVALALAAGASNVMIGSWFAGTYESPGDVLRDSEGRLYKESFGMASARAVRLRTADDSPFERARKALFEEGISSGRMYLDPERPSVEDLIDMIVAGVRSAMTYAGAANLAEFHERAVIGVQSVAGYNEGKPVLHGW

SEQ ID NO: 8262 - protein, 239 aa, Thermobifida fusca
QVRITLRVWRQKSRDDEGRMVTYELDDVNENMSFLEMLDVLNEKLTLQGEDPIAFDHDCREGICGACGVVINGVAHGPEVTTTCQLHMRSFKDGDVIEVEPWRAKAFPVIKDLVVDRSAFDRIIQAGGYISAPTGTAPDAHSVPVPKADADRAFDAATCIGCGACVAACPNASAMLFTAAKITHLGMLPQGQPERASRVVKMVNQHDEEGFGGCTNIGECAAVCPKGIPLDTISQLNND

SEQ ID NO: 8263 - protein, 561 aa, Thermobifida fusca
RKLSIIIVGTGLAGASAAATLGEAGYNIKSFCYQDSPRRAHSIAAQGGINAAKNYRNDGDSIYRLFYDTVKGGDYRARESNVYRLAQVSVEIIDQCVAQGVPFAREYGGLLDNRSFGGVQVSRTFYARGQTGQQLLLGAYQALERQVAAGTVEMYTRHEMLDLIVVDGRARGIIVRDMVTGEIETHFADAVVLATGGYGNVFFLSTNAMGSNVTAIWRAHRKGAFFANPCFTQIHPTCIPVSGTYQSKLTLMSESLRNDGRIWVPKKKGDTRDPRDIPEEERDYYLERMYPAFGNLVPRDIASRAAKRVCDEGRGVGPGGLGVYLDFADAIKRMGRDAVEAKYGNLFDMYERITGENPYEVPMRIYPAVHYTMGGLWVDYDLQSTIPGLFVIGEANFSDHGANRLGASALMQGLADGYFVLPNTINDYLADGPFEKIDENHPEVKEAVEGVRARLEKLLSINGSRTVDSFHRELGKIMWDYCGMERTEEGLRKAITLIRELRDEFWRDVKVTGVNEELNQTLERAHRVADFMELAELMCIDALHRRESCGGHFRAESQTED

SEQ ID NO: 8264 - protein, 396 aa, Thermobifida fusca
  unsure (1)..(396): unsure at all Xaa locations
LSPKAKDYLANLQEFMDEHVYPAEPVYHAWRQQAGPDNHELPPIMEDLKAEARRRGLWNLFLPDVSGLSVLDYAPLAELSGRSSLAPQAMNCSAPDTGNMEVLHMFGTPEQKKRWLEPLLDGRIRSAFAMTEPDVASSDATNIRTSIVRDGDEYVINGRKWWISGAADPRCEIFIVMGKTNPDADLHRQQSMILVPRDTSGVKVLRSLPVFGYQDQEGHCEVEFDNVRVPAENLIANEGDGFMIAQARLGPGRVHHCMRALGKAERALELMVRRATSRVAFGKPLSEQGIVQAHIAESRLEIEQARLLVLKTAWMIDRYGAKAARNEIAAIKVVAPRVAAAVIDRAIQVHGGAGVSDVVPLAEMYAGARAMRIFDGPDEVHLRSLARREIKRHSXS

SEQ ID NO: 8265 - protein, 200 aa, Thermobifida fusca
LFDLDGTLINSEPRSVAVWARVLQDRGVEPDEALLCKFMGRRGEDVINELAHLFPGESVEDIFADRWRYGQDPDLPPVEQLPESVAFLKYLHAQGVPFALVTSAGRQWAESTLEWLGVRDMFRGIISADDVTVGKPHPEGYLSGAELVGYGPEHIVVFEDTPAGIMAGRNAGMRVVGVTTTHPPQALAHAHLVVEHLGQV

SEQ ID NO: 8266 - protein, 476 aa, Thermobifida fusca
FDFKVADLSLAEFGRKEIRLAEHEMPGLMATRAEFGPKKPLRGAKITGSLHMTVQTAVLIETLVELGAEVRWASCNIFSTQDHAAAAVVVGPDGTPDNPRGVPVFAWKGETLEEYWWCTEQALTWPDGEGPNMILDDGGDATMLVHKGVQYEKAGAVPDPDTADSEEFRIVLELLRRTLAENPRKWTEIASRIKGVTEETTTGVHRLYEMQRSGTLLFPAINVNDSVTKSKFDNKYGCRHSLIDGINRATDVLIGGKVAVVAGYGDVGKGCAESLRGQGARVIVTEIDPICALQAAMDGYQVTTLDEVVETADIFITATGNRDVITAEHMARMKHQAIVGNIGHFDNEIDMAGLAAIPGIEKIEIKPQVHEWRFPDGHSIIVLSEGRLLNLGNATGHPSFVMSTSFTNQVIAQIELFTKTDQYPTGVYVLPKHLDEKVARLHLDALGVKLTRLTKEQAEYIGVDIDGPYKSDHYRY

SEQ ID NO: 8267 - protein, 390 aa, Thermobifida fusca
ESLQPNDPTTFGQYSVIGRLGRGGQGIVYLARDSEGQKYAIKVLNEQWSQDTELRKRFEKEVRAAQKVASFCTAAIHEANLDADPPYVVSEYVEGPDLQEAVSKEGPRKGAALQRLAVSTATALVAIHQAGIVHRDFKPGNVLLGPDGPRVIDFGIARVTDSTATMTNSIVGTPSYMAPEQITGKNITDKVDVFAWGCVMAFASTGNAPFGSDSVPAVVHRVVSAPPDISEVPEPLREIVADCLNKDPDKRPTAKQLLMRLLGHNVEDETKVSTSQAVEEGEKRAISPTPFVSPYPNQQVSESGPQTPFPPQPPPAPPTPPHTGPQSGYRYPQPGPPVPNPNSGGRAHPNVTTHSSMPSLPPHPPITTPRPNYPTLPQTTSQQADDPVLS

SEQ ID NO: 8268 - protein, 454 aa, Thermobifida fusca
  unsure (1)..(454): unsure at all Xaa locations
QIFKAYDIRGVFPDTLDADIARAVGAAFARIVDGDTIVVAHDMRPSSPELAAAFTEGANAQGRDVIMAGLGSTDLLYFASGKFNIPGAMFTASHNPAQYNGIKMCRAGAAPIGVETGLAEIRELVEQGVPAYDGPRGTVTERDLLADYAAHLRKLVDLSGIRTLKVVVDAGNGMGGHTVPAVLGDQLLDALPLEIIPLYFELDGTFPNHPADPMNPANIVDLQAKVRETGADIGLAFDGDADRCFVVDERGEPVPPSAITALVAVQELAQEPGATIIHNLITSRAVPEIVAEHGGVPVRTRVGHSFIKAAMAQTGAIFGGEHSAHYYFRDFWKADTGMLAAMHVLRVLGTDHRPLSEITAEYTRYVASGEINSRVADQAGRMAAVEEAFTGRADVESVDHLDGLTVNLTGKRWFNLRASNTEPLLRLNVEAPDTESMAELRDEVLAIIRAXPLH

SEQ ID NO: 8269 - protein, 341 aa, Thermobifida fusca
IDVRRGAIADLGLLLADRRIANEGRIAVAVGPGQGARIVADLNLPHCEVFQVDEGTVDVANELGKKLRTEAFEAVAGIGGGKTIDVTKFAATMAGIPMIAVATNLSHDGIASPVSSLEHESGKSSYGVNMPVAVVVDVDYVRSAPDRLVRSGIGDVLSNLSAITDWELAGKEMDEPVDGMAVTFARVAAESVLHRRDSVESESFLTALAEALVLSGMAMSVAGSSRPASGADHEILHAIDQLYPGTSNHGELAGLGTLFAFFLRSRYLGHGEQQLEDIRASLLRHRLPTLPSDVGLDEEQFVKAVVHAPSTRPGRYTVLEHLNLSEDEIRRSVRDYVQTFG

SEQ ID NO: 8270 - protein, 437 aa, Thermobifida fusca
LRIAVLGTGYLGATHAACMADLGFDVLGLDTDQSKIASLSSGRVPFYEPGLEEVLNRNLAAGRLRFTTDYAEVAAFADVHFICVGTPQQANSNAADLRYVDAVVDTLAPLLTRPAVIIGKSTVPVGTAARLAARFRALAPAGEAVELGWSPEFLRESHGVEDTLNPNRIVLGTDSPRVEQVMREICASQIERGIPFLVTDLQTAELVKVSANAFLATKISFINAMAEVCEAVGADVIQLAKALSYDDRIGGKFLGPGLGFGGGCLPKDIRAFMARADELGVESALSFLREVDAINQRRRARTIDIARGLIGGSFAGRTVGVLGASFKPNSDDIRDSPALDVAATINSLGARVTVYDPEALENAKRAYPQLNFAHTMLEAVRDAEVVLLLTEWAEFRDADPDELGKVVAEKRIVDGRNALDPDYWRSRGWTYRALGRP

SEQ ID NO: 8271 - protein, 862 aa, Thermobifida fusca
LRRDVRLLGEMLGTVLAESGGQDLLDDVERLRRAVIGAREGTVEGKEITELVASWPLERAKQVARAFTVYFHLVNLAEEHHRMRALRERDDAATPQRESLAAAVHSIREDAGPERLRELIAGMEFHPVLTAHPTEARRRAVSTAIQRISAQLERLHAAHPGSGAEAEARRRLLEEIDLLWRTSQLRYTKMDPLDEVRTAMAAFDETIFTVIPEVYRSLDRALDPEGCGRRPALAKAFVRYGSWIGGDRDGNPFVTHEVTREAITIQSEHVLRALENACERIGRTHTEYTGLTPPSAELRAALSSARAAYPRLMQEIIKRSPNEPHRQLLLLAAERLRATRLRNADLGYPNPEAFLADLRTVQESLAAAGAVRQAYGELQNLIWQAETFGFHLAELEIRQHSAVHAAALKEIRAGGELSERTEEVLATLRVVAWIQERFGVEACRRYIVSFTQSADDIAAVYELAEHAMPPGKAPILDVIPLFETGADLDAAPQVLDGMLRLPAVQRRLEQTGRRMEVMLGYSDSAKDVGPVSATLRLYDAQARLAEWAREHDIKLTLFHGRGGALGRGGGPANRAVLAQAPGSVDGRFKVTEQGEVIFARYGQRAIAHRHIEQVGHAVLMASTESVQRRAAEAAARFRGMADRIAEAAHAAYRALVDTEGFAEWFSRVSPLEELSELRLGSRPARRSAARGLDDLRAIPWVFAWTQTRVNLPGWYGLGSGLAAVDDLEALHTAYKEWPLFASLLDNAEMSLAKTDRVIAERYLALGGRPELTEQVLAEYDRTRELVLKVTRHTRLLENRRVLSRAVDLRNPYVDALSHLQLRALEALRTGEADRLSEEDRNHLERLLLLSVNGVAAGLQNTG

SEQ ID NO: 8272 - protein, 585 aa, Thermobifida fusca
VRKVLIANRGEIAVRVARACRDAGLGSVAVYAEPDIDALHVKVADEAYALGGQTPADSYLDIDKILAIAAKSGADAVHPGYGFLAENADFAQAVIDAGLTWIGPPPEAITALGDKVKARHIAQKVGAPLVAGTPDPVSGVDEVLAFAEQHGLPIAIKAAFGGGGRGLKVARTMEEIPDLYESAVREAVTAFGRGECFVERYLDRPRHVETQCLADAHGNVVVVSTRDCSLQRRHQKLVEEAPAPFLTDEQVELLYSSSKAILREAGYVGAGTCEFLVGADGTISFLEVNTRLQVEHPVTEEVTGIDLVREMFRIAAGEELGYDDPEVRGHSFEFRINAEDAGRNFMPAPGTITSMRLPGGPGVRVDTGCEPGFTVPQAFDSMVAKLIVTGRTRTEALERARRALAEFEVGGMPTVIPFHQAVVRHPAFAPADPEQPFSVHTRWIETEFDGVIEPFSGDVEQTEAAEREKVTVEVDGKRLEVVLPAGLGADLSASAPAKKSGKRGGSRKKSAAAVSGDALVSPMQGTIVKVVASDGQEVSEGDTIVVIEAMKMEQPLTAHKSGTVTGLSVSAGETVGNGAVICEIK

SEQ ID NO: 8273 - protein, 455 aa, Thermobifida fusca
VTKVVIIGGGPGGYEAALVAAQLGADVTVIERDGIGGASVLTDCVPSKTLIATSVRTSYVKEAATLGINVGNEPEDKDLVRVELKTVNARVKRLAQAQSVDTANRLRTEGVEIIIGEARLVDPHIVAVGDERIRADVVLIATGAHPRELPTARPDGERILTWRQLYDLNELPEKLIVVGSGVTGAEFANAYQALGSDVTLVSSRDRVMPTQDADAARVLEDVFARRGMTVLGNSRAESVTRTDAGVLVRLTDGRVIEGSHCLMTVGMVPNTANLGLEEAGIRLDERGFVQVDRVSRTSTPGVYAAGDCTGVNMLASVAAMQGRIAMWHALGAAVSPLRLSTVASTVFTHPELAAVGATEDDVVSGRVDGRIVKLPLATNPRAKMHNTRDGFVKLICRQHTGIVLGGVIVGPRASELILAVSLAVQQRLTVDDVAHTFAVYPSLSGSVTEAARSLM

SEQ ID NO: 8274 - protein, 403 aa, Thermobifida fusca
KIKVENPVVELDGDEMTRIIWSFIKERLILPYLDIDLKYYDLGIEERDRTEDQVTIDAAHAIKKYGVGVKCATITPDEARVEEFGLKKMWRSPNGTIRNILGGVVFREPIICSNVPRLVPGWTKPIIIGRHAHGDQYKASDFKVPGPGTVTITYTPENGGEPIEMEVAKFPEGGGVALGMYNFRKSIEDFARACFNYGLDRNYPVYLSTKNTILKAYDGMFKDVFAEIYENEFKEKFEKAGLTYEHRLIDDMVAAALKWEGGYVWACKNYDGDVQSDTVAQGFGSLGLMTSVLRTSDGRVVEAEAAHGTVTRHYRQHQQGKPTSTNPIASIFAWTRGLEHRGKLDNTPAVIEFARTLEDVVIKTVESGQMTKDLAILIGPDQEWLTTEQFLAVLDENLQKRLA

SEQ ID NO: 8275 - protein, 278 aa, Thermobifida fusca
AQVLDGKATAAAIREELKERVAALRARGVVPGLGTILVGDDPGSHAYVRGKHRDCAEVGIASIRKDLPADATQADVEAAVAELNADPACTGFIVQLPLPRGLDENRVLEKIDPAKDADGLHPSNLGKLVLMEEAPLPCTPRGIVELLNRYGVSLRGAEVVVVGRGVTVGRPLGLLLTRRSENATVTLCHTGTRDLAAHTRRADIVVAAAGVPGLITKDMVSPGAVVLDVGVTRTEKGLVGDVAPDVAEVAGYLSPNPGGVGPMTRAMLLTNVVEAAER

SEQ ID NO: 8276 - protein, 308 aa, Thermobifida fusca
  unsure (1)..(308): unsure at all Xaa locations
MAIFLTKDSKVLVQGMTGSEGTKHTRRMLAAGTNIVGGVNPRKAGQVVDFDGTQVPVFGSVAEGMKATGADVTVIFVPPKFAKDAVIEAIDAEIGLAVVITEGIPVHDTATFWAHACSKGNKTRIIGPNCPGLITPGQSNAGIIPADITKPGRIGLVSKSGTLTYQMMYELRDIGFSTCVGIGGDPIIGTTHIDALAAFEADPDTDVIVMIGEIGGDAEERAAEYIKKHVTKPVVGYIAGFTAPEGKTMGHAGAIVSGSSGTAAAKKEALEAVGVKVGKTPSEAAKLVRSLFXHATRVGGPAPAEGRA

SEQ ID NO: 8277 - protein, 392 aa, Thermobifida fusca
VDLFEYQAKALFAEYGVPVPQGKVASTPEEVRAIAEEFAAAGKPRVVVKAQVKTGGRGKAGGVKVADGPDDAVAKAKQILGMDIKGHTVHRVLVEEASDIAEEYYFSFLLDRANRSFLSICSAEGGMEIEEVAATNPDAVAKVPISPLKGAPADVAADIVAQGKLPEAAAQGAVDVITKLWKVFVEKDATLVEVNPLILTKDGRVVALDGKVTLDDNAEFRQDLESLASAAEGDPLEVKAKEKGLNYVKLDGEVGIIGNGAGLVMSTLDVVAYAGEQHGGVKPANFLDIGGGASAEVMANGLEIILSDPAVKSVFVNVFGGITACDAVANGIVQALELLESRGEDVTKPLVVRLDGNNAELGRSILNERNHPAVRQVDTMDGAAALAAELAA

SEQ ID NO: 8278 - protein, 119 aa, Thermobifida fusca
LSVPAELGYTKEHEWVAINEGIATVGITAFAAEALGDIVYVEPPEVGSTVTAGESCGEIESHKSVSELYSPVDGEVVDVNQAAVDDPELIGSDPYGRGWLFKVELAEEPADLLTPEQYT

SEQ ID NO: 8279 - protein, 346 aa, Thermobifida fusca
NDTRVVSYQPLVAPHDLLAELPMGPERTALVEEARAEVKKVLDGEDDRLLVVVGPCSVHDPESALDYARRLKALIPSVSSELCVVMRVYFEKPRTTLGWKGLINDPGLDGSFDVHRGLRTARKLLLDIGSLGVPAGTEFLDPITPQYIADAVTWGAIGARTTESQVHRQLSSGLSMPVGFKNGTDGNVQVAVDACRAAASSHTFFGVDPSGSGAVVSTSGNPDCHVILRGGRSGPNYDADSVAAALDTIEAAGLPRRLMIDASHANSGKDHLRQPGVAQAIAAQVAEGQTGIIGVMLESFLVPGAQKLGDPAKLTYGQSITDKCMGWETTEEVLAHLADAVRSRRK

SEQ ID NO: 8280 - protein, 580 aa, Thermobifida fusca
DYDVIVVGSGFGGSVSALRLTEKGYRVGVLEAGRRFTPETLPKNSWDLRNFLWAPRLGFFGIQRIHLLRDVMILAGAGVGGGSLNYANTLYEPLDDFYNDPQWRDITDWREELAPFYDQAKRMLGVRTNPTVTPADVHLRHAAEAMGVGSTFHLAPVGVFFGDGKDGAATQPVSPGEACRDPYFGGAGPTRRACLECGECMTGCRHGAKNMLTENYLYFAERHGAVIHPMTTVVAIRERPASLGGGYAVDTVATGAFRTRRATRTFTARYIVLAAGTYGTQRLLHAMRDSGLLPRISPKLGTLTRTNSEALVGAMTKAIRPPQDFTQGVAITSSMHPDAHTHIEPVRYGKGSNAMGLLTTMQVPGGGRIPRWLRFLGVIAAHPYLFMRSLSVRRWSQRTIIGLVMQSLDNSLTTYTRRGLFGRRVLTSRQGHGAPNPTWIPVAQQFAAQIAKQIDGYPGSCVSEIFDIPLTAHFLGGCPIGASPEEGVIDPYHRLYGHPGIHVVDGSAVTANLGVNPSLTITAQAERAMAMWPNKGEPDPRPAPGSPYQRVEPVYPVRPAVPAGAYAELRFTRRIALPLD

SEQ ID NO: 8281 - protein, 372 aa, Thermobifida fusca
SESELNLLYSEIEQELRASVRELLAHRCPWQSVLDRVSHHAPAEVTDRALWQELAELDVLGLFVPETLGGAGATAREASSVAEELGRAVAPVPFLGSAVLATGALVALGTAEEQVRALLTDLAAGQRCATLVVPLPTAPGSGFPSQVRADGSQLTGTVPGVVDALSADVLVVPALGAEGPGLYLLPADQATLSPVVSLDQTRPLAEVTLTGAEATRVAVGQQAVDAVEAALLTGAVLLAAEQLGTAEWAFDTTVAYLKERVQFARPIGSFQALKHRVADLWVLLAQARAVVRHAASALAADSEDLPLAAALAQAFVSEVAVKVTEEAVQLHGGIGFTWEHPVHLYLKRAKSASLSLGTADRHRARIADLVGL

SEQ ID NO: 8282 - protein, 391 aa, Thermobifida fusca
DAAELRARVAAFVAEHDPATTDQTEFLAARYDAGLAWVHFPKGAGGLGAPCALQNVVDAEFERFGFVPVDREGLVIGLGMAAPTIAAFGTPEQRDRFLKPIYTGEEVWCQLFSEPGAGSDLAAVGTRAVRDGTDWVIDGHKVWTSLAHRAQWAILLARTDPDVPKHRGLTYFLCDMTAPGVTVRPLRQMTGEAEFNEVYLDEVRIPDSLRLGGVGEGWKVAQTTLMNERVSIGGRPEPREGGLIGIVSDLWRSRPDLRTRGLHEELLRLWVAAEAARLTKERLRQQLAAGQPGPEGSATKLSFAELNQRISGLELELRGVEGLTYDDWTFRRPEKPDLLGRGPGFRYLRAKGNSIEGGTSEILRTIIAERVLGLPPEPRADKDLAWKDLPR

SEQ ID NO: 8283 - protein, 244 aa, Thermobifida fusca
RVAIVTGAARGIGAATAQRLAAEGHAVAVLDLTKESAQATVDAITEAGGKAIALGADVSDTQQVEAAVKETAERLGPPTILVNNAGVIRDNLLFKMTDDDWDTVMRVHLRGAFLMSRAAQAYMTEQGWGRIINLSSSSALGNRGQANYSAAKAGLQGFTKTLAIELGKFGVTANAVAPGFIVTDMTRATAQRIGVDFEEFKAARAAQIPVRRVGVPEDIAATVAFLASEEAGYISGQVIYVAGG

SEQ ID NO: 8284 - protein, 612 aa, Thermobifida fusca
PVLCVDNLHVTFPATPHSQPVPAVRGLSYQLHRGEILGIVGESGSGKTAALLAVLGLLPDRTRITGSIRLHGRELLGLTERELAAIRGATVATVSQDPLAALTPVHTVGFHLAEALRLHQPRLSRAQVKDRIVALLRRVGIPDAERLPDAYPHELSGGMRQRVMIAMAIANNPDVILCDEPTTALDPTVQIQILDLLATIRRDTGAAIVLVTHDLGVVAEIADRVLVMYAGQPVETGTVAEVYRHPRTPYTMGLLAALPRVDTTDPAPPAPISGTAPPPTAPPRGCPFAPRCPIALPACTAEPPALQPVDPTAPAGHRAACHRLADITAHQWTAADLYPQPAPASPTRPPRDQRSTVLAVDSLVKHHPLYRGSLFRRRAGAIHALDGVSFDLREHETLALVGESGAGKSTLLTEILELARPAHGRITVLGHDTATLTPQQRFALRRDLQVVFQDSSSALDPRMTVAQIVAEPLQIHRYPRRDIPHRVREVLSLVGLDSSFTQRRPAQLSGGERQRVGIARALALNPKLLLLDEPVSALDVSVQAGILALLTELQARLGLSCLLVTHDLAVVRHVADRVAVMHLGVIVEIGATEPVLTAPRHPYTQALLSALP

SEQ ID NO: 8285 - protein, 382 aa, Thermobifida fusca
RRSAHNYHPLPVVIAHGEGAWVTDVAGRRYLDCLAGYSAVNFGHRNPELLAAARAQLDRITLTSRAFHHDRFAPFVAALADLVGKEQVLPVNTGAEAVETGIKIARKWGYEVKGVPDGRAVIVVASGNFHGRTTTIVSFSTDPAAYRGFGPPTPGFRIVPYGDAAALADAIDADTVAVLVEPVQGEAGVIVPPADYLPRVRDLCTRAGILLIADEVQSGLGRTGTVRACDHSGVDADIYLFGKALGGGILPVAAAVGDAEVFDVIRPGQHGSTFGGNALACAVGTAVVSLVRDGPYLDHVRALAPVLRARLDQLVGNGVVAARSIGLWAGIDVDPTLATGRELCERLLQRGVLVKDTHGSTIRLSPPLVITEDELHWAVDQI

SEQ ID NO: 8286 - protein, 639 aa, Thermobifida fusca
QPPILWSPDEERKERANLTAFTRWVREHRGVDAPDYEALWRWSVTDLEGFWSAIWEYYRVRAATPYTTVLASDAMPGAVWFPGATLNYAEHIFRDRDPSAVAIRHASELRPLTEWTWGELRTRTAAIAAALRSLGVGPGDRVVAYLPNIAEATAAFLACAAIGATWSSCSPDFGVRSVLDRFAQIEPKVLLAVDGYRYGGKDFDRRDVLKALRDGMPSLQHTVVLPYLGCGPVADTLSWAEFEAAGEGAELEFTPLPFDHPLWVLYSSGTTGLPKAIVHGHGGILLEQLKNLHLHLDAHADDRVFWFTTTGWMMWNFLVSVLLTDASIVLYDGSPAYPDLGVLWDLAERAGITIFGTSAGYLANCRKAGIHPTGGRNLSALHAIGSTGSPLSPDEFAWCYQEFGSDLWLFSTSGGTDICSCLVGGVPTLPVYQGEIQARSLGMAVASWDSAGNELVGEVGELVVTRPAPSMPLYFWGDKDGSRLRDSYFSMYPGVWRHGDWIEITDRGTAIIYGRSDSTINRGGVRMGTSEIYRSVLALEEVIDALVVDVPQSDGSSRIELFVVLRENTVLDDDLVRRIKQGIREDCSPRHVPDGIQAIPAVPRTLSGKVLEVPVKRILMGEPPERVVSRDSLANPEAL

SEQ ID NO: 8287 - protein, 659 aa, Thermobifida fusca
DSGGPIEGEAAMPQHGDTARVDVEALRDLLDGRWAAVRRRARDILRGPEFTPRYGLSVAEHRARVTEQLHALARTDLARYGFDPRYGGRGEVGASVAAFEMLVCDLSLMVKMGVQWGLFGGAIQALGTEYHHATYLPGVMSLEIPGCFAMTETGHGSDVQRLRTTATFDPNTDEFVVHTPDEAARKDYIGNAARDGRLAVVFAQLITGGQRHGVHALLVPIRDADGTVLPGIRIEDCGPKAGLNGVDNGRIWFTQVRVPRTALLNRYGDVAADGTYSSPIENPNRRFFTMLGTLVRGRISVAGGAGMAAKTALAIAIRYGQVRRQFLRPGSDSEVALLDYLAYQRRLLPALARTYALHFAQEEMVSRLHDGFTDGPLDERAQRELEAHAAGLKAVATWHAVDTIQTCREACGGAGYLAENRLPQLRADTDVFTTFEGDNTVLLQLVGKSLLTNYRQEFGNLDPLGMAKFAAGQFLGTVIERTAARSLLDRLVQAAPGRGDEDDLRNREWQRALLADRENHVLEGLARRLRAAPADADPFDVVNNVQDHVLLAARAHVDRLVFEAFASGVARIEDEGTRAVVERLCDLAALSLVEQERAWFLEHGRLTPARAKAVTATVNALCQELRPHARDLVDAFGLNDEWLAAPIALGAETARQDQQ

SEQ ID NO: 8288 - protein, 133 aa, Thermobifida fusca
VERTLVLIKPDGVRRNIIGEVISRIERKGLKIVAMELRTLDEETAKAHYEEHVEKPFFSSLVEFITGGPLVAMVVEGNRAIEAFRSLAGATDPVLAAPGTIRGDYGLDVQANIVHGSDSTYSAEREIKLFFPD

SEQ ID NO: 8289 - protein, 846 aa, Thermobifida fusca
  unsure (1)..(846): unsure at all Xaa locations
MFERFTDRARRVVVLAQEEARMLNHNYIGTEHILLGLIHEGEGVAAKALESLGISLEAVRQQVEEIIGQGQQAPSGHIPFTPRAKKVLELSLREALQLGHNYIGTEHILLGLIREGEGVAAQVLVKLGADLNRVRQQVIQLLHGYQGKEPQAAGTAAESAPSTSLVLDQFGRNLTQAAREGKLDPVIGRDKEIERVMQVLSRRTKNNPVLVGDPGVGKTAVVEGLAQKIVKGEIPETLKDKQLYTLDLGALVAGSRYRGDFEERLRKVLKEIRSRGDIILFIDELHTLVGAGAAEGAIDAASILKPMLARGELQTIGATTLDEYRKYLEKDAALERRFQPIQVEEPTISHTIEILKGLRDRYEAHHRVSITDGALVAAAQLADRYISDRYLPDKAIDLIDEAGSRMRIRRMTAPPDLREFDEKIAKVRRDKEAAIDAQDFERAAALRDEEKRLQAQRAQKEKEWKAGDMDTVAEVNEELIAEVLATATGIPVFRLTEEESSRLLRMEEELHKRVIGQDDAIKALSQAIRRTRAGLKDPKRPGGSFIFAGPSGVGKTELCKALAEFLFGDEDALIQLDMSEFMEKHTVSRLFGSPPGYVGYEEGGQLTEKVRRKPFSVVLFDEIEKAHGDIFNSLLQVLEEGRLTDAQGRNVDFKNTIIVMTTNLGTRDISKGQPMGFARPDDTQTTYDRMKAKVNEELKQHFRPEFLNRVDDTIVFHQLTQKEITAIVDLMVARLDERLKDRDMGIEVRPHAKKILAERGYDPVLGARPLRRTIQREIEDALSEKILYGELKSGQIVIVDAEGEGADAKFTFRGVPKPQALPETAEVGAQXHRALPSSGPAPTRNA

SEQ ID NO: 8290 - protein, 563 aa, Thermobifida fusca
LRLTAPEPGWTAHTDVVIVGSGIAGLSTALRYIERTPTGRVVLVTKDLIANGSTRWAQGGIAAAVDPGDNPWAHLVDTIEAGAGLCDPDAVRILVDEGPAALHWLIDQGTVFDRTDTGDLALTREGGHRAHRIAHAGGDATGAEIERALVEAVRACDRIELIEHAFVPDLLVGVDTQGQRRVAGVTVHVMGEGERDGVGAIHATAVVLATGGMGQVFAATTNPEVSTGDGLALALRAGARVQDLEFVQFHPTVLWLGAHARGRQPLVSEAVRGEGAFLVDVHGRRFMRGVHELADLAPRDVVAREIARAMAETGADHVYLDARHFGADKWERRFPTILASCRTHGIDPVTDLIPVAPAAHYASGGIRVDHDGRTDLAGLYAVGETARTGVHGANRLASNSLLEGVVFADRIAAALADEQPPALTGPVLPAGGGPSGLADPEILPELREAMSRYVGVRRDAAGLAKATAVLEELTARATATNPAPGVPAWQATNLLTVAWALVRAAERRQETRGSHWRADYEQPSAQARSRTFILDPSGNQGGHVDAPLHAAGGTRRGAQPDHR

SEQ ID NO: 8291 - protein, 186 aa, Thermobifida fusca
DQPRIEKAVREILLAIGEDPDRDGLVETPARVARAFAEQFAGLSQRPEDVLTTVFEANHEEMVLVKDIELYSTCEHHLVPFYGAAHVGYIPNTDGRITGLSKLARLVDIYARRPQVQERLTSQVADALMERLEPRGVIVVVEAEHLCMTMRGVRKPGAKTVTSAVRGAFRESYKTRAEAMDLILGR

SEQ ID NO: 8292 - protein, 592 aa, Thermobifida fusca
IAILLMLLVTSQFMGWGSGPEHVKTDTSKVFTLIEQDQVRDAKIIDKDQRIELTTVDGKLYEAYWVDGQGAELAEALRANQGGNLEAYDVEVPGDNIWLSLLFSFLPLLLVIAVFFFIMNQMQGGGSRVMNFGKSRAKLISKDTPKTTFADVAGADEAIEELKEIKDFLQNPGKFQSLGAKIPKGVLLYGPPGTGKTLLARAVAGEAGVPFYSISGSDFVEMFVGVGASRVRDLFEQAKANAPAIIFIDEIDAVGRHRGAGMGGGHDEREQTLNQLLVEMDGFDSRGGVILIAATNRPDILDPALLRPGRFDRQIVVDRPDLEGRKGILRVHAQGKPLGPDVDLDVIARRTPGFTGADLANVINEGALLTARRGKQQIDMATLEEAIDRVIAGPERKSRVMSEAEKKIIAYHEGGHALVGHALPNADPVHKVTILPRGRALGYTMSLPTEDKFLTSRSEMMDQLAMMLGGRAAEELVFHEPTTGAANDIEKATNLARSMVTEYGMSERLGARKFGNSNTEPFLGREMAHSREYSEEIAALIDEEVRRLIEAAHDEAWEILVEYRDVLDELVLQLLDKETLSKEEVLEIFAPV

SEQ ID NO: 8293 - protein, 182 aa, Thermobifida fusca
VDAKDMGSALDKILVTEEQIRTRTRELAAEIDADYAGKDLLLVGVLKGAVMVMADLARELHHPCEMDWMAVSSYGAGTTSSGVVRILKDLDTDIQGRNVLIVEDVIDSGLTLSWLVGNLKSRHPASVEICTMVRKPMAFNVDLDVKYVGFDLPNEFIVGYGLDYAEKYRNLPFIATLAPHVY

SEQ ID NO: 8294 - protein, 242 aa, Thermobifida fusca
STLVLLRHGESVWNAEGLFTGWVDVDLSPKGEEEARRGGRLLAEAGIRPDVVHTSLLKRAIRTANIALEEAGLHWIPVKRSWRLNERHYGALQGKNKAQTRAEFGDEQFMIWRRSYDTPPPPLAEDSEFSQHNDPRYATLPPELMPRTECLADVVRRMLPYWYDAIIPDLAAGRTVLVAAHGNSLRALVKHLDNIDDKSIAGLNIPTGIPLVYELNDDFTPRKTGGEYLDPEAAKEAIEAVK

SEQ ID NO: 8295 - protein, 491 aa, Thermobifida fusca
MTETRHRPSRRARRSLSLLLTSALTAAGLLVTAAPAQAESTLRELAAQNGGRHFGTAIAYSPLNSDAQYRNIAATQFSAITHENEMKWESLEPQRGQYNWSQADNIINFAKANNQIVRGHTLVWHSQLPSWLNNGGFSGSQLRSIMENHIEVVAGRYRGDVYAWDVVNEAFNEDGTLRDSIWYRGMGRDYIAHAFRKAHEVDPDAKLYINDYNIEGINAKSNGLYNLVVDLLRDGVPIHGIGIQSHLIVGQVPSTFQQNIQRFADLGLDVAITELDIRMQMPADQYKLQQQARDYEAVVNACLAVTRCIGITVWGIDDERSWVPYTFPGEGAPLLYDGQYNRKPAWYAVYEALGGDSSGGGPGEPGGPGGPGEPGGPGGPGEPGGPGDGTCAVNYTVVNDWGHGMQGAITVSNTGSSPINNWTLQFSFSGVNISNGWNGEWSQSGSQITVRAPAWNSTLQPGQSVELGFVADKTGNVSPPSQFTLNGATCS

SEQ ID NO: 8296 - protein, 528 aa, Thermobifida fusca
  unsure (1)..(528): unsure at all Xaa locations
RSCLRRIIRSRPGGRXLRHVPGSVPARRRXRPRPRGDPSMTTIEREARIVEQVPKQVCIGGHWRDAQSGATFKVEDPATGSVLCEVADAGVADGMAALEMAAATQPTWAEYPPRERGEILRRAYELLMHRQEDLAVLMTLEMGKPVAESKGEIAYAAEFFRWFSEEAVRIDGSYSVAPNGQSRLLVMRQPVGPSLLITPWNFPMAMGTRKIGPAIAAGCTMILKPAQQTPLSALALADILHEAGLPEGVLSVLPTTDAAGLTGPLLRDGRLRKLSFTGSTPVGRALIKQSADQVLRTSMELGGNAPFLVFDDADLDAAVAGALQAKMRNIGEACTAANRFYVQSGVAEEFSRRLAERMAGLRMGRGTEPDVDVGPLIDDKARTKVQSLVDDAANRGARVLLGGKRGDGAGYFYHPTVLTDVPKDSEVCRTEIFGPVAPVIPFDTEEEALAEANRTEFGLVSYVYTENLRRALRMAEKLESGMVGLNQGIVSNPAAPFGGVKHSGLGREGGRVGIDEYLETKYVGIAGV

SEQ ID NO: 8297 - protein, 754 aa, Thermobifida fusca
IRKVVAEACQGLPGASAETVIAEATRGFYPGITPAELELALIMAARTFVETDPDYSYVSARLLLDKLRREALTFLSGHPDEATHADMARRYPEYLRAFITRGIELEHLTPELADFDLDRLGAALRPERDLNFTYLGLQTLYDRYFLHHEGTRYELPQAFLMRVAMGVALHEDDRNARAIEFYELLSSFDFMCSTPTLFNAGTRRPQLSSCFLTTVGDDLAEIFRAISNNALLSKYSGGLGNDWTPVRGLGAHIKGTNGKSQGVVPFLKIANDTAVAVNQGGKRKGAVCAYLETWHIDIEEFLDLRKNTGDERRRTHDMNTANWVPDLFLERVESDAQWTLFSPDEVPDLHDRYGEDFARAYVAYERAADRGEIRVFRRVRAVDLWRRMLTMLFETGHPWITFKDPCNLRSPQQHAGVVHSSNLCTEITLNTSLDEVAVCNLGSVNLANHVGPDGLDAERLRRTVRTAVRMLDNVIDVNLYTIPEAERANMRHRPIGLGLMGYQDALFTLRLPVASPEAVEFADESMELLSYYAIEASADLAAERGSYSSFEGSLWSRGILPIDSLELLAEARRGDLDVDRTQRLDWDTLREKVRTTGMRNSNVMAIAPTATIANIVGVNPSIEPLYRNLYVKANMSGDFTVVNPSLVRDLKERGLWDEEMVTALKLHDGSLGPIDRVPEDLKNLYATAFEIDPIWLVDAASRRQKWIDQAQSLNLYMAEPSGRKLDELYRRAWRKGLKTTYYLRSQGATHVEKS

SEQ ID NO: 8298 - protein, 336 aa, Thermobifida fusca
RVDVEDKRMINSRADVNQLLPLKYRWAWEKYLAACNNHWMPTEVSMQADIALWKSKDGLTEDERLMVKRNLGFFATAESLVANNIVLAVYRHLTNPECRQYLLRQAFEEAVHTHTFQYICESLGLDEGELFNMYREVPSITAKDAWALRYTRNLENPNFTTGTPEADQAFLRDLVAFYVVLEGMWFYTGFAQILSLGRRNKMVGIAEQYQYILRDESIHLNFGIDVINQIKIENPHLWTEEFQDEVRTMLIEACELEAAYGRETMPRGILGLNAKLCEQYMRFITDRRAEQLGLAPIFGETENPFPWMSEMMDLKKEKNFFETRVIEYQTGSGLSW

SEQ ID NO: 8299 - protein, 340 aa, Thermobifida fusca
MPIATPEVYAEMLGRAKSEGFAYPAINVTSSQTLHAALRGFAEAESDGIVQISTGGAEFLSGTTIKDMVTGAVAFAEYARVVAEKYPVNIALHTDHCPKEKLDTFVRPLLAISKERVAKGQEPLFQSHMWDGSAVELEENLQIAEELLKESKEARTILEIEVGVVGGEEDGIVGEINEKLYTTPEDGLRTAEVLGLGEKGYYIAALTFGNVHGVYKPGHVKLRPSVLKEIQDVVGAKYGKEKPFDLVFHGGSGSSLEEIHEAISYGVVKMNIDTDTQYAFTRPIVDHIMKNYDGVLKVDGDVGNKKAYDPRSYGKAAEAGMAARVVEAAQQLKSAGKKLK

SEQ ID NO: 8300 - protein, 423 aa, Thermobifida fusca
MPAIALVGAQWGDEGKGKATDLVGDRVDYVVRYQGGNNAGHTVVIGDQEYALHLLPSGILTPGVIPVIANGVVIDPAVLFEELDALTARGVDVSRLLISANAHLIMPYHRALDKVSERFLGKGRIGTTGRGIGPTYADKTARAGVRVQDMFDPKILRKKLELALNDKNQILTKVYNRRALEVDRILDEYLGYAEKIRPYVVDTSLVLNRALDEGKTVFLEGSQGTLLDIDHGTYPFVTSSSPTAGGACSGSGIGPTRITKVIGILKAYTTRVGSGPFPTELEDEWGEWLRSRGHEYGTTTGRNRRCGWFDAPIARYATRINGITDFFLTKLDVLSGLERIPVCVAYDIDGVRHDEIPMTQTEFHHATPIYEYLDGWNEDISQARSFDDLPKNAQAYVRAIEEMSGAPISAIGVGPGREQTLEL

SEQ ID NO: 8301 - protein, 429 aa, Thermobifida fusca
  unsure (1)..(429): unsure at all Xaa locations
VRGGHALHGTAFIQGAKNAVLPMIGAALLASKGRTVLRNVPVIEDVRRALELAEYVGAKVEFHEAERTIVIDATGLNDPNRAVLPASIASRFRGSVLFIPALMHRMGRARIEGVGGCNLGSRNLDFHYRGFARLGAEVTEDPERKHINVKADNLKGGRLYLDTPSHTGTENLIMAAALTPGTTVIEHAALEPEVLDVIEFLGSMGAKISGGGTGFIKVEGVSELTAVEHTVMPDRIDTGVFAMMTAATGGDVSLVGANLDHLGVARWKLEQMGVQFTQQGAVLRVRRDPNVPLRPINAVTSPFPGFATDLQPPLMALATLAEGESYIREAIFDGRFALADELNKMGAKIEVEGNRAIVHGPSELHGTKVTAHDLRCGAGAIMAGLVAKGETIVSPAYQVDRGHSHFATRLSALGADVVREEVSXSEKSD

SEQ ID NO: 8302 - protein, 351 aa, Thermobifida fusca
PYLRSALDSIPPYRPGRKVVGPDGRSAKLSSNESPFGPLPSVRQAIADAAADLNRYPDPAAAELTAALARRFHVPEEHVALGAGSVGLLQQLLEATAEPGAEVVYAWRSFEAYPLLTGLAGATPIHVPLREETHDLEALAAAVTDRTRMVFVCNPNNPTGTAVRETELAEFLDTVPEHVLVVLDEAYREYVQDPRVPDGVQLYRDRPNVAVLRTFSKAYGLAALRVGFLIGHPQVVDAVRKTLVPFAVNHLAQAAAVASLAAEQELLERVAVTVKERERVRAALLADGWTVPETEANFVWLRLGEDTLDFAAACEQAGIAVRPFAGEGVRVSIGLPDDNDAFLTVARTYPK

SEQ ID NO: 8303 - protein, 885 aa, Thermobifida fusca
HTVAAHEVFPALETSPDGLTEEEARRRLAEYGPNRLEEAPPPSAVAVFLRQFASPVIAILLFALLLTVVLREWLDAAVIAAALLVNAGIGFVQERKAEQAVRALMNLSQPRARVVRDGRRREVESTDLVPGDVVFIESGSRIPADIRLVEAHALEVDESLLTGESEPVVKSTATAAADAGVGDRSGVAFSGTMVVSGRGMGVVYATGRRTELGAIAGLLKSEPETATPLKERMTRLSRVIVAATLVSALLVMAIGLVRGGDPMELLLVAVALAVAAVPEGLPIVLTVALAVGVTRMARRNAIVRRMLAVEALGSATVIGSDKTGTLTENRMTVRRLWSPAGGEAGPAAVTPYWGNITELPLEQVDPYVLLVLCGALTNEATMASEEGREASGDPTEVALLEAAYDAELLHTARDVRFPKTAEVHFEPARRFSATARRWGNREVLFVKGAPERVVEMCDAQVGRVEAGRWQPAALRPGELHAAGERMAAEGLRLLALAVSRPYEPGAASVDPHDPSGLVLLGLVGIMDPPRPGVREAVQDCREAGVRVVMITGDHAVTARAIAAELGICEPDAPVLTYQQIAGLDDEELRAAVAQVNVYARIPPEGKLRLVRALEANGEVVAVTGDGVNDAPALKAASVGVAMGQEGTDVAREAAEIVLADDNFTTIVHAVEEGRVTFDNIRRAVFFLVSIGAAMVVALTVSTLLGWPLLMVPAQLLWLNLVTSGVQDIALVFERAEPGLLRRPPRSVHEGILSRLLWQRVGVTGVVMAAGTLAMFWWEWQRTASLTAAQTMALTTMVVFMAFQAGNARSDTRSVLGMPLRYNPYLVVAVAGSFALHVAALYFPPTQVLLRVEPLDAAAWARIAAVAVSVVVVVELEKMVRRAWAR

SEQ ID NO: 8304 - protein, 238 aa, Thermobifida fusca
DRITAVLFDMDGVITDTASVHAAAWKRTFDEFLLDLSRSGGPPFRPFDLIEDYRRHVDGKARTAGIRDFLASRGLTLPDTAPPDRPETMTVATLGDRKDRYFKDYIDQYGVTAYPATVRLIHRLRERGIRLAVVSASRNCAAVLRAAGISDLFDVRVDGVDAARLRLPSKPDPALFLEAARRLDASPATTAVVEDSLSGVEAGRRGGFALVIGVDRAHQRAALYEKGAHIVVSSLASL

SEQ ID NO: 8305 - protein, 312 aa, Thermobifida fusca
LLDYYRQMLLIRRFEERAAQAYTQARIGGYCHLNLGEEATIVGLMEALQERDYLFTNYREHGYAIAKGTHPREVMAELYGRSTGVSKGWGGSMHLFDARTRLLGGYGIVGGQLPLAVGAALAITYRGSDEVVMCQMGDGTTNIGAFHESLNIASLWNLPVIFVVINNFTGMGTPVERSSAEPELYKRGSAYRIEGVRVDGRDVLAVRDTATTLVERARSEHRPFLLEAFSYRMKGHSVVDPAKYRTKEEAEEALANDPIAMFEERLTEAGILTDEIKKEIAESVKAEVADAADFAENSPHPEVSTLFDYTYA

SEQ ID NO: 8306 - protein, 312 aa, Thermobifida fusca
ITYRQALRDTLRAEMHRDENVFLMGEEIGVFEGSYKITEGLLKEFGERRVRDTPIAEEGFVGAAVGAAMLGLRPVVEIMTINFSLLALDQIVNHAAKIYGMFGGQNSVPMVIRTPGGGGQQLGATHSQNVELYYAFVPGLKVVAPSTPADAAALLRAAIRDDDPVLFLENLGLYNTKGEVPDEEVVGEIGRAAVVREGTDITLVGYSRMAMIATQVADRLAEEGISVEVVDLRSLRPLDRETIVNSVKKTGCAVVAEDDWLTYGIGAEIAASIQEGAFDYLDAPVRRVAMAEVPLPYAKPLENAALPSAESV

SEQ ID NO: 8307 - protein, 445 aa, Thermobifida fusca
  unsure (1)..(445): unsure at all Xaa locations
PXEPSAGESVKEPQMSEIYMPRLSDTMEEGVISSWVKQVGDKVSVGDVLVEIETDKAVMEYEAYEDGYLVQQTVREGETVPIGAVIGVIADSPDAVPAAPEGGEGAEQKAEEPQQPAPAAQEAKEEQPTVPAPAAPAEQGGKPRPLSSPLARRLAREYGLDITKIQGSGPKGRVVRADVEAAAQQKREQEAAAPQPAAAKAPAPAAAPPQPEFEDLRASEEVPVTNIRRVIARRLTQAKQEIPHFYLRRRIDAEALREFRAQINEQLAPTGVKVSVNDLIVKAVATVLRDHPEVNSSWVDDKLLRHKRINVGIAVAVDTGLVVPVLHDADTLALSEVARRSRALVEKARDGKLSPQDMSGGTFSVSNLGMFGVESFSAVINPPEAAILAVGAMQQEPVVRDGEIVARHTIALELSVDHRAVDGAVGAAFLKDLAEVLESPMRIVL

SEQ ID NO: 8308 - protein, 299 aa, Thermobifida fusca
MVGSTTPNAPFGQMLTAMITPMLDNGEVDYDGVARLATYLVDEQRNDGLIVNGTTGESATTSDEEKERILRTVIDAVGDRATIVAGAGSNDTRHSIELARTAERAGADGLLLVTPYYNRPPQEGLLRHFTAIADATGLPIMLYDIPGRTGTPIDSETLVRLAEHPRIVANKDAKDDLGASSWVMSRTDLAYYSGSDMLNLPLLSIGAAGFVSVVGHVVGSELHDMIDAYRAGDVARALDIHRRLIPVYRGMFRTQGVITTKAVLAMFGLPAGVVRAPLLDASPELKELLREDLAMAGVK

SEQ ID NO: 8309 - protein, 494 aa, Thermobifida fusca
QYVAAIDQGTTSSRCIIFNRHGDVVALGQREHRQIFPRPGWVEHDAEEIWANVVAVVEEALAAGGLRRHQLAAVGITNQRETTVVWDRQTGQPVHHAIVWQDTRTDRLLRVLGGTEGQDRFRQRCGLPLATYFSGPKLRWLLDEIPGLRERAQRGEVLFGTMDTWLVWQLTGRHVTDVTNASRTMLMNLRTLDWDAETLDAMGIPAAMLPEIRSSAEVYGTATGPLAGVPVAAALGDQHAALFGQTCFDPGDVKGTYGTGAFLVLNTGTEPVVSTNGLLTTVGYQIGGQPAVYALEGSIAMAGSLVQWLRDNLGMITHAAEIEELASQVADNGGCYIVPAFSGLFAPHWRSDARGIIAGLTSYVTKAHLARAVLEATAWQTREVVDAMNSDSGIPLASLKVDGGMVANRLLNQILADVLDVEVVRPKVAETTCLGAAYAAGLAVGYWPDLDSLRANWQHDATWTPQIDAQVRDREYRNWTKAVRRTFGWVESEE

SEQ ID NO: 8310 - protein, 245 aa, Thermobifida fusca
IKVGVFGALGRMGSEVVKAVEAADDTELVAGIDVGDDRGKVLGADVVVDFTHPDAVMDNLRWLIEHGIHAVVGTTGFDDARLAEVRRMLDAKPGVNVLIAPNFGIAAVLMMHFAAKAAPYFESAEIIELHHPNKADAPSGTAYRTAELIGAARAHAGLGDAPDATTSELPGARGAQVDGVRVHALRITGMIAHQEVVFGTHGETLRIRHDSMNRESFMPGVLLGVRKVASLPDRLTVGLESLLGL

SEQ ID NO: 8311 - protein, 429 aa, Thermobifida fusca
VGTTVTLLEPGDGTGLVRRTVLPGGLRVVTETMQGVRSVAFGISATTGSRDEDAEHAGAAHFLEHLLFKGTERRSALDISALLDGVGADYNAYTTKEQTTYYAKVLDRDLPLAIDVISDMVANSVLDPAEVETERGVILEEIAMYEDEPADVVDDVFAAHFFKGSPLGRPILGTNDTIRALTRERILEQYRSAYVPSELIVAAAGNLDHDTVVRQVAEAFRDKLDAAGDARPAAPRIGTEPPATNPGTVLVSRDSEQAHLILGREGVKRTDPRWYALRVLSAILGGGMSSRLFQEVREKRGLAYAVHGYTCSYSDTGLFQVYVGCLPDKIDEVLDVCRTELERAAAHGVDAAELARAKGQIRGSWVLGTEGTNARMSRLTSHELGYRRHLSLSEDLALFDAVTSEDVSEVAAEILTRPEALAVVGPYEE

SEQ ID NO: 8312 - protein, 467 aa, Thermobifida fusca
QRPFWLAGSATTGDNELTVTNPYTGQTVATVAVPSPEQVDQAVAAAHGALDATAALPAHVRATALAHVARRLQERSEEIAQLITAESGKPILWARAEVGRAVSVFTWAAEEVRRDSGRVQRLDTDSAGEGRIALIRRVPKGAVLAISPFNFPLNLVAHKVAPAIAVGAPIVVKPAPATPLSALVLGEILAETDLPAGAFSVLPMPNELAQPLITDERLPVISFTGGQFGWELRKMAPNKHVTLELGGNAAAVVLADADLDWAARRIALFGNNQAGQVCIGVQRVIVEDAVYDEFAAKLVQRVEELVTGDPADEATQVGPLINEAAAARVEQWVNEAVAGGATVLTGGTRDGVTMAPTVLADVPDDAKVVCEEVFGPVMVLRRVSGVDEAFAEVNNSKYGLQAGVFTRDLATAFRAHRELKVGGVIIGDVPTYRADQMPYGGVKKSGVGKEGVRSAMDDLTDERVMVL

SEQ ID NO: 8313 - protein, 441 aa, Thermobifida fusca
LPQERRLVTEIPGPRSRALQERRTAAVAQGVGSSLPVYVVRASGGIVEDVDGNRLIDFGSGIAVTNVGNANPRVVARASEQLARFTHTCFMINPYEGYVDVCEALNRITPGDHEKRSILVNSGAEAVENAVKIARHATGRQAVVVFDHAYHGRTNLTMALTARNMPYKQGFGPFAGEVYRMPMAYPFRWPTGPDNCGPEAAAQAIDLITTQIGPENVAAVLIEPIQGEGGFIVPGEGFLPALVEFCRKHGIVFIADEIQTGFARTGRLFACEHEGIVPDLITTAKGIAGGLPLAAVTGRAELMDAVHGGGLGGTYGGNPVACAAALAALETIEQDNLVERARAIGDVLLSRLRALAERYDIIGDVRGRGAMVAMELVAGAGDKTPNPEALASVVKYCHAKGLILLTAGTYGNVIRLLPPLVISDALLDEGLTIIEEAFAQL

SEQ ID NO: 8314 - protein, 583 aa, Thermobifida fusca
WRRPASAASSSARAACTARPCAWRRRSPSPRRKQKKGRPSSSTRSPRSTTPSRNQLNGRTLTPHPGVRPPLARTLSSPEEGCPLSVTHVSHWIDGKPWQGPAERRGDIYNPATGRVSGTVDFAGPAEVDAAVAAAKRAFPAWRDTSLSRRTEILFAFRELVRAHRDELARIISAEHGKVVSDALGEVSRGLEVVEFACGIPHLLKGGYSENVSTRVDAYSILQPLGVVTGITPFNFPAMVPMWMFPIAIACGNTFVLKPSEKDPSAPMRLAELWAEAGLPDGVFNVVHGGKEAVDALLTHEDVKAVSFVGSTPIARYVYATAAAHGKRVQALGGAKNHMVVLPDADLDLAADAAVSAGFGSAGERCMAISAVVAVGGIADDLVARIKQRVAQLRVGPGDDERSEMGPLVTREHRDRVASYLESGVREGATLVVDGRIHPVIGGERDGFWLGPSVLDHVTPDMACYRDEIFGPVLSILRVDTYEEAIDLINANPYGNGTAIFTNDGGAARRFQNEVEVGMVGINVPIPVPMAYYSFGGWKNSLFGDSHAHGTEGVHFYTRTKAVTVRWQDPSHGGVNLGFPTTK

SEQ ID NO: 8315 - protein, 267 aa, Thermobifida fusca
DLLARHRAVMPAWMPLYYETPIEIVSGKGNRVVDADGNTYLDFFAGIVTNMIGYDVAEVREAVEAQLARGVVHTSTLYLLRGQVELAEKIARLSGIPDAKVFFTNSGTEANETALLLATYARRSDEVLALRNSYHGRSYGTIAVTGNRGWKNSSLSPLTVHYLHGTDRSHPAFAHLSDREYIDVCVADLRDVLSTTAPNVACLIAEPIQGVGGFVMPPDGLFAAYKEVLDEQGILFISDEVQTGWGRTGTSFWGIGNHGVTPDMMTF

SEQ ID NO: 8316 - protein, 1180 aa, Thermobifida fusca
VYLKTLTLRGFKSFASATTLRFEPGITCVVGPNGSGKSNVVDALAWVMGEQGAKTLRGGKMEDVIFAGTSSRPPLGRAEVSLTIDNTDGALPIDYSEVTIKRTMFRNGGSEYAINGDPCRLLDIQELLSDSGIGREMHVIVGQGQLDTVLHAGPEERRALIEEAAGILKHRKRKEKALRKLSAMQSNLDRVSDLVAELRRQLKPLGRQAELARRATVIQAELRDARLRLLADDIVTLREALAKEEADEAEVRARRAAVEAELTQAQERENQLEQAAAEAAPLLARAQEAYHALQRLKERLSAVASLATERHRNLSAASREEHRGRDPEELEAEAAEIRAEEEELRAQLEEARLRLEEVVVERAEAEAALRDEEQRVAAAVRAAADRREGLARLHERAAALRRTLEAQDAEIERLTQAAAEARERAAQAQEEFADARADAESLDLGDSELDEAYEQAREELAAAEARLAELRDAERNAERERAALEARRDALQMGLERRDGAAALLTADGDALGLIGALTSLIDVAAGDESAIAAALGAAADAVVVGTHDAARSALDLLKQRDAGRAGIVVADSAEVQPREQWPDPPAGARYAVDSVTVPPRLRSAVTALLADTVLVPDMATAARVIAERPALRAVTPEGDVFTSAFVHGGAATGPSQLEVRAAIDETASQLAAAEEVCKRITEDLGDAQLERERAAAAVDAITARRREADRRRSEIAQRVGRLGAQVRSATQEAERYTAAVEKAVREREATRAALAELEERVAQAESEPVDESEPDTARRDQWAAEAARLRSVEMEARLAVRTAEERVRAITGRAEGLLRAAAAERRAREEAARRRQRRAAQAKVAQAVAEGASQALARITVSLAEADGERRLAEEQRDAREAELKTVRVRIRELSTELEKLRSAVHSGEMARAERRLRLEQLETRAREEWGMEVETLVAEYGPHVPVPPPPGTPEDEAVPVPYVRAVQEKRAKTAERQLNQLGKINPLALEEFAALEERHNFLNAQLEDLKKTRRDLMTVVKEVDDRVQEIFSAAYADVAREFSRVFARLFPGGEGRLVLTDPDDMLTTGVEVEARPPGKKVKRLSLLSGGERSLTAVAFLVAIFKARPSPFYVMDEVEAALDDINLQRLLVVFEELRATSQLIVITHQKRTMEIADALYGVTMQGDGISQVISQKLER

SEQ ID NO: 8317 - protein, 800 aa, Thermobifida fusca
  unsure (1)..(800): unsure at all Xaa locations
IRFANVSLTYPGRNLPALSQVSLVIRPGQRLLLTGPSGSGKSSLLALLLRFVEPTEGAILVERPGGTGSAPLSHIPADLWRQLIAWVPQHPYLFDTTVLENIRLGKPEASVAEVRRAAELAEAHDFISTLPLGYGTRLGERGTRLSAGQRQRIALARAFLRDAPIVLLDEPTAHLDPDHAAAVRRAVARLLEGRTGVIVAHDTGWSELVDETVHLAGGRIGAPLXTFPHRNLPVGHCCGXSRWPARAPPGFVLGVLLGALATGAGVGLLSVSAWLLATAATHPPITALGVAVVATRALGVTRGVARYLERLVTHDAAFRTLAEVRVRVYERLARSEPVRRFRSGDLVSRLVNDTDATQDLLVRGLTPPLSALAVGSAVVLLSTVLFVPGGLLLAAGLLLGGLAVPLFAAALGRTSGRHQAAARGELSSALVDTLYGAPDLVAYGAMEQAVRRVERADAELTRLARRDAAVLGLGTGASALVAGLTVWATLLLGVAAVAGGTLDAIAFAVVVLTALAAFEIVAPLPAVAAKLEAIRTAGARLFDVLDTEPEVKAAAAPEQSGLPDQAATLRVRDLRVRYGPDEPWALDGVDLDLAPGKRIAVLGPSGSGKSTLASVLFRFRDPDAGTVTLDGADITDYPVDEVRRLISGVPQDPHIFASTLRENLRLARPGADDAELWAALERARLADDIRATMPDGLDTEVGAHGARLSGGMRQRLALARALLAQPRILVLDEPTAHLDPDTRDAVLDDLLAASAGYATLLITHDLARLEEMDEIYVIVDGRVVQRGSHDELLAEKGWYR

SEQ ID NO: 8318 - protein, 375 aa, Thermobifida fusca
PVYRASTYAFATSRDYAASLTGDGQYAYARIDSPNSDAFAAAVAALEGAHLEGEVHGQGFASGMAAISITLLALTHAGAHVVASRALYGNTYKLLDVVLRRFGVAVDFVDITDPAAVRAAFRPETVLVYTETLANPTMTVSDLPVLAALAHEAGALLVVDSTFASPVVCRPLEHGADIVLHSATKYLGGHSDATGGVAVGRPDLLARIREARIDLGPHLAADEAFLLHRGLETLPLRMARQCATAAEFAAALAEHPAVARVDHPSLPTHQGHVLARKLFDTGPEGPRYGAVVTVTPRGGREAGIAFADRLRLATIAPSLGGTHTVVSHVASTTHRQMSDEALHAAGIDPGAVRFSIGVEDPADLIADARQALDGL

SEQ ID NO: 8319 - protein, 334 aa, Thermobifida fusca
REVTKVAVLGSGSWGTAFANVVADAGIAETVLWGRRPEIVEAINTKHENPDYLPGITLNPRLTATTDVAEAMAGADFTVIAVPAQTLRTNLAAWSEALDPGTVVVSLMKGIEVGTCLRMSEVIAEVLELPDHRIAVLSGPNLAREIAERQPATAVVACTDEQTAVRLQHLCKSPYFRPYTNTDVIGVELGGAVKNVIALAVGVAVGMGFGDNAKAALITRGLAETVRLAVALGADEHTLAGLAGLGDLVATCSSPLSRNRTFGEKLGSGMTVDEVIAETKQTAEGVKSSTSILELARAHGVEMPITEAVVAMMYHGLPPAEALLAFMSRSAKPE

SEQ ID NO: 8320 - protein, 329 aa, Thermobifida fusca
AHGDDSICAVSARGHRVRFADGRELLCGASGLWNANLGYGNPAIAQAVAQALHDASYLSAFRYENVYARRAAADLIEVSGPEHYSRVLFSSSGGAANDAAMKVARHYHALLGRTRRSLVVSLRGSYHGLTFGGFALTGEDLGQRLYGVDQRLVRHVRPNDTAELNALVSRAAKQIAAVVVEPVVGTGTIPLTDEYVAELLRLRAEHGFLLIADEVATGFGRTGSFFASQRWPEQPDLLITSKGLTNGTCPASAVIVSQRVADAFTEHDAVLSHAETQGATPLTCAAISATIAEMRRLDAVAAGQALGEKLGAGIAELMAEMPQIIGTTG

SEQ ID NO: 8321 - protein, 474 aa, Thermobifida fusca
DKAQILVASNRGPVSFSIGDDGAVKSRRGGGGLVSGLSSVATEIETLWVCAALSDADRKAAAAAPEGRLDKAGYDVGGASVRMLNIPADVFNNAYNSVANSTLWFVHHMLYDTPNKPSFGSRFRAEWEDYRAYNSAFAEALLTGADEGAKVAVQDYHLALVPKMLRVRRPDLRIAHFSHTPWAPPEYFRMLPADIGRELLEGMLGADHLGFLSVRWADAFLRCCEVFLRAPVNWGTRTVEHGGRVIRVGVHGLGADAQGLRERAAAEDVARWRERLRERVGDRKLIVRVDRTELSKNIVRGLEAFGELLRKRPEWRNRVTHLAFAYPSRSGVAEYRAYTESVRATAEAINAEFGTDDWTPVVLEVNDDYPRSLASYQIADVLLVNPIRDGMNLVAKEGPVLSLNGVALVLSTEAGAADDLGADAILVNPYDVSETAEALHRALTMDEEERRQRTERLAEAAAALPPQRWFTDQL

SEQ ID NO: 8322 - protein, 576 aa, Thermobifida fusca
  unsure (1)..(576): unsure at all Xaa locations
GRDIRQTGAGSARPSVAGVGSFPRVSARSREDXNSMAAKLIAFDEEARRGLERGMNQLADAVKVTLGPKGRNVVLEKKWGAPTITNDGVSIAKEIELEDPYEKIGAELVKEVAKKTDDVAGDGTTTATVLAQALVREGLRNVAAGANPIGLKRGIDAAVARISEELANLSKEVETKEQIASTASISAGDPQIGEYIAEAMDKVGKEGVITVEEGQTFGLELELAEGMRFDKGYISPYFATDLERMETVLEDPYILIANQKISNNNEFLPVIEKVLQAGRPLVVIAEDVEGTALQTLVVNKIRGTFKSVAIKAPGFGDRRKAMLQDIAILTGGQVITEEVGLKLENTELDMLGRARKVVVTKDETTIVDGAGDASAIAGRVNEIRAEIERTDSDYDREKLQERLARLAGGVAVIKAGAATEVELKERKHRIEDAVRNAKAAVEEGILPGGGVALLQASIAAFEKLELEGDEAIGASIVRRAVEEPLKQIAINAGYEGGVVVEKVKSLEPGIGLNAATGEYTDLFKDGVIDPTKVTRSALQNAASIAGLFLTTEAVIAEKPEKPAANNAGGDMGGMDF

SEQ ID NO: 8323 - protein, 369 aa, Thermobifida fusca
IHIPENLLPGDGRFGCGPSKVRPEQVTALASSGATYLGTSHRQKPVKSLVGRVRSGLAELFSLPDGYEVVLGNGGTTAFWDIAAHTLVRRKSQHVSFGEFSSKFAKVTQGAPWLDEPTVITAEPGSYAPPRAEAGVDVYALTHNETSTGVATPIERIAGADEDALVLVDATSGAGGLPVDITQTDVYYFAPQKCFAADGGLWIAIMSPRALERMAEIAATDRYIPAFFSLTTAVDNSRKDQTYNTPAVSTLLLFAEQIEWLNKQGGLEWAARRTAESSSILYSWAEKSEYATPFVADPALRSQVVGTIDFSDEVDAAKVAAVLRANGVVDTEPYRKLGRNQLRIGMFPAVEPEDVRALTECIDYVVGKL

SEQ ID NO: 8324 - protein, 378 aa, Thermobifida fusca
EAYIVGAVRTPIGTRKGALAAVHPADLGAHVLKELVNRTGIDPAAVEDVIMGCVTQVGPQALDLARTAWLSAGLPESTPGVTIDRQCGSSQQAVHFAAQGVMSGTQDLVIAAGVENMGMVPMGANVQFAVDNGLSVYGQGWVERYGTQEISQFRGAQLMCEKWGYTREDLEKYALESHRRAAAAIEAGYFDAETAPLAGVTHDEGVRPDTSLEKMAELAPLREGWALTAAVSSQISVGASALLIASERAVAEHGLTPLARIVQLALAGDDPVYMLTAPIPATRIALRKAGLDIDDIDVVEINEAFAPVPMAWIDEIGADPAKVNPNGGAIALGHPLGATGAVLMTKLVHELRRTGGRYGLQTMCEGGGQANVTIIERV

SEQ ID NO: 8325 - protein, 262 aa, Thermobifida fusca
VRLATWNVNSVRARSERIAAWLRRSDVDVVALQETKCRDDQFPTAVFTELGYEVAHHGLSQWNGVAIASRVGLSDVQIGFPGQPGWGEPEEAEARAISAVCGGVRVWSLYVPNGREIDHPHYTYKLQWLARLREAGEAWLSEDPKAQIALCGDWNIAPYDEDVWDMAEFEGRTHVTKPERDAFHAVVDAGFTDVVRPHAPGPGVYTYWDYKGLAFPKRKGMRIDFILASPALAERATDAKIDREERKGKGASDHAPVIADFQ

SEQ ID NO: 8326 - protein, 285 aa, Thermobifida fusca
IAVFGSVNMDLVAYVDTPPARGETVQGRQFSQVPGGKGANQAIAAARAGADVVFLGAVGDDVFGPQLRATLVDNGIDVSGLRTVGGASGIAHIVVDREGNNSIIVIPGANGTVTGLRENDTLLLDGAQALLLQLETPLSGVIAAARAGRSLGVTTVLTPAPAQPLPQELLECVDVLLPNQYEAATITGEDTPERALAALLETVPEVIITLGSRGALYGARDREPLWVPVVQVEAVDTTGAGDTFCGAYAVARTEGQDPESALRFAAKAAALSVRIPGASTSMPTR

SEQ ID NO: 8327 - protein, 450 aa, Thermobifida fusca
DFQQAAKDHLWMHFTELAAYQDTDVPVITRGEGPYVYDTNGKRYLDGLAGLFVSQVGHGRTEIAEAIAEQSRKLAYFPIWTYAHPTAIELADRLADLAPGDLNRVFFTTSGSEAVESAWKLARQYFKLIGQPTRHKVISRRIAYHGTTMGALSITGLQAIKTPFEPLVPSTIQVPNTNIYRAPVHGDDPEAFGRWAADQVEEAILQNDPESIAAVYVEPVQNSGGCFPPPPGYFQRLREICDRYGVLLVSDEVICAFGRVGAYFGAQRFDYLPDIITFAKGVTSGYVPMGGLIAREHLVEPFREAGNTFLHGSTFAGHPVAAAAALANLDIFEREGLIDHVQANAPAFRATLEKLLDLPIVGDVRGEGYFYGIELVKDKETKETFTDEEAHRLLKGFLSPALFDAGLVCRADDRGEPVVQLSPPLICGPEHFAEMESILREVLTEAWQRI

SEQ ID NO: 8328 - protein, 468 aa, Thermobifida fusca
FINGEYVDSVDGRTAPVVNPATGEAYAEAPVSTAEDVDRAFRAAADAFENGWRDSTPAERQIILNKIADAVEERADELVAAEVENCGKPVKATREEEIWQVTDALRFFAGAARVLEGKAAGEYMADHTSWIRREPIGVVGQITPWNYPMAMAAWKIGPALAAGNTIVLKPSDTTPVSTLLLAEIAAEFLPPGVFNVVTGDRDTGRALVDHPIPRLVSLTGSTRAGYEVAQSASRDLKRLHLELGGKAPVIVFDDADVEKAAEGIAGAGYFNAGQDCTAATRVLAAPGIHDDLAAALAEQAKKTKTAGPDETDAYYGPLNNPNQLDRVSGFFERLPDHAEVLTGGSAVDRPGYFFSPTVVSNLRQGDEMVSEEIFGPVITVQRFDDEDTAVAWANSVKYGLASSVWTKDHARALRVSRRLDFGCVWINTHIPIIAEMPHGGFKHSGYGKDLSLYSLEEYTRIKHVMSYI

SEQ ID NO: 8329 - protein, 324 aa, Thermobifida fusca
  unsure (1)..(324): unsure at all Xaa locations
NRSVAIHVSDLHQSYGSFEAVRGVSFTVAPGELFALLGTNGAGKTTTIETLEGFRRPTRGSVRIFGIDPFGQPPELRPRVNAVLQHSGLFEELTVTESIELARDLADDPMDTAEVLEAVVLADKARNTVRSLSGGERRRLDLGLAILTRPDVLFLDEPTTGMDPEMRRETWKIISSQVARGAAVVLTTHYLEEAERLADRLAIMHRGEIRVSGTVSEVVSQWGDRISFRLPSHIRSRELPELPGAELTIDVRGDHQWAVYTVTTGTDPATRTHHALLPLLKWAEERSLDLERLESRPASLEDVFLAVAQGDVTDLVDLXPDRPM

SEQ ID NO: 8330 - protein, 396 aa, Thermobifida fusca
VKIALIATHATPIPAHKGDPTDSESLYLCHLARNLAALGHRVTIHTRCTDPQTSERTRMGRSVVVAPIVAGPRRPLREQEYIEHTGTFARRLTEQLRADPPDIIHAFGWSSGLAALAAVRDLERDIPVVQTFHSLNVSEQRVGLPANPQRVRLEAALAHHAKAVLVNSADQRFELARMGVPRSRVCIVPFGVDTDQFTVEGAAHGPWQRRRSAAGRPLRIIAVTRLDPLGGVDTLIRTMARLPDGELLIVGDPAPEHLAIDPNAQRLERHAKEAGVNDQVTLTGAVTRRDLARMLRSADVFVSTAFYDPYGSAVLEAMACGLPVVARAVGGITGAMLDGTTGVLLRSAHPSTLAHVLRQLAADTTQRTAYGIAGADRAASRFTWARVAAETERIYQ

SEQ ID NO: 8331 - protein, 424 aa, Thermobifida fusca
LKRRQRRSAMETFSRLESEVRSYCRGWPTLFTRARGSRVYDHTGRGYLDFFAGAGALNYGHNNPTLKTALLDYLGSDSIVHSLDAATTAKRDFLDTFEEVILKPRGLDYKVQFPGPTGTNAVEAALKLARKVTGRETVISFTNSFHGMTLGALAVTGNSMKRGGAGVPLNHTVTMPFDNYMDGQVPDFLWLRSLLEDSGSGLDRPAAVIVETVQGEGGINVARADWLRGLAELCREHELLLIVDDIQMGCGRTGPFFSFEEAGIVPDIVTLSKSISGYGLPMALTLFKRELDVWEPGEHNGTFRGFNPAFLTATVALNTYWRDDSLERETLAKGQLITERLEAIAAEHAEAGASVRGRGMACGLVLPGEGDARRVCAEAFERGLLMETSGPEDEVAKLLPPLTTSVAEMEEGLDILAESVRAAV

SEQ ID NO: 8332 - protein, 380 aa, Thermobifida fusca
DRCPGVLRPHFAADGALLRIRIPGGHISRRGIATLSQITAKFGDGNLHLTSRGNVQIRGIPVTDDQQIPNELPHIVAASGFLPSSTHDRVRNIVASPLSGIIGGRMDVRPLVSALDRALCTDPRLAELPGRFLFGLDDGRGDLAGMPIDLGIYAIDERSAQIRVGTFSGPVISSTEIVDIILDLAHRFLDISEGKWNVVQLPKKGRELLNNVEFSNFLRHTKSGDRWSVERFRRNILHGIITISTAESAVAGSVPLGVLTPPMQRALLDAAEHSDSTIILTPWRGVIVTPVPTDQASNVAALLQEAGLVLDPASPWSRISACIGSPGCARSRGDTRSQAVKLVRRLSSPDTSDDGSPYHIAGCERACGAPHTPHTLVLLG

SEQ ID NO: 8333 - protein, 1203 aa, Thermobifida fusca
PMPRIALLSTSDTDLLSARASGANYVWGNPSRLDVTGTDPGSLHALLHGADLVIVRILGSARSWQEGLDQVLTHGVPVVVLGGEQTPDAELMSHSTVPVGIAAEAHRYLAHGGPDNLAALHAFLSSTVLLTGGSFDPPTELPEWGLLERSTPPQADRDGLPRIGILYYRAHQASGNTRFVHDLADAVDATGEAVAVPIYCTSLRSASPELLAELGTLDALVVTVLAAGGTRPATASAGGDDEAWDVGELARLDIPILQALCLTWGRDQWKASDEGTSPLDSASQIAVPEFDGRIITVPFSFKEFDDEGLPHYVTDAERCRRVADIAVAHARLRHIPPAQRRVAIVLSAYPTKHSRVGNAVGLDTPVSAVRLLRAMRDAGYDLGDGFPGVDLADETEAGNTLIHALIEAGGQDEEWLTAEQLAGNPVRIPAERYREWIADLPGELIDAVNEHWGEPPGTLFVDNGDIVLATLQAGNVVLMIQPPRGFGENPVAIYHDPDLPPSHHYLAAYRWLECGFGAHAIVHLGKHGSLEWLPGKNAALSAACATDAALGAVPLIYPFLVNDPGEGAQAKRRAHATIIDHLVPPMARAESYGDIARLEQLLDEHANIAAMDPAKLPAIRAQIWTLIQAAKLDRDLGLSERPHDAEFDDFLLHVDGWLCEVKDSQIRDGLHVLGGAPVGEARVNLVLAILRAVQVWGGQAGAVPGLRRALGLAGDTGNRAEVDAVEARARALVEAMEEAGWDPEQAQVVADRLGETAPDVVRVLRFAAEHVIPRLADTRQEITAVLHALNGGFVPAGPSGSPLRGLVNVLPTGRNFYTVDPRAIPSQLAYETGKALADALIERYRAETGEYPRSVGLSVWGTSAMRTSGDDIAEVLALLGVRPEWDEVSRRVRELSVIPLPELGRPRIDVTVRISGFFRDAFPHAVAMLDDAVRMVAELDEPDDANYVRAHVRSDLAEHGDRERALRRIFGSAPGAYGAGLLQLIDSGDWRSDADLAEVYTAWGGFAYGRNLHGEPSAEDMRANYRRIAVAAKNTDTREHDIADSDDYFQYHGGMVATVRALTGVEPKAYIGDSTTPDQVRTRSLREETARVFRARVVNPRWLAAMRNHGYKGAFELAATVDYLFGYDATAGVVDDWMYETLAQTYVLDTENQEFLRQANPWALQGIVERLTEAADRGLWREPHPQTMEALRRVYLEVEGELE

SEQ ID NO: 8334 - protein, 259 aa, Thermobifida fusca
  unsure (1)..(259): unsure at all Xaa locations
ILADVRWYLDGRSGRQAYRDGHLPGAVFVDVDTDLAAPPSPAGGRHPLPDPADFAAALSRLGIGDGSVVVAYDDAGGSTAARLVWMLRVLGTRAALLDGGLQAWPGPLETGDVTAEPRTRTPVPWPADRVVDTDTVRQELGEPGRLLLDARTFGRFTGEQPAPVDARPGHIPGARSASWQDNLDDTGRFAPPDVLQARFRALGVDTATSVTVYCGSGVTACHDLLALEHAGFPDARLYPGSWSAWGADESLPVQTGEXP

SEQ ID NO: 8335 - protein, 256 aa, Thermobifida fusca
DRTIVVTGGANGIGYALAERFLAEGAARVVLADLDGERAAAAAAELGARAQGYQLDVTDAEAVAALIEEVERDSPIDLWCSNAGVTTGGGLGSDADWDRTWRVHVLAHVYVARLLLPRMVERGGGHLLITASAAGLLTNIDSAPYSVTKHGAVALAEWLAILHGDEGIDISCLCPMGVNTAMTAKDGPDAATRLGGDYLEPEDVAQSVVEALNEGRFLILPHPKAAVMEQRRASDRDRWLAGMRRARARLKGGSGR

SEQ ID NO: 8336 - protein, 155 aa, Thermobifida fusca
HTVVDSPLGPLTLVAADGALVGLYQEDQRHRPAPDSFGVPDPAPFTEVIAQLTEYFSGQRTVFDLPLAFTGTPFQTTVWRALLEIPYGQTVSYGELAARIGKPSASRAVGLANGRNPISIIVPCHRVVGSSGSLTGYGGGLARKQWLLALEQRRA

SEQ ID NO: 8337 - protein, 290 aa, Thermobifida fusca
VTKAVIPVAGLGTRFLPATKSTPKEMLPIVDKPAIQYVVEEAVSAGLNDILMITGRNKRSIEDHFDRAYELEEALRAKGDIERLNAVRHPSDLAQLHYVRQGEPRGLGHAVLCGAAHVGNEPFAVLLGDDLIGARETLLQRMIEVRQTYGGSVIALMEVEPDQVSLYGCAAIEPTDEPDVVTVTDLVEKPPADQAPSRWAIIGRYICDPEIFEVLRKTPPGRGGEIQLTDALRELAQRSSNGGGRVHGVLFRGQRFDTGNKLDYLRTVVEFACESPDLAKEFVPWLRDFL

SEQ ID NO: 8338 - protein, 303 aa, Thermobifida fusca
SELSANSTQRRAPEPEILDEKRSRTERYTIFTFVFVPLLALAAAVPFAWGWGLTWLDVAIGAVFYLIGGLGITVGYHRLFTHGSYRAARPLKIALAIAGSLAIEGGVIKWVADHRRHHKYSDHEGDPHSPWRFGDDWRSVAKGMFYAHMGWLFLDEQKTSPKRFAPDLLKDKDLVRIDRYFWVFVLISLLTPPLIGGLVTMSWWGACTAFFWGSLVRIALLHHVTWSVNSICHTIGEENFTVRDRSRNVWWLAIPSFGESWHNLHHAEPTCARHGVLKGQIDISARVIWIFEKLGWATKVRWP

SEQ ID NO: 8339 - protein, 314 aa, Thermobifida fusca
QKKLMLFSGRTHPDLAAEVAVELGIETVPTRFQDFANGEIFVRYLESVRGCDAFVIQCHSDPINKSIMEQLIMVDALKRASAKRITVVTPFFGYARQDKKHRGREPISARLITDLFKAAGADRLMAVDLHTDQIQGFFDGPVDHLFALPLLADYVAANVDLSNTTVVSPDSGRVRTADRWADRLGTPLAIVHKRRDPDVAHEVRVHEVVGEVRGRTCVLVDDMIDTAGTIVKAADALFEQGAAKVIAVATHGVLSGPAVDRLKDSRISEVVITNSLPVSKDRQFDKLTQLSIAPLLARAINEVFSDGSVTSLFE

SEQ ID NO: 8340 - protein, 423 aa, Thermobifida fusca
LASIEAVHAREILDSRGNPTVEVEVALDDGTIARAAVPSGASTGQFEAVELRDGGDRYGGKGVEKAVAAVNEEISEQIVGYEAEEQRLVDSALITLDGTPDKSRLGANAILGVSLAVAKAAAESADLPLFRYLGGPNAHVLPVPMMNILNGGAHADTNVDIQEFMIAPIGAESFREALRWGAEVYHSLKAVLKAHGLATGVGDEGGFAPNLDSNRAALDLISEAITKAGFTLGQDIALALDVAATEFYADGAYQFEGSSRSAEEMAAYYTELVESYPLVSIEDPLSEEDWAGWKALTESLGDRLQLVGDDLFVTNPERLQRGIDEGAANSLLVKVNQIGTLSETLDAVSLAQRNRYTAMISHRSGETEDTTIADIAVATNSGQIKTGAPARSERVAKYNQLLRIEEELDDAAVYAGANAFPRF

SEQ ID NO: 8341 - protein, 402 aa, Thermobifida fusca
IDAVCELADFWRFNVHFARQILAEQPLVHAPGTWNRTDHRPLEGFVYAITPFNFTAIAGNLPTAPALMGNVVVWKPSPTQTLAACLTMELLEAAGLPPGVINLVTGDGVALSEVALTHPDLAGIHFTGSTRTFQYLWRTVGENIARYRSYPRIVGETGGKDFVVAHASADVDVLRTALLRGAFEYQGQKCSAASRAFIARSVWERMRDDFLAQVDALPMGDVTDFRNFLGAVIDRRAYDRLARLLDRVRTDPTIDVLVGGTADDSVGYFVRPTVLLGSDPSHEVFTTEYFGPVLAVYVYDDHAYEEVLRLVDRGAPYGLTGAIIATDRAAILAATRQLRFAAGNFYINDKPTGSIVGQQPFGGSRASGTNDKAGSMANLMRWTSPRVIKETFVPPTDHRYPH

SEQ ID NO: 8342 - protein, 407 aa, Thermobifida fusca
MPEAVIVATARSPIGRAFKGSLKDIRPDDLTAQIISAALAKVPQLDPATIDDLLLGCGLPGGEQGFNMARVVAVQLGLDSVPGTTITRYCSSSLQTTRMAFHAIKAGEGDVFISAGVEMVSRFTKGNSDTLPDTKNPLFAEAEARTARRAEGGAEPWRDPREEGKLPDIYIAMGQTAENVAQLRGVSRQRQDEFAVRSQNLAEKALDNGFWEREITPVTLPDGTVVSTDDGPRRGTTYEKVAALDPVFRPDGTVTAGNCCPLNDGAAALIIMSDRKAAELGITPLARIVSTGVSALSPEIMGLGPVEASRQALARANMSIRDIDLVEINEAFAAQVLPSADDLGIDIDSQLNVNGGAIAIGHPFGMTGARITTTLINALQFHDKTFGLETMCVGGGQGMAAIFERLS

SEQ ID NO: 8343 - protein, 381 aa, Thermobifida fusca
GAMSYEGFETLAIHAGQEADAETGAVVVPIYQTSTYRQDGVGGLRGGYEYSRTANPTRTALEECLAALEGGVRGLAFASGMAAEDTLLRTIARPGDHLIIPNDAYGGTFRLVSKVFERWGVSWDAVDLSNPEAVRTAIRPETVAIWVETPTNPLLNIADIAALADIAHAADALLVVDNTFASPYLQRPLSLGADVVVHSTTKYLGGHSDVVGGALVVADAELGERLAFHQNSMGAVAGPFDAWLTLRGIKTLGVRMDRHCANAERVVEALVGHPEVAEVLYPGLSDHPGHKVAVDQMRAFGGMVSFRMRGGEEAALRVCAKTKVFTLAESLGGVESLIEHPGKMTHASTAGSLLEVPSDLVRLSVGIETVDDLVNDLLQAL

SEQ ID NO: 8344 - protein, 328 aa, Thermobifida fusca
VTIRVGVNGFGRIGRNFWRAVQAAGGSDVEIVAVNDLTDKATLAHLLKYDTVLGTLPGEVEVGEDSITVGGTTMKALAQRDPAQLPWGDLGVDIVVESTGFFTKAEDAKKHLDAGAKKVIISAPAKGEDLTVVMGVNDDKYDPANHHILSNASCTTNCVAPMAKTLMENFGIVKGLMTTVHAYTNDQVILDYPHKDLRRARAAAQNIIPTTTGAAKATALVLPELKGKLDGLAMRVPVPDGSVTDLVVTLEREVTKEEVNAAFKAAAEGALKDILVYTEDPIVSSDIVGTPASCTFDASLTMAFGTQVKVVGWYDNEWGYSNRLVDLV

SEQ ID NO: 8345 - protein, 652 aa, Thermobifida fusca
  unsure (1)..(652): unsure at all Xaa locations
TIEDLDVAGKRVFVRADLNVPLDGDRITDDGRIRASLPTITALRERNARVIIGAHLGRPKGKVDPAYSLKPVAARLGELLGTEVRFASDTAGESAQAISRELADGEVALVENLRFEPGETSKDDAERGEFADRLAALAELYVGDGFGAVHRKHASVYDLPKRLPHAAGGLVLAEVNVLRKLTESPQRPYVVVLGGSKVSDKLGVIDNLLNTADRILIGGGMAYTFLAAQGYEVGASLLERDQIDTVKGYLRRAEERGVELVLPVDVVAAEKFAADAAHDVVDVREIPADRMGLDIGPASAELFASKLADAATVFWNGPMGVFEMEPYAKGTRSVAQALADSSAFTVVGGGDSAAAVRALGFDEKAFSHISTGGGASLEYLEGKTLPGIAALEEXDDMATAKRKPLIAGNWKLNNNHLEAIALVQKMAFALNDADYDAADIAVLPPFTAIRSVQTLVEGDKLRITYGAQDISQHEKGAYTGEVSGPMLAKLNCTYALAGHSERREYHHEDDAVVNAKVKAAFASGITPILCLGEGLEVRKAGRHVEHTLAQLEGALKGVTEEQVRTLVVAYEPVWAIGTGEVATPEDAQEVCAALRKRIGELYSPEAAQQTRILYGGSVKSGNVAAIMAQADVDGALVGGASLDADEFVKLIR

SEQ ID NO: 8346 - protein, 486 aa, Thermobifida fusca
SIWRTKSIEQSIRDTDEPGYRLRRDLNGFDLIVFGIGVIIGTGIFVVTGRQAAENAGPAIVLSFLAAGAVCALAAMCYAEFASTVPVAGSAYTFGYATLGEFVAWIIGWDLILEFTLAASVVSVGWSEYAGDLLALPTTVTLAGLPVNLGAVAIAVLLGLVGMLGAKLSGRVTAVVVAIKVGIVLFIIAVGAAYVDPANWTPFIPPAQPAAADTTGVSDATLTHVLFGLEPTSFGPWGVVAAASVVFFSFIGFDIVATTAEETRNPRRDIPVGIFGSLLIVTLLYMAVAAVVTGMRPYTELNVTAPLSDAFRSVGADWAATLISLGGVIGITTVILVLMMGQARVAFAMSRDGLLPRALSRIHPRFGTPYVTTLLTTAAVALLGGLVPISTLEEMVNIGTLFAFVVVSVGVVVLRSLRPDLPRAFRVPWSPVLPLLAALSCLWLMLNLTALTWIRFAVWLVIGVAIYFLYGIHHSRLAAPPAQPSG

SEQ ID NO: 8347 - protein, 512 aa, Thermobifida fusca
EPVMPGAVPNPLRSVLDRRLPRIAGPCVLVLFGVTGDLSRKKLLPAIYDLANRGLLPPGFGLVGFARRDWADQDFTQVAYDAVRTHARTPFREDVWRQLSEGVRFVPGEAHDDAAFDALVRTVRELDESRGTGGNYAFYLSLPPKLFPTVLTQLKRSGLAESSGDSWRRVVIEKPFGHDLASAQELNALVDDVFPPHSVFRIDHYLGKETVQNLLALRFSNTLFEPIWNRSYIDHVQITMAEDIGVGGRAGYYDGIGAARDVIQNHLLQLLALVAMEEPLSFTADAIRAEKVKALSAVQLPDDLATGTARGQYTAGWQGGAWVPGYLEEEGIPPNSTTETYAAMRLGVNTRRWAGVPFYLRTGKRLGRRVTEVALVFHRTANQVFDHVATANQGANSLVIRIQPDEGVTLRFGSKVPGTAMEVRDVSMDFSYGASFTETSPEAYERLILDVLIGDPPLFPHQEEVELSWRILDPVEEFWAKNGRPEPYPAGSWGPPSGHELLARDNRTWRRP

SEQ ID NO: 8348 - protein, 691 aa, Thermobifida fusca
TPKTLDWSDLDRRTVDVVRALAMDAVEEAGSGHPGTAMSLAPVAYLLFQKVMRHDPTDPKWIGRDRFVLSCGHSSLTLYIQLYLAGYGLSLNDIKRLRQWGSLTPGHPEYGHTAGVETTTGPLGQGIGNAVGMAMAARRERGLFDPDTPIGESPFDHYIYVLCSDGDVQEGISHEVSALAGTQKLGNLIVIWDDNRISIEDDTQIAFTEDVVARYAAYGWHVQEVEWVGEDGSYHEDVAALYDAIRAAQAETERPSFIRLRTIIGWPSPNKQNTGAIHGAALGAEEVAATKRVLGLNPEAQFDVPNELLEHARGVVARGRAARQEWEALFAKWRANAGERAELFDRLMAGSLPDGWEKAIPTFEPSAKGMATRKASGEVLSAIAPVLPELWGGSADLAGSNNTTPKGEPSFIPEERSTKAFSGHRYGRVLHFGIREHGMGAILNGIALHGPTRPYGGTFLVFSDYMRPSVRLAALMKLPVTYVWTHDSIGLGEDGPTHQPVEHLWSLRAIPGLAVVRPADANETAVAWRTILERNDGPVALALTRQSVPVLDRSELASAELVSRGGYILAEASNGRPEAIIIATGSEVQIALEARSRLEESGTPTRVVSMPCLEWFNEQDDAYRQQVLPPSVRVRVSVEAGVALGWRELVGEYGESVSLEHFGASAPYATLYEQFGLTADRVVAAVHSSAA

SEQ ID NO: 8349 - protein, 384 aa, Thermobifida fusca
VDFSLTEEQREIRNWVRTFVERELMPLEPEVLRRERNGEGHGLTPQELHDLRQLAKKSDFWGIQTPVEYGGMGLDAVTTALVEIELGRTFIPFSFGGGADNILFYANEEQKKRYLLPTIAGERKSCFAITEPGAGSDAKAIRTRAYKDGDHWVINGEKTFITGGNEADFAMVFAVTDPEKGANGGVTCFLVDREAGWRSEPIPTMGEWGPASLVFDNVRVPESNVLGEVGKGFELAMKWIGRGRYLLPARALGACERLLSMAIDYANTRETFGKPLAERQAIQWMIADSQVEIEALRLLVLHAAWQVDNGRDSRHAQSIAKLYGGVKANEIVDRVLQIHGGMGYTRELPIERWYRELRLLRIYEGTDEIQRRTIARDLLKGYVK

SEQ ID NO: 8350 - protein, 499 aa, Thermobifida fusca
LSLATILAEAARRHPERTALIADGERISYATLWHESLRHAAALRSLGVSPGDRVALLAGNVADFVRCYYGILAVGGTVVTIPPMLRPQEVAFLLSDTGARLVLAQSLFADLAHAAVDGNDVTVRTVGDPQRPDALAPLVADSEPLPSYVSRAPDDIAVIFYTSGTTGVPKGAMLTHLNLVMNATVNAFDVHPMSGEDVVMGSLPLFHTFGQSVALNTTFRVGATLILQERFDPDEAIRMMCEYGATIFDGVPTMFVRLAEAAAHHTKLPSLRFCVSGGASLPEVVLRRFEEAFSTTIYEGYGLSETSPTASTNQTLYGARVGSVGHPIWGVEVEIARADIDDRIELLPRGEHGEIVIRGHNVFVGYLNRPEATAEAIVDGWFRTGDIGFIDDDGFIHIVDRKKDLIIRGGFNVYPREVEEVLLKFPGISQVAVIGVPDAELGEEVCAVVVPDKEGAVDPAELQAWAQERLGKHKYPRRVEIVTELPLGPSLKVLKRELR

SEQ ID NO: 8351 - protein, 403 aa, Thermobifida fusca
VDSEIGRLRQVLVHRPDLEIQRLTPSNKGTLLFDEVLWVERAREEHDLFVQLLRDRGVTVHEFGSLLAETLHIPEAKRFILDEVLEERFYGPMALDAIRACLDAMDPGELRRFLTGGITKREILQRISEPKSVWFHALDLDAFVLPPLPNLIFTRDTSSWIGNGVSINVMRNRARMRETTLYEAVYRWHPLFAATDFPVWNPGVSWAPATIEGGDVMPVGNGSVLVGMSERTRPQAVELLARELFARGGAQRILGIQMPEARAIMHLDTVMTNVDHGVFTKYAGLGMLPSYTIEPGDSDKELKITDHAPEDMHRAIAAAVGVDDITVLTPTQDVFSAEREQWDDGCNLLALAPGVVVAYERNVSSNAYLQANGIEVITIPGNELGRGRGGPHCLTCPLERDPV

SEQ ID NO: 8352 - protein, 332 aa, Thermobifida fusca
MAFNLRNRSFVKELDFTPQELMFLITLAADLKAAKYAGTEQPQLSGKNIALIFEKTSTRTRCAFEVAAHDQGAHVTYLDPSGSQIGHKESIKDTARVLGRMFDAIEYRGASQATVEELAEYAGVPVWNGLTDEWHPTQMLADFLTIMEHTDKPLREVTLAYMGDARNNLGNSLTVTGAMLGIDVRMVAPRELWPDEERVAAPARAIAETTGARVTFTDDIAEGLAGADFIYTDVWVSMGEPSEVWDERIRQLLPYQVNAEALKATGNPDVKFLHCLPAFHDLGTEVAREIHARTGLTALEVTDEVFESPASIVFDQAENRMHTIKALMVATL

SEQ ID NO: 8353 - protein, 292 aa, Thermobifida fusca
KRYGTVTAVAGLSFTAARGAVTALLGPNGAGKTSTIEICEGFRHADAGRVRVLGLDPIRDAAALRPRVGVMPQSGGVPTGVRAGEWLRLLAAFYAHPLPPEALLDRLGLSAVARTPFRRLSGGQQQRLSLAAAIIGRPELVFLDEPTTGLDPQARMATWELIGELRTAGVGVVLTTHYMEEAERLADHVVIIDHGRVVADGPTAALTRGDRELRFRAAPGLDVSDLAAALPPGCSVTERDAGQYTVTCADPDEIGPGLVATVSTWCASRGLLPEDLRVHRRTLEDVFLELTG

SEQ ID NO: 8354 - protein, 406 aa, Thermobifida fusca
REVVVTGLGASSPLGGDVATTWSALLEGRSGITSLPEEWHEKLPVHFAGLLAEEPSEKLERHRLRRLDRTQQLALITAREAWDDAGSPEVDPLRLGVVMSSGIGGILTTLHQYDIFREKGWKRVSPFTVPMLMPNSPAAAVALEFTARAGAHAAVSACASSAEAIADGINMIRSGRADVVIAGGCEAAIHPLNIAAFAAMRALSTRNDDPQGASRPFDVNRDGFVMGEGAATLILESAEHAAARGARVYAVAAGAGYTCDAYDIVQPDPVGAGASRAISAAIADAGLSPSDIAHINAHATSTPAGDVPETVAIRSALGDSAADAVAVTSTKSMTGHLLGGAGALESVATVLALYHGVVPATINVEEIDPGVVVDVVVDKPRELPSSAVAALNNSFGFGGHNIALAF

SEQ ID NO: 8355 - protein, 309 aa, Thermobifida fusca
GACVVAFGEYQPANVVTNDDLAKRVDTSDEWIRSRVGIAERRIASPEESVTDMAVAAGGKALAASGLAPDDIDLVIVATCTQRDQIPNTSASVAARLGIPAPGAFDVNAACAGFCYALSVANDAVRGGSARNALVIGAEKLSDWVDWDDRSTCVIFADGAGAAVVSASDEPGIGPVVWGSAGDRADKIYLRDHKYIYQEGQTVFRWTTTELYPVALEALERAGVAPEELTAFVPHQANLRIVEAIARKLGAPQAIIARDIVTAGNTSSASIPLALSRMIGRGELPSGSTVLTLGFGAGLTYAAQVLRLP

SEQ ID NO: 8356 - protein, 303 aa, Thermobifida fusca
VLAIVAPGQGAQVPGFLSAWLELPGMAERFAEWSDVVGLDLVRYGTTADAEEIRDTAVAQPLLVSAGIAAAIALFGDLESAAASADVVAGHSVGEFTAAAVAGALTPRDALLLVAERGRGMAEASAVTPTGMTAVLGGDRDEVLAAIKAAGLTPANDNGSGQIVAAGTLEQLEALAAAPPARARLRPLAVAGAFHTHHMAPAVKRVEALAATLTPADPRTRLLSNRDGAVVTSGSEYLSRLVSQISSPVRWDACTATLADLGVTALMELPPAGTLTNLAKRALRGVELLAIKSPEDLDRARTL

SEQ ID NO: 8357 - protein, 984 aa, Thermobifida fusca
MRSLLSPRRWRTLASGALAAALAAAVLSPGVAHAAVACSVDYDDSNDWGSGFVAEVKVTNEGSDPIQNWQVGWTFPGNQQITNGWNGVFSQSGANVTVRYPDWNPNIAPGATISFGFQGTYSGSNDAPTSFTVNGVTCSGSQPANLPPDVTLTSPANNSTFLVNDPIELTAVASDPDGSIDRVEFAADNTVIGIDTTSPYSFTWTDAAAGSYSVTAIAYDDQGARTVSAPIAIRVLDRAAVIASPPTVRVPQGGTADFEVRLSNQPSGNVTVTVARTSGSSDLTVSSGSQLQFTSSNWNQPQKVTIASADNGGNLAEAVFTVSAPGHDSAEVTVREIDPNTSSYDQAFLEQYEKIKDPASGYFREFNGLLVPYHSVETMIVEAPDHGHQTTSEAFSYYLWLEAYYGRVTGDWKPLHDAWESMETFIIPGTKDQPTNSAYNPNSPATYIPEQPNADGYPSPLMNNVPVGQDPLAQELSSTYGTNEIYGMHWLLDVDNVYGFGFCGDGTDDAPAYINTYQRGARESVWETIPHPSCDDFTHGGPNGYLDLFTDDQNYAKQWRYTNAPDADARAVQVMFWAHEWAKEQGKENEIAGLMDKASKMGDYLRYAMFDKYFKKIGNCVGATSCPGGQGKDSAHYLLSWYYSWGGSLDTSSAWAWRIGSSSSHQGYQNVLAAYALSQVPELQPDSPTGVQDWATSFDRQLEFLQWLQSAEGGIAGGATNSWKGSYDTPPTGLSQFYGMYYDWQPVWNDPPSNNWFGFQVWNMERVAQLYYVTGDARAEAILDKWVPWAIQHTDVDADNGGQNFQVPSDLEWSGQPDTWTGTYTGNPNLHVQVVSYSQDVGVTAALAKTLMYYAKRSGDTTALATAEGLLDALLAHRDSIGIATPEQPSWDRLDDPWDGSEGLYVPPGWSGTMPNGDRIEPGATFLSIRSFYKNDPLWPQVEAHLNDPQNVPAPIVERHRFWAQVEIATAFAAHDELFGAGAP

SEQ ID NO: 8358 - protein, 337 aa, Thermobifida fusca
YDAFLLISFGGPEKREDVIPFLENVTRGRGIPRERLAEVGEHYYLFDGVSPINQQCRDLIAALRDDFAANGVELPIYWGNRNWDPYLEDTVAEMARNGVRRAVALATSAYSNYSSHRQYLEDIERARAAVPEAPEIDLIRPFYDHPGFIDAFVDHTRQALERIPEELRPETRLLYSAHSLPIAMAKKSGDPRRDYGSLTAYEAQLLETARLITERLDRDYPYEIVYQSRSGPPSQPWLEPDINDRLEQLAKEGVRSVVVVPHGFVSDHMEVKYDLDVEARETAEKLGIRLERAAAPGTHPAFVAMVRDLVAERAEGRPPRGLGAIERSCHDDPADCC

SEQ ID NO: 8359 - protein, 915 aa, Thermobifida fusca
VSANSFGSRDTLRVGDESYEIFRLDAIDGVQRLPYSLKVLLENLLRTEDGVNVTADHIRALANWDSKAQPSQEIQFSPARVIMQDFTGVPCVVDLATMREAVRDLGGDPTKINPLAPAELVIDHSVIVDVFGRPDAFERNVEMEYERNRERYQFLRWGQNAFEGFKVVPPGTGIVHQANIEHLARVTMVRNGQAYPDTCVGTDSHTTMQNGLGILGWGVGGIEAEAAMLGQPISMLIPRVVGFKLTGELPPGTTATDLVLTITEMLREHGVVGKFVEFYGEGVASVPLANRATIGNMSPEFGSTAAMFPIDDETIRYLKLTGRSDEQTALVEAYTKEQGLWHDPSVEPEYSEYLELDLSEVVPSIAGPKRPHDRIALSDAKTAWRRDVRDHVNNDGIVTRADEASAESFPASDAPAISSNGVVTERPRKPVKVTLGDGTEFTIDHGSVVIAAITSCTNTSNPSVMLGAALLAKKAVEKGLSRKPWVKTSLAPGSKVVTDYYERSGLTPYLDKLGFNLVGYGCTTCIGNSGPLPEEISKAINDNDLAVAAVLSGNRNFEGRINPDVKMNYLASPPLVVAYALAGTMDIDFDTEPLGTDTDGNPVYLRDIWPSPEEIQEVIDSAIAAEMYQRAYSDVFAGDERWRSLPTPTGDTFSWDPNSTYVRKPPYFDGMPLEPEPVSDIVGARVLAKLGDSVTTDHISPAGAIKPGTPAAEYLMANGVERKDFNSYGSRRGNHEVMIRGTFANIRLRNQIAPGTEGGYTRDFTQEGGPVTFIYDAAQNYAAQNIPLVVLGGKEYGSGSSRDWAAKGTRLLGVRAVIAESFERIHRSNLIGMGVLPLQFPEGQSADSLGLTGEETFSITGVTELNEGRIPETVKVTTDTGVEFDAVVRIDTPGEADYYRHGGILQYVLRQLINK

SEQ ID NO: 8360 - protein, 611 aa, Thermobifida fusca
NPDDLKKLPDSQLPQLAAEIREFLISQVARTGGHLGPNLGVVELTIALHRVFDSPRDPILFDTGHQAYVHKILTGRKDFSKLRKEGGLSGYPSRAESEHDFIENSHASTALSYADGLARAYELQGITDRTVVALVGDGALTGGMAWEALNNIAEGKNRRIVIVVNDNGRSYSPTIGGLAEHFANLRMTRGYEQMLATAKNAINRAPVVGPPLYDALHAFKKGLKDAIQPQMMFEDLGLKYVGPIDGHDVAAVERALRRARDFGAPVIVHVLTQKGKGYAPAENHDEDQFHALGAFDVATGRPQSTPGLKWTSVFSDEMVRIGAEREDVVAITAAMLHPTGLAAFAEAYPDRVFDVGIAEQHAATCAAGLAMGGLHPVVAVYATFLNRCFDQVLMDVALHRQPVTFALDRAGITGDDGASHNGMWDLSILQVVPNLSIAVPRDAVRLRELLREAISIDDGPTVVRYPKGVVPPAIPAVDQIGGMDVLRRPASGTEAPDLLLVAVGPMAQTCCEVADRLADQGIGVTVVDPRWVKPLDPALVSEAARHSVVAVVEDNGRVGAVGDAVARALRDADLDIPVRTFGIEQRFLEHAKRDRILAQMGLDAQGLARKL

SEQ ID NO: 8361 - protein, 386 aa, Thermobifida fusca
RDVVFVDGVRTPFGKANKGLYTETRADDLVVRVIRELLRRNPALPPERIDEVAIAATTQIGDQGMTIGRSAAILAGLPRSVPGYAIDRMCAGAMTAVTTTAAGIAFGAYDVVIAGGVEHMGRHPMGEGVDPNPRYLSEKLVDPSALIMGNTAENLHDRYPTITKERADAYAVRSQEKTAKAYAEGKIQPDLVEVAVRSSENGYGLATVDEPPRPGTTMEALATLKTPFRPHGRVTAGNAAGLNDGATGAILAAEDVAAELGLTVKMRLVDFAFAGVDPEVMGVGPIPATEKLLARNGLTMDDIGLIEINEAFAVQVLAFLEHFGIPDDDPRVNPWGGAIAMGHPLASSGVRLMMQLSRLFAERPDVRYGLTTMCVGMGMGGTVLWE

SEQ ID NO: 8362 - protein, 337 aa, Thermobifida fusca
DSAFLRACRRQPVPHTPVWFMRQAGRSLPEYRKLREGVPMLEACARPDMIVEITLQPVRRYNVDAAIFFSDIMVPLKAIGVDLDIKPGVGPVVAEPIRDLAATRRLRGLEPDDVPYVTEAIRELVRELGSRPLIGFAGGPFTLASYLIEGGPSRHHEHTKALMYGAPEVWTELMRRLSAITLEFLRVQIAAGASAVQLFDSWVGALSAEDYRANVLPYSSWIFAQLAEFDVPRIHFGVGTGELLGLLSEAGADVVGVDWRVPLDQAARRVRPHTALQGNLDPAVLFAPWSVVAERTDDVLARAKAAEGHVFNLGHGVLPTTDPAVLERLVEYVHTQT

SEQ ID NO: 8363 - protein, 459 aa, Thermobifida fusca
VSGLAVAHRLARSGHRVTVLEAAARPGGKLAVEKVAGVSADVGAEAVLARRPEALSLIDELGLTERVTHPGTVTSQIYSRGKLRDFPEGHVMGVPSDFAALARSGVLSPLGVLRAARDLVWPATPVKADVPVATYIGIRMGRETVDRLVEPLLGGVYAGRADQLSLDATLPQLASAARTQRSLAAIARDTHSRTARPTAEPPPPLFATLRGGLATLIDALAAQPGVTVRTATPARDLRRTEQGWQLAVGDPPAETVDADAVVLACPAPEAARLLRTIAPSAAVELGGVRYASMAVVTLAYPLSAFPAPPTASGFLVPSVEGRTIKAVTFSSVKWPWLAAELRDANPGEEIVLLRCSLGRFGDDAVVDYDDDTLVARATSDLADLCGVSGPPVDSHVTRWNAGLPQYTVGHRDRVARIRSALDGIDGLAVCGAVYNGVGIPACLSSAEEAARRITHTTGG

SEQ ID NO: 8364 - protein, 231 aa, Thermobifida fusca
RLSVADCLTLGNALCGFMAVCQLVTAQLAHTASGALGPLPREAVTMPIILLLGAAAFDLFDGRVARRLGGSAMGAELDNLADVISFGFAPAFFVVTWGAFTHSAGSVLVLVVAAAVLLAVVVRLARFSCQSPGDRHFTGLPSPFGAMTVIVIVLLHPPVYVGSLAILVVAWLMVSSIRYPKPRGRSAYTVVASLVGGAGCLVAWAMDAPGGLLLLYSSALLMLLVLVLAPM

SEQ ID NO: 8365 - protein, 694 aa, Thermobifida fusca
VWPGHAYPLGATYDGSGTNFSLFSEVATGVELCLFDDDGAETRVPLTEQDGHVWHGYLPTVGPGQRYGYRVHGPYDPERGLRCNPNKLLVDPYAKAIDGQIHWHESLFDYHFADPGRVNNHDSAPYVPTCVVVSPFFDWGAEQHPNIPYHETVIYEAHVRGMTIRHPDVPPPLRGTYAGMAHPAIIEHLLSLGVTAVELMPIHHFLPEHALVARGLTNYWGYNTLAFFAPHSGYAATGTRGHQVQEFKTMVKALHQAGIEVILDVVYNHTAEGDHMGPALSLRGIDNLAYYRVREDNPRYYLDYTGCGNSLNVRHPHSLQLIMDSLRYWVLDMHVDGFRFDLAAALAREFHDVDRLSTFFDIVQQDPVISQVKLIAEPWDVGPGGYQVGNFPPLWTEWNGKYRDTVRDFWRGYPVLPELASRISGSSDLYQADGRRPVASINFVTCHDGFTLADLVSYDRKHNEANGEDNRDGTDDNRSWNHGTEGPTTDSAIATLRRRQMRNMLTTLMLSQGVPMLSHGDEIGRTQHGNNNAYCQDNPISWVDWELARRNADLLDFVRTLSRLRREHPVFRRRRFFQGALPGRGKQRDIAWLRPDGTLMEDADWGRGWRALGVFLNGDAITEPDRMGRRIRDDSFLLLLNAGINDVQFTLPGPSYSAAWETVVDTADPEVAGRPYLPAGSDVTVIDRSFLVLK

SEQ ID NO: 8366 - protein, 236 aa, Thermobifida fusca
  unsure (1)..(236): unsure at all Xaa locations
TGEEQRXTSRPTARRFAAEAAARLEEASATEIIQWAADTFGDRLCLTASMADAVMVDLVSKVVPGIDVIFLDTGYHFPETLGTRDAVAQTYPINLITVTPSRTVAEQDRDLGPRLYARNPDLCCYLRKVEPLQRALQSYDAWLTGLRRDEAVTRRTVGVVQWDARKKKIKVNPIARWTQEQVDSYIAEHGVLVNPLQDDGYPSIGCAPCTQRVPEGADPRSGRWAGTGKVECGLHS

SEQ ID NO: 8367 - protein, 554 aa, Thermobifida fusca
PARKTTRPRRGEGQWALGYREPLNKNEEIKKNDDGLNVRKRIIDIYSKQGFDSIDPADLRGRFRWYGLYTQRAPGIDGGKTAVLEPEELDDRYFMMRVRTDGGQLNVAQLRVLAEVSTAYGRDTADITDRQNIQMHWVRIEDVPTIWERLESVGLTTTEACGDTPRGLLGCPLAGIAEDEIIDATPQLRQIVADHIGSPLFSNLPRKFKTAIDGCAVHCTNYEVNDVAFVGVIGPDGTPGYDLFVGGGLSTNPMFAQRLGAFVRPEQVSEVWAGVCSVFRDYGYRRLRHRARIKFLIKDWGPQKFREVLEKEYLGYSLPDGPEPVLDPGTRRDHVGIHRQKDGRFFVGFAPRVGRVSGTILGRIADIAEAHGSNRVRTTADQKLAILDITEDRLDSVVAALEAEDLQVNPSVFRRQTMACTGIEYCKLAIVETKNRAMALIDELERRLPDFTEPLTINVNGCPNACARTQIADIGLKGQLVTDAHGNQVEGFQIHLGGGLGLQAGFGRKVRGLKTTAAELPDYIERVVRRFAEQRQAEETFAEWVARADEADLK

SEQ ID NO: 8368 - protein, 256 aa, Thermobifida fusca
KGIAGSVAVVTGAGGGIGRAVATALAAQGAAVAAVDVNPESTAQTVTGLAQAGQRGKGYARDVTDTAGVERLFDEIEHDLGPVDILVNAAGILRTGPVVDCPDHDWHDLIAVNATGVFTVSRAAARQMVPRRRGCIITVASNAAGVPRAAMAAYAASKAAAVAFTKSLGLELAPHGIRCNVVSPGTTDTPMLWAMRPEGYTEADAVAGDPDLYRIGIPLGRIARPEDIADAVCFLASPAARHITLHDLYVDGGASL

SEQ ID NO: 8369 - protein, 533 aa, Thermobifida fusca
TPWPAEFAVRYREAGYWTGETFSDFVTDRTRRFADRLAVVGAGQRWTYAELGERSAVLATGLARLGIAAGDRVVVQLPNIPELFEVVFALFRLGALPVYALPAHRAHEITHLCTTAQAKALIIPDRHAGFDYRTMAAQLRHAGTAPEHVVVVGEPGGFTPLAELRADRPDPGVFTRPEASDAAFLQLSGGTTGLPKLIPRTHDDYLYSVRASAEICALGTDTVYLAALPAVHNFPMSSPGFLGTFHAGGTVVLAPNPSPDTAFSLIETERVTITAVVPPIALQWLDAVEHGSQSHRDLSSLRVLQVGGAKFAPEAARRVRPVLGCTLQQVFGMAEGLVNYTRLDDPDDIITTTQGRPISPDDEIRIVDEADRPVPDGEVGHLLTRGPYTIRGYYRAEEHNATAFTPDGFYRTGDLVRRTPTGHLVVEGRAKDQINRGGEKVSAEEVENHILAHPAVHDAAVVGMSDPYLGERVCAYVIARTEPPSRSELLRFLRERGLASYKIPDRVEFVDRFPVTGVGKISRSELRRELARR

SEQ ID NO: 8370 - protein, 236 aa, Thermobifida fusca
AVMSRSVLVTGGSRGIGLAIARELKEAGDDVAVTYRTGQPPEGLFGVQCDITDSAQVDAAFKQVEEAHGPVEVLVANAGINKDQLLALMSEEDFNAVLDTNLTGAFRVAKRAVRGMMRKRSGRIILISSVVGLAGSPGQANYAASKAGLVGFARSLARELGSRNITVNVVAPGYIETDMTAALPEKRQEEIKKNVPLGRYGTTADVAKAVRFLASEDAGYITGAVIPVDGGLGMGH

SEQ ID NO: 8371 - protein, 253 aa, Thermobifida fusca
GILEGKRILVTGVLTDSSIAFHVARLCQEQGATVVLTGYGRLTLVERIAKRLPEPPPVLELDVTNDEHLDTLADRVAEHVDGLDGIVHSIGYTPQEALGGNFLNTRWEHVATALHTSTFSLKSLTTALLPLMKNGGSVVALDFDNSVSYPIYDWMGVAKAGLASTARYLARYLGEQKIRVNLVSAGPLNTMAARSIPGFEELAAEWPKRAPLGWDITDPEPAARAVVALLSDWFPATTGEIVHVDGGFHSTGA

SEQ ID NO: 8372 - protein, 242 aa, Thermobifida fusca
LRGAAVLVTGASRGIGRAIAQVFAEEGANLAICARTRAPLEVAARQLRETGAIVMAREVDVADAPALRAFVDEAAAELGGLDVVVSNVSGGGAVGWEGALRTDILPFTVLTDQAQEHLASSQRGGAVILISSTSALHVTAPSGPKPYGAVKAALNHHATALARALAPRGVRVNIVSPGPIEFEGGSWARRRDTDPDYYASVRARIPFGRLGRPEEVARAVAFLASPAASFITGANLVVDGGF

SEQ ID NO: 8373 - protein, 774 aa, Thermobifida fusca
GLTSAQAAQRLAAGLGNDVPVRASRTVGQIIRANVFTRINAMVAVLFGVIAVIGPVQDGLFALVIVINTLVGIVQELRAKKTLDSLAIINAARPRVVRDGVAVEVRPQEVVLDDVIELGSGDQAVVDGVVVSASGLEVDESLLTGEADPVLKQPGDPILSGSFVVAGSGRFRATRVGRDAYAARITEEASRFSLVRSELRSGVDRILRFITWLLFPIGGLLLYSQLFLDAHVTAEVSAGGTISGPFADALRGTVAALVSMVPEGLVLLISIAFAVGVIRLGRRRCLVQELPAIEGLARVDVVCTDKTGTLTEAGMRLAEVRPLDAAADADALTEVLAALAAADPHPNPSMAAIRDSCGTPPDWPVAAVRPFSSARRWSGASFTTPQGKQHWVLGAPEVLADADSPAVAAAARTAAQGLRVLLLGRADAAVDGPHQVTPMALVVLEQRVRPDSAPTLDYFARQDVAVKVVSGDNAASVAAVAHTLGLPGADQPVDARDLAPQDADFAEKVEKATVFGRVSPEQKRSMVAALQQHGHTVAMTGDGVNDVLALKEADIGVAMGSGSPAARSVAQIVLLDDRFATLPHVVAEGRRVIGNIERVANLFLTKTVYSMTMATVVSLLAVAYPFFPRHATLINAVTFGIPSFFLALAPTTERARPGFVARTLRLAVPAGLVSGLAAMTTYFLVLDGADTPTLADRTAVLITLCATTLWVLLLVARPYVWWKAVLVAAMVGLLLAALLTPVGQAFFALDMSDPAAVGTALAVAGVAAAIITVI

SEQ ID NO: 8374 - protein, 203 aa, Thermobifida fusca
AVLFDMDGTLIDTEPLWIATEAEVAAELGCTTWTVEDQRRCLGSSAAMVASYIAERSGTSVPQSEIVTMLYTSVARRMADSPPVQPGAKELLSELDALGVPMALVTSTYRSLLGTALRGLGEHYFAATVAGDEVSQAKPHPEPYLTAARLLGVDPRRCVAVEDSPAGVAAAQAAGCVVVAVPHVAPIEEAERRYVVSSLTEIS

SEQ ID NO: 8375 - protein, 69 aa, Thermobifida fusca
DTNEYAATFNLVDSDGDQRISARELGRLMEVLGSPITLDQAEEAVRSIDSDGDGLISLEEFAAYLESAR

SEQ ID NO: 8376 - protein, 249 aa, Thermobifida fusca
VSMPFYVSPEQIMKDKADYARKGIARGRSAVVLQYEGGILFVADNVSRTLHKISELYDRVAFAAVGRYNEFENLRLAGVRFADMHGYTYDRSDVTGQMLANAYAQTLGAVFTESSKPWEVEIVVAEVGDSPDSDQIYRITFDGSVVDERDFLAMGGSAERVTAALRERYVKNMSLTDALRVAVHGLAHENGERRELKASSLEVAMLERSRPHRKFRRIQGERLARMLQEAREAEEAAEAQSSEDGGATD

SEQ ID NO: 8377 - protein, 242 aa, Thermobifida fusca
RFTDRVALVTGAAGGIGAATAQRLAAEGAAVVLTDIDTERGERVAARLRDQGHRAVFQYCDVSDEDSWAHAVRTANDTFGPVDALVSNAYRVTIAPAHATSLADWNDQIAVTLTATFLGVRACLTDLLARNGSVVAVSSVHAMVGLPGRPAYAAAKAGLTGLARQLAVEYGPQIRVNSVLPGPIRTRAWDNVSEDDVRRSVEQTVAGRLGEPDEVAAAIAFLLSSDASYITGTTLLVDGGWT

SEQ ID NO: 8378 - protein, 382 aa, Thermobifida fusca
MDFTLTEEQTALRAMAAEFVDREITPHVVEWDRAESVPRDLVPRLGELGFLGMTIPEEYGGVGGDHVSYALVMEELGRGDSSVRGLVSVSLGLVAKSIATYGTEEQRQRWLPGLCSGELLGCFGLTEPDTGSDAASLSLKAVRDGDDYVLTGSKMFITNGTWADVAIIFARTGGPGPKGITAFLVPTDTPGLTRTTIHGKLGLRGQPTAQLFLDEVRVGPDAILGEENQGFRIAMAALDKGRVSVAAGAVGAARGALESALAHAKERVQFGRPIAGFQLVQEMLADMAVETDAARLLVWRAADLIDRGEPFSTAASMAKLYATETAVRAANNAMQVFGGYGYIDEYPPGKYLRDARVTTLYEGTSQIQKLIIGRALTGISAF

SEQ ID NO: 8379 - protein, 463 aa, Thermobifida fusca
IYIDGQWIAPQTSDRMAVENPYTCQDIATIPLCGTEEVDHAVHAARRAFPAWSTTDLEERLAHLDALRRELAVRATEMSALITSEMGAPKVIADRIQVGLPLTVLGDTVATARDFAWTEKIGNSLILREPIGVVGAITPWNYPLHQIVAKIAPALAAGCTVVLKPSEIAPLSALLLAEIIDSVGFPPGVFNLVTGTGPVVGEALAAHPDVDMISFTGSTRAGSRVSEVASATVKKVALELGGKSAGVVLDDADLPTAVKAVVSDCLLNSGQTCTALTRLLVPHDRYEEAVALAVDAARSKPMGDPADPATRIGPLASADAHRRVLGHLEQARKDGAVFATGGPDADVPEQGYFVAPTVLAGLDRDAAAAREEIFGPVLTVLGYRDVDDAVELANATDYGLSGAVWSADTDRALAVARRMRTGQVAINGGRFNPSAPFGGYRKSGNGRELGRFGLEEFCEVKAV

SEQ ID NO: 8380 - protein, 952 aa, Thermobifida fusca
SRLTSMSTYAARYAEFRRRQKESSPTIEEFQNLYGFDFDDFQIRACKALETGHGVLVAAPTGSGKTVVGEFAVHLALRDGRKCFYTTPIKALSNQKYTDLVRRYGSDKVGLLTGDNSINGEAPVVVMTTEVLRNMLYAGSATLSGLAYVVMDEVHYLADRFRGAVWEEVIIHLPESVQIAALSATVSNAEEFGQWLQQVRGDTSVIVDEKRPVPLWQHMMVGTRIHDLFVEPEGTDTGQEEEKNGRGSRKRRRSRHARQRTVEIEVGGERLHVNPKLIRFAEEDARLTQLAYQRRHPQARARGGAPRPRSRFAPPTRAQIVEQLDREGLLPAITFIFSRAGCDEAVRQCVASGLVLTTPEEAAEIREYAERQCAEIPPADLNVLGYSEWLQALECGIAAHHAGMLPTFKEVVEVLFSRGLIRAVFATETLALGINMPARTVVIEKLDKWNGETHVALTPGEYTQLTGRAGRRGIDVEGHAVVVWQPGTDPEMVAGLAGTRTYPLNSSFQPSYNMAVNLVAQVGRERGRAMLESSFAQFQADRSVVGLVRKLRAQQEALEGYAKAAYDPRGDFMEYAAMRRRLSDLESAAQRNRRTARRKEAERSLRALRTGDIIRIPSGRHAGYAVVLDPGLDKGPLPVPLVLTVNRQVKRVSANDFPIPVEPTGRLRIPKSFSARSAQARRDLASALRSKLETLPTAPIRHRVRDGAPEDPEIAELRARIREHPCHHSEGREDRARWAERYFRLKKETEELERRIESRSHVIARTFDRVCGVLQELDYLEGDTVTEDGRLLSRIYSELDLLAAESLRRGVWDALGPEELAACVSALVYESRRPDEVFARVPSGPVEEALNAMMRLWGELSDIEHRHRVSFLREPDLGFVWPTYRWARGDQLDHILNEAGMPAGDFVRSTKQLIDLLGQIAQAVPEASGVRTTARQAADKLMRGVVAYTSVG

SEQ ID NO: 8381 - protein, 494 aa, Thermobifida fusca
PRNPAGPRREEDAQPQFKGRKNGPYKDVSPELAAWMRTGWADTERRDLEPIEQAAYTAKRRATVSARFPGERLVIPAGNLKTRSNDTDYPFRAASDYVYLTGDQSEDGCLVFEPREDGGHDVVLYLRPRSSRENGEFWLDAYGELWVGRRNSLAEAATLYGLPTRDVRTLPEVLREAPEAPTRILRGHDSTLEAVVTLRRSSEGTTAEEDKKRDEELAIFLHDTRLVKDDWEIAQLQRAVDSTVRGFEDVVRALPQAQATSERYVEGTFFLRARVEGNDVGYGTIAASGPNATTLHWVRNDGPVRPGDLLLLDAGVETTTLYTADVTRTLPVSGRFTDVQRRVYDLVYAAQEAGIAEVRPGRPFRAYHDTAQRVLAEGLIEWGLLEGPVERVLELGLQRRYTLHGTGHMLGLDVHDCAVARTEAYVDGILQPGMVLTVEPGLYFQPDDLTVPEELRGIGVRIEDDILVTPEGNRNLSAALPRTSADVEAWMAEL

SEQ ID NO: 8382 - protein, 202 aa, Ralstonia metallidurans
EVVLGLGGGSSMDVAKLIAVLLPAAQSLKDMYGVKKVTGTRLPLVQMPTTAGTGSEVTAVSIVTTGETTKMGVVAPQLLADLAILDAELTLGLPRAATAATGIDAMVHAIEAYTSAHLKNPISDMLAVRALELLSQNLMLACDNGHDHGAREAMLLGAMFAGQAFANSPVAAVHALAYPIGGIFHVAHGLSNALVLPHVMKF

SEQ ID NO: 8383 - protein, 289 aa, Ralstonia metallidurans
  unsure (1)..(289): unsure at all Xaa locations
MPLSHRQTLTRYLIEERRRCXPRATGELNALILDVALACKALARVLCRLARXLGRLRXATVSAAPTGGGINVQGEVQKPLDVQSNEMFIRMNEWNGQLAGMASEEMEEPYLIPSSYPRGKYLLVFDPLDGSSNIDVNVSIGSIFSILRAPADVVASGRDVTEADFLQPGAAQVAAGYTIYGPTTQLVLTVGNGVAAFTLDPNLGEFLLTRSDIRVPEQTQEFAINSSNSRFWEPPVKRYVDECLAGKTGPRGKDFNMRWVASMVAEAHRILMRGGVFMYPRDTKDPAKP

SEQ ID NO: 8384 - protein, 221 aa, Ralstonia metallidurans
RRLLVAGNWKMNGSLAGVQALAAAIADGAVARLDRVQLVLFPPFTYLPEAQRRLGASGMAWGAQNVSGHEDGAFTGEVSAQMLREFGCACVLVGHSERRTLFGENDAVVARKFLAVRQAGMTPVLCVGESLPEREQGATEDVVARQLQAVLDLAGASAFADAVVAYEPVWAIGTGKTATPAQAQDVHAFIRGRLAEADPAIAASLHVLYGGSMKRANAREL

SEQ ID NO: 8385 - protein, 394 aa, Ralstonia metallidurans
VDRIQVPEIADFRPVEMIESLVKAANTFEEDQSLIVLESDKASMEVPSSAAGKVVDVKVKVGDKVAKGTLICTVEGGAAAAPAPAPAAAPKPAAAPAPAPAAAPAAATHAGGADIQCEMLVLGAGPGGYSAAFRSADLGMNTVLVERYGTLGGVCLNVGCIPSKALLHNAAVIDEAKALAAHGILFGEAKIDLDGLRHYKESVVGKLTGGLSGMAKARKVQVVRGIGTFLDPHHLEVQETEGDSKATNGKKTVIRFEKAIIAAGSQAVKLPFVPEDPRIFDSTGALELRDIPNKMLVIGGGIIGLEMATVYSTLGARLDVVEMLDGLMQGADRDLVKVWDKVNKHRFDNVMLKTKTVGVEAKPDGIYVKFEGESAPAEPQRYDAVLVSVGRSPN

SEQ ID NO: 8386 - protein, 338 aa, Ralstonia metallidurans
PNQMRWSAPAMPTVPTDFVDGIVTMAGNGGPEALSGCGIHLYLANASMRDRFFYNADGEMLIVPQEGRLLIVTEMGRLAVEPQEIVVIPRGVRFRVELPDGAARGYICENYGAMFKLPDLGVIGSNGLANPRDFLTPVASYEDREGDFELVARFQGNLWRADIGHSPLDVVAWHGNYVPYKYDLRLFNTIGSISYDHPDPSIFLVLQSPSDTPGVDTIDFVIFGPRWLAAEDTFRPPWFHRNIASEFMGLIAGEYDAKAEGFVPGGASLHNCMIGHGPDAETFERASASDTSKPHHITDTMAFMFETPGVIRPTRHAAESALLQHDYYPAWQGLKKHF

SEQ ID NO: 8387 - protein, 284 aa, Ralstonia metallidurans
INGFGRIGRMVFRAAVQDFKNDIEVVAINDLLEPDYLAYMLRYDSVHGRFKGEVVVDGGTLVVNGRKIRLTAVKDPAALAWGDVGVDVVVESTGLFLTHDTCQKHLDAGARKVIQSAPSKDDTPMFVYGVNHTQYAGEKIVSNASCTTNCLAPVAKVLNDSFGIKRGMMTTVHAATATQKTVDGPSNKDWRGGRGILENIIPSSTGAAKAMGRVIPALNNKLTGMALRVPTSDVSVVDLTVELAQETSYEKICAAMKAASQGAMKGVLGYTQDKVVSTDFRGEA

SEQ ID NO: 8388 - protein, 251 aa, Ralstonia metallidurans
  unsure (1)..(251): unsure at all Xaa locations
QLSLSIDHGELRCVIGPNGAGKTTMMDVITGKTGPRNANVTGRVFLGQTIDLMRLTEPRIAQTGIGRKFQKPTVFEQHAVWENLELAMKADKRWWASLRARLTLEGHRRIEETLALTGLEDEAYRPAGLLSHGQKQRLEIGMLLTQQPQLLLLDEPVAGMTDEETMQLAALLNSLRGSCSMMVVEHDMEFVAALAGDAGTVTVLAEGSLLAEGTLDAVKRDERVIESYLGRXRCCRSTQSISSTAAAISCA

SEQ ID NO: 8389 - protein, 694 aa, Ralstonia metallidurans
GSGRPVADHRIAWLIQNARCPGGILAVTFTNKSAKEMQTRLSSMLPINTRGMWIGTFHGLCNRMLRAHFRDAGLPQTFAILDSQDQLSAIKRLLKGLNVDDEKYPPKNLQYFINNAKEQGLRPADVEANDDFNRRFVDLYAAYDEQCQREGVVDFAELLLRCYELLRYNDAIRQHYQHRFRHVLVDEFQDTNVLQYQWLKLLAGYGSGNAAAVFAVGDDDQSIYAFRGANVGNMRDFEQEFRVRHLIKLEQNYRSHGHILDSANHLISHNARRLGKNLRTDAGHGEPVRVFQAGSDGQEASWIVEEIRDQIAQGMSRSEIAILYRSNAQSRVIEHALFSSGIPYRVYGGLRFFERAEVKHALAYLQLIENPRNDAAFGRVVNFPTRGIGAKSLEVLQDAARQYNCSLAEAVAYVPGKAGSSLGAFIRLIEQMRAETSRMTLAQTVEYVTNTSGLMTHYQTEKEGQDRIENLQELVTAAQAFVVEEGYGLEALGRMLPANRDAMPALAQGEQDQQVLDPEQLPVVMTPLVAFLTHASLEAGDNQAQAGQDAVQMMTVHAAKGLEFNVVFITGLEEGLFPHENSAMEADGLEEERRLMYVAITRARARLYLSFAQSRVLHGQMRYHVRSRFFEELPEASLKWITPQGQAYRAYAQVADASHLSAKALGAVTGQACRGRALYRGEPNGGMNTGRTSR

SEQ ID NO: 8390 - protein, 399 aa, Ralstonia metallidurans
  unsure (1)..(399): unsure at all Xaa locations
RXAALIXXHGVPIIGTSPDMIMAAEDRERFQKLVQDLGLRQPPNXYRARXXEALRLAEEIGYPLVVRPSYVLGGRAMEIVHEPRDLERYMREAVKVSNDSPVLLDRFLNDAIECDVDALCDGTRVFIGGVMEHIEQAGVHSGDSACSLPPYSLSQATVDELKRQTAAMAKALNVVGLMNVQFAIQQRNGEDIVYVLEVNPRASRTVPYVSKATGLSLAKIAARCMAGQSLDSQGIGEEVVPPYYSVKEAVFPFNKFPGVDPVLGPEMRSTGEVMGVGKVFGEALFKSQLAAGSRLPEKGTVLITVKDSDKPRAVTVARMLHDLGYPIVATRGTASAIEAAGIPVRVVNKVKDGRPHIVDMIKNGELALVFTTVDETRTAIADSRSIRIAALAARVPYYT

SEQ ID NO: 8391 - protein, 207 aa, Ralstonia metallidurans
ITLTQFIIQSQRAHPAATGGVSGLLNVIATACKVIATAASRGALAGVLGSAEHENVQGEVQKKLDVISNAILVHATERGGHLVALASEEMDTIYPIPAAFPRGKYLLVFDPLDGSSNIDANISVGAIFSVLRSPDPEVPPTLEHFLQAGAGQVCAGYALYGPATMLVLTTGQGTHGFTLDRDVGEFILTHPMLRIPAATQEFAINTS

SEQ ID NO: 8392 - protein, 242 aa, Ralstonia metallidurans
RIAYVTGGMGGIGTAICQRLARDGYKVVAGCGPNSPRREKWLEQQRALGFEFVASEGNVADWDSTKAAFDKVKSEVGEVDVLINNAGITRDVVFRKMTRADWDAVIDTNLTSLFNVTKQVIDGMADRGWGRIVNISSVNGQKGQFGQTNYSTAKAGLHGFTMALAQEVATKGVTVNTVSPGYIATDMVKSIRQDVLDKIVGTIPVKRLGTPEEIASICAWLSSDESGFSTGADFSLNGGLHM

SEQ ID NO: 8393 - protein, 192 aa, Ralstonia metallidurans
RFFDPTEGHILLDGQPIDRFALADLRRQIAFVSQDVVLFNDTVAANVAYGVHPREKIDMARVERALAAAYLTDVVKGLPEGLETNIGDNGMKLSGGQRQRLAIARAIYKDAPILILDEATSALDSESERQVQAALESLMVGRTTLVIAHRLSTIENADRIVVLEQGRVAEQGSHAELIGKNGLYAGLHRIQF

SEQ ID NO: 8394 - protein, 247 aa, Ralstonia metallidurans
MSGRVAVVTGSTKGMGLEMARALGASGARVVVSGRNAAISEKVAAALKSEGIDATGLACDIADTASVRAFADRVLETFGRVDALVLNAAGSGVAGSILEQGPEDFDAVMAGNVRGNLVLVNALAPQMISRNDGSIIFMSSIAARRGSALLPLYSISKGAVDLAMRSLAHTLGPHNINVNSINPGPVRTDFSRDALWGNPDREKALSASIPMRRIAEARDVAGLAVLLASPAGRYISGQTIGLDGGAT

SEQ ID NO: 8395 - protein, 491 aa, Ralstonia metallidurans
YWATVPKFHIVFYAILKLGAVYVPVNPLFKEHELAYELNDAGATMVIALDTLVPMLMTVKPQTSVETVFSTSAGEFLPAHPTLPVPAGLDAAPVAHAGTIDLMAAIQTCTGNVRDVSVDLDALAALNYTGGTTGMPKGCMHTQRDMIYTAAATLAVTSGREDRDATLPSSDVMLNFLPMFWIAGENLGLIYPIFSGATLVLLARWDPLAVMSAVDRYRVNRTFMVVDNLVELLQHPELARHDMRSLQHTRVASFIRKLTVDLRRQWHALTGSVVAEGAWGMTETHTSDTFTTGMQTDDMDLHGRPVFVGLPVPGTRIKICDFETGVTLPVGEEGEIVVTTPSLLKGYWGRPDANAEVFRDGWFRTGDIGAYDDAGYLHFLGRRKEMIKVRGMSVFPSELEVLLGRHAAVLGSAVVARPDRDKGQVPVAFIRLRPGHDDVSAEALTAWCREHMATYKVPEIRVVDELPMTATGKVKKGELQKQFEQDEQEVG

SEQ ID NO: 8396 - protein, 264 aa, Ralstonia metallidurans
LKVEPIPAFQDNYIWAIHDGHSAAVVDPGEAAPVEQFLAQRGLALGAIVITHHHGDHQGGVSDLLARHPSGPNGEPLPVIGPQGERIGHRTQAVREGDTVTLRHPAVTFRVLDVPGHTAGHVAYVGDLPGAGPVVFCGDTLFASGCGRLFEGTPAQMLASLDKLAALPGDTRVYCAHEYTRSNVRFAQAVEPANPDLAAWAARVDILREAGTPTVPTTVAHERAVNPFLRSRESTVRQAVRAQGGDVSGDAAAFGALRGWKDGF

SEQ ID NO: 8397 - protein, 221 aa, Ralstonia metallidurans
TNGTQADWICLLCNTSDGPVHKNKSLIIVPLRENGRLVRGVEVQKIRKMGMWCSDTAQIFFDDVRVPARNRIGDEGMGFIYQMKQFQEERLNGAARRLACSALIEETADYLRQRVAFGKPLLDNQYIQFKLAELKTELESLRALVHVATRAYIQGEDVVELASMAKLKAGRLSREIADWCIQFQGGMGYTWDNHANRAYRDFRLGSIGGGADEVMLQVIAK

SEQ ID NO: 8398 - protein, 658 aa, Ralstonia metallidurans
REHSMSASCRPFHTVLVANRGEIAIRIMRTARRLGLGTVAVYSEADRHSPHVASADRAVCIGAAAPRESYLNIAAIIAAARNAGADAVHPGYGFLAENAEFADAVTDAGLVFVGPPASAIRAMGNKAEAKRLMLAADMPCVPGYQGEAQDDKTLLAEAGRIGFPLMVKAAAGGGGRGMRLVPDAAALPAALASARSEAATAFGNDELILERAVIQPRHVEIQVFADAHGNVIHLGERDCSVQRRHQKVIEEAPSPAVSPALRGRMGEAAVRAARAIGYVGAGTMEFLLDADANFYFMEMNTRLQVEHAVTEAITGFDLVAWQLQVAAGETLPATQDQVTFDGHAIEVRLTAEDVPAGFLPQGGPVLRWRAPESGHDVRVDHALETGGTIPTHYDSMIAKLVAHGRTREEARQKLLRAVQDCVLLGVPSNQPFLASCLASAAFAGNDVHTGFVDAHMQASLQPTEPSSHVVAIAALTASGQLSRSEPVALLRMTTSVRLHAEGRPWDSAVQATEEGWRVTVSARGETGAQPVHVRMLRDHAADGAAWIECDGMARPVLHADDDLAIHLFADGRAWRFTRHDPRRRNTEGESSGALTAPLTARIVAVNVAEGDRVEAGQSLVVLEAMKMEHTLVAPFAGVVSELSARAGGQASAGTLLVR

SEQ ID NO: 8399 - protein, 671 aa, Ralstonia metallidurans
NEMLSSIEGLSTPLVRQIDRFGRGLAVAILLLSAVVFVAGILWRGHSAADMFMMAVALAASAIPEGLPAIMTVTLALGVQRMARRHAIVRRLPAVETLGSVTVICSDKTGTLTRNEMTVQRMVCAGHVFDVGGVGYAPVGDFSIDGHVVDPMHCAPLAMALRTGVLCNDANMRNDDGMWHVEGDPTEGALLVAGAKAGLEHQNPESSWHRLDSIPFESEHRFMATYHHDADHAPWILVKGAPERILDMCARQWNLDGERPLDVDYWRRMATDTAAQGLRLLALACKRAAPAGDKLAFSDVETGYTMLALVGIIDPPREEAIRAVNECHHAGIRVKMITGDHVETARAIGAQLAIGVGKPALTGSEVALMDDAALRRVAMEVDVFARASPEHKLRLVRALQDGGQVVSMTGDGVNDAPALKRADVGVAMGLKGTEAAKEASDVVLADDNFASIAHAVREGRAVYDNLKKFILFMLPTNGGEALIVIAAILFDLPLPVTPAQVLWINMVTSSTLGLALAFEPAEDGIMAKPPRPVGETLLSGFFVWRVTMVSILMMAGALSLFLWELSDGTSLETARTMAVNAVVAAEMFYLLNSRHTLKTVLNREGLFGNPYVLLAIAACVPLQLAYTHLPLMQAVFDSTDLSALEWCKVIGAGLLVFCVAELEKILIRRKP

SEQ ID NO: 8400 - protein, 236 aa, Ralstonia metallidurans
ASKKKTGDKVMPTQQLRGVFTPVVTPFHEDLSINLPAFVAHCKRLIADGAGIAISGTNSEACSETFEERIALVDAAIDAGIPGERVLVGTGCCAIDDAVVLTRHAIERGCAGVLVLPPFFFKNVSEDGVFAYYSELIARVNDPALRIVLYHIPAMSGVPISLSLIERLVQAFPTHIVGIKDSSGNWDNLVAMLERFPSLSIFPASELLMLRSLSLGAAGCISATNNINARAIAQAF

SEQ ID NO: 8401 - protein, 414 aa, Ralstonia metallidurans
RRIVMAQRFDAIIIGTGQAGPALAARLAGAGMKLAVIERGRFGGTCVNTGCIPTKALIASAYAAQLARRAAEYGVTIGGPVAVDMRQVKARKDEISGRSSQGVEQWMRGLDNVTVHQGHARFEHARGVRVNGELLEADQIFINVGGRALIPPMPGLDQVSYLTNSSMMEVDFLPEHLIIVGGSYIGLEFGQMYRRFGARVTIVEKGPRLIQREDEDVSQAVREILEREGIEVRLDANCLSARKDGDHIAVGLDCAGGAPEVHGSHLLMAVGRVPNTDDLGLDKAGIETDARGYIKVDDQLRTSVPGIWALGDCNGRGAFTHTSYNDYEIVAANLLDNDPRAVTDRIPAYALFTDPPLGRIGMTEREARQSGRKVLVGTRPMSRVGRAVEKGESQGFMKILVDADTRLLLGAAIL

SEQ ID NO: 8402 - protein, 299 aa, Ralstonia metallidurans
IGARPVDQHIKGLQAMGAEITIEHGFIHARANRLKGARVVTDMITVTGTENLLMAATLAEGETVLENAAREPEVTDLAELLVKMGAKIEGIGTDRLVVQGVDRLHGAEHKVVADRIEAGTFLCAAAATLGDIVLRGIPPLILDAVLIKLREAGATVETGDDWIRLAMPQRAQAVSFRTSEYPAFPTDMQAQFMALNAVAEGTARITETIFENRFMHVQELNRLGANITAEGNTAVVTGVPRLSGASVMATDLRASASLVIAGLVADGETVIDRIYHLDRGYDRMENKLSAVGAKILRIS

SEQ ID NO: 8403 - protein, 406 aa, Ralstonia metallidurans
DEAIDRAAADILADVRRRGDEAVLEYTRRFDRMEASSMSALALSQSELEAALEDLEPKRRAALEAAAARVRAYHEKQKIECGSHSWEYTEADGTMLGQKVTPLDRVGLYVPGGKAAYPSSVLMNAIPARVAGVKEVIMVVPTPGGVRNELVLAAAQIAGVDRVYTIGGAQAVGALAYGTATLPQVDKIVGPGNAYVAAAKRRVFGTVGIDMIAGPSEILVICDGTTDPDWVAMDLFSQAEHDELAQSILLCPDAEYLNRVLESIQRQLPTMPRREVIAASLSGRGALVKVRDMEEACEIANAIAPEHLEISAENPRQWSEKIRHAGAIFLGRYTSESLGDYCAGPNHVLPTSRTARFSSPLGVYDFQKRSSLIEVSENGAQMLGQIAAELAYGEGLQAHARSAEYR

SEQ ID NO: 8404 - protein, 477 aa, Ralstonia metallidurans
RNYVDARFEEAANLFPNLSPVDGSIVGHVCEADASQVDRAVQAARAAMEGPWGNTSAAERARVLHAVADGIERRFDEFVAAEVADTGRTEQQARALDIRRGVLNFRTFADLASQAGGDYFDMRTAEGDVFSYTVRKPHGVVGIISPWNLPMLLMTWKVAPALACGNAVVVKPSEETPGSATLLAEVMHEAGVPAGVFNLVHGFGGGSAGEFLSRHPGIDALTFTGESRTGSTIMKAVADGVKEISFELGGKNAAVVFADCDFDKAVAGVMRSSFTNTGQVCLCSERVYVERPIFERFVAAMKARAEALRIGYPTVEGVEMGSLISRNHRDKVLSYYALAREEGATVVTGGGVPHFGDARDNGAYVQPTIWTGLPDSARCIQEEIFGPVCHIAPFDTDAEVVKRVNDSRYGLAASVWTRDLARAHRVTRQFDVGIVWVNTWFLRDLRTPFGGTRLSGIGREGGRHSLDFYSSLTTICV

SEQ ID NO: 8405 - protein, 260 aa, Ralstonia metallidurans
LASGDKTMCFGLSEPDAGSDVFGMRTRATRDGDHWVLNGTKQWITNAPYADYAMVFAVTDEEKARAHKGGITGFFLPTRTPGFSVPSVIPTMGHLGADIGIISLENVRVPDTHRLGPVDRGLSVALDGVNAGRLSMAASCLGLAEWALEQAVAYAKVRKTFGQPIGDHQAVQIMLAECAMDIYATKSMVRHCAWLVDNDLPATKEVSIIKASSTEMAGRVFDRAMQIHGGMGLTNELRLEAGYRFVRTMRIPDGTSEIQR

SEQ ID NO: 8406 - protein, 327 aa, Ralstonia metallidurans
MAKAPMRVAVTGAAGQIGYSLLFRIANGDMLGKDQPVILQLLDLPQAQAAVKGVVMELEDCAFPLLAGVVITDDPKVAFKDADVALLVGARPRSKGMERKDLLEANAQIFTVQGKALDEVASRDVKVLVVGNPANTNAYIAMKSAPNLKRENFTAMLRLDHNRALSQIAAKTGKPVSSIEKMFVWGNHSPTMYADYRYATVDGKSVKDMINDPVWNNDVFLPTVGKRGAAIIEARGLSSAASAANAAIDHVHDWVLGSNGKVVTMGIPSNGEYGIPNDVMFGYPVTTANGKYEIVKGLEIDAYSQEKINITLKELEEERAGVQHLLG

SEQ ID NO: 8407 - protein, 198 aa, Ralstonia metallidurans
DHNIQVVQSTTPAQIFHLLRRQMIRLFRKPLVIMTPKSLLRSRMAVSPLSDLAKGHFETVIPDHEELNASKVKRVIMCSGKVYYDLVNTRRERGATDTAIIRMEQLYPFPHKAVAAELKKYPGATEILWCQDEPQNQGAWFFVQHYIMENMTEGQKLGYAGRPASASPAVGYYAKHNEQQKALLDAAFSKLKGFVLTK

SEQ ID NO: 8408 - protein, 419 aa, Ralstonia metallidurans
MAIVDVKVPQLSESVAEATMLNWKKKPGEAVAQDEILIEIETDKVVLEVPAPSAGVLSQIIKNDGDTVVADEVIAKIDTAATAGAVAPAAAAPAPAAAAPAPAAAAPAAAASAGAIAMPSAAKLMAEGGLSASQVAGTGKDGRITKGDVLAAGSAPAPAAKAAPAPAAAKPALPQVSAQVDFAALGDRPEERVPMSRLRARIAERLIQSQSTNAILTTFNEVNMKPVMDLRAKYKDRFEKEHGVKLGFMSFFVKAAVHALKKYPVINASVDGNDIVYHGYFDIGIAVGSPRGLVVPILRNADQMSLADIEKKIAEFGTKARDGKLSLEELTGGTFSISNGGTFGSMLSTPIINPPQSAILGVHATKDRAVVEDGQIVIRPMNYLAMSYDHRIIDGREAVLGLVAMKEALEDPARLLLDL

SEQ ID NO: 8409 - protein, 263 aa, Ralstonia metallidurans
MSKQFDVLVIGAGPGGYIAAIRAAQLGLNVACLEGNAYDDPKGEARLGGTCLNVGCIPSKALLASSEEFENASHHLADHGITVGDVKVDVAKMLKRKDDIVSKMTKGIEFLFRKNKVTLFKGYGKFTGKAAEGFQVEVNGETLTAKQVIIATGSKARHLPGVAVDNNLISDNEGALKFGTVPKKLGVIGAGVIGLELGSVWRRLGAEVTVLEALPAFLGAADEGVAKEAQKLLTKQGLQFHLSVKVDEVKTGKDNVTTTTPDR

SEQ ID NO: 8410 - protein, 508 aa, Ralstonia metallidurans
GEMIVHAIDRYPDRVAFIDGDARMTYRALGDRISQAISAFRALGLVRGDCVVQLSGNRPEVFIVMAAAYLMGLRSVTLHAMGGVDDHAYIVDDAEARVFMADPVYAERALALRERCAGVAHWFGHADVPGLPSFWDQATSFAPARLVPEALTTDVIRLAYTGGTTGKPKGVMLANRCVWMQAVLLLAARSLPDDLRLLCPTPISHGAGAMIVPTLWRGGTIILQHGFDAERFIDAVETHRASMTFLVPTMIYTLLDHPRARTADFSSLQTLSYGASPMAPARIREAIDRFGPILAQSYGQTECPSNILQLTQEDHMRTDVDTSTSAGMPYPGVTVALLDDNDEPVAPGSVGELCVRSPLVMDGYWKQPQLTALALRNGWLHTGDMAYRDQFGYYYLVDRKKDMIISGGFNVYPKEVEDVLTGHPARADCCGDGVPDAKWGEAVKAVVVPRPGAQLDVEALRALVRHAKGAVNTPKTIDFVDALPLTALGKPDKKQLRERYWGGMGRAV

SEQ ID NO: 8411 - protein, 261 aa, Ralstonia metallidurans
PQPASRSLKGRVAIVTGAGSRADGIGNGRAAAILLARDGARVALIDSVREWAEVTHRMIVEEGGEAEVIACDVSRDEDCRSAVARAVELWGRVDILVNNVGIGGPQGTAEDVDLEAWDQALRINVTSMMLMARHAIPHMRAQGKGAIVNVASVAGLIGGHPSLLYPTSKGAVVNMTRAMAAHHGEQGIRVNCVAPGMVYTPMVYAKGMSPEKREARRNRSFLRTEGSGWDVGQAIRYLVSDESGWVTGAVLPVDAGATAGR

SEQ ID NO: 8412 - protein, 308 aa, Ralstonia metallidurans
CTVVLKPSEVAPLNAFVLAEVIEAAGLPPGVFNLVTGYGPVVGEVLASHPEVDMVSFTGSTRAGKRVSELAAQSVKRVALELGGKSASVILDDADLPTAVKGTIGACYLNSGQTCSAHTRMLVPRSRYEEVKAIAAKVVEGFTVGDPLADTTKLGPLISAVQKERVTGYIRRGLDEGAELVAGGPDTPAGLDRGFFVKPTVLGNVDPKATVAQEEIFGPVLSVICYDTEDEAIRIANDSIYGLGGGVWSGDESRAIRVARRIRTGQVDINGGPFNMNAPFGGFKQSGNGREGGKFGLEEFLEYKSLQL

SEQ ID NO: 8413 - protein, 138 aa, Ralstonia metallidurans
IDIRKILKLLPHRYPILLVDRVLEFEPQKRIKTLKNVTINEPYFMGHFPDQPVMPGVMILEALAQSAGLLTFGADMERKEGALYYFVGIDGARFKRVVYPGDQLHLNVTVERYIRGIWKFKASATVDGEVACEAELMC

SEQ ID NO: 8414 - protein, 267 aa, Ralstonia metallidurans
MSIPSFGVGTFRLTGQVVVDSVRNALDVGYRAIDTAQIYGNEADVGQAIAESGVERGELFVTTKIWTANYAADKLVPSLRESLDKLRTDYVDLTLIHWPAPGNGVALSEYMAALAEAKALGLTRQIGVSNFNIELTRQAIEAVGKGEIATNQIELSPYLQSRKLTAFLKEQGIAVTSYMTLAYGKVLKDPVLGQIAAKHHATVAQVALAWALQLGYAVIPSSTKRENLASNLLARDLKLDADDMALIASLERNGREVSPEGLAPVWD

SEQ ID NO: 8415 - protein, 550 aa, Ralstonia metallidurans
MYQYDQYDQRIVQERVAQFRDQVRRRLSDELTEEEFLPLRLQNGLYMQRHAYMLRVAIPYGLLASKQMRMLAHIARTYDRDYGHFSTRQNIQYNWMDLERVPDVLDDLASVEMHGIQTSGNCVRNITTDQFAGVAPDETVDPRVLAELLRQWSTFQPEFAFLPRKFKIAISSSADDRAVVQMHDIGIYAYKNAAGETRLRILAGGGLGRTPILGTIIKEDLPWQHMLTYVESAIRVYNRYGRRDNKYKARIKILVKAIGAEKFARRSGRRVEVQQGRPGHATQAEFDRVAQYFQPPAYEKLPDTDASFEKHLLENKAFARWVNRNVHAHKVPGYASVTLSTKPGPVSPPGDATSAQMDTVADFADRYGYGELRVAHEQNLVLPDVKKRDLFALWEDAKKAGLATANIGLLTDIIACPGGDFCSLANAKSIPIALAIQERFDNLDYVYDLGDISLNISGCINACGHHHVGNIGVLGVDKDGAEWYQVTIGGAQGNDTALGKVIGPSFSAHEMPDVVSRIIETFVANRVGDERFIETVGRIGIAPFKERVYA

SEQ ID NO: 8416 - protein, 415 aa, Ralstonia metallidurans
  unsure (1)..(415): unsure at all Xaa locations
KVLVGGVGMIPFSKPGASPSYTDMGAEAVRRALADAGIGYEQVQQAYVGYVYGDSTCGQTALYEVGLTGIPVVNVNNNCSTGSTALYLARQAVALGDADCVLALGFEQMQAGALKSHWDDRPKTRARFAHVLQDLTADVADLPQALRTFGGAGREHMQKYGTKMETFAAIRAKASRHAANNPLALFRNVVTTEEVMNDKVMWPGVMTRLMACPPTCGAAAALIVSEKFAKKHGLRTDVQILAQAMATDPVESFDPPSMISYAGFHMAQAAANKVYEKAGVNPRTSESRSCMTASPHNELLSYEALGLCGIGEGEKFVMDGDNTYGGRVVTNSSGGLLSKGHPLGATGLAQCYELTHQLRGTADKRQVEGAKLALQHNIGLGGACVVTLYGKAXPTVTNAAASCRRPSKSXNPTAG

SEQ ID NO: 8417 - protein, 269 aa, Ralstonia metallidurans
KLEGKVAIVTGAGRGIGRCIALKFASEGAGVVVNDLDAAPANDVVEEIRRSGGKALPLPANVTEPDFGERLVKATLEAFGGIDIIVNNAGYTWDNVIQKMSDEQWDAVIDCHLKAPFNLLRAAQPYFREVSKAEAAEGREVFRKVVNISSISGTQGNAGQVNYSAAKAGVMGMTKTLAKEWGRMKVNVNCVAFGFISTRLTEATTEEKTVSIEGRDIKVGVNPERIAQASKEMALGRPGTAEEAAGSVYMFCIPESNYVTGQTIICGGG

SEQ ID NO: 8418 - protein, 523 aa, Ralstonia metallidurans
MMQQYQSNSYLFGGNAPYVEELYEAYLQNPSSVPDNWRAYFDAMQNVPAADGSNARDIPHAPIVASFAERAKQGPIKTIVASADSDMGRKRVAATQLIAAYRNIGSHWADLDPLKRQERPPLPDLDPAFYGFSEADLDIVFNASNTYFGKESMSLRELLNNLRETYCGTIGAEFMYVSDQAQKRWWQERLETTRSKPVFTLEKKKHILDRLTAAEGLERFLHTKYVGQKRFSLEGGESFIAAMDELIQHAGTKGVQEIVIGMAHRGRLNVLVNTLGKMPADLFAEFEGKHVDDLPAGDVKYHKGFSSDVSTEGGPVHLSLAFNPSHLEIVNPVVEGSSKARQERRGDVGHKEVLPVQVHGDAAFAGQGVVMETLNLAQTRGYGTGGTMHLVINNQIGFTTSDPSDARSTLYCTDVVKMIEAPVLHVNGDDPEAALYAMQMADDIRMEFTHALLVDLICLRKLGHKEPDTPAMTQTMMYKKIGTIPGTRKLYADKLVAHRLPQTTPTRAAQDYEPHGRGTTGDP

SEQ ID NO: 8419 - protein, 233 aa, Ralstonia metallidurans
RDDGVIRVFTDIPGVPADTDLVVRAARAMQAASGTVFGVDIAIDKILPMGGGIGGGSSDAATTLLALNRLWGVNLPREELMRIGLSLGADVPVFVFGQNAFAEGVGEELTPVALPDSWFVVIHPRQHVPTAAIFSDERLTRNSPISIVADFAACTNKFAFGRNDLETIATAKFGEVARALEWLKNYSPHARMTGSGACVFARFEDEQTAQRVMERLPSEWDGRCVKSLSHHPL

SEQ ID NO: 8420 - protein, 309 aa, Ralstonia metallidurans
LMVFTGNANPKLAEAVVQHLGIPLGKALVGRFSDGEVQVEIQENVRGKHVIVLQSTCAPTNDNLMELMVMVDALKRASARSITAAMPYFGYARQDRRPRSARVAISAKIVANMLEVAGVERVLTMDLHADQIQGFFDIPVDNIYASPVLLGDLREKNYGNLLVVSPDVGGVVRARALAKQLDCDLAIIDKRRPKANVSEVMNIIGEVAGRNCVIMDDMIDTGGTLCKAAQVLKERGAQKVFAYCTHPVLSGGAVARIAASALDEVVVCDTIPLSDEARQTGKIRQVTTAPLLAETFTRIVRGDSIMSLF

SEQ ID NO: 8421 - protein, 327 aa, Ralstonia metallidurans
TNATLPLHELARESRMGAHGSETDTREIRCIDLSDFDTRKPEITDQLWRAATDIGFFQLRHHGIDLPAIRQAFAMAEQFFALPETVKARYPLQKANNAGWESRAQVRPSTGTPDQKESYQITRPHMAPLWPSETELPGFRQTMLEFEAQCWNVGMKVLSCFADRLGFDTDFFSRAHDPARAGLPEHATACCITTRFHPRRRTSLDLWRAGAHTDFDCLTLLFQREGQGGLQVCPGKEMDAQAWTPIAPIEDVVTCNIGDMLMRWSDDHLPSNFHRVRNPAPGEYMGPRYSLAFFCQANRDAVIEGPSKRYPAITAGDFLRQRVAANF

SEQ ID NO: 8422 - protein, 227 aa, Ralstonia metallidurans
MARTHILGFPRIGARRELKFAQEAFWRGETPEAALRETGTTLRRRHWQLQADAGLATVAAGDFAWYDQMLGLTALLGALPKRFGFDAASLTLAQYYELARGNAAQPAMEMTKWFDTNYHYLVPELDADSTFDGGPTWFLDEVDEALALGLATRPVLIGPVTYLYLSKSHVPGFDRLTLLPKVVQAYRRILAQLRERGIEWVQIDEPVLCLDIDAEWLDAIDRAYVDL

SEQ ID NO: 8423 - protein, 657 aa, Ralstonia metallidurans
ETLTTSARRPAQPALPDPLDAGIAHVVESLLAQQQSDGHWVYELEADATIPAEYILMVHYLGETPDLVLEGKIANYLRRIQNADGGWPLFHAGASDISASVKGYFALKMAGDNPEAEHMRRARAAIHAMGGAEASNVFTRTLLALYGVMPWQAVPMMPVEIMLLPEWFPFHLSKVSYWARTVIVPLLVLNSLRPQARNPRKIGIDELFVRPCQATRLPRRAPHQSPLWVGVFRTLDAVVRMAEPLFPRGLRQRAIERAREFTVERLNGEDGLGAIFPAMVNSVLMFDVLGVPESDPNRAIARRSIDKLLVIKDDEAYCQPCLSPVWDTSLAAHALLEVGEPRTIAAAARGLDWLLPLQELELRGDWTVRRPNVRPGGWAFQYANPHYPDVDDTAVVAAAMDRVDKGDRSNRYDEAVSRACEWIVGMQSSNGGWGAFEPENTHLYLNNIPFADHGALLDPPTADVSARCLAMLCQLGQMPANSEPAARALRYLLDEQEADGSWFGRWGTNYIYGTWSALCGLNAAGIGTDAPEMTRAAQWLLSIQNEDGGWGESGDSYKLEYRGYEKAPSTASQTAWAMLGLMAAGAGDHPALVRGVEYLLRTQASHGFWDEPYFTAVGFPRVFYLRYHGYSRFFPLWALARFRNLLRDGNRAISWGL

SEQ ID NO: 8424 - protein, 397 aa, Ralstonia metallidurans
MSLFSAVEMAPRDPILGLNEAFNADTRASKVNLGVGVYFTDEGKIPLLRAVQEAEKARLTTATPRGYLPIEGIAAYDQAVQTLLFGKESPLITEGRVVTAQALGGTGALKIGADFLKRLYPNASVAISDPSWENHRALFEAAGFPVVNYAYYDAASHGLNFAGMVESLKSYPANTIVVLHACCHNPTGVDLDEAQWKQVVELVKERNLIPFLDMAYQGFAEGIEPDGAAVRLFAESGLPFFVSSSFSKSFSLYGERVGALSIVTTGKEEAQRVMSQIKRVIRTNYSNPPTHGGTVVATVLNSPELRAMWEQELAEMRDRIKLMRHALVDKLAAKGVPGDFSFVKAQRGMFSYSGLTSAQVDRLRTEHGIYAVGTGRICVAALNSRNIDAVVNAIAAV

SEQ ID NO: 8425 - protein, 374 aa, Ralstonia metallidurans
KPKKSVALSGIAAGNTALCTVGRSGNDLHYRGYDILDIADTCEFEEIAHLLVHGKLPTKSELAAYKVKLKALRGLPANVKAALEWVPASAHPMDVMRTGVSVLGTVLPEKDDHNTPGARDIADRLMASLGSMLLYWYHYSHNGRRIEVETDDDSIAAHFLHLLHGEAPSKLWERAMQTSLILYAEHEFNASTFACRVVAGTGSDMYSAICGGIGALRGPKHGGANEVAFEIQKRYDTPDEAEADIRRRVENKEVVIGFGHPVYTISDPRNVVIKEVARKLSKDAGSMKMFNIAERLETVMADAKKMFPNLDWFSAVSYHMMGVPTAMFTPLFVIARTSGWAAHVIEQRVDNKIIRPTANYTGPENLKFVPIEKR

SEQ ID NO: 8426 - protein, 487 aa, Ralstonia metallidurans
KLPYTSRVLAENLVRRCDPATLTASLKQLIERKRELDFPWFPARVVCHDILGQTALVDLAGLRDAIADQGGDPAKVNPVVPVQLIVDHSLAVECGGFDPDAFTKNRAIEDRRNEDRFDFINWTKKAFRNVDVIPPGNGIMHQINLEKMSPVIHADHGVAYPDTCVGTDSHTPHVDALGVIAIGVGGLEAENVMLGRASWMRLPDIVGVELTGRRQPGITATDIVLALTEFLRKEKVVGAYLEFRGEGASSLTLGDRATISNMAPEYGATAAMFFIDNQTTEYLRLTGRDEAQVQLVETYAKTAGLWADALTKAEYERVLHFDLSTVVRNMAGPSNPHKRLPTSDLAARGIAGKWEEVPGQMPDGAVIIAAITSCTNTSNPRNVIAAALLARNANARGLTRKPWVKSSLAPGSKAVELYLEEANLLPDLEKLGFGIVAFACTTCNGMSGALDPKIQQEIIDRDLYSTAVLSGNRNFDGRIHPYAKQAF

SEQ ID NO: 8427 - protein, 290 aa, Ralstonia metallidurans
AVDHVQFKIRRGEIFGFLGSNGCGKSTTMKMLTGLLPASDGRAWLFGQEVDPRDIDTRRRVGYMSQAFSLYTELTVRQNLVLHAQLFHVPREDIEVRVEEMAQRFGLQDVMESLPDGLPLGMRQRLSLAVAMVHKPELLILDEPTSGVDPVARDNFWRLLVALSREDHVTIFISTHFMNEAARCDRISLMHAGKVLVSDPPEKIVSDCGRGYAGSRVYRLPRGSRRRHAGSLGRRGGPGVPGRGRSRSRGKKQASVFSLGRMYSYLWRESLELQRDPVRLTLALLGSVIL

SEQ ID NO: 8428 - protein, 241 aa, Ralstonia metallidurans
VTLRYGKTVALDDISLEFPAGCMIGVIGPDGVGKSSLLSLVAGARAVQEGTVTALGGDMSRKDHRDAVCPRIAYMPQGLGKNLYPTLSVEENLQFFARLFGHGAAERRHRIDDLTRSTGLQPFLDRPAGKLSGGMKQKLGLCCALIHDPDLLILDEPTTGVDPLARAQFWDLIARIRQDRPGMSVIVATAYMDEAQRFDWLVAMDSGKILDTGTPAELLARTSAADLEGAFIGLLPEEKKR

SEQ ID NO: 8429 - protein, 583 aa, Ralstonia metallidurans
RLWRFARPYRWELLGGFVLLLLGTAATLVPPYLTMPLMDKVLIPYQNGVPIDIGLVKLYLAGLLGAALVAWVLGWARTYLLARVSERISADLRTTTYEHLLKLSLEYFGGKRTGDLMARIGSESDRISVFLSLHLLDFATDVLMIAMTSIILVSINPWLALVTLVPLPFIAWMIHLVRDRLRHGFEKIDRIWSEITNVLADTIPGIRVVKAFAQEKREVTRFREANKHNLAINDRVNAVWSLFTPTVTFLTEVGLLVVWIFGIWQVSHDAITVGVLVAFLTYISRFYTRLDSMSRIVSVTQKAAAGAKRIFDILDHVSSVPEPQKPVHIDNVQGAIELRDLGFRYGNRAVIRGLNLSIQPGEMIGLVGHSGSGKSTLVNLICRFYDVSEGAIRVDGVDIRSLPVSEFRRHIGLVLQEPFLFFGTIADNIAYGKPDATREEIIAAARAAHAHEFILRLPHGYDSLVGERGQALSGGERQRISIARALLINPRILILDEATSSVDTTTEKEIQKALDNLVQGRTTIAIAHRLSTLRKADRLVVMDRGQIVEVGNHDELMAREGAYYKLYQAQARNVDTDADTISD

SEQ ID NO: 8430 - protein, 596 aa, Ralstonia metallidurans
PIKSLLIANRSEIAIRVMRAAAEMSIRTVAIYSKEDRLALHRFKADESYLVGDGKKPLAAYLDIEDVLRIARQAKVDAIHPGYGFLSENPDFAQAVIDAGIRWIGPSPEVMRMLGNKVAARNAAIAAGVPVMPATDPLPLDLAECKRLAAGIGYPLMLKASWGGGGRGMRVLESEQDLEPSLAAARREALAAFGNDEVYLEKLVRNARHVEVQILGDTHGNLVHLHERDCTVQRRNQKVIERAPAPYMDAAGRASLCDAALRLMGAVGYSHAGTVEFLMDADTNKFYFIEVNPRIQVEHTVTEMITGIDIVKAQIRVTEGGRIGMTEDTLDENGDITTRAAGVPPQAQIPLNGHALQCRITSEDPENGFLPDYGRLTAYRSAAGFGVRLDAGTAYGGAVITPYYDSLLVKVTTWAPTAAESIRRMDRALREFRIRGVSSNLQFLENVINHPAFGSGDVTTRFIDLTPELLAFTKRRDTATKLLSYLGDVSINGHQEMTGRAVPQLPLPRPVLPVVDTTRPLPLGTRDRLRELGAEKFASWMLDQKQVLLTDTTMRDAHQSLFATRMRTADMLPIAPFYASELSQLFSMECWGGATF

SEQ ID NO: 8431 - protein, 161 aa, Ralstonia metallidurans
DFYIAAALAPAAYIFDVLDGRIARWRHAHSALGRELDSLSDIISFGVGPATLAFAAGMRGGWDLAALIYFVCCGVSRLARFNVTAESMAEGTGKVKYFEGTPIPTSVVLTGVLAWCASQGRIGDALVGGAWEIGPGTLHPMALLFVLSGSLMISKTLRIPK

SEQ ID NO: 8432 - protein, 267 aa, Ralstonia metallidurans
KVALVTGSGRGIGHAIAQRLAREGARLVINDLDAEPAHATVEALRKMGVEAVACVGNVTAPDFADRFIGTAMSEFKGIDIIVNNAGFTWDDVVQKMSDEQWHAILDCHMTAPFRILRAAYPHIKALHAADKEAGREVYRKIVNISSTSALNGNAGQINYSGAKAGVIGMTRAIAREWGRFNVNVNAVAFGLIHTRMTSADANAGATVNIEGREIRVGLNPEMLKSHAQRNPLGRGGTPEEAAGGVYLFCSPDSNYITGQTIAVAGNL

SEQ ID NO: 8433 - protein, 479 aa, Ralstonia metallidurans
  unsure (1)..(479): unsure at all Xaa locations
RIAQRIMQTGYSLRDSAVQAVDALWHVIVYAVSSLALFAEADWRLTIPLLIWIVGYIAALAWFTPRVKQRSVVATDARSRLMGRIVDGYTNITTLKLFAHSQHEETYARDAMADQTDKVRQAGRMVSAMDVTVTTLNGLLIAGTTGIALWLWNQGLVTTGAIALSTGLVIRINNMSGWIMWVVNGIFENVGQVQDGMKTIAVPRRVLDRPDAQPLDIRQGEVRFDHVGFHYGKGSGVIDNVNLVVRPGEKIGLVGPSGAGKSTLVNLLLRLYDVETGHILIDGQDIAGVTQESLRAQIGMVTQDTSLLHRSIRDNLRYGKPDSTEAELHEALRQARADDFMDLLVDSHGNHGLDALVGERGVKLSGGQRQRIAIARVLLKNAPILILDEATSALDSEVESAIQESLEALMHGKTVIAIAHRLSTIARMDRLVVLDGGRIVESGTHAELLADGGLYARLWAHQTGGFVGVDXSRRQTSPR

SEQ ID NO: 8434 - protein, 790 aa, Ralstonia metallidurans
  unsure (1)..(790): unsure at all Xaa locations
EVHVGRDVNNLLNATEKEAIKRNDQFIASELFLLAVSDDKGETGRIARENGLSRKSLEAAITAVRGGDTVNSADAESQREALKKYTVDLTERARAGKLDPVIGRDDEIRRAIQILQRRTKNNPVLIGEPGVGKTAIVEGLAQRIVNGEVPETLKNKRVLVLDMAGLLAGAKYRGEFEERLKAVLNDVAKDEGQTIVFIDEIHTMVGXRXXXKXXRXXXXXXXXXXXXXPXPXGYKPALARGELHCIGATTLNEYRKYIEKDAALERRFQKVLVDEPSVEATIAILRGLQEKYELHHKVEITDPAIVAAAELSHRYITDRFLPDKAIDLIDEAAARIKMEIDSKPEAMDKLERRTIQLKIEREAVKKETDEASRKRLELIEQEIIRLEKEYADLDEIWRAEKGAAQGAAALKEEIEKIKLDITRLQREGKLDKVAELQYGKLPELEGKLQAATKAEASEQKQQNKLLRTQVGAEEIAEVVSRATGIPVAKMMQGEREKLLKMEDRLHQRVVGQDEAVRLVSDAIRRSRAGLSDENKPYGSFLFLGPTGVGKTELCKALSEFLFDSEEHLIRIDMSEFMEKHSVSRLIGAPPGYVGYDEGGYLTEAVRRKPYAVILLDEVEKAHPDVFNVLLQVLDDGRLTDGQGRTVDFKNTVIVMTSNLGSHIIQSMAGEPQEAVKGAVWQEVRTHFRPEFLNRIDEVVVFHALDQKNIESIAKIQLKRLQVRLARMDMTLDVSERALEKIASAGYDPVFGARPLKRAIQQQIENPVAKAILEGRFAAKDVVPVDYVDGE

SEQ ID NO: 8435 - protein, 388 aa, Ralstonia metallidurans
MSFVNAGIPVMLIEREQAALDRGMALIRRNYEITAAKGKLAPQQIDACMGRITPTLAFEAVADADLVVEAVFEDMAVKQAIFERLDALCKPSAILATNTSRLNIDTIAASTKRPGDVIGLHFFSPANVMKLLEVVRGQATRADVIASCMAMAQRIRKIPVLVRVCEGFVGNRMLTPYWREAGFLLEEGASPLQVDRALTQFGMAMGPLTMADLAGMDINWATRKRLAPTRPAHLRYSAVADRICELGRFGQKTNGGYYRYEPGSRTPIPDPQIDALIEECAREAGITRRPVADEEIVERCMLALINEGARILDEGIAQRASDIDVVYVHGYGFPAWRGGPMFYAETLGLAHVLARIRALQDVHGAHWEPAPLLERLVAEGRQTFDGPR

SEQ ID NO: 8436 - protein, 361 aa, Ralstonia metallidurans
LVFTEGKGSWLTDHNGKRYLDFVQGWAVNALGHSNEGMIQALEKQARKLLNPSPAFYNEPMLKLAQQLTDNSCFDKVFFANSGAEANEGAIKLARKWGRKHKNGAYEIITMDHSFHGRTLATMSASGKAGWDTIFAPQVPGFPKAELNDLASVEKLITDKTVGIMLEPVQGEGGVIPATREFMQGLRALADKHKLLFIVDEVQTGCGRCGTLFAYELSGVEPDIMTLGKGIGGGVPLSALLCKADVASFEAGDQGGTYNGNPLMTAVGSSVMEQLTAPGFLDDVKAKGEYLREQLLVLTKEFGLGGERGEGLLRALVLGKDIGPQLVEEAREMSPVGLLLNAPRPNLLRFMPALNVTREEI

SEQ ID NO: 8437 - protein, 550 aa, Ralstonia metallidurans
SELDAAIVRARDALLDRQHPDGHWCFELECDATITAEYILMMHFVDEIDTALQARMAKYLRAVQRLDGHGAWDLYFGGDLDISCSVKAYFALKAAGDPPDAPHMVRAREAILARGGAAKSNVFTRILLATFGEIPWRGTPFMPVEFVLFPRWAPIHMDKVAYWARTTMVPLLVLCSIRAAAKNPLGVHVQELFVTPPELEREYFPRKRGLQQAFLVADRVVRHLEPLIPRALRRRAIQRAVEWSEARMNGEDGFGGIFPPMVYSYEMMVLLDYPEDHPLRVECKAALKKLVVHRDDGSSYCQPCLSPVWDTAWSVMALEQAPSDARTETAIARAYDWLTDRQVLDLRGDWENNAAPSTPPGGWAFQYENPYYPDIDDSAVVLAMLHARGKRTGQPGRYEMPVARCLDWIIGLQSRNGGFGAFDANCDRDFLNAIPFADHGALLDPPTEDVSGRVLLALGITERPQDATARERCIQYLRDTQQPDGSWWGRWGTNYIYGTWSVLAGLGLAGVDRKLPMVRNGLQWLRGKQNADGGWGETNDSYARPELAGK

SEQ ID NO: 8438 - protein, 521 aa, Ralstonia metallidurans
MTITGEMLIGASAVRGTEETFYGINPATGEQLEPAFHSGNANDVERACVLAEAAFDAYRATTPEQRAQFLESIADAIEAIGDELIQRAHAETALPLARLQGERGRTTGQLRLFARVLRDGRWQDATLDSALPERTPPRPDLRMQKIAVGPVAVFGASNFPLAFSVAGGDTASALAAGCPVVAKAHPAHPGTSELVGRAIQKAVADSGLPEGVFSLIMGVGNAIGTALVAHPAIQAVGFTGSRTGGLALMNVANTRPQPIPVYAEMSSINPVYLLPEALAARGEQIARDLIDSLVLGVGQFCTNPGLLLAIEGPALEAFRATALAALTGKPAATMLTPGIHQAFERGVTQLSDIAGLSRAACGLDATGPNQARPVFFETSAEQFIADHRMHVEVFGPSTVLVTCKDAETLLAVTRILEGQLTATVQADAGDHALAARLLPALERKVGRVLFNGFPTGVEVSFAMVHGGPFPATSDTRTTSVGASAIDRFLRPVCYQNVPADLLPQAVRDSNPLNLWRLKDGE

SEQ ID NO: 8439 - protein, 454 aa, Ralstonia metallidurans
TYRAPLKDMQFVMNELAGLESISQLPGYEDATPDTAQAVLEEAAKFNEQVVAPLNRAGDLNPSSWKDGVVTTTPGFSDAFRQFGEGGWQGVLHPSDFGGQGLPKLVATPCNEMLNAANLSFALCPLLTDGAIEALLTAGSDAQKETFLPKLISGEWTGTMNLTEPQAGSDLAAVRTRAEPQGDGTFKVFGTKIFITYGEHDMAENIVHLVLARTPNAPEGVKGISLFIVPKFLLNADGSLGERNDVHCVSIEHKLGIKASPTAVLQFGDHGGAIGTLVGEENRGLEYMFIMMNSARFSVGMQGIAVSERAYQQAVAFAKERVQSRPVDGSAREAVTIIHHPDVKRMLMTMRALIEGARSVAYVAAAASDIAHQHPDEGVRRQNMALYEFLVPVVKGWSTELSIDVTSLGVQVHGGMGFIEETGAAQHYRDARILPIYEGTTAIQANDLIGRKTV

SEQ ID NO: 8440 - protein, 355 aa, Ralstonia metallidurans
MEPFVYQATPSRVVFGAGRLEALPEEVLRLGARRALVLTTPGHRALGERVAALLGECSAGVYSEAVMHVPVEVAHAARDEAARLGADCYVAVGGGSTIGLGKAIALVSGQPIIAVPTTYAGSEVTPIYGLTEGRLKQTGRDPRVLPRTVLYDPELTLTLPVEISAASGMNAMAHAVEAIYAEDANPIISLMAEASIRALAGALPTVVRRPDDIDARGDALYGAWLAGACLGSVGMAIHHKLCHTLGGTFNLPHAQTHAILLPHTAHYNHAAAPLALARVARALGGERAQDTGPLLFRLNQTLGIATALSAIGMPEDGLDEAATLACANPYYNPRLVEREPIRALLERAWRGESPA

SEQ ID NO: 8441 - protein, 351 aa, Ralstonia metallidurans
DAVVAYFHTGGTTGLPKLVAHSSRNQLAAALGAASLLGMRKDDRVTNGMPLFHVGGTIVSTLSVLLSGGHIIMLSAQGLRNPAMVTGIWKIVERFGITIFGAVPTALGALLNVPVDADISSIRYGLTGAAPCPFSVTKRFAEVTGVELHELLGMTETGGATAADAAGQRPTVGSVGYRLPFTRLRVRRQDAEQGLGDDCDPHEVGVLFVEGPHVSHGYRDPSQNAGVFIEGGLNTGDLAYFDDAGKLFIAGRAKDLIIRSGHNIDPGMIEQAMMMHPSVVLAAAVSLPDKYAGELPVVFVVAKPGVGINLEELDAFVKERIAERPAWPKAIHVLDQLPTTAVGKLFKPALR

SEQ ID NO: 8442 - protein, 257 aa, Ralstonia metallidurans
LKGKTALVTGSTSGIGLGIAQALAAQGANIIVNGFGDVDGAKAEIAKSGSGIQVGYHGADMSKAAEIEDMMRYAEKDFGGVDILVNNAGIQFVAKIEEFPVDRWDAIIAINLTSAFHTTRLALPSMKAKNWGRVINIASTHGLVASAEKSAYVAAKHGIVGFTKVTALETAQTGVTANAICPGWVLTPLVQKQVEARAQKEGIPVEQAKRELVIEKQPSGQFVTPEELGALAVFLSSEAARQVRGAIWNMDGGWVAQ

SEQ ID NO: 8443 - protein, 258 aa, Ralstonia metallidurans
  unsure (1)..(258): unsure at all Xaa locations
NLEGKVALVTGASSGLGTRFSNVLAAAGAKVVLASRRVERLKELRASIEADGGSAHVVQLDVTDPDSIRAAVAHAETEAGAIDILVNNSGVSTTQKLTDVTADDFDFVFDTNTRGAFFVAQEVAKRMIARAKGAEKLGNPLPQARIVNIASVAGLKVLSQIGVYCMSKAAVVHMTKAMALEWARHGINTNAICPGYIDTEINHHHWDTDAGQKLIQMLPRKRLGQPEDLDGLLLLLASDASRFINGAVVTADDGMVXS

SEQ ID NO: 8444 - protein, 254 aa, Ralstonia metallidurans
MQGIMEGKVALVTGAGGGIGRGIALALGAAGARVVVNDLGVSMSGEGGDAGPAQRVAEEIRAAGGQAVANTDSVSTWNGAHNIIQCALDNFGRIDAVVNNAGNLRDRMFFKMNEEEWRSVIDVHLHGTFFVSRAAANHFKDQEGGAYVHMTSTSGLIGNFGQANYAAAKLGIVALSKSIALDMQRFNVRSNCIAPFAWSRMTSSIPAETPEEKARVAKLQRMEAGKIAPMAVFLASDAARDVSGQIFAVRANEI

SEQ ID NO: 8445 - protein, 514 aa, Ralstonia metallidurans
YYVDTPLPIGTAPALPVHASMSMCVRAPEQLEPGCRCWPANAVLSAGVIDGRNIWRADLRAVLATLAPLHAQLGDRLWIAPSCSLLHVPVSLDAEQRLDPELKSWLAFATEKLEELRTLAVALNQGKAAAATQLAASDAARESRRTSRRVVNQRVQGRLAAVTADMADRASAFDIRIERQREALQLPALPTTTIGSFPQTTAIRQTRAAYKRGEIGALDYLQRIRGEIELAVRKQEALGIDVLVHGEAERNDMVEYFGEQLCGYAFTENGWVQSYGSRCVKPPVIYGDVYRPEPMTVDTARYAQSLTDKPMKGMLTGPVTMLQWSFVRDDQPRATTARQLALAIRDEVRDLEAAGIRIIQIDEPALREGLPLRRDDWTAYLEWAVNAFRLSAAGVSDQTQIHTHMCYAEFNDILPAIAAMDADVITIETSRSAMELLEGFGEFDYPNEIGPGVYDIHSPRVPTVEAITRLLERACEVIPPERLWVNPDCGLKTRGWPETEAALANMITATRQLR

SEQ ID NO: 8446 - protein, 470 aa, Ralstonia metallidurans
LLIDGKRLPPGSGEYSTDINPATEEPIALVAQGSAADVDTAVLAARAALKSWAGMRAADRGRILNRFADLLEAHAEELITLESLDAGKPLAAVRRQDLPAVVDTVRYYAGWCDKIHGAVIPTRPDALTYTVREPVGVVAAIIPWNFPLMIGMWKIAPALACGCTLIVKPAEITPLTALRVAELALEAGVPPGVFNVVTGKGSVVGNALVAHPGIDKVTFTGSPGVGRGIMQGAASNFKRVTLELGGKSANVIFADADIDAATRAAASGIFFNSGQVCSAGSRILAQRKVYDEVVERLTTRARAIRVGDPASPDTTMGPVVSAAQMKTVLDYVEIGKREGASAVTGGARIGQRGFFVEPTVFANVEHEMRISQEEIFGPVASVIPFEDEAEAVRIANGTAFSLAAGVWSADIARVHKVAGELRAGTVWINTYGYTDVRLPWGGAGDSGLGREHGDAAIENFTEPKAIWLSL

SEQ ID NO: 8447 - protein, 375 aa, Ralstonia metallidurans
IAELRGKVRQFVEQHAIPSEDPVLAHDVQRLDVVVRRLQGLAREAGIYAPHLPPEHGGLGLDWQARAEILEEAGRSFLGAPALNCAPPDQPNMINLMRHGNAAQQARYLQPLVQGRIRSCFAMTEPAPGAGSDPSMLRTTATRQDGKWVINGHKWFISGAVDAAFAIVLARTDEAAGTGATMFIVDTDNPGYRLVRNIAGMDGYQVGGHGEIVFEQCVVDDDAVLGQVGQGFAYAQARLEPARLSHCMRFIGRASRAMEIAQQYAAQRESFGQRLADLQQVQAMVADSHIDLHASRLMVRDCARKMDAGESVKHDSAMTKIFVSEAVWRVADRAVQIMGALGISDDTPVSMIQRELRPFRIYDGASELHRATLAR

SEQ ID NO: 8448 - protein, 450 aa, Ralstonia metallidurans
VEREQGLHRGLSTGQLSMIAIGGAIGTGLFLGSGFAIGFAGPSVLVSYAIGALIALLLMGCLAEMTVAHPTSGSFGANAEHYIGPLAGFLVRYAYWSSIVFAVGTEVTAIAVYMKYWFPMVPGWYWIVGFSAALIGINATSVKVFGAVEYVFSMLKIVAIVGFILLGAYVVTRAPTGSGIGLANYTAHGGFFPKGMWGTWVAVIVSIFSYLSIEMIAVAAGEARDPETAITRAFRATMVRLVFFYLLTLALMLMIVPWTAAGAGESPFVRVMAATRVPGAAAVFNFVILVAALSAMNSQLYITTRMMFSLSRAGYAPKALGQVNGRGVPMTALLLSTVGIAFAVVLNVVYPDASFMLMMAISMFGAMFTWLMIFITHLFFRRQHRGRPLAFRMWGFPVTTLLGAGLMFATLVTTWFTPEFRMTLVAGVPFMLALSAAYWLWYRKRGGAAQ

SEQ ID NO: 8449 - protein, 482 aa, Ralstonia metallidurans
MQLKDPSLFKQLAYVDGQWISADSGATFDVTDPATGEVIARVADLGAAETTRAVAAAEVAQKAWAAKTGKERANILRRWFDLMLANTDDLAYLMTREQGKPLAEAKGEIAYAASFIEWFAEEAKRVDGEVLATPAADKRLVTLRQPVGVCAAITPWNFPAAMITRKVAPALAAGCAIVIKPAELTPLSAFALAELAHRAGVPAGVLQVVTGDARNIGGVLTASPIVRKLSFTGSTEVGRILMAQSAPTIKRLSLELGGNAPFIVFDDADVDAAVEGAIVAKYRNGGQTCVCANRFYIQDGIYDAFAAKFAERTAQLRVGNGLEAGVVIGPLIEDAAIEKVNSLVEDATSKGGKVLAGGGKHPLGGTYYTPTVIGNATADMRMAREEIFGPVAPLFRFKQDDEAVAAANATEYGLAAYLYTRDISRAWRTAEALEYGMVGLNTGLISNEVAPFGGIKQSGVGREGSRHGIEEYLEIKYLCLQM

SEQ ID NO: 8450 - protein, 378 aa, Ralstonia metallidurans
MAKRDYYEVLGLGKNASDDEIKKAYRKLAMKHHPDRNPDNKEAEEKFKEVKEAYEMLSDPEKKAAYDQYGHAGVDPNMAGGFGGGGFGGGGFAEAFGDIFGDIFGQAAGGGRRGGGPQAYRGADLRYSMEISLEQAAHGHEAQIRVPHWDDCEHCHGNGAEPGSSVETCPTCNGVGQVRVSQGFFTMQQTCPKCHGSGKFIPKPCTKCHGQGKLKSQKTLEVKIPAGIDEGMRIRSSGNGEPGINGGPPGDLYVEVHIKQHPVFERDGDDLHCQMPISFATAALGGDIEVPTLGGRASFPVPEGTQAGKTFRLRGKGIKGVRSGYPGDLYVHVNVETPVKLTEAQKDILRQFDRSVHEGGSRHSPQEQSWLDKVKSFF

SEQ ID NO: 8451 - protein, 443 aa, Ralstonia metallidurans
ASTVINTDEGLLDRSQAPRVAGGIATVLANGDKPGGQRPSTVITFEPLMIQAAGQEVTLIHAGRSSQDMLATVRAAMLRDEVLSLADQLNKTSATIVKLARQHAETIVPNYTNGVAAQPNSYGHYLLGINAGLERDAQRLREAYQRIDRSPMGTTVLNGTGWPLNRTRMASYLGFSALVDNAYDASQISAVDLPVEVGAIVTSIALHTGSFIEDVMTQYAQPRPWILLQEGGGNTYVSSAMPQKRNPGLLNSTREKASTAITLAMGPVIRAHNLPPGMSDAKDAVTNGQMVQSAITTLKGLDRIMTALVIDRPRALDELDSDWTASQELADELMRKYKLPFRVGHHFASNLVDYAKAHDIKPSAFPYAEAKRIYAEAVRDYGGGEFPMSEAEFRAALDPVAIVKRRVTVGGPQPAEMERMLKASEGQLAQQDAWIRARRAAID

SEQ ID NO: 8452 - protein, 335 aa, Ralstonia metallidurans
PTMTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQE

SEQ ID NO: 8453 - protein, 482 aa, Ralstonia metallidurans
PHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPF

SEQ ID NO: 8454 - protein, 297 aa, Ralstonia metallidurans
LQMRNVRKLYGDHVVVDNLDLEVQPGQCFGLLGPNGAGKTTTLRMLLGLTTPASGTLMLCGEPIPQRAPQARMRVGVVPQFDNLDPDFSVIENLRIFGRYFGLSSAQIAERVPKLLEFARLESRADAQVRDLSGGMRRRLTVARALINDPDLLIMDEPTTGLDPQARHLIWERLKSLLSAGKTILLTTHFMEEAERLCNHLCVIDAGRKIAEGKPHELIDSEIGCDVVEVYGDELEPLRDTLTPLAERTEMRGETLFFYVREPAPLLAALHGKGGVRYLHRPANLEDVFLKLTGREM

SEQ ID NO: 8455 - protein, 388 aa, Ralstonia metallidurans
DTLGVRAGTLRTGEFMEHSEAMYLTSSFCFNSAAEAAARFANSEEGYTYSRFTNPTVSMFQSRLAALEGAEACMATASGMSAILSVALATLQAGDHLVSSRSIFGSTMTLFNSILAKFGVETTYVDGTDLAAWRAAVKPNTKLFFLETPSNPLTEVSDIAAVADIAHNAGALFVVDNCFCSPALQQPIKFGADVVVHSATKHIDGQGRVLGGAVVGKHDFIMGKVFPFVRTAGPTLSAFNAWVMLKGMETLAIRMERHSQSALAIAEFLESHPAVNRVFHPALKSHPQYEIAQRQQSGGGAIVSFELKGDSPEAMRAAAWRVIDSTKLCSITGNLGDTRTTITHPYTTTHGRVAPEAKAAAGISEGLIRLAVGLESVEDLKADLLRGL

SEQ ID NO: 8456 - protein, 652 aa, Ralstonia metallidurans
IVRAACPHDCPDTCALLVTVEDGRAIKVAGDPEHPGTQGVLCTKVSRYTERTYHPDRLLTPLRRVGKKGEGRFEPISWDEALDEIAERLSSIAARNPEAIVPYSYAGTMGLVQGESMAARFFHKLGASLLDRTICASAGATALRHTYGASVGMDMEQVVDAKLIIIWGSNPITSNLHFWTRAQEAKRRGATLVAIDPYRSLTAEKCHRHIAPMPGTDAALALAMMHVLIRDDLIDHDYVARNTVGFDALRERAMQFSPETAARICGIPVDDIEWLAGLYGKLAVRERQPVAIRLNYGMQRVHGGGQAVRAVACLPSLVGAWREAAGGLLLSTSGFFPVDNAALQRPDLLPGWPNLPRTINMSTIGDALLDDGTTGNGPKIEAVVVYNSNPVAVAPESGKVAAGFGRDDLFTVVLEHFRTDTADYADIVLPATTQLEHIDVHKAYGHTYFLANNQAVEPLGQALPNTEIFRRLAARMGFTESCFADSDEAIASQAVLREDKRAAGISWDSLKARGWQKLNIAKAPFAEGGFPSASGKCEFYSETMAREGLDPVPAYVPPYEAPSSAPELFARYPLAMISPPARNFLNSTFVNVDSLRATEGEPHLDIHPLDAAARGIANGVQVRAFNDRGSMLARARVTDRARQGLVVGLSIW

SEQ ID NO: 8457 - protein, 555 aa, Ralstonia metallidurans
WLKNYPAGVPAEIDASQFRSLAQLLEESFRTYADRRAFICMDHAITYGELDQLSHAFAAWLQSRGLRPGARIAIMMPNVLQYPVVLAAVLRAGYVVVNVNPLYTPRELEHQLKDSGAEAIVILENFASTLQAVLSATPVKHVVVASMGDLLGTVKGAIVNFVVRNVKKMVPAWELPHCVRFKDVLAEGRKMTLKPVNTGPDDVAFLQYTGGTTGVSKGATLLHRNIVANVLQSEAWMQPALAKGAPIDQVVTITALPLYHIFALTVCCLLGMRSGGLSILIPNPRDIPGFIKELQKYKFHMFPAVNTLYNALLNHPDFAKIDFSGLRVANGGGMAVQEAVAKNWLAKTGCPIIEGYGLSETSPSATCNPTDTDAFSGTIGLPLPSTDVSIRDDDGNELPLGQPGEICLRGPQVMAGYWNRPDETAKVMTADGFFKTGDIGVMDERGYTKIVDRKKDMILVSGFNVYPNEVEGVVAECPGVLEVAAVGVPDQHSGEVVKLFVVKKDPALSEADVIAFCKDRLTGYKRPKYVEFRTELPKTNVGKILRRELRDSRKA

SEQ ID NO: 8458 - protein, 622 aa, Ralstonia metallidurans
LHARSLSDPAGFWAEQAARIDWETPFERVLDDSRPPFARWFVGGRTNICHNAIDRHLSARADQRALVYVSTETDTERTYTYRELHDEVTRMAATLQGLGVQRGDRVLIYMPMIPEAMFAMLACTRIGAVHSVVFGGFASVSLAARIDDAKPRVIVSADAGSRAGKVVPYKPLLDEAIRLAGHHPEKVLLVDRKLAEMPLVSGRDQDYAAWRDKVAGQAVPCVWMESSEPSYVLYTSGTTGKPKGVQRDTGGYAVALATSMENIFCGKPGDTMFTASDIGWVVGHSYIVYGPLLAGMTTVMYEGTPIRPDGAILWKIVEQYGVNIMFSAPTAIRVLKKQDPALLKRHDLSSLRLLFLAGEPLDEPTARWIQGGIGKPVVDNYWQTESGWPIIAIQRGVEALPPKLGSPGVPAYGYDLRIVDEVTGEECPPNTKGVVAIDYPLPPGCMSTVWGDDDRFIRTYWSAVPNRQCYSTFDWGIRDEDGYVFILGRTDDVINVAGHRLGTREIEESLSSHPGVAEVAVVGVQDALKGQVAMGFCIARDAGRTATEADRMAFEGELMKTVEQQLGAVARPARVFFVNALPKTRSGKLLRRAIQAVAEGRDPGDLTTIEDPTALEQVKESL

SEQ ID NO: 8459 - protein, 437 aa, Ralstonia metallidurans
GRNVVVIGTQWGDEGKGKIVDWLTDHAKGVVRFQGGHNAGHTLIIGGKKTILRLIPSGIMRESTVCYIGNGVVLSPEALFREIEELESAGLQVQNRLRISEAATLILPYHVAIDKAREARRGAAKIGTTGRGIGPAYEDRVARRALRVQDLFDPKHFAERLRENVEFHNFMLTQYLGAEAVDYQQILDESLAFAPRLKPMVADVSAELYAVNAAGNNLMFEGAQGTLLDVDHGTYPFVTSSNCVAGAAAAGAGVGPGRLNYILGITKAYCTRVGAGPFPSELYDNDNPARQDAVGVRLANVGKEFGSVTGRPRRTGWLDAAALKRSVQINGVSGLCMTKLDVLDGLETIKLCVGYELDGKRVDILPRGSDAVAACVPVYEEFPGWNESTFGVKTWDALPEAARVYLKRIEEVVGIPIDMVSTGPDRDETILLRHPYQ

SEQ ID NO: 8460 - protein, 309 aa, Ralstonia metallidurans
AERDAQSLTRRRRIAHTACAPHQSVGGIDATPTPLLTFCSNDYLGLANHGSIAHALAEGAHRYGAGSGASHLVSGHSLAHAQLERELARWLAPYIPQAQALYFCTGYMANLAVLTSLGATGATLFCESLNHASLIDGARLARADVQRYPHGDAGALDALLAASTTALKLIVTDSVFSMDGDIAPLAALLEVAERHDAWIIVDDAHGFGVLGENGHGVLEHLGLRSERLIYIGTLGKAAGVAGAFVAAHETIVEHLINTARPYIYTTAAPPAVAHALLTSLEIIAGEEGRSRRGHLTGLIAELGAGLQVL

SEQ ID NO: 8461 - protein, 450 aa, Ralstonia metallidurans
TSLAARSQRAVWHPCTRLRPDASANEPPLAIVRGEGPWLIDAGDKRYFDAISSWWVNLFGHANPAINAAIGEQLQTLEHVMLAGCTHAPAVELAERLTALTGGALGNAFYASDGASAVEIALKMSFHYWRNTGLTAKREFICLRHGYHGETVGALAVTDVEIFRDAYDPLTRRAHVVMSPDARQAARSESAADVATRALAELEALLRERAGQIAALIVEPLVQGAAGMAMYDPSYLEGARALCDRYRVHLIADEIAVGCGRTGTFFAWEQARGGDAVPAHAWPDFLCLSKGITGGYLPLSLVLSRPEIQRAFVADDIARSFLHSHSYTGNPLACRAALATLDLFESEDVLARNRERAQWLGTAMAGIAADPRVSHVRQRGMIWAADIDPQAAGANFAGRFHLAARERGVLARPIGHTLYVMPPYVFDAELANWLGEQLLDTLQAVLDPAE

SEQ ID NO: 8462 - protein, 685 aa, Ralstonia metallidurans
SNPLLDFSDLPRFAEIRPEHIGPALDVLLAQAQAAVARAEDPATPATWASAVEALEVATEPLGRAWGVVGHLSAVADTPELRKAHADNLPRMTEFWSSLGQSLALYEKYKAVAAGPEFAGLSPARKQLLENELRGFRLGGAELAEDKKPRFAEIQEQQAQLSKAFSDHVLDATNGYALYIEDEARLSGIPADAKEAAALAAQKDGKAGWKFTLHFPSYFPVLQYADDRALRQTMYEASVTRASELGPQHGNGQADWDNTANMREQLTLRREEAHMLGYANYGEVSLVPKMAESPAEVLKFLDELAVKARPFAEHDWTELREFAAAELGLNDVAPWDVAYASEKLRQKRYSFSDDEVKQYFQEPKVLEGLFGVAEKLFSVRIQPDTTQTWHKDVRFFRVVSPQGALLAQFYIDLYAREGKRGGAWMDDARGRKERGNGTVQTPVAYLTCNFTAPVGDKPALFTHDEVITMFHEFGHGLHHMLTQVGDLGVSGINGVEWDAVELPSQFMENFCWEYEVLSTMTAHVETGAPLPRALFDRMLAAKNFQNGMMTLRQIVFSSFDMHLHTDYDPQGAVSVLELSRQINDAKHVVPQSPLSRWPNTFSHIFAGGYAAGYYSYKWAEVLSADVYAAFEEAAQLSGSVLDSATGERYRREILSVGGSRPAMESFVAFRGRAPQIDALLRHGGM

SEQ ID NO: 8463 - protein, 262 aa, Ralstonia metallidurans
MRIASWNVNSLKVRLPQVLQWLGAQDAAGTPIDALCLQELKLPDDKYPLAELQAAGFHSIFTGQKTYNGVAILARNAAMPVPTDVVRNIPGYEDAQQRVIAGTYGDVRLISAYFPNGQALDSDKFVYKLDWLKAMIEWLRAEMTRYPKLALLGDFNIAPEDRDVHDPAKWEGQNLVSPQERDAFQTLIGLGLVDSFRMFEQPEKMFSWWDYRMMGFRRNAGLRIDHILLSADLARQCATCVIDKEPRRWEQPSDHTPVVATL

SEQ ID NO: 8464 - protein, 419 aa, Ralstonia metallidurans
MSKVAEIRGLEVLDSRGNPTVEVEVVLDDGAVGRAIVPSGASTGAREAVELRDADPRRYLGRGVLRAVQAVNTELCEALLGRDAGDQPEIDTIMIDLDGTPDKRRLGANALLGVSLAVAHAAAMSNGLPLFAYLGGERASLLPVPLINVINGGAHADNALDFQEFMIVPAGAPTFTEAVRASAEVFHTLRAMLKAAGYTTNVGDEGGFAPEFHAAEEALDILVAAIAKAGYRPGEDIALAIDPAASELYVNGSYVYQGEGVERSREEQVAYLVRLADRYPIVSIEDGMAEDDAMGWQLLTRQLGKRCQLVGDDVFCTHPTLLRQGVEQGMANAILVKANQIGTLSEMRETVRVAHGYAYSAVMSHRSGETEDVTIADLAVALRCGQIKTGSMSRADRTAKYNRLLRIERELGSRAEYAG

SEQ ID NO: 8465 - protein, 300 aa, Ralstonia metallidurans
DSQAVRDYLLGLQDRITDAIAAVDGQAFLTDNWEKPPTERLRGSGRTRILEGGAVMERAGVGFSHVRGDTLPPSASANRPELAGRSFEAMGVSLVFHPRNPYVPTVHMNVRCFIAVKPDAEPVWWFGGGMDLTPYYGNADDCAHFHRTCKDSLAPFGDDLYPRFKQWCDEYFFLRHRGEARGIGGIFFDDFSALGFDRSFEMLRSVGDAFLAAYLPILTARKDAAYGERERDFQAYRRGRYVEFNLVFDRGTLFGLQSGGRTESILMSMPPQVSWRYDWQPEPGTPEAALYTDFLPARDW

SEQ ID NO: 8466 - protein, 243 aa, Ralstonia metallidurans
QRTALVTGGNRGLGAAIARALHDAGHRVIVTHTPGNTTIGQWQQAQATQGYSFAAYGVDVSDYESTQELARRIHADGHRIDILVNNAGITRDATLRKLDKAGWDAVLRTNLDSMFNVTKPFIDPMAERGWGRIVNISSINGSKGQFGQTNYSAAKAGVHGFTKALAQEVARKGVTVNTVSPGYLATEMVMAVREDMRQKIIDAIPVGRLGQPAEIAALVAFIASEAAAFMTGSNVAMNGGQHM

SEQ ID NO: 8467 - protein, 662 aa, Ralstonia metallidurans
QPMSAIESVMQEHRVFNPPASFAKTAAIPSMEAYQALCDEAAKDYEGFWARHARELLHWHKPFTKVLDESNAPFYKWFEDGEINASYNCLDRNVEKGLGDKTAIVFEADDGTVTRVSYQELLAKVSRFANGMKALGIKKGDRVVIYMPMSVEGVVAMQACARIGATHSVVFGGFSAKSLQERLVDVGAVALITADEQMRGGKALPLKAIADEALTLGGCEAVKNVIVYRRTGGNVAWTEGRDRSMEDVAAGQSDNCPAEPVGAEHPLFVLYTSGSTGKPKGVQHSTGGYLLWALMTMRWTFDIKPDDMFWCTADIGWVTGHTYITYGPLAAGATQIVFEGVPTFPNAGRFWDMIQRHKVSIFYTAPTAIRSLIKAAEADEKIHPKQYDLSSLRLLGTVGEPINPEAWMWYYKNIGRERCPIVDTFWQTETGGHMITPLPGATPLVPGSCTLPLPGIMAAIVDETGQDVPNGNGGILVVKRPWPSMIRTIWGDPERFKKSYYPEELGGKLYLAGDGSIRDKETGYFTIMGRIDDVLNVSGHRMGTMEIESALVSNPIVAEAAVVGRPDDTTGEAICAFVVLKRSRPTAEEAVKIAAELRNWVGKEIGPIAKPKDIRFGDNLPKTRSGKIMRRLLRSLAKGEDITQDTSTLENPAILDQLQASP

SEQ ID NO: 8468 - protein, 554 aa, Ralstonia metallidurans
MSQAIEIKVPDIGDYDAVPVIEVHVKPGDTINAEDALVTLESDKATMDVPSPQAGTVKEVRIKVGDSVSEGSVLVMLEPAGASAAAPAPAAAAAPSAPAPAAAAPAPAAPAAPAPAAAPAGAGTVEVKVPDIGDYDAVPVIEIHVKVGDQINAEDALVTLESDKATMDVPSPQAGTVKEIKVKVGDNVAQGTLILILEAAGGAAAAAPAPAAAPAPAAAAPAPAPAAAAAGTCCRAGRRASGAGYDRQGRSRQPDRAQVRARAGCRRVACAGHRSKGRITQEDVQNYVKSVMSGQTATPSAPAAAAGTGVGLDLLPWPKVDFTRFGEVESKPLSRIKKISGANLHRNWVMIPHVTNCDEADITELEAFRVQLNKENEKAGIKVTMLAFMIKATVAALKKFPNFNASLDGDNLVLKKYFNIGFAADTPNGLVVPVIKDADKKGVLEISQEMSDLAKLARDGKLKPDQMQGGCFSISSLGGLGGTYFTPIINAPEVAIMGVCKSYMKPVWDGKQFAPRLTLPLSLSWDHRVIDGAEAARFNTYFAALLADFRRILL

SEQ ID NO: 8469 - protein, 250 aa, Ralstonia metallidurans
LRGKHALVCGASKGLGFACADALAAEGVDVVIRGAEALEKAAADLRARHGRRVLAVATDITTAEGRKLALDAATKLGDLDILVNNAGGPPPGNFRDWGRDEWLKALDANMLTPIELIKATVDGMIARRWGRIINITSGAVKAPIDVLGLSNGARSGLTGFVAGLAREVAQHGVTVNNLLPGPFNTDRLYKTMEGGAQKAGISVDEMAQRRAASNPTRRFGDPAEFGATCAFLCSRQAAYMTGQNVLLDGG

SEQ ID NO: 8470 - protein, 333 aa, Ralstonia metallidurans
  unsure (1)..(333): unsure at all Xaa locations
LPIGTLLANYRIVKKLASGGFSFVYLATDETGAPVAIKEYLPSSLARRSPGELIPVVPDENVASFRLGLKYFFEEGRSLARISHPSVVRVVNFFRENSTVYMVMNYELGKTLQEHILQARQQGKAKVLRERFIRKVFHDLMSGLREVHIHKLLHLDIKPGNIYLREDESPILLDFGAARQILTMEASRFQPMYTPGFAAPELYGKHTDLGPWTDIYSLGATLYACMAGMPPQEATSVRRKTAXPSRSVGCAPPTRTGLVDLVEWCLRLTPAERPQSVFRLQKELRDQSNALGEQSAAAMAANPAGPSPSAXTPPAVSXPCCAAAKRRPCPPPR

SEQ ID NO: 8471 - protein, 474 aa, Ralstonia metallidurans
TRALWVDGVSVFTPARTFDSVNPATGEVNWQVAFATAEHVAAAVASAKRAVNDPAWRKMLPHVRAGILMRIADAMTARADEFARLQMLENGKVWSECRAQALSAASTFRFYASACETLGSEVTPSRGNYLSMTAYEPYGVVAAITPWNSPLTMEAQKVAPALAAGNAVILKPSEVTPSGALLLAQVAFEAGLPKGLLNVVTGDGRETGTALVEHPDVRMVSFTGGTATGRSIAGIAAQRLIPVALELGGKSPHIIFEDANIDAAINGVVDGIFEGSGQSCVAGSRLFVQRSIYDKAVGLLVERARALRVGLPDVAGSQLGPLAGFAHRDRVERFVSIAREEGGQILAGGRRPPEAALQAGAFFEPTVIGGLSNSATAVQQEIFGPVLCVLPFGDEDDLIAQANDSAFGLASGIWTANYQRAWRVARALETGLVWINTYKQLSIATPFGGFKDSGIGREKGVNGVRLYQQSKGIY

SEQ ID NO: 8472 - protein, 533 aa, Ralstonia metallidurans
TDLQAWNALRQHHDVVRETPMQQWFAEAGAAQRVDAFSLEASGLYLDYSKNRITGETLALLMKLAEEAGVPARRDAMFAGEHINATEDRAALHVALRALPDAPFKVDGASVMPAIHDVLRRMREFAGRVRSGVWTGSTGQGITDIVNIGIGGSDLGPRMVCRALAHLADPRGPRVHFVSNVDGTELAETLQRLDPARTLAIVCSKTFTTLETMANACSMRDWFLRHGVAENQLARHFVAVSTNRDAVVDFGIDPNNMFEFWDWIGGRFSLWSSVGLSIALAVGFDAFEDLLLGARAMDDHFRTAPLAQNMPVVMAMLGIWYRNFHDMPTSCMAPYSTSLELFPAFLQQLEMESNGKSVQLDGRPVDADTAPVVWGTAGTNGQHAYFQMIHQGSQIVPVDFVAPLVPPRELPGHHVKLLANCFAQAEALMRGRSAEELQAAGVDAARIPHMVFEGNRPSNMLLMENLTPHVLGALIALYEHRTFVQGIVWNINSFDQWGVELGKILARPIEAELSGNATEAHDASTAALIARAR

SEQ ID NO: 8473 - protein, 339 aa, Ralstonia metallidurans
VRQLGQAGWLRYCVPAAFGGALPALDSRALCLLRETLARHDGLADFAFAMQGLGSGAITLAGSDAVRERYLPRVANGEAIAAFALSEPEAGSDVAAMQCSAKLSDDGTHYVLNGAKTWISNGGIADFYCVFARTGEAARARGITAFVVDANTPGLSIAERIDVIAPHPLATLRFDDCRVPVGNRLGEPGQGFKVAMMTLDIFRASVAAAALGFGRAALDDALARATSRPMFGGVLADLQLTQAAIGDMATAIDAAALLTYRAAWLRDVRQQRTTREAAMAKMVATENAQQVIDRAVQMFGGLGVKVGTRVESLYREIRSLRIYEGATEVQKLIIARETL

SEQ ID NO: 8474 - protein, 527 aa, Ralstonia metallidurans
PPQTWPVFQFNDDTRYPDRLNAAVELVDRHVAAGNGGRVAVRHERAGRIETVTYAELAALVDRIAHVLVEDMGLVPGNRVLLRGPNNLMMAASWLATLKAGLIAVPTMPLLRAKELKQIIDKAQVTAALCDARLRDELDANRRADGEYFCPTLERVRYFHGEGADALETAMAGKPDTFTACDTAADDICLIAFTSGTTGQPKGTMHFHRDVLAMCDLFSRHVLKPTPDDVFCGTPPIAFTFGLGGMLCFPLRIGASTALSERLTPELLLKLIQDHRATIVFTAPTFYRQMAALVKNFDLSSLKKSVSAGEALPDATRQAWKAATGIEMTDGLGGTEMMHIFVSSAGADVRPGAVGRVVPGYEARIVDENMQPVPPGTVGKLAVRGPTGCRYLDDPRQEAYVRDGWNLPGDTFMADADGYYFYQARSDDMIISAGYNIAGPEVEGSLMRHEWVAECGVVGAPDAERGQVVTAYVVLRPGVEPSDATRAALQDYVKREIAPYKYPRRIEFVAALPRTETGKLQRFRLRQ

SEQ ID NO: 8475 - protein, 370 aa, Ralstonia metallidurans
AILALADGTVFRGYSIGASGHTIGEVVFNTAITGYQEILTDPSYSRQIVTLTYPHIGNYGVNPEDVEATKVHAAGLIIKDLPILASNFRKEHTLAHYLKQEKVVAIAGIDTRKLTRILREKGAQNGCILAGEDNVQKAIDLARSFPGLAGMDLAKVVSVKEPYEWTQTEWKLGEGYGKQDKPQFHVVAFDFGVKFNILRMLAERGCKVTVLPAQASAADALALNPDGIFLSNGPGDPEPCDYAIAATREFIARGIPTFGICLGHQIMALAVGAKTLKMSTGHHGANHPVKDHDDGRVVITSQNHGFAVDASTLPANARVTHTSLFDGTLQGFALTDKPAFCFQGHPEASPGPHDIAYLFDRFTKLMQDAR

SEQ ID NO: 8476 - protein, 717 aa, Ralstonia metallidurans
MPKRTDIKSILIIGAGPIIIGQACEFDYSGAQACKALREEGFKVILVNSNPATIMTDPNTADVTYIEPITWEVVERIIEKERPDAILPTMGGQTALNCALDLHRHGVLDKYKVELIGASPEAIDKAEDRQKFKDAMTKIGLGSAKSGIAHSMDEAVAVQSRIAQETGTAGYPIVIRPSFTLGGTGGGIAYNREEFEEICKRGLDLSPTRELLIEESLLGWKEYEMEVVRDKADNCIIICSIENLDPMGIHTGDSITVAPAQTLTDKEYQILRNASLAVLREIGVDTGGSNVQFSINPTDGRMIVIEMNPRVSRSSALASKATGFPIAKVAAKLAVGYTLDELKNEITGGQTPASFEPSIDYVVTKVPRFAFEKFPAADSHLTTQMKSVGEVMAMGRTFQESFQKALRGLEVGVDGLDEKSTDRDEVIEEIGEAGPDRIWYVGDAFRLGMSLEEVQSETDIDPWFLAQIEDIVKTEGLVRNRTLESLSTAELRHLKQKGFSDRRLAKLLKTDAKAVRLARVAQNVRPVYKRVDTCAAEFATNTAYMYGTYEAEHGECEADPTSNKKIMVLGGGPNRIGQGIEFDYCCVHAALALREDGYETIMVNCNPETVSTDYDTSDRLYFEPLTLEDVLEIVDKEKPVGVIVQYGGQTPLKLALDLEANGVPIIGTSPDMIDAAEDRERFQKLLQDLGLRQPPNRTARAEDEALRLAREIGTGFI

SEQ ID NO: 8477 - protein, 888 aa, Ralstonia metallidurans
TTCPYCGVGCGVRATVRADGLVDIAGDADHASNAGRLCVKGSALGETLDLNGRLLHPQVRDADGSLRRVDWDEALDKVARGFTEIIARHGPDAVALYVSGQLLTEDYYVANKLMKGFIGTANIDTNSRLCMSSAVAGHKRAFGEDLVPCSYEDLELADLVILVGSNTAWCHPILFQRLTRAKEARPEMKIVAIDPRRTATCELADLHLPLRAGTDVRLFNGLLSYLARHGHGDDVFVADHTAGLNDALAVADADGADIAAVARACKLAPQDVQAFYELFAATTKVVTAFSMGVNQSSAGTDKVNSIINCHLLTGRIGRPGMGPFSLTGQPNAMGGREVGGLANMLAAHMELGDPRHRDIVQDFWHSPAMADKPGLKAVDLFQAIEQGKVKAVWVIATNPVVSLPDADQARRALARCELVVTSDIVTRTDTNDAAHILLPALGWGEKDGTVTNSERRISRQRAFLPAPGEARADWDILCDVARRMGFAGFDYAGQHEIFDEHARLSAWRNGDDSGDDAAHAPRMFDIGGLAGMDQAAYDAMLPVQWPLPVMASSGKQRLFENARFAFADGRARFVATAARAPVHATDDEFPLILNTGRVRDQWHTMTRTGKAARLSDHLPEPFVDMHPQDALLCGVGEGKLARVTSRWGMMIGRVRFGGGIPRGSVFVPIHWNDQFSSDARVGAVVNPAVDPVSGEPEFKHTPVRVEEFRVSWHGFVLSRKVLPADALTWWTRIQGKHFHRHEFAGRDVITDRAAWARERLGAQAPDADWLEFEDRAAGVYHAGYIVDDRLEACVYLSTRPDLPSRAWLSQLFGQARLEDSDRIGLLLGQPLEKTADAGPTVCSCFGVGRNTICDAVRQHDLKTPAEITACVKAGGNCGSCVPELRKLL

SEQ ID NO: 8478 - protein, 404 aa, Ralstonia metallidurans
YGGTSMGSTERIKNVAKRVAKWHRAGHRVVVVPSAMSGETNRLLGLAKEISAQPDPRELDMLASTGEQASVALLAIALHGEGIDAVSYTGWQVPVKTDSSYTKARIESIDDERILGDLDAGKVVVVTGFQGIDGDGNITTLGRGGSDTSAVAIAAAIEADECLIYTDVDGVYTTDPRVVEDARRLDQITFEEMLEMASLGSKVLQIRSVEFAGKYRVKTRVLSSLTDPLMPLEQEMHSGTLITFEEESEMEAAVISGIAFARDEAKITVLGVPDKPGIAYQILGPIADANIDVDMIIQNQSVDGKTDFTFTVPRGDYQRALTILNDNVKGHIGAESVSGDPKVSKVSVVGVGMRSHVGIASKMFRTLSEEGINIQMISTSEIKISVLIDEKYMELAVRALHKVF

SEQ ID NO: 8479 - protein, 223 aa, Ralstonia metallidurans
MASDRARAALAARLRAGGIRDERVLGAIATVPRHLFMEPGLASQAYEDAALPIGHQQTISKPSVVARMIELLREGMPSDHALARVLEIGTGCGYQAAVLSLVAQEVFSIERIRPLHEQAKANLRPLRVPNIRLHYGDGMLGLPQAAPFSSIILAAAGMEVPQALLEQLAIGGRLIAPVVAPSSGAPGQTVTQQLLLIERLNRHRFHRTALEAVFFVPLKSGTI

SEQ ID NO: 8480 - protein, 362 aa, Ralstonia metallidurans
IMSGNTLGLLFTVTTFGESHGPAIGAVVDGCPPGMSLTEADIQIDLDRRKPGTSRHVTQRQEADQVEILSGVFEGKTTGTPICLLIRNTDQRSKDYGNIVETFRPGHADYTYWHKYGIRDYRGGGRSSARLTAPVVAAAAIAKKWLNEQYGTEIRGYMSQLGEVEVPFTDWKHVPENPFFAANADIVPELETYMDALRRDGDSVGARIEVVASHVPVGLGEPLFDKLDADIAHAMMGINAVKGVEIGAGFDSVSQRGTVHGDELTPEGFRTNNSGGVLGGISTGQDIKVSLAIKPTSSIRTARESIDKAGSPASVETFGRHDPCVGIRATPIAEAMLALVLMDHALRHRAQCGDVRVDTPRI

SEQ ID NO: 8481 - protein, 326 aa, Ralstonia metallidurans
LSLAEVRELSLNVLQTNGYSEAHSKAITDVIVAGQRDECQSHGLYRLLVCVHTIRNGKVDGHAVPEVVDQAKAIVRVDARFGNSLLAFQTGLPHFIRKARECGLAAMAINRCFHFSALWPEVESLASEGLVAMAMTPSHAWVAPAGGTKPVFGTNPLAFAWPRPGRTPFVFDFATSAIARGDIELHRRQGKALPEGWAIDADGNPTTDPLAALKGAMLTFGGHKGSALSAMIELMAGPLIGDMTSAESMAFDASAGATPCHGELLLAFDPTVFLGDRASEYLEKAESLFEAITSQGARLPSQRRYAARARSDEAGVTVPRALYEDL

SEQ ID NO: 8482 - protein, 522 aa, Ralstonia metallidurans
LMCVDRLSVTFGEGEHATRAVREVSFDLRAGERYALVGESGSGKTVTALAMLRLVEDAHYQGSIRFEGEDLLQVSDREMRRIRGSEIAMIFQEPMTALNPLYTIGNQIVETLALHEGLDRRAARDRAIALLERTGITDAPNRFNSFPHQLSGGQRQRAMIAMALACRPKLLLADEPTTALDVTIRAQILDLLRDLQAEFGMAVMLITHDLNMVRAFAQRVGVMEKGVLVETGETAEVFSNPHHPYTRKLIDSRPRREVLPLVPLAPVLLETDALCVNYMKKRPGMAGWFLKEAFPAVKEVNLQLREGETVGIVGESGSGKTTLAHAVLALQRKSSGSIQFLGRSFDTCTGKERSALRSRMQVVFQDPFGSLSPRMTIEQIVEEGLALHQPGLSREATRERVIEALREVGLDRTALGRYPHEFSGGQRQRIAIARVLILKPQVLVLDEPTSALDVSIQQQVLALLSQLQHKYNLSYLFISHDLAVIRAMAHRVVVMKNGEVVESGETETVLGAPQHSYTRKLM

SEQ ID NO: 8483 - protein, 253 aa, Ralstonia metallidurans
MGFLAGKRILITGLLSNRSIAYGIAAACKREGAELAFTYVGERFKDRITDFAKEFGSDMIYECDVGSDEQIDATFAALGQRWEKFDGLVHSIGFAPREAIAGNFLDGLSREGFRIAHDISAYSFPALAKAAMPLLNDKASLLTLTYLGAERVVPNYNTMGLAKASLEASVRYLASAVGPRGMRANGISAGPIKTLAASGIKDFSRLLKHFEDVAPIRRNVTIEEVGNVAAFLLSDLASGVTGEITYVDGGYNI

SEQ ID NO: 8484 - protein, 585 aa, Ralstonia metallidurans
LPRRKFDVVIVGAGGAGMRASLQLAEAGLNVAVLSKVFPTRSHTVAAQGGIGASLGNMSEDNWHYHFYDTIKGSDWLGDQDAIEFMCREAPKVVYELEHFGMPFDRNADGTIYQRPFGGHTANYGEKPVQRACAAADRTGHALLHTLYQRNVRAKTHFFVEWMALDLIRDEDGDVLGVTALEMETGEVYILEAKTTLFATGGAGRIYAASTNAFINTGDGLGMAARAGVPLEDMEFWQFHPTGVAGAGVLITEGVRGEGGILRNKDGERFMERYAPTLKDLAPRDFVSRSMDQEIKEGRGCGPNGDYVLLDLTHVGAETIMKRLPSIREIGMKFANVDAIKEPIPVVPTIHYQMGGIPTNFHGQVVVPKNGNPNEVVNGFYAIGECSCVSVHGANRLGTNSLLDLVVFGRAAGNHIVANAMKQKEHKPLPADAADRAMARLAKLQGTTSGEYTQDVANDIRRNMQSHAGVFRTQKLMDEGVERILEVAERANNIHLKDKSKVFNTALVEALEVSNLVEVAKATMISAAARKESRGAHAHSDFPNRDDENWLKHTLFYSEGNRLDYKPVKMQPLTVESVPPKARTF

SEQ ID NO: 8485 - protein, 232 aa, Ralstonia metallidurans
KRIFEVYRYDPDKDAAPRMQTYEVELDGHERMLLDALVKLKKLDETISFRRSCREGVCGSDAMNINGKNGLACLTNMRELPDRIVLRPLPGLPVVRDLIVDMTNFFKQYNSIKPFLINDEPPPEKERLQSPQERDELDGLYECILCASCSTSCPSFWWNPDKFVGPAGLLQAYRFIADSRDQATSERLDNLNDPYRLFRCHSIMNCVDVCPKGLNPTKAIGKIKELMVRRAV

SEQ ID NO: 8486 - protein, 419 aa, Ralstonia metallidurans
GSPSVELPIYKGTVGPDVIDIRKLYGQTGKFTYDPGFMSTASCNSKITYIDGDKGELLYRGYPIEQLAQKCDHLETCYLLLKGELPNAKQKEEFVNSVMNHTMVHEQLQFFLRGFRRDAHPMAVLTGLVGAMSAFYHDAMDIDDPHQREISAIRLIAKMPTLVAMAYKYTMGQPYIYPQNDLSYSGNFMRMMFATPCAPYTVNPVLERALDRIFILHADHEQNASTSTVRLAGSSGTNPFAAIAAGVACLWGPAHGGANEAALKMLEEIGSVDNIGEFIKQVKDKNSGVRLMGFGHRVYKNYDPRAKLMRETCYEVLNELGLHNDPLFKLAMELEKIALEDEYFVSRKLYPNVDFYSGIVQRALGIPTSLFTCIFALARTPGWISQWEEMITDPEYKIGRPRQLFNGAAAREVPDLAKR

SEQ ID NO: 8487 - protein, 592 aa, Ralstonia metallidurans
VGIDLGTTNSLVAAVRNSIPEVLPDEHGRALLPSVVRYLPNGNAHIGYKAQDEAVRDPKNTIISVKRFMGRGVRDVANIEHSLYDFVDAPGMVQLKTAAGIKSPVEVSAEILATLRQRAEDSLGDELVGAVITVPAYFDDAQRQATKDAAQLAGLEVLRLLNEPTAAAIAYGLDNAAEGIYAVYDLGGGTFDISVLKLTKGVFEVMSTGGDSALGGDDFDQRLLCWIVEQVGLQPLSAEDSRLLMVRARAAKEALSSSDSTVIDAVLTSGEIVHLTLDADTFIQITANLVQKTLTPVRKALRDAGVGPEDVKGVVLVGGATRMPAIRRAVGDYFGQQPLTNLDPDRVVALGAAMQANLLAGNHAPGEDWLLLDVIPLSLGVETMGGLVEKIVPRNSTIPVARAQEFTTFKDGQTAMAIHVLQGERELASDCRSLARFELRGIPPMVAGAARIRVTYQVDADGLLSVSARETGSGVEASVSVKPSYGLADDDIARMLQESFQEAEHDMKNRALAEERVEAARLVEATTRALETDGNLLSADERAAVDELMANVSEIAKGEDHRAIKAAVERLSQGTDEFAARRMDRSIKSALA

SEQ ID NO: 8488 - protein, 332 aa, Ralstonia metallidurans
YPLLRPALFSMDAEDAHHFTLNNLMRAKRMGLAGCIGNSIADDPRTVMGVRFPNPVGLAAGLDKDGAYIDGLAAFGFGFIEVGTVTPRAQPGNPRPRMFRLPQADALINRMGFNNGGVDAFIRNVQASRWKAEGGVLGLNIGKNADTPIERAADDYLYCLERVYPHASYVTVNISSPNTKNLRQLQGASELDSLLSTLKAAQQRLADQHKRYVPVALKIAPDLDDDQVRNIGDALVRHKIDGVIATNTTISRDAVKGLPHAEEAGGLSGRPVFEASTRVVRALREVIGDALPIIGVGGIFSGADARAKIDAGAQLVQVYSGLIYRGPTLVRE

SEQ ID NO: 8489 - protein, 256 aa, Ralstonia metallidurans
SIMTTDTQPKAASRTVQIDGKTVTLSGISKGAGMIRPNMATMLGFIATDAAVAQPVLQKLVSHAADHSFNSITIDGDTSTNDSFVLIASGKAGVTIDRAEGAAFEALRDAVTALAQELAQAIVRDGEGATKLMTIRVEGGKNVAECRQIAYAVAHSPLVKTAFYASDPNLGRILAAIGYAGVNDLDVDRVNLWLDDVWVARDGGRNPEYREEDGQRVMKQAEITVRIALGRGDAEATVWTCDLSHDYVSINADYRS

SEQ ID NO: 8490 - protein, 713 aa, Ralstonia metallidurans
MNSSSRRNFLKMAGSSAAATAALAAFPPAIRRALAIPANNATKSIRDVEYVVILTQENRSFDHYFGTMNGVRGFSDRFPIPLPGGRNAFQQTYASNNINRVVLPYHLDQTAGNAQRVSGTPHSQPDAQAAWDLGRMSAWPTAKKTQSMGYYTEQELGFQYALANAFTLCDAYHCGFHGGTNTNRLFQWTGTNDPFGKNGGPVIDNSGDSLDATGVNYTWTTYPERLQAAGVTWKVYQNMPDNFTDNPLAGFKQYRAANAALGNAANGSPYTPYTPANDTVNPLFKGIGNTMPDGGFLQALRDDIAAGTLPQVSWIVAPATYSEHPGPSSPVQGAWYTQQLLDALTANPAIWSRTVLLINFDENDGFFDHVPPPCAPALDATGNPVGYTTMDASTEYYSVDKTPFGPGPRVPMYVVSPWSRGGWVNSQAFDHTSILRFIEQRFGVAETNISAYRRAIMGDLMSAFDFINPNSNTALAFTPLQKTDADTLRAAQDAKAQIPAPTVAAQSMPTQKNGTRPSRALPYTLHTSGFEDPSTNTVWLRFKNDGTQAAVFHVYDRLHLGDVPRRYAIEAGKSYDAKLDVSRDSGRYDLWVLGPNGYHRAFVGDISAQKAAGGGAAPEIRVCYDEANAQVWLTLINRGSATCTFTVKPNAYRNDGPWTFEVPAGKEVDQHWPVGSQGNWYDFTVTTQQGGFMRRFAGRLENGTHTVSDPAMG

SEQ ID NO: 8491 - protein, 422 aa, Ralstonia metallidurans
GVGKFQYRLFVIFGLVWLADAMQVLSIGFSAPSIAKTFGITMPQALQTGTLFFVGMLVGAIVFGRLADRIGRRPVLMIAIVIDALSGIASAFAPELSWLLVLRFLTGVGVGGTLPVDYTMMAEFLPSDRRGRWLVLLESFWAIGTICLAVLALVALSHGDQAWRVIFLVTGIPALIGVVLRFYIPESPMYLNRSGRSDEARKVLQRVAKTNGRNVEIPALQSDIVAPKSVLTLFSGTFRRRSFALFAAWALISIAYYGVFVYLPIKLGAEGFAFMRGQVFLVVLAIVQLPGFALSAYGVERWGRKPTLIGFLLLSAVGCMLYSLGTSPTVVVGSTLLMSFALLGTWGALYAFTPEVYPTDLRATGMGAAGAVARFGGLFAPAIIAPVMATHFTLALALISSMLLAGAFAIGMVNVESKDRAL

SEQ ID NO: 8492 - protein, 195 aa, Ralstonia metallidurans
HGETAWNRERRLQGQLDIPLNDTGRAQARALAEALAGEPIDAVYSSDLGRAMQTAAPLAETLGLQVRPERRLRERCYGDLEGMTYAEVAEKRPEDFARWQARVPDYAPPEGESLREFHDRAVEVALYLSRRHPGERIALVAHGGVLDCLYREAAGMTLEAPREHELLNASVNRLRCDTAHLTLLQWADVSHLEAL

SEQ ID NO: 8493 - protein, 533 aa, Ralstonia metallidurans
ATMHRIAVYTEHEDGRRASHTYAHIQAEANRLSRALRELGVQRGDRVAIVMPQRIETVIAGMAVYQLGAVAMPLSMLFGPEALSYRIDHSETRVAIADETSIDNMLAARPDCPTLRTVIGVGDATGRGDLDWDTLLAAQIPEFTAEQTKAEEAAVLIYTSGTTGPPKGAVIPHRALIGNLTGFVCSQNWYPQDDDVFWSPADWAWTGGLWDALMPALYFGRPIVGYQGRFSAERAFELLERYGVTNTFLFPTALKQMMKACPTPSDHYQLKLRAIMSAGEAVGETVFTWCRDALGVIVNEMFGQTEINYIVGNCTAQYDESRLGWPARPGSMGRPYPGHRVAVIDEDGRPCPPGEDGEVAVCATDIHGHPDPVFFLGYWKNEAATAAKYSEYDGLRWCRTGDLARIDADGYLWYQGRADDVFKSSGYRIGPSEIENCLLKHPAVSNCAVVPSPDPERGSIVKAFIVLTPSVTRSFDNDAALIAELQQHVRGQLAPYEYPKAIEFIDQLPMTTTGKIQRRVLRLQEQERAEKPA

SEQ ID NO: 8494 - protein, 429 aa, Ralstonia metallidurans
MSAIVDIIGREVLDSRGNPTVECDVLLESGVMGRAAVPSGASTGSREAIELRDGDKSRYLGKGVLKAVEHINTEISEAIMGLDASEQAFLDRTLIELDGTENKGRLGANAMLAVSMAVAKAAAEEAGLPLYRYFGGSGAMQMPVPMMNIVNGGAHANNSLDIQEFMIMPVSQTSFREALRCGAEVFHALKKILSDKGMSTAVGDEGGFAPNFSSNEECLNTVVQAIEKAGYKAGEDVLLALDCAASEFYHEAEGVYSLEGEGLKLTSTQFADYLANLCDKFPIVSIEDGMAEGDWEGWKTLTDKLGKRVQLVGDDLFVTNTKILKEGIEKGIGNSILIKINQIGTLTETFAAIEMAKRAGYTAVISHRSGETEDSTIADIAVGTNAGQIKTGSLSRSDRISKYNQLLRIEEDLGDIATYPGKSTFYNLR

SEQ ID NO: 8495 - protein, 390 aa, Ralstonia metallidurans
HETMSFQAEVKQLLHLMIHSLYSNKEIFLRELVSNASDATDKLRFEAIANPALLENDADLAIRIEADPAARTLKITDNGIGMSRDEAIRNLGTIARSGTKEFFQQLSGDQQKDAALIGQFGVGFYSAFIVADKVTVETRRAGLAADEAVRWESAGDGEFSIDAINRAERGSTITLHLREGEDDFLSSYRLQNIIRKYSDHISLPIRMPKEEWDAEAQQQKVTGEWESVNQASALWTRSKSDITDEQYQAFYQHIAHDHEAPLAWTHNRVEGRSEYTQLLYIPARAPFDLWDRNHKAGLKLYVKRVFIMDDADQLLPAYLRWVKGVVDSADLPLNVSRELLQESRDVKAIREGCAKRVLSMLEAMADSEDEAERAKYKTFWEQLGQVLTEG

SEQ ID NO: 8496 - protein, 214 aa, Ralstonia metallidurans
NMLRIWGRLSSINVQKVVWCARELHLDHERIDIGNQKGELDTEAYVRLNPNRLIPVIEDFRDTDVAGEPFVLWESNAIVRYLCARYGEDTLWPSDVKARASADRWMDWQTTTFSPAMVQAFLQLVRTPADKRDEAVIEKSCERTEPLAKMLDDALEGREFIGGDRFTMADVSLACAAHRWMGMPKAHTARPNLERWLAAMRARPAATGILELPL

SEQ ID NO: 8497 - protein, 721 aa, Ralstonia metallidurans
AKCPFLHPAGAGRALQEWWPERLNLHILRQNAPLSDPMGEAFDYAKAFNSLDLAAVKKDLEALMTDSQSWWPADFGHYGPLFVRMAWHAAGTYRIGDGRGGAGAGQQRFAPTNSWPDNVSLDKARRLIWPIKQKYGRKISWADLIVLTGNVALESMGFKTFGFGGGREDVYEPDESVYWGNEAEWLADKRYSGNRNLENPLAAVQMGLIYVNPEGPNGNPDPVAAAIDIRETFRRMAMNDEETVALIAGGHAFGKTHGAGPASHVGPEPEAAGLEEQGLGWRSSFGTGKGGDAIGSGLEVIWTTTPTKWSNDFFKHLFEYEWELTKSPAGAHQWKPKGNAGAGTVPDPADPSKRRSPSMLTTDLSLRFDSIYGKISRRYYDHPDELADAFARAWFKLTHRDMGPRARYLGPEVPKEELLWQDPIPPVDHPLIDAKDVAALKAKVQASGLTVPQLVSTAWASASTFRGSDKRGGANGARIRLAPQKDWDVNQPAELAKVLVKLESIQSEFNKAQSGGKKVSMADLIVLAGCAGVEQAAKSAGQDVTVPFSPGRMDTTQEKTDLDAMVVLEPIADGFRNYLQGKFSVRAEALLVDKAQLLKLTVPEMTALVGGLRVLGANFGNSQHGVFTKRPGTLTNDFFVNLLDMGTEWKPVSEEREVFEGSDRATGTPRWTGTRVDLVFGSNSELRAVAEVYGAADAQEKFVQDFVAAWSKVMNLDRFDL

SEQ ID NO: 8498 - protein, 226 aa, Ralstonia metallidurans
LGTALVTGASSGIGAIYADRLARRGYDLILVARNRDKLDTLARRITDDTQRVVEVFPADLNDRQSLARVEEKLRQDASITLLVNNAGVGTHTPLLDSDVDAMNRMIDLNVTALTRLTYAAVPGFVARGRGAIINISSIVGIAPEILNGVYGGSKAFVLAFSQSLHHELAAKGLRVQAVLPGATATDFWETGGLPIEHLDKAIVMPAEAMVDAALVGFDRGELVTIP

SEQ ID NO: 8499 - protein, 471 aa, Ralstonia metallidurans
FVANRLIAPDSGLRIKVFDPSSGQPFAEIARGNATDINVAVHAARRAFDGAWGAMSPADRVRLLNRVALTLIEHEDELAALEARDTGKPLRQARADARAVARYFEFYAGAADKLHGQTIPYQAGYTVLTVREPHGVTGHIIPWNYPLQIFGRSVGAALAAGNACVVKPAEDACLSLLRVAELAAEAGLPEGALNIVTGYGHEAGAALARHPDINHISFTGSPETGKLVSQLAAENHVPVTLELGGKSPQIVFADADLDALLPVVVNGIVQNAGQTCSAGSRLLVERPVYEELLDRVASVFESLRVGPSELDLECGPLISRKQQQRVWDFVSDAQHAGISVMAQGQIVAEAPESGYYQVPMLFRDVPATHRLAQEEVFGPLLAAMPFDTEDEALQLANGTAYGLVAGVWTRDGGRQLRLARKLRAGQVFINNYGAGGGVELPFGGTGQSGYGREKGFEALYGFTTLKTIAIQ

SEQ ID NO: 8500 - protein, 250 aa, Ralstonia metallidurans
LSGKVAVVTGGGSGFGEGIAHTFAREGASVMVADLNLEAAERVAVAIREAGGQARAVRADVSQGDDVAAMRDATLAAFGDVHCVVNNAGTTHRNKPILEVTEAEFDRVYAVNVKSIYWSAHHFIPHFRKRGGGNFVNVASTAGIRPRPGLVWYNGSKGAVIVASKAMAAELGPDNIRVNCVNPVIGATGLLEQFMGLPDTPENRAKFLATIPMGRMSTPQDVANACLYLASDEAAFITGTCIEVDGGRCV

SEQ ID NO: 8501 - protein, 417 aa, Ralstonia metallidurans
MSSTTQSQHGFRTVFRVVSGNFLEMYDFMVYGFYAAAIARTFFPSDNEFASLMLSLATFGAGFLMRPLGAIILGAYIDHHGRRKGLILTLILMAAGTLLIAVVPGYAAIGVAAPLLVLFGRLLQGFSAGVELGGVSVYLSEIAKPGKKGFYVAWQSASQQVAVIFAGLLGVILHATLAPAQMDSWGWRVPFLIGCLIVPFLFIIRRSLEETEEFRTRKHRPSVNEIYRSMLDNWGIIIAGCMMVVMTTVSFYMITAYTPTFGKTVLKLDDVDNLIVTMCVGLSNFIWLPLMGAVSDRIGRKPLLVFFTIATLVTAYPAVSWLVAAPSFERLLMVELWLSFLYGSYNGAMVVTLTEVMPPAVRTAGFSLAYSLATALFGGFTPAISTYLIHATGNKAAPGLWLMFAAACGLVATIIIF

SEQ ID NO: 8502 - protein, 206 aa, Ralstonia metallidurans
MIDAYTWPTPNGHKVHIMLEECGLEYRVHPINIGAGDQFGEDFLKISPNNKIPAIVDTDGPDGQPISLFESGAILLYLAGKTGKFLPEDVRGKYEALQWLMFQMGGVGPMLGQAHHFRIYAPEKIEYAVNRYTNEAKRLYGVIDKQLSTHKYLAGDTYTVADIATFPWLRSWQNQGVELDDYPHLKRWFNDIAERPAVKRGVEVLA

SEQ ID NO: 8503 - protein, 169 aa, Ralstonia metallidurans
MTTQIETAILAGGCFWGMQDLLRRYPGVLSTRVGYTGGDVPNATYRHHGTHAEGIEIAFDPSQISYRQILEFFFQIHDPTTKNRQGNDVGTSYRSAIFYLNDEQKQTAEDTVADVNASGLWPGKVVTEIAPAGPFWDAEPEHQDYLERYPNGYTCHFIRRAEAAEARLR

SEQ ID NO: 8504 - protein, 958 aa, Ralstonia metallidurans
DRRSFLKRSGIGVGAGLAATQLTMMRRADADDGKGGAGGKGDIVVRRTVCGHCSVGCAVDAVVQNGVWVRQEPVFDSPINLGAHCAKGAALREHGHGEYRLKYPMKLVNGKYQRISWDQALDEISAKLKQIRQETGPDSLFFIGSSKHSNEQSYLLRKWVSFFGTNNTDHQARICHSTTVAGVANTWGYGAMTNSYNDMQNAKAALYIGSNAAEAHPVSMLHLLHAKESGCKVIVVDPRYTRTAAKSDHYVRIRSGTDIAFLFGVLYHIFQNGWEDKKYLSDRVYGMDKVKEEVLAKWTPDKVEEVCGVPEAEVRYVAETMAKNRPSTLVWCMGQTQHTIGNAIVRASCIVQLALGNIGVSGGGANIFRGHDNVQGATDVGPNPDSLPGYYGLAAGAWKHFAAVWGVDYEWIKKQFASQAMMEKSGTTVSRWIDIVTEKPELIDQDHNVRGVFFWGHAPNSQTRGLEMKRALDKLDLLVVIDPYPSATAAMANMPATEGDTPNPNRAVYLLPACTQFETSGSCTASNRSLQWREKVIEPLFESMPDHAIMQAFAEKLGFANELSKNYKLVEVKRAGRTWREPETESILREINAGNWTIGYTGQSPERLKAHMRNMHMFDVRSLRCKGGKDPVTGYDITGDYFGLPWPCYGTPELKHPGSPNLYDTSRNVMDGGGNFRANFGVERDGVSLLAADGSHSLGADITTGYPEFDAVLLKKLGWWDELTDAEKKAADGKNWKTDLSGGIQRVVMKNHGCHPFGNARARAVVWNFPDPIPQHREPLYSTRPDMVAKYPTHDDKMAFWRLPTLYKTVQQRNIENKVYEKFPIILTSGRLVEYEGGGEETRSNPWLAELQQENFVEINPKAASERGIRNGDYCWVKTPTGARIKVRALVTERVGVDTAFIPFHFSGWWQGKDLKPYYPEGAMPIVRGEAVNTATTYGYDSVTMMQETKTTVCQIER

SEQ ID NO: 8505 - protein, 283 aa, Ralstonia metallidurans
PTPLITATELDQLRAAGKPRVVVFDCSFDLTNPAAGRDSYQQGHIPGAYYLHLDNELSGPKTGLSGRHPLPDAELFAARLRVLGVDDDTLVVAYDGQGSMYAARLWWMLRWIGHAAALVLDGGRNAWVAAGLPLEHGATAEPEIGGNLMRRASLVKTVDADALVANLSQPSLLVVDARAADRFRGENETLDPVGGHIPGAANRFFKDNLTADGYFKPADQLRADFGQVFTGKAPAQTVMQCGSGVTACHNLLALEVAGLTGAALYPGSWSEWCADPKRPVATG

SEQ ID NO: 8506 - protein, 291 aa, Ralstonia metallidurans
SDFATWMRAQGARTEAALEAALPSTDTIPYTLHEAMRYAVLGGGKRVRPLLVHAAGEVVGATPEACDAAACAVEMIHAYSLVHDDMPCMDDDDLRRGRPTVHKAYDEATALLVGDALQSQAFIVLAQTPALAAEARLKVVAELAVASGSIGMCGGQAIDLQNVGKAMTREALEGMHRMKTGALLRASVRMGALCGNIDQAGLVALDRYAAAVGLAFQVVDDILDVTADTATLGKTAGKDAANDKPTYVSLLGLDAARELAAQLRTDAHEALEGFGTRAGRLAELADLIVLR

SEQ ID NO: 8507 - protein, 618 aa, Ralstonia metallidurans
YTLLNKIDDPADLRKLDRRQLDTLAEELRAYVLESVSQTGGHLSSNLGTVELTIALHYVFDTPNDRVVWDVGHQSYPHKILTGRRDRMSTLRQYGGISGFPRRAESEYDTFGTAHSSTSISAALGMALGARTRGEKRVGIAVIGDGAMTAGMAFEAMNNAGVYKDLPMLVVLNDNDMSISPPVGMLNKHLARLMSGQFYAATKKGIEKVLSVAPPVLEFAKRLEEHAKGMVVPATLFEEFGFDYVGPIDGHDLESLVPTLQNIRQRALEGHGPQFLHVVTKKGQGYKLAEADPILYHGPGKFNPAEGIRPSAKPSRKTYTQVFGEWLCDMAAADKRLIGVTPAMREGSGMVEFEKRFPDRYYDVGIAEQHAVTFAGGLACEGLKPVVAIYSTFLQRGYDQLIHDVALQNLPVVFALDRAGLVGADGATHAGVYDIPFLRCIPNMMVMVPADENECRQLLTTAFQQDCPTAVRYPRGAGVGVATQPELTALPVGKGEIRREGHARAGQRVAIMAFGSMVHPALTAAEQLDATVANMRFVKPLDVELVKQLAANHDFLVTVEEGATMGGAGSAVLEALAEAGIELPTLVLGLPDKFIDHGDPAHLLSLCGLDAAGIERSV

SEQ ID NO: 8508 - protein, 246 aa, Ralstonia metallidurans
KLVLIRHGESTWNLENRFTGWVDVDLTDTGAAQAKQAGTLLKEAGFAFDVAYTSVLKRAIRTLWHVQDEMDLMWIPVRNEWRLNERHYGALAGLNKAETAKKYGDEQVLVWRRSYDTPPPALEPTDERASFGDPRYANVPRAEIPLTECLKDTVARVMPLWNESIAPDIKSGKRVVIAAHGNSIRALVKYLDQISDDDIVGLNIPNGTPLVYELDADLRPLRHYYLGDQEAIAASLAAVASQGKAR

SEQ ID NO: 8509 - protein, 397 aa, Ralstonia metallidurans
MDLLLTPELVEFRDTVRAFLREHLPAELRRGQQLTTAMYPEPEISGPWQARLRERGWLVPLWPREWGGTGWSSIERFIFETECALAGAPLVHPMGVRLVGPVILRYGTEAQKQTYLSRILSGQDYWCQGFSEPGAGSDLASLRTRAVRDGDHYVINGSKLWTTHAHHANRMFALVRTSTEGRRQEGISFILIDMETPGISVRPIPTIGGDHDVNEVFFDNVRVPVANRIGAENEGWQCARYLLEFERGAGIFSPRLRSQLKRIGDVLAREAQCDGDTTVTALRRLRFGEVRADLDAFEMLELKTMCSVAPGESPGPVASVLKLRASRLRQAISEMGTTVVGAESLRWRADDAHDEEPSEDEVLRACLLPDFLNARAYTIFGGAAEVQLGIIAKSCLG

SEQ ID NO: 8510 - protein, 289 aa, Ralstonia metallidurans
TGSIVAIVTPMHEDGSLDFPALRALIDWHAAEGTDGIVIVGTTGESPTVNVDEHCELIRVAVEQSAGRVPIIAGTGGNSTSEAIELTAFAKKVGANASLQVVPYYNKPTQEGMYRHFRTIAEAVDLPVVLYNVPGRTVADMNNDTILRLAQVPGIVGVKEATGNIDRAAQLINGAPEGFAIYSGDDPTAVALILLGGHGNISVTANVAPRKMHEMCVAALKGDVVTARRLHMELIDLNRAMFVEANPIPVKWALQQMGKMEGGIRLPLTPLAEGQHETVRRALAAAGLL

SEQ ID NO: 8511 - protein, 568 aa, Ralstonia metallidurans
QFDKPRAQDSVTYSQFMDDAKNGKVVCVSTMQGRNLVVSPKEGSKYTIISPGDIWMVGDLMKYGVQVTGKADDEPNVLVQALYYLGPTLLIIVFWFYMMRQMQGGGKGGAFSFGKSRARLIDENQNAVTFADVAGCDESKEEVVELVDFLKDPQKFQKLGGRIPRGVLLVGPPGTGKTLLARAIAGEAKVPFFSISGSDFVEMFVGVGAARVRDMFENAKKQAPCIVFIDEIDAVGRHRGAGMGGGNDEREQTLNQMLVEMDGFEANSGVIVIAATNRADVLDKALLRPGRFDRQVYVGLPDIRGREQILKVHMRKVPIGNDVDASIIARGTPGFSGADLANLVNEAALFAARRSKRVVDMQDFEDAKDKIYMGPERKSTVMREEERKATAYHESGHAVVAKLLPKADPVHKVTIMPRGWALGVTWQLPEHDKYSKYKDNMLEEIAILFGGRAAEEVFLNAMSTGASNDFERATKIARDMVTRFGMSDSLGAMVYVDTEQDGMFGKLSSKTVSEATQQKVDAEIRRIIDDQYALAKRLLEENRDKVEAMTNALMEWETIDAEQVNDIM

SEQ ID NO: 8512 - protein, 445 aa, Ralstonia metallidurans
RKYFGTDGVRGRVGDAPITPDFVMRLGHAAGKVLALGQKTSQGKPTVLIGKDTRISGYMLEAALEAGFTAAGVNVLLTGPLPTPGIAYLTRTLRLAAGVVISASHNPYYDNGIKFFSASGDKLPDDVESQIEAMVEEPMTCVHSDELGRARRIDDAAGRYIEFCKSTFPYEHDLHGLKIVVDCANGAAYHIAPHVFHELGAEVISIGNQPNGRNINAGYGATAPEKLIEAVKANGADLGLAFDGDADRLQVVDADGRLYNGDELLYLIVRDRQASGQRVEGAVGTLMTNMAVELALKRLGVSFVRAKVGDRYVLEELNRHHWQLGGEGSGHLLCLDRHTTGDGIVSALQVLAALRRSGKTLPQLLDGVSLFPQTLINVRVEKGFDWQNHAGLKAVRDRVEPELEGRGRVLIRASGTEPVVRVMVEAEQVETAERAAQELAAALRA

SEQ ID NO: 8513 - protein, 342 aa, Ralstonia metallidurans
TGCTMVVEKSTVAVGTADRVSAVIREELVERGLEELQFSSVSNPRVLKEGAAVEDFMRPDRIVLGCAPDVAGRHAQAIMRQLYSPFNRNHERTFYMDVRSAEFTKLRRNSMLATRISFMNELANLADEVGADIELVRLGIGSDPRIGYSFLYAGAGYGGSCFPKDVQALMRTASAHGKPMRVLEAVEAVNDSQKQVLGDKIIKRFGEDLTGKTFGVWGLAFKPNTDDMREAPSRVLAREMISRGASLRVHDPVAMDEARRVLELDLADIPDAMARIQFCNAQMDVLKDADALVIVTEWKVFRSPDFSQIRNMLKTPVIIDGRNLYEPDAMAEAGIEYHAIGR

SEQ ID NO: 8514 - protein, 405 aa, Ralstonia metallidurans
KRVVVTGAGAVSAIGNDWATVRERLAAGRNAIVVMPDWREIRGLNTHIAAPVPPFTLPPHYTRKLMRTMGRVSQMAVLATESALAGAGLAGHPLVTGGQMGIAYGSSTGTPSAAQDFARMMSDRTTEGVNATTYIRMMSHTAAVNIGVFFGIKGRILTTSSACTSGSHGIGYAYETIRMGRQVAMVAGGAEELDATEAAVFDTLFATSTRNDAPTATPRPFDAARDGLVLGEGACTLVLEELEHARQRGAPILAEIVGYGTNSDGVHVTQADAGTMALAMRMALDDAGVSPDRIGYVNAHGTATDQGDIAESQATHAVFGARMPISSLKSYVGHTLGACGALEAWMTIEMMRDGWFAPTINLENPDPRCAQLDYIVGEGRAIDTEYVMSNNFAFGGINTSLVLRR

SEQ ID NO: 8515 - protein, 238 aa, Ralstonia metallidurans
QTVLVTGSSRGIGRAIALRLARDGYDVVIHCRARRNEAESVADAVRAFGRNARVLCFDVGQREAAASALLADIDHHGCYYGVVCNAGLARDAAFPAMSGEEWDEVIHTNLDAFFNVLNPVVLPMVQRRRPGRIVTLSSASGIVGNRGQTNYSAAKAGVIGATKALAIELAKRQITVNCVAPGLIDTEMIEEHVREEAMKMIPARRMGTPDEVAATVAFLLSPDAGYITRQVISVNGGM

SEQ ID NO: 8516 - protein, 315 aa, Ralstonia metallidurans
MSSLICGSVAYDTIMTFDGRFREHILPDQIHMLNVSFLVPGMRREFGGCAGNIAYTLKMLGGDPIVMATVGQDAEPYLQYLRNLEIRTDHIRVLPETFTAQAMITTDLDNNQITAFHPGAMGQSQLNRVQDALATGNRPAVGIVAPDSREGMLHHAQQFAAEGIPFIFDLGQAMPLFNGEDLRQFIELASYVTVNDYEAQVLLSRTAWTSAEVAAKVRAFIVTHGERGASVFADGKQYAIPAVPAERVVDPTGCGDAFRGGLLHGIENGMDWETTGRLASLMGSLKIAQQGPQNHWMSCDEIGSRFQSVFGYRYA

SEQ ID NO: 8517 - protein, 444 aa, Ralstonia metallidurans
MFDKILIANRGEIALRIQRACRELGIKTVVVYSEADKDAKYVKLADEAVCIGPAPSPLSYLNMPAIISAAEVTDAQAIHPGYGFLSENADFAERVEKSGFVFIGPTSENIRLMGDKVSAKQAMIKSGVPCVPGSDGALPDDPKEILATARRVGYPVIIKAAGGGGGRGMRVVHTEAALLNAVNMTREEAGRAFGNPEVYMEKFLENPRHVEIQILADQHRQAIWLGERDCSMQRRHQKVIEEAPAPHIPRRLIERIGDRCAEACKKIGYRGAGTFEFLYENNEFYFIEMNTRVQVEHPVTEMITGIDIVQEQIRIAFGEKLRLRQKDVELRGHAIECRINAEDPFKFTPSPGRITAWHMPGGPGVRVDSHAYDGYFVPPNYDSMIGKIITYGATRDQAIARMRIALSEMVVDGILTNVPLHRDLMLDANFVEGGTSIHYLEHRL

SEQ ID NO: 8518 - protein, 142 aa, Ralstonia metallidurans
VLVLHGPNLNLLGTREPQTYGHTTLDDINEALAKRAAEAGIELDTFQSNHEGALVDRIQAARGEGVDFIIINPAAYTHTSVAMRDALAGVAIPFVEVHLSNVHRREPFRHHSYFSDQAIGVICGLGWQGYLLALDYALAQEQ

SEQ ID NO: 8519 - protein, 258 aa, Ralstonia metallidurans
SFSVLLQRLAPLHLLTRIAGQLADCRQPWLAQYLIRTFVRRHKIDLDEALVSDLATYPTFNEFFIRALRPGARPIAAADWTSPVDGTISQIGRVEAGQMIHAKQHAYSATALLGDAALAKQLEGGCFSTVYLSPRNYHRIHMPCEGRLLGMRHVPGKLYSVRPDIVEGIDGLLAINERLVCWFEHPQHGVFALVLVGAAIVGRIATVWHGLVEPKRSGQVSEWHYADGASAPQLKDLLQGVEMGHFQLGSTIVLLMPG

SEQ ID NO: 8520 - protein, 141 aa, Ralstonia metallidurans
MAIERTLSIIKPDAVAKNVIGQIYARFEAAGLKVVAAKMVHLSRGEAEQFYAVHKARPFFKDLVDFMVSGPVMIQALEGESAIAKNRDLMGATDPKKAEKGTIRADFADSIDANAVHGSDAPETAAVEVAFFFPGMNVYSR

SEQ ID NO: 8521 - protein, 410 aa, Ralstonia metallidurans
VSRRRVVVTGLGLVSPVGNTVAEGWANLVAGKSGIATITKFDHSPFAVHFAGEVKGFNAEDYIPAKEARNMDTFIHFGIAAGSQALKDSGLEVTEANAERIGVLVGSGIGGLPMIEDTQMTLAERGPRRISPFFVPGSIINMISGHLSIIHGLKGPNLAAVTACTTGLHSIGLAARLIQAGDCDAMLAGGAESTVSPLGIGGFAAARALSTRNDDPAAASRPWDKDRDGFVLGEGAGVMMLEEYESAKARGARIYAELIGFGMSGDAFHMTAPNTDGPRRCMVAAIKDAGINPDEVQYLNAHGTSTPLGDKNETDAVKLAFGDHAYKMVVNSTKSMTGHLLGGAGGLESVFTVLAIHNQISPPTINIFNQDPECDLDYVANTARDMKIDVAVKNNFGFGGTNGTLVFRRV

SEQ ID NO: 8522 - protein, 75 aa, Ralstonia metallidurans
MDNIEQRVKKIVAEQLGVAEADIKNESSFVNDLGADSLDTVELVMALEDEFGMEIPDEEAEKITTVQQAIDYATA

SEQ ID NO: 8523 - protein, 244 aa, Ralstonia metallidurans
LENQVALVTGASRGIGRAIALELARQGATVIGTATSESGAAGISEYLAGEGLKGGGVVLNVNDAARCEAVIDEIIKANGGLNVLVNNAGITQDQLAMRMKDEDWSAVIDTNLTAVFRLARAVLRPMMKARGGRIINITSVVGSTGNPGQMNYAAAKAGVEGMTRALAAEIGSRNVTVNCVAPGFIDTDMTKVLSEEQHAALKTRIPLGRLGQPEDIANAVAFLAGPQAAYITGTTLHVNGGMYM

SEQ ID NO: 8524 - protein, 306 aa, Ralstonia metallidurans
KFAFVFPGQGSQSVGMLNAFADNPVVRATLEEASTALGQDIGKLIAEGPAEELNLTTNTQPVMLTAAVAVYRAWLDAGGPAPALVAGHSLGEYSALVAAGVIPFAEAVPLVRFRAQAMQEAVPVGEGGMAAILGLSDDDVRAACAEAAAAGAGVVEAVNFNAPSQVVIAGNKGAVEKACEIAKAKGAKRALPLPVSAPFHSSLLKPASDRLRERMAGLSFSAPAIPLVNNVDVAIISDPAQIKDALVRQAAAPVRWVECVQKIAAEGVTHVIECGPGKVLAGMTKRIDGNLVGGAIFDPASLQETL

SEQ ID NO: 8525 - protein, 334 aa, Ralstonia metallidurans
FSRDLWRQAAELGFTGVLIDEAYGGSGLGVVEAGIIAEAIGATLAPLPFLSTSVLGASLLGLFGSDTQRSALLPEMASGRHLTALALDEGSKHRPERITLLARRHGDGYMLDGSKVFVVDGHVADTLIVAAKDAQAGPDGDISLFLVPRDNAGVRVERCVIADATNAARVTFEGVRVPAYALLGRAGNGAAMLDKVLDIARAVLSSELVGIADATFARTLAYLKERSQFGKQIGEFQALQHRAAHLFAEIELARAAVLQCQQRLDAGRSDGPEPLVCVAKAKAGTTATLAVQEGVQMHGGIGMTDELDIGFYMKRARTAQEWLGDANWQLNRWA

SEQ ID NO: 8526 - protein, 468 aa, Ralstonia metallidurans
LDLCRAAIGSQNVLTDPADKAPYLTDWRRRYTGDALAVLRPGSTEEVAAVMRACHAHKLAVVPQGGNTGLCGGATPEPGDAAARGTVVLSLQRMNRVRQVDPLNNTITVEAGVILQQLQEAAQTHGRLFPLSLAAEGSCTIGGNLSTNAGGTAVLRYGNTRELCLGLEVVNIKGEVWDGLRGLRKDNTGYDLRDLFIGAEGTLGIITAAVMKLFPAPRARVTALAAVESPRAALALLAIAQSHAGAMLTGFELMSAMCMDLVTKHYPQLRYPFTAHHPQLVLLELSDSESEEHARTIFEKMMEVAFEAGVVKDAVVAESVQQSRDFWNLREHIPLAQVEEGKNIKHDIAVPISRVADFIETTDTLLQDAFPGARMVTFGHLGDGNLHYNVSPPVGVDHDQFLSHQDAINLIVHNSVHVHNGSISAEHGLGQLKREENRRYKSEVELAMMRAIKQALDPQGLMNPGKVV

SEQ ID NO: 8527 - protein, 422 aa, Ralstonia metallidurans
FDTLALHAGAAPDPTTGARATPIHLTTSFVFRDSEHAASLFNMERAGHVYSRISNPTVAVFEERVAALENGAGAIATASGQAALHLAVATLMGAGSHIVASTALYGGSHNLLHYTLRRFGIETTFVNPRDIDAWRAAIRPETKLLFGETLGNPGLDVLDIATVAQIGQEHGIPLLVDSTFTTPYLLRPFDHGAGLLYHSATKFLGGHGTTIGGVLSEGGTFDFQASGRFPELSEPYEGFHNMVFTEESTVAPFLLRARREGLRDFGACMNPMAAWQLLQGIETLPLRMSRHVDNTRRVVQFLASHPMVESVAYPELESHPDYELAKRLLPRGCGAVFSFNLKADRTAGQRFIESLSLFSHLANVGDARSLVIHPASTTHFRMDAAALRAAGIGEGTIRLSIGLEDPDDLIDDLKRGLKAAEK

SEQ ID NO: 8528 - protein, 887 aa, Ralstonia metallidurans
LGTGGRGQYYSLPQLGKALGVKIERLPVSIRVVLESVLRNCDGKKVTEEHVRQLANWKPNAERVDEIPFVVARVVLQDFTGVPLLADLAAMRNVAEKMGKNPKKIEPLVPVDLVVDHSVQIDHFREKNALDLNMQLEFKRNNERYQFMKWGMQAFDTFGVVQPGFGIVHQVNLEYLARGVHKKDGVYYPDTLVGTDSHTTMINGIGVVGWGVGGIEAEAGMLGQPVYFLTPDVVGVELKGRLREGVTATDLVLTITEMLRREKVVGKFVEFFGEGTASLTTPDRATIGNMAPEYGATMGFFPVDEKTIDYFRGTGRTDEEIAAFEGYFRAQGMFGVPRAGEIDYSKTLTLDLGTVAPSLAGPKRPQDRIEIGHVKETFKSLFAKPVAENGFNKDVADLDREYTNADGVKVHNGDVLIAAITSCTNTSNPSVLLAAGLLAKKAVEAGLKVAPHIKTSLAPGSRVVTEYLKAAGLLPYLDKLGFGVTAYGCTTCIGNAGDLTQALNDTIVQNDIVAAAVLSGNRNFEARIHPNIRANFLASPPLVVAYAIAGNVTRDLMTEPVGKGKGGKDIWLGDIWPTSEEIHALLKYAMDAKTFKGNYEQVRKPSKLWAAIKGTKGQVYDWPKSTYIAEPPFFQDFALEPSGEAVTVRGARALGVFGDSVTTDHISPAGSIKDTSPAGKYLLSHGVLKADFNSYGSRRGNHEVMMRGTFANVRIKNLMIPAKADGSRVEGGITLHQPTGEELSIYDAAMKYIAEGTPTVVFGGEEYGTGSSRDWAAKGTQLLGVKAVIARSFERIHRSNLVGMGVLPLQFKGNDSVQSLGIVGNETFDVEGIEGDLKPQQDVTLVIHRANGDTQRVPVLLRIDTPIEVDYYNHGGILPFVLRQLLA

SEQ ID NO: 8529 - protein, 350 aa, Ralstonia metallidurans
DDARVEDIIPLPPPEHLIRFFPIRGTPVESLVTQTRQRISRILHGSDDRLLVIMGPCSIHDPQAALDYARRLAAERERYADSLEIVMRVYFEKPRTTVGWKGLINDPYLDESYRIDEGLRIARSLLVDINRLGLPAAGEFLDVISPQYIGDLICWGAIGARTTESQVHRELASGVSAPIGFKNGTDGNIKIAIDAIQAASRPHHFLGVHKNGQVATVHTKGNPDCHVILRGGKAPNYDAEVVAAACKELEAARLRNSLMVDCSHANSNKQHQRQIDVARDVAQQISGGSQSIFGLMVESHLVPGAQKFTPGEHNPSGLTYGQSITDACIGWEDSVTVLELLSEAVNVRRG

SEQ ID NO: 8530 - protein, 368 aa, Ralstonia metallidurans
MKTKAAIAWKAGAPLTIEEVDLDGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPAREAMARKFGMTHFVNPKDVDNVVDHIVQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFDLMKRGESIRSVVLY

SEQ ID NO: 8531 - protein, 522 aa, Ralstonia metallidurans
YDVAIVGSGLAGLTVALQLADTHRVVILSKRAMTTGASDWAQGGIAAVLDSGDSHDEHTQDTLVAGAGLCDEDATRFIVEHGREAIQWLIDRGVPFTRDEQAELGFHLTREGGHSRRRIIHVADATGHAVVTTLAEQARQHPNITILEDQFAVDLITSAKLGLPGNRCYGLYVLDAETGEVRTLTATHTVLAAGGAGKVYLYTTNPDTATGDGIAMAWRAGCRVSNMEFIQFHPTCLYHPYAKSFLISEAVRGEGGLLRLPDGTRFMPEHDARAELAPRDVVARAIDFEMKKRGLDCVYLDITHQPVSFLKEHFPTIYARCLELGIDIAREPIPVVPAAHYTCGGVVTDTAGRTDLGNLYAVGETGCTGLHGANRLASNSLLECMVIGRAAAADIASQGKADAPDITLPAWDESRVSDADEEVVVSHNWDELRRLMWNYVGIVRTDKRLERAQHRIGMLREEIAEYYANFRVTRDLLELRNLVEVASLIVDSAYSRHESRGLHYSRDYPETLPKALPTVLQP

SEQ ID NO: 8532 - protein, 342 aa, Ralstonia metallidurans
NGLANWSWWEIVIYTLVMTHITIAGVTIFLHRCMAHRSLDLHPIAQHFFRFWLWMTTGMVTKEWTAIHRKHHAKCETEDDPHSPQTRGIRKVLLEGAELYRAEAKNKETITKFGHGTPDDWIERNLYSRFSWQGVALMLIIDLALFGLVGMSVWAVQMLWIPIHAAGIINGLGHYWGYRNYDCEDASTNVSPWGFIIGGEELHNNHHTYPTSAKFSIKWYEIDVGWWYIRAMQSVGLAKVKKIPPKARLVEARPVDHNTLEAIIANRYDVMARYAKTLSPPTRMNCASTRKAIRPSTRASKPARKWFHREETKLAAPQRQQLATIVEQNKMLSTFVEMRREL

SEQ ID NO: 8533 - protein, 222 aa, Ralstonia metallidurans
MSEPLPAIEIETAPNPAFSVIWMHGLGADGSDFVPVVPELGLPETLAVRFIFPNAPAIPVTCNGGYVMPAWYDIYSLDEAGRRADERGILQSRDAIRTLIARENARGVPTNRIVLAGFSQGGAIAYTTALTHPETLAGVIALSTYIPSTDLIASEAAPANAATPILAAHGTEDGVVPLMLGTRARDWVAAAGHPVTWLTYRMPHSVCIEEIVDIGQWLQERF

SEQ ID NO: 8534 - protein, 681 aa, Ralstonia metallidurans
SACSACKGKTIMFTKILIANRGEIACRVAATCRRLGIRTVAVYSDADANARHVAFCDEAVHIGGAAARDSYLRADHIIEMAKETGAQAIHPGYGFLSENEDFARACAEAGLVFIGPPASAIHAMGSKSAAKQLMEKAAVPLVPGYHGEDQDATLLRREADRIGYPVLLKASAGGGGKGMRVVEAGDGFDAALASVKREASASFGDDKVLVEKYLTRPRHIEIQVFADSHGNCVYLFERDCSVQRRHQKVLEEAPAPGMTEERRRAMGEAAVAAARAVGYVGAGTVEFIANQDGSFYFMEMNTRLQVEHPVTEMITGQDLVEWQLRVAAGEALPLAQEQLAIHGHSLEARIYAENPDKQFLPSTGTLRFLRTPPAVQFMRGGDANAPAAVRIDAGVREGDTISPYYDPMIAKLIVWGRDRDQALARMAQALAGYHVVGLSTNVAFLQRLVKSEAFRTADLDTGLIERNQTVLFPPQKTAGIEAIALAMAALLERETRTRRIDEADRHSPWTHAGGWRLNGRDVRTLHFQGGGHKLEAVLKGNASDTSKNTLIYADQAAPFAYTFNADDIRVDLGTRRTHGQVHVEGDTFHVFHDGRHTVLEWLDPLAHASESEGEGGKLTAPMPGKVIAVMVEAGSKVTRGTPLLVMEAMKMEHTIAAPADGVVSEVLYGVGEQVSEGAQLL

SEQ ID NO: 8535 - protein, 445 aa, Ralstonia metallidurans
AAAASTARRTNVRYWILALIFIVTTVNYADRATLSITGPAMREEFGFSAVQMGYIFSAFSWSYVMAQIPGGWLLDRFGARRIYAVSIFLWSFFTLLQGWVGIFASMGATMTALFMLRFAVGLAESPAFPANAKVVASWFPTAERGTASAIFNAAQYFAAVVFTPLMAWIVHSMGWHHVYLWMGIMGMLLAMLWLKVMRSPVTHPAVNRAELEHIEQGGGLIHMNEGAGKSKQGANPAGWFYARQLLSNRMLAGVYLGQYCINVLTYFFLTWFPVYLVQARGMSILKAGFVASLPAICGFLGGVLGGVISDHLLRRGYSLTIARKVPIVAGMLLSVSMIACNYVDAEWLVVGIMALAFFGKGIGALGWAVVADTAPKEVIGLAGSIFNTFGNIAGIVTPIVIGYILSATGSFNGALVFVGINALVTVLSYLVIVKDIRRVELKHPQ

SEQ ID NO: 8536 - protein, 301 aa, Ralstonia metallidurans
PQELKQIISEGLLSFPITDFDAQGNFRPDTYIERLEWLAPYGASALFAAGGTGEFFSLTQQDYSNVIRTAVETCRGKVPILAGAGGATRVAIEYAKEAERLGAHGVLLMPHYLTEASEEGIANHIEEVCKALKIGVIVYNRANSRIGADLLERVVDRCPNLIGFKDGVGEIEAMVRVRRKLGDRLAYLGGLPTAEVYAAAYKALGVPVYSSAVFNFIPKTAMEFYRAIAADDHATVGRLIDDFFLPYLDIRNRKQGYAVSIVKAGAKLVGHDAGPVRAPLTDLTEDEMARLDALIRKLGPQ

SEQ ID NO: 8537 - protein, 416 aa, Ralstonia metallidurans
TRSLFGQVLIALVIGTLLGLFFPEFAAKLKPLGDAFIKLIKMLIGPIVFCVVVAGICGAGELKKVGRVGIKAVVYFEVVTTIALALGVVLAYVFHPGTGMNVNPRSLDISAMSAYIESADKVKSAGMVDFLLKLIPNTIMGAFSSGDVLQVLLVSILFGCALSVVGESGRPLVKLIDTFSHTLFKMMGFIIKLAPLGVLGAVAFTVGKYGIGSLKQLGFLVILFYGAVVIFVVGVLGLIMRLCGFSVLKLIRYLRAELLVVLGTASSDSVLPQVMKKLEYMGIRKSVVGLVIPTGYSFNLDAFSIYLTLAAVFIAQATNTPLALGDLLGILAVALVTSKGAHGIPGSAIVILAATLSAHPAIPAIGLVLVLSVDWFIGIARAVGNLIGNCVATVVVAAWEHDIDRERAHGVLNGTI

SEQ ID NO: 8538 - protein, 315 aa, Ralstonia metallidurans
TVMQVQRNVYREDHEMFRETARRFLERECLPKQGAWDKAGKVDRETWLKAGREGLLCVTLPTEYGGGGGDFGHSAVFNEELARVGVSGLGFGVHSDIIAPYIARIANEEQKQRWLPKVCSGEAILAIGMTEPGTGSDLKAVRTTAIRDGDEYVINGSKTFISNGLNCDLIIMVCKTDPAAGSRGVSLIMVEADREGFRRGRKLEKVGQHAQDTAELFFDNVRVPVSNLLGEEGKGFAYLMGELPQERLSIAVSAAAKLEACLDHTIAYVKERKAFNQTVWDFQNTKFKLADIKAQAVAVRVMVDYYLSEHIRRRL

SEQ ID NO: 8539 - protein, 481 aa, Ralstonia metallidurans
PTPDNDKETRVKTLDRFYIDGQWVTPAAAARSMPIVNPATEEVAGHVTLGSAEDVNRAVAAARAAFPAWSETSREERLALLERITALYKARLGDFAEAVRTEIGAPVSLCNTLQAPIGLAHLGAATETLRAFQFETAHGNNYVRHEPIGVAALITAWNWPLSLICAKVAAALAAGCTIVLKPSEIAPLDAALFAEVMHEAGTPAGVFNMVFGDGQEVGARLAAHPDVDVISITGSTRAGIAVAQAAAATVKRVHQELGGKSPLLILDDADLQAAVAQGVGHVMLNSGQTCIAPTRMLVPRDRYDEAVRVAAATANALQVGDPAEPGTRIGPISNKAQYEKVQRMIGTGIEEGARVVAGGPGRPDGLTRGFYARPTIFADVDNSMTIAREEIFGPVLVMIPYDDEAQGVDIANDTPYGLAAYVASGDPARARRVAARLRAGSVRINGGQVDLSMPFGGYRASGNGRENGAHGLAEYLEVKAV

SEQ ID NO: 8540 - protein, 532 aa, Ralstonia metallidurans
IVVGAGSAGAAVAARLAEDAGVTVACLEAGRATLTSRLDAGASPRSSRKPSAHYAYRSVPQPGLTAGAPTQPRGPRFGRSSSINGMVYIRGHRKDYDTWAQLGCQAGAMRMCLPYFRRSETNHALDDRHHGKDGPLHVNELRTPNPFSARFIEAAMQAGIPFNRDFNGAEQDGAGYYQVTQRNGERWNSARAYLHHGDANDGTFSGGRRNLTVWTDTQVQRIVFEGRRAVGVSITRAGVTQVLRARREVIVSGGAFNSPQLLLASGIGPAAHLRDLGIDVVHDLPGVGENLQDHLDIAVCHQVPSPQLFGYSLRGAAKMLGQWRQYRRDRTGMFSSNLAEAGAFLRSRRELAEPDLQFHFVPGLSSTHTGMRRRDLKHGFTGLACLLRPESRGHVRLNSADTRDAPLIDPRFLSAESDMAGMVACFRLMRRILAQPALASAQGRELLTEEIGPGDGDEAAIRAYVRRHADSVFHAIGTCKMGVDAMAVVDPSLRVHGVEGLRVVDASIMPTLIGGNTNAPAMMIGEKAADLI

SEQ ID NO: 8541 - protein, 425 aa, Ralstonia metallidurans
  unsure (1)..(425): unsure at all Xaa locations
QHQGLLRFITAGSVDDGKSTLIGRLLFDSKAVLSDQLTALANAKNKRTAGEQIDFSLLTDGLEAEREQGITIDVAYRYFSTARRKFIIADTPGHEQYTRNMVTGASTAHAAIVLVDATRVTVKDGRAELLAQTKRHSAILKLLELQHVIVAVNKMDLVDYSEQRFNEIRADYIELAAQLGLQDVTYVPVSALRGDNIVHASDAMPWXQSEPLLPLLESLPVEDVAPVGDAALRFPVQLVVRQDGSAADDFRGYAGRVEAGTVRVGQKLRVLPANREAVVAEVLTPNGSADSASAGDTVTVRLAEDVDVSRGDMFVSADTAAESAKKLTADLCWFDDESLNPSRKYVLKHTTASVFARVSAVDRVLDVHTLSHETGRHEINLNDIGSVQISLQKPIVCDTYGDNPATGAFVLIDEATNHTVAAGMI

SEQ ID NO: 8542 - protein, 297 aa, Ralstonia metallidurans
KHYLQFSDLSADEYEYLLDRARILKAKFKNYETWHPLHDRTLAMIFEKNSTRTRLSFEAGIHQLGGHAVFLNTRDSQLGRGEPIEDAAQVISRMVDIIMIRTFGQEIIDRFAKHSRVPVINGLTNEYHPCQVLADVFTYIEQRGTIAGKTVAWIGDANNMAYTWIQAAERLDFTFHFSAPPGYQLDPAMVPDWAASRVKVFDNPLDACQGAHLVTTDVWTSMGFEAENDARKRAFKDWMVTTAMMDRAADDALFMHCLPAHRGEEVEAAVIDGPRSVVWEEAENRLHVQKALMEYLL

SEQ ID NO: 8543 - protein, 633 aa, Ralstonia metallidurans
IRPLPDQLISQIAAGEVVERPASVVKELLENALDAGATQLGIRLEEGGVRRIVITDNGCGIPADELPVALMRHATSKIASLDELESVLTLGFRGEALASIASVSHLVLTSRTATATHATQISADTGHLQPASGGVGTMIDVQHLYFNTPARRKFLKSEQTELGHCLEMIRRAALARPDVTISVHHNGKPLEHWNAGDVATRTAQVLGSDFARARLPLDEQADALHLYGFAGLPTASRGRPDQQYFFVNGRFVRDKLLNHAVRSAYQDVLHGDRFPSYVICLDLPPELVDVNVHPSKIEVRFRESRAVHQFVYHAVQRCLARQAGEQGDSLHSEIADEAGRPSMPAARPVGAPGAPGAAPQWVNYSAGRQTELGIAQPRQAYLGMVRDAAGQGSARPWQPSPQPPAWLADAQAARADEPPGLLDRLPQQPLQPSTLPAAGEGDDDHPLGYAVAQLHGIYVLAQNARGLVLVDMHAAHERILYEQIKTALEARELAVQPLLIPVTLPASPVEIGAAEEHQETLQLLGFDIKPVSPTTLAVRAIPALLKQADTEALARDVLRDLQAYGGSRVLAERQNELLATLACHSAVRANRKLTVEEMNALLRQMEQTERADQCNHGRPTWVQLTVAELDRLF

SEQ ID NO: 8544 - protein, 165 aa, Ralstonia metallidurans
PACRPPQMTTFTIRPAAPADSETLYNLISALAEYEKLTHLVEATPQKLCDALFGAHPGAEVVILEVDTESGKLPVGFALFFHNFSTFLAKPGLYLEDLFVDPAWRGHGLGKALLKHLAALAVERGCGRFEWSVLDWNQPSIDFYRAMGADVMPDWRICRVTGDAL

SEQ ID NO: 8545 - protein, 338 aa, Ralstonia metallidurans
LSYRDAGVDIEAGDALVDRIKPFAKRTMREGVMAGIGGFGALFELSKKYQEPVLVSGTDGVGTKLKLAFQLNRHDTVGQDLVAMSVNDILVQGAEPLFFLDYFACGKLDVETAATVIKGIAHGCELAGCALIGGETAEMPSMYPDGEYDLAGFAVGAVEKKKIIDGSTITPGDVVLGLASSGAHSNGYSLVRKIIDVARPNLDADFHGQRLQDAIMAPTRIYVKPLLSLIETLPVKGMAHITGGGLTENVPRVLADNVTAVIQRDAWTLPPLFQWLQAEGRVADAEMHRVFNCGIGMVVIVAKEDAERAIRHLQAAGEAVWQIGEIRERAEGQAQTVV

SEQ ID NO: 8546 - protein, 249 aa, Ralstonia metallidurans
IQGNVFIVTGGASGLGAGTARMLAAAGGKVVIADLNEAAGTALATELGGQFVKCDVASEADGQAAVDAARKLGRLSGLVNCAGIAVAAKTVGKNGPHPLDAFEKTIRVNLIGTFNMIRLAAAEMVQNTPDAEGERGVIINTASVAAFDGQIGQAAYAASKGGVVGMTLAIARDLSRDGVRCLTIAPGLFETPMLLGMPPEVQEALGKMVPFPPRLGRPAEYAKLVQSIIGNTMLNGEVIRLDGAIRMQP

SEQ ID NO: 8547 - protein, 325 aa, Ralstonia metallidurans
MAKVVRMYETGGPEVLRYEDMEVGDPGPGQVRIRHVAVGLNYADTYFRNGTYPVPLPAGMGVEASGVVQAIGPDVTNVAVGDRVTYTGFLNTLGAYSTERLVPAAPLIRLPENIGFETAAAMTMRGLTSAYLMRRIYAFKRGDTILLHAAAGGVGLIVSQWAKLQGLNVIGTVSSEAKAEVARAHGCDHIINYSHEDVAKRVRELTDGVGATVVFDSVGKNTFMASLDSLKRRGLLVCVGTASGPIPPFDPVLLAMKGSVYVTRPALADYIADPGEKAELAGELFDHVGAGRIRIEINQRYALEDAVQAHRDLESRKTTGSSIFV

SEQ ID NO: 8548 - protein, 530 aa, Ralstonia metallidurans
YPLLIKQLLINAMSLYGDQEISYRGELRYTYREFRERVGKLANSLSALGVHHGSTVAVMDWDSHRYLECYFGVPMMGATLFTVNVRLSPQQILYTLNDAGADVVLVHPDFVPVIDQIRDKLTCKPRFVLMADGQTVPDTAIPFAGEYEALVGAASPEFEFPEFDERTKAATFYTTGTTGDPKGVCYSHRDIVLHTLTATASLCSPREGQRMHREDVYMPITPMFHVMAWGIPYVAITLGLRTVLPGRYAPEMLLKLRAQEKVSFSHCVPTILQMLLHAAEAGGQDLSGWKIIIGGSALPPSLCEAALERGIDIFAGYGMSETGPIVALAQLPPGYQPASREEEVRLRCSTGRPVPLADFRVVGTDMRELPRDGQSQGEIVLRAPYLTRSYFRKPSASEELWADGYLHTQDVAVVHENGFVQIVDRLKDVIKTGGEWVSSIEIENLVTRVPGVRECAVIGVPDARWGERPMAFVVRQPDSEVGAEDIRAELMNHVSAQRLSKFAVPEADRIAFVAEIPKTSVGKIDKKLLR

SEQ ID NO: 8549 - protein, 133 aa, Ralstonia metallidurans
IYILMGVSGSGKSTVGQMLADRLHCGFHDADSFHSDANKAKMHAGIPLTDDDRWPWLDAMRAAIDAARAEGRTHVFTCSALRQVYRDRLLPADGGVTFVFMKGDASTIGSRLSARTDHFFNPALLQSQFETLR

SEQ ID NO: 8550 - protein, 163 aa, Ralstonia metallidurans
IVSAEEVQNSLDRMAHDITEKMGDAFPLVLSVMGGAVVFTGMLLPKLQFPLEFDYIHLSRYNNKTVGGEMQWRVAPRESVKGRVVLVLDDILDEGETMAAIRQRIMDMGAKECHAAVLCEKTLTKIKPMHPDFCGFQVPDRYVFGCGMDVKGYWRNLGAIRAL

SEQ ID NO: 8551 - protein, 466 aa, Ralstonia metallidurans
HIYINGEFVTPHGDEWFDLYNPSTEEVIGQVRLGDAQDARRAIAAAQAAFPAWSRTTREERIAALHRMHRAVAAREDELMEAILLEYGAPQVRGRWMATYPADVIAQAIDTLESFAFEEHVGSAKVIQVPVGVAGLITPWNSNAGFICNKLATALAAGCTAVIKPSEMSAMQTQIVAQALHEASLPPGVFNIVNGRGEIVGEEIARNPGVAKISFTGSSAVGQHLVVTGAETMKRVTLELGGKSPTIVLPDADFATVMPLVLQAGFANSGQACIAGTRILVPRNRLTEFEHIAKEAVSHVRSGDPRDTDTDIGPMVSQKQWERVQNYIRIGQQEGATLLAGGEGRPDGMHAGWFVKPTLFTHANNQMRIAREEIFGPVLTIIPYDDEADAIAIANDTRYGLSALVLGTNLESCERVARQIDSGRVLVNTLAHEPRAPFGGFKHSGLGREMGRWGMSAYLEPKTLLT

SEQ ID NO: 8552 - protein, 452 aa, Ralstonia metallidurans
TDVAIIGAGTAGLAAYRAAIAAGKRAVIIEGGAYGTTCARVGCMPSKLLIAAAEAAHEARHTAAFGVHVDGPVRIDGREVMQRVRSERDRFVGFVVRGVESIPQDDRLIGRARFIDNTILQVDDHTVVRASRVVIATGSRPAVPPSFGVFGDRLIVNDDVFSWEDLPQSVAVFGPGVIGLELGQALSRLGVRVRVFGVGGGVGPLSDPEIRAYAAKSFNQEFSLLADARVLEMRREGDDAVITFEDADGQTVTERFAYVLAATGRRPNVDTLALGNTALELDGRGVPTFDPVTLQCGESPIFIAGDANNVLPLLHEAADEGKIAGENAALWPKVGPLTRRAPIAVVFSDPQIAMVGKRFAELTPGSFVTGEVSFEDQGRSRVMLKNRGLMHVYADRATGRFIGAEWIGPRAENIAHLLAWSYQQGLTIAAMLAMPFYHPVVEEGLRTALRDA

SEQ ID NO: 8553 - protein, 76 aa, Ralstonia metallidurans
FDQAQIDVKTLSERPNNMTLLRLYALYKQGAEGDAHGDKPGMTDFVGRYKFEAWEALKGTGREEAMQKYIELVTDL

SEQ ID NO: 8554 - protein, 268 aa, Ralstonia metallidurans
QQQFVDWLRSVAPYIHAFRGKTFVIAFSGELVKAGVLNGLVNDVALLHAMGMQIVLVFGSRPQVEEQLALRNVQSQYAEGIRITDNAALECAKEAAGELRLDIEAAFSQGLPNTPMAGAQLSVVSGNFITARPVGIVNGVDYQHTGLVRKIDGDSMRMSLSHGKVVLLSPLGFSPTGQAFNLSMEDVASATASALKADKLIFITEVPGVPDQVGKLMKEMSLRTAVERLQNNHLPPDVAYYLQHLVKALKGGVPRAHLIPFSLDGSVL

SEQ ID NO: 8555 - protein, 439 aa, Ralstonia metallidurans
HVFHRNPKQTLPVAVGGQGIELIDSNGRRYLDASGGAAVSCLGHGHPRVIEAIKAQVDTIAYAHTSFFTTEVSETLAQTLADAAPGDLDHVYFVSGGSEAVEAALKLARQYFVEIGQTQRRHFIARRQSYHGNTLGALAIGGNAWRREPFLPLLVPAHHVSPCYAYRDQAAGEADTQYAQRLADELEAKILELGPDSVAGFVAETVVGATAGAVPPVADYLKRIRAVCDKYGVLLILDEVMSGMGRTGYLFACEEDGVVPDIVTIAKGLGAGYQPIGAMLSTSRIYDAIIGGSGFFQHGHTYIGHATACAAALAVQRTIVEDKLLDNVLARGEQLRARLRESLGDHPNLGDVRGRGLFVGVEFVADRATKATLDPAKKTHAVLKRTCMEHGVLVYPMGGTVDGIHGDHVLFAPPFICTPTDIDNIVDRFTQAVKTVLPA

SEQ ID NO: 8556 - protein, 245 aa, Ralstonia metallidurans
SQGESQKAAIVTGASRGIGAAISARLARDGFAVVINYANGADTAGDLRRKLEASGGRAMTFQADVSDASAVARMFDAAEATFDGVDVVVNNAGVMVLDTIAASDDAAFERVMNINLKGAFHTMREAARRLRHGGRIINLSSSVIGLRMERYGIYAASKAAVEAMTAVLSKEMRGRAITVNAVAPGPTATDLFLDGKSPETIERLAKLNPLERLGTPEDIAAAVAFLARPDGAWINGQVLRANAGM

SEQ ID NO: 8557 - protein, 236 aa, Ralstonia metallidurans
ILVVGAGDATGGAIARRFAHEGYVACVTRRDVDKLAPLVEQIRAEGGEAHAFGCDARKEEETVAMIERIERDIGQLEVAVFNIGANVNFPILETTSRVYFKVWEMACFAGFLMGREAARVMVPRQRGSIFFTGATASTRGREGMSAFSGAKHALRALAQSMARELGPKNLHVAHLIIDAAIDTAFIRDNFPDRYATRTQDGIVNPEHIADTYWMLHQQPRDAWTHELDLRPWIEHW

SEQ ID NO: 8558 - protein, 402 aa, Ralstonia metallidurans
MTADSGKRRFARIDRLPPYVFNITAELKMAARRRGEDIIDMSMGNPDGATPPHIVAKLVDAAQRPDTHGYSASKGIPRLRRAISHWYRERYDVDIDPDKEAIVTIGSKEGLAHLMLATLDRGDTVLVPDPSYPIHIYGAVIAGADIRSVPLTPGIDFFAELERAIRGSYPKPKMIVLGFPSNPTAACVELDFFERVIALARKHDIFVVHDLAYADIVFDGWKAPSIMQVPGAKDIAVEFFTLSKSYNMAGWRIGFMVGNPDLVAALTRIKSYHDYGTFTPLQVAAIAALEGDQQCVKEIAAQYQSRRDVLARGLIESGWPVDIPKASMYIWARIPEPYRALGSLEFAKQLLAKAKVSVSPGIGFGDYGDEYVRFALIENESRIRQAVRGIKAMFRADGLVTA

SEQ ID NO: 8559 - protein, 196 aa, Ralstonia metallidurans
RGKFITFEGIDGAGKSTHIEWVAERLRARANVVTTREPGGTPLGEDLRQLLLHRKMHLETEALLMFAARREHIAEVIEPALARGDWVISDRFTDATFAYQGGGRGLALDRLATLEQWVQSGLQPDLTLLFDVPLETASARLAGAREPDKFEAESRAFFERTRTEYLRRAAEAPQRFRVIDATRSIDEIRVALEEII

SEQ ID NO: 8560 - protein, 393 aa, Ralstonia metallidurans
LGTPLSPSATKVMLLGSGELGKEVLIALQRLGVETIAVDRYENAPGQQVAHHARTITMSDGEQLKALIEAERPDLVVPEIEAIATPMLEALEAAGVVRVIPTARAARLTMDREGIRRLAAETLGLPTSPYKFCDSLEELQAAIDGGIGYPCVVKPVMSSSGKGQSKIDGPADVKAAWDYAMAGGRVSHGRVIVEGFIDFDYEITLLTVRAVGANGEVETHFCEPIGHVQVAGDYVESWQPHPMHPKALETSQHIARAVTADLGGQGLFGVELFVKGEQVWFSEVSPRPHDTGMVTMITQWQNEFELHARAILGLPVSTALRAPGASAVIYGGVEAEGIVFDGVDEALRVPQTELRLFGKPESFTKRRMGVALAYAEDVDTARERAKEAAGKVK

SEQ ID NO: 8561 - protein, 293 aa, Ralstonia metallidurans
PEAFDAFLQTLRRFVREKLVPREAEVAEHDEVAQDLVDAMAAQGMFGYSIPEQYGGAGMTTEELVLAAMELSQCSVAFRARVGTNTGIGSEALVADGTPAQKQHYLPLLASGQLTGSFALTEPEAGSDATALQTTAVRDGDAYILNGTKCFITNAPIAGLFTVMARTDPANLGAGGISAFIVPRETPGLSTGRPYQKMGQAGSPVSEVHFDNCRVPAVNLIGGEEGKGFRTAMKVLNKQRIHLAALCTGPAIRMLEDAVRFVTERKQFGQVLADFQLVQAMIADCQTDIHAAR

SEQ ID NO: 8562 - protein, 366 aa, Ralstonia metallidurans
  unsure (1)..(366): unsure at all Xaa locations
LQQTSVYVIGVGLHPYQFASDTPYVSLGLRAMREALSDAGIAWPEVQSAYVGTSAIGMATGRVMFRHLGSTGLAVTQVESASASGCSAFRQACLEVASGVSDVVVAIGVDKFGDGRKAADKDGLPHLAPTATMPPVKFALMAHEYLRQHGLKPEAMARVAVKNHGNAALNPYAQFRKARTLEQVMASPKVVGDLTVQQCCPRGDGAAAVIVVSEAAIKRLGLDKRRAVRVLASVANSEELEHGDSSAAVDMVRKSTAMAYEQAGVGPRTXTWWSCTRPFRSRELVYTEAMDLCAPGEGAAWLERGASAIGGECAVNASGGLLGMGHPTGPTGIGQIAEITRQIRGEAHGRQHPGARLGLAHMIGLG

SEQ ID NO: 8563 - protein, 388 aa, Ralstonia metallidurans
MHFPTGLLQETSMFFEATPEQRLLRDNIRRFMQAEVAPLISRHDQEKTFPFEILKGLAQFGYIGGRLSEEQGGMGLDQLTWAMMMEEAGYAWLSLRTILNITNGPIAKLAAVGTPDQKTRFLDPLLACERKVFTAISEPGTGSNIAQIQTRADLKGDHYVLNGRKLWITNGAFADFGIVVARTYSDNCEGQLSTFLVEREVSPYEVRRVDTMVLRSTGTAELGFDNVRVPRENLLGEEGGALKRMLQGLDGARVNIAMGAVGAAQCALDLATDYAKTRTQFGRAIGSFQLVQKMIVDMTIRVEAARALGYRAAMALDRGEDTRVSASIAKLYATEAAHEVASMALQVHGGLGYATDYPIERIFRDTRGGTIPEGTTEVQTLIVGREIL

SEQ ID NO: 8564 - protein, 383 aa, Ralstonia metallidurans
VLVCGGLLVTLSMGIRHGFGLFNLPITQTHGWSRETFAFALALQNLMWGASQPITGALADKFGALRIMIIGVALYVAGLIVMGLATSGTAFATGAGVLIGIAQSGTTYSVVYGVIGRVASAEKRVWAMGIAAAAGSFGQFLMIPVEQTLISTMGWQNALFILAFLACFMLPLALTLREPKMVATTTGHHQTIGEATREAFGNRNFQLLTLGYFVCGFQVVFIGVHLAPYLKDRGFTDPKVATVALALIGLFNVFGTYTAGSMGQRMPKRYLLSFIYIARSVVIAGYLLMPLTAASTWVFAALMGFLWLSTVPLTNGIIAQVFGVKYLSMLSGVVFFSHQIGSFLGAWLGGYLFDKTGSYSTVWMIAIALGLMAAVVNLPIREQ

SEQ ID NO: 8565 - protein, 508 aa, Ralstonia metallidurans
LHRSMQQRPDKVAVRFNGRALTYAEIGDRVARLAGALRKLGVAEGERVAMFSLNSARYIEYYMAVPWAGAVLNPVNFRWSAAEIAYSFKDSGTAVLIVDDPFTEVAQKVAAECTTVRHVIYAGDGETPAGMLNYETLIADSAPMEDAYRHGDDLAGIFYTGGTTGFPKGVMLSHANLISSACNQPMSGTVDESIVMMHVMPMFHLACFASINAVFLVGGTHVAISAFDPGRMMEGIAQDRVTAVLLAPTMIQMGLDWMDRHPGRAAELDLSSLNSLRYGASPMTPALLERTRQTFPAVRFSQGYGMTELAPVATMLGPEYHDAAAQASGKMYSVGRPAHTVEVKVVDSRGNEVPRGTVGEIIVRGPNVMLGYWNQPQATAEAIRNGWMHTGDGGYMDKDGFLFLVDRLKDMIISGGENVYSAEVEKALASHPAVAQSSVIGVPHEKWGESVHAVVVLRQGESATLESIQSHCRERIAGYKIPRSVEFVDALPLSSVGKVLKNELRKRH

SEQ ID NO: 8566 - protein, 272 aa, Ralstonia metallidurans
MSKLAGKSAIVTGSGRGIGREVAMKLAAEGARVVVNDLDADPAQEVVELIRANGGEAVACVGSVTAPDFADRLIKTTVDSFKGIDIIVNNAGYTWDNVIQKMTDEQWYAILDCHLTAPFRILRAAQPVISAAAKAEAAEGREVFRKVVNISSGAAGGNAGQSNYSAAKAGILGMTKTLAKEWGRLKVNVNAVAFGLIETRLTQALAADQSKSVSIEGREIKVGVQQAMLDGASRMIPVGRAGRAEEAAGAVYLLCTPESNFLSGQVLYCGGG

SEQ ID NO: 8567 - protein, 392 aa, Ralstonia metallidurans
KHVVVAGVGMIPFKKPGQSDSYSVMGATATRLALEDAGLPYDRIQQAYVGYVYGDSTCGQTALYKVGVTGIPIVNVNNNCSTGSSALFLARQAVESGAVECALALGFEFMQPGALTSVWTDRERAMARFTEISAPMVQDALDAGVPSALTMFGGAGREHMQRYGTKLETFAKIRAKASRHAANNPLAVFRTVVTEEDVMNEKVMWPGVMTRSMACPPTSGAAAAIVCTEAFAKKHNLRTDVRILAQSLTTDVAQSFDPPSMIGLVGFHMAERGAKAVYEAAGVSPSDIQVCELHDCFAQNELLTYESLGFAKIGEAEKMVQDGDNTYGGKVVINPSGGLLSKGHPLGATGLAQCYELTRQIRGTAEATQVERVQLALQHNLGLGGACVVTLY

SEQ ID NO: 8568 - protein, 408 aa, Ralstonia metallidurans
  unsure (1)..(408): unsure at all Xaa locations
WGSRRIIRSPRAGRIVXPAGYANTXQGGDVVEVVRSVYREDHEQFRTTVRRFLERECVPRQEQWLADGIVDRETWLKAGREGLLCTALPTEYGGGGGDFGHAAIIAEEMAYAGVSVSFGLHSDIVAPYIARLGTEEQKQRWLPDICAGKTILAVAITEPGGGSDVKACRTTAVRDGDEWVINGSKTFISNGFCSDMVMVVCKTDPAAGARGVSLILVETNREGFRRGRKLHKVGMHSQDTAELFFDNVRVPAGNLLGEVNKGFGYLMHDLAQERFIIAVTAAAKIERLLEQTIEYVKDRKAFGGTVWDFQNTKFKLADVKANAVALRTMVDYYLGEHMRRRLSGEEAAIAKLHATEVQWKCIDDMVQLHGGYGYMLEYPIARAFVDMRVARVYGGSNEVMRDIITRKM

SEQ ID NO: 8569 - protein, 239 aa, Ralstonia metallidurans
VRQKLVIGNWKMHGSLAANAALLEGIKAAPARAKLAVCAPFPYLAQCQTLLSGSQVAWGAQDVSSEARGAFTGEVAASMLGEFGCGYALVGHSERRTYHGETDAVVAAKALRALEFDIVPVVCVGETLAEREAGQTEAVVGRQLQAVLDALSIEQLGRIVLAYEPVWAIGTGKTATSAQAQEVHAALRARVTAKDAGVAARMAILYGGSVKPDNAAELFSMSDIDGGLIGGASLKADDF

SEQ ID NO: 8570 - protein, 679 aa, Ralstonia metallidurans
QQGFLLTRHWRDTPAGTEVEFWLATDEGPRRLRLPRQPSTAFIPAAQRETAEALLRGERDVEFRPLNLQDFQRRPVTGIYCDQHRQLMRIEKALRDAGVSVYEADVRPPERYLMERFITAPVWFDGQPGADGVLRDAQMKPAAGYRPKLRLVSLDIETNAFGELYSIALEGCGERQVYMLGPTPAQPAADIDFALEYHATRPLLLEALNDWLARHDPDAIIGWNLVQFDLRVLREHARQHQIPLRLGRGGAELEWREHNQQQHYFAAAAGRLIIDGIEALRSATWNFPSFSLESVARTLLGEGKAIDNPYDRMDAIDRMFAEDKPALARYNLRDCELVTRIFEKAELLPFLLERATVTGLPADRSGGSVAAFTHLYMPLMHRQGYVAPSLGEKAPEASPGGFVMDSRPGLYESVLVLDYKSLYPSIIRTFLIDPIGLVEGLAHPDDAESVPGFRGARFSRTKHCLPAIVARVWQGREAAKRDKNKPLSQALKIIMNAFYGVLGSSGCRFFDPRLASSITMRGHEIMRQTRALIEARGYEVIYGDTDSTFVWLRRARSEADAAQIGRSLVAYVNDWWRDHLWQTYGLESALELQFETHFRRFLMPTIRGADLGSKKRYAGQVMRADGTAEMVFKGLETVRTDWSPLAQQFQQTLYAKIFNREPYRDYVRDTVHRTLAGKL

SEQ ID NO: 8571 - protein, 263 aa, Ralstonia metallidurans
MNIDLSGKTALVTGSTAGIGFATARGLAESGAHVIVNGRSQASVDNALASLKKSYPTAQATGFAGDLTDAAVCDTLVKTHPAVDILVNNLGIFEPKDFFDIPDSDWTRFFDVNVLSGVRLSRAYAKGMAERKWGRIVFIASESGINIPVEMIHYGFTKTAQLAVSRGLAKRMAGTGVTVNAVLPGPTLSEGVTAMLKDEIAKSGKSAEEVAAEFVKAHRSTSIIQRAASVEEVANMIVYVCSPQASATTGAALRVDGGVVDTI

SEQ ID NO: 8572 - protein, 568 aa, Ralstonia metallidurans
HGIEPVKKLLIANRGEIALRVQRAAQDLGIATVAVYATDDAQSRHRQLADEAIALPGNGPATYLDIDAILGAARAAGCDAIHPGYGFLSERADFAQACAAAGITFVGPTPEQLALFGDKGRALELAAQCDVPVMPATPGGASLDDVRAFFAAQQGNGIVLKAVGGGGGRGMRVVRDAEALAEAYARCQSEARSAFGIEAIYAERLVERARHIEVQIIGDGTETIALGERDCTLQRRFQKLVEIAPSPVLTPALRDRIVQAASRIAKHTGYRSLGTFEFLVETDDAGTPHGFVFIEANPRLQVEHTITEQVTGLDLVALQLGLADGRSLRDLGLDPAAPPTARGFSVQLRINAEATDAQGQARPALGRLERFDPPTGPDVRVDTHGYTGYAPPAGYDSLLAKLIVSTSSPRFEDVVRRVRRALGECRVDGVPSNLDLLRALVAREDFATQHVHTRHFEAILPELLTAAQRVAASDAARQASIGIAQTAPVPVPTATAEAIDEGLVAVRAPMNGRVVEMRVQEDDIVQPGQIVAILDAMKMEHTIAAECAGRVIDVRVGATGQTVEGQIL

SEQ ID NO: 8573 - protein, 432 aa, Ralstonia metallidurans
FRKDWYAPLGNPPLAVVRPRTTADVAAILAACHRHGQPVVPQGGLTGLASAATPGQGEVVLSLERMRGVEEIDEQAGTMTVWAGTTLQAAQEAARAAGWLLAVDLGARGSCQIGGNIATNAGGNRVIRYGMMRDQVLGIEVVLADGTVLTSLNKMLKNNAGYDLRQVFVGSEGTLGVITRAVLRLAPLPSATQTALCALKSFDDVVRLLRHAQRALSGRVSAFEAMWADYYTLVTTRVPGVRAPLAAGHPFYVLVDLQGSDADADAAAFERMLEGAMESGLIVDAAVAASGKEAESFWKLRDAVAEFPQMWAPNAAFDVSLPIGSIGRFADALRSAILERWPSAELVNFGHVGDSNLHFSVHLPGVDAAAFPEAEIDAVAYAIVREFAGSVSAEHGIGIHKKPYLGNSRTPEELALMRTIKAALDPKGILNP

SEQ ID NO: 8574 - protein, 415 aa, Ralstonia metallidurans
YQHIKVPAGEKIKVNADLSLNVPDNPIIPYIEGDGTGVDITPVMLKVVDAAVAKAYGGKRKISWMEIYAGEKSTKVYGPDVWLPEETMEVVKEYVVSIKGPLTTPVGGGIRSLNVALRQQLDLYVCLRPVRYFKGVPSPVREPEKTDMVIFRENSEDIYAGIEWEAESEGAKKLIAFLQNEMGVKKIRFPETSGIGIKPVSKEGTQRLVRKALQYAIDNDKPSVTLVHKGNIMKFTEGGFRDWGYELAQQEFGAELVDGGPWCKFKNPKTGRDIVVKDAIADAFLQQILLRPAEYSVIATLNLNGDYISDALAAQVGGIGIAPGANMSDSVAMFEATHGTAPKYAGKDYVNPGSEILSAEMMLRHMGWTEAADLIIRSMEKSIQSKKVTYDFARLLEGATQVSCSGFGQVMIDNM

SEQ ID NO: 8575 - protein, 756 aa, Ralstonia metallidurans
MIAQELEVSLHMAFVEARQARHEFITVEHLLLALLDNPTAAEVLRACAANIEDLRTSLKNFIADNTPVVPGTDEVDTQPTLGFQRVIQRAIMHVQSTSNGKKEVTGANVLVAIFGEKDSHAVYYLQQQGVTRLDVVNFISHGIRKDQAEPAKHGDGNAEGEGGDGKESPLEQYTQNLNTLAKAGKIDPLIGRESEVERVVQVLCRRRKNNPLLTGEAGVGKTAIAEGLAWRITKGEVPDILEKAVVYSLDMGALLAGTKYRGDFEQRLKGVLKSLKDNPNAILFIDEIHTLIGAGAASGGTLDASNLLKPALSSGQLKCIGATTFTEYRGIFEKDAALSRRFQKIDVVEPSVDQTVQILRGLKSRFEEHHGVKYAASALTAAAELSARFITDRHLPDKAIDVIDEAGAAQRILPKSKQKKTIGKAEIEDIVSRIARIPPQSVNQDDRSKLQTLERDLKSVVFGQDPAIEALASAIKMSRAGLGKTDKPIGSFLFSGPTGVGKTEVAKQLAFIMGIELLRFDMSEYMERHAVSRLIGAPPGYVGFDQGGLLTEAVTKKPHCVLLLDEIEKAHPDIFNILLQVMDHGSLTDNNGRRADFRNVIIIMTTNAGAETMNRATIGFTTAREQGDEMADIKRMFTPEFRNRLDAMISFRSLDEEIILRVVDKFLMQLEEQLHEKKVDASFSEKLRKYLAKKGFDPLMGARPMQRLIQDMIRKALADELLFGKLVSGGKVAVDLDDDDQIKLTFSEADPEPPEA

SEQ ID NO: 8576 - protein, 218 aa, Ralstonia metallidurans
PRTRIKICGLTREEDVRAAVDAGADAIGLVFYARSPRHVDVAHAAALAELVPPFVSVVGLFVNADAEEVAHVAERVPLTLLQFHGDETPQQCTEIARRCRLPFMRAARVRPGLDLVEFANQYRDASGLLLDAFVEGYGGGGHVFDWTLIPAQWLPPNPANPRANDAPRIVLSGGLNAQNVAGAIERVRPYAVDVSSGVEASKGVKDHARIAAFVRAVR

SEQ ID NO: 8577 - protein, 372 aa, Ralstonia metallidurans
VGLVGWRGMVGSVLMQRMQEEGDFDHFEPIFFSTSNAGGKAPAMAKNETTLKDANDIEALKKCDVVLTAQGGDYTNDVFPRLRAAGWNGYWIDAASSLRMKDDAIIVLDPVNMGVIKDALKKGVKNFIGGNCTVSCMLMGLGGLFEHDLVEWMTSMTYQAASGGGAQHMRELLTQFGTLNAAVKPLLDNPASAILEIDRQILSTQHGLSADETKQFGVPLAGNLIPWIDKDLGNGVSREEWKGGAETNKILGRGEGFLGATGASPIAVDGLCVRIGAMRCHSQALTIKLRKDVPLDEIEGMLAANNQWAKVVPNTREASMKDLTPAAVTGTLTIPVGRLRKMQMGGEYLSAFTVGDQLLWGAAEPLRRMLRI

SEQ ID NO: 8578 - protein, 508 aa, Ralstonia metallidurans
WDVIVIGGGATGLGTALDAASRGYRTLLLEAADFAKGTSSKATKLVHGGVRYLAQGNISLVREALHERGLLARNAPHVVWPLGFVVPAYQMFDQPFYGIGLKLYDMLAGGLNLSGSRWLSHHETLEAAPTLAEHVGGRPLRGGNLYFDGQFDDARLAMALMRTLFDVGGTAVNYMRVSGLSQSNGVITGVTAQDVIGGETFHLRADCVINATGVWVDAVRQMEDGQARRMVAPSQGVHLTIPRSFLPGDRAVLIPKTDDGRVLFLVPWNGHTIVGTTDTPRQDLPLEPRAASDDVDFILETAARYLARDPTRDDVTSVWAGLRPLVKATGEASTASLSREHTILVSKAGLITVTGGKWTTYRKMAEDVMETAIQRQLLRAAPCRTADLPLHGATNMPNDLPPSGTGSPDRYYGADLPLVQAMPGADNVLVPASGLTEAHVRFAARYELARRVEDVLARRNRALFLDARAALDGAPRVAAILAEELAHDSAWQARELEDFGKLARGYML

SEQ ID NO: 8579 - protein, 497 aa, Ralstonia metallidurans
QYVLALDQGTSSSRAILFDHLGNVVRIAQREFRQYYPHPGHVEHDPYEIWQSQLAVAHEVLGDAGVSGTQISAIGITNQRETTVLWDRKTGEPVGRALVWQDRRTAPMCEDLQAAGHAETFQRKTGLIVDAYFSGTKLRWMLDNYEGARARAERGELAFGTVDSWLIWQLTDGARHVTDVSNASRTMLFNIHDFRWDDELLGLLDIPRNLLPEVVPSSGEVARASARLFGVEIPIAGIAGDQQAATFGQACLRPGMAKNTYGTGCFILMNTGDKPVTSHNRLITTIGWQIGGNTQYCLEGGVFMGGATIQWLRDGLKLIHSAPEVEPLARQCTDTGGVVLVPAFAGLGAPHWDPFARGTLVGITRGTGGPHIARAALESIALQSVDVLDAMQKDAGISLAELRVDGGASRSDLLMQMQADLLGTVVVRPRVTETTALGAAYLAGLATGYWTDPEEITRQWQVEQRFEPKLSADERERRIARWHRAVDRARDWARESD

SEQ ID NO: 8580 - protein, 397 aa, Ralstonia metallidurans
IFVAMLLGVLVGAAVHNMSPDAATAKSIADHLSILTDVFLRMIKMIIGPLVFATLVSGIASMGDGKTVGRIGLKAMAWFMAASITSLLLGLLMANLLAPGHGMNLPLPAADAASNLKTGALNLRDFIAHMFPKSFVEAMATNEVLQIVVFSLFFGFALGTLKDGVGKPVLAGIDGLGHIMLKVTNYVMAFAPLGVFGAVSAVISAQGLGVLVVYAKLLGSVYAALALLWLALIAGGYFFLGRDVFRLMRTLRTPLMIGFATASSESAYPKVIDQLTRFGVKPRITNFVLPLGYSFNLDGSIMYTSFAALFVAQVYGIQLSLTQQITMLLVLLVTSKGIAGVPRASLVVVAAVLPMFGLPEAGILLVLGIDHILDMGRTVTNVLGNAIATTVVAKSEG

SEQ ID NO: 8581 - protein, 664 aa, Ralstonia metallidurans
  unsure (1)..(664): unsure at all Xaa locations
CFVPDLTRLTAPPCEEARPTGIVTQPXEAFQFCILAKDFGWLFDLKRGWRPAMLAAWRTANSGRKALNXQAGDMNANDQILRGALAPQDISIEVLQEKYAKGEEQTIDDVRRRVARALAEVEPADKREAWASRFLWALEGGFVPAGRINSAAGTGIQATLINCFVQPVGDSVSQVRGGKPSIYTAVAQAAETMRRGGGVGYDFSSIRPGGALVRATHSRASGPVSFMKVFDASCATVESAGARRGAQMGVLRCDHPDIESFIHAKDRGDLTNFNISIGVTDEFMQAVAADGEIELIHEAEPGADGIAAGAYRRDDGQWVYRRVPARRLWDQVMQATYDHAEPGILFLSRINADNNLYYCETIEATNPCAEQPLPSYGCCCLGSINLTRFVRRPFTDQASFDFEAFAEVVRVSTRMLDNVLDITYWPLPEQQAEAQAKRRIGLGFLGLGSALVMLGHRYDTDAARALAGRISETMRDHAYLASVELAEEKGRFPLFDADAYLSGGFVSRLPEPIRDAIREHGLRNSHLLSIAPTGTITLAFADNASNGIEPAFSWTYNRRKRMPDDSYRTFEVADHAWRLYRHMGGDVEQLPESFVTALQMSAIDHMRMLEAVQPYIDTSISKTVNVPEDYPYEAFRNLYLEAWKAGLKGLATYRPNQVLGAVLS

SEQ ID NO: 8582 - protein, 366 aa, Ralstonia metallidurans
RVFNFSPGPAALPTEVLHQAAEEMLSWRGTGVSVMEMSHRSREFEGIHNEALADLRELLQVPKNFRILFLQGGAIGENGIVPLNLASRINAAKPKTDFVVTGTWSVKTEQEARRYSEVNIVASSQDQKWHKIPDVASWKLSDDAAYVHLCTNETIVGTEFQEIPDIGQTGTHDKGRIVVADASSHILSRPIDWSRVQVVYGGAQKNIGPAGVTIVIVREDLIGFAHPLCPSAFNWRLVAEYDSMYNTPPTYAIYIAGLVFKWLKAQGGVPAIEQRNIAKARALYDFLDQSDFYRNEIDPSCRSRMNVPFFLRDESRNEAFLTQARANGLVQLKGHKSVGGMRASIYNAMPLEGVTALIEFMREFER

SEQ ID NO: 8583 - protein, 367 aa, Ralstonia metallidurans
  unsure (1)..(367): unsure at all Xaa locations
FGPSYVRKISPYIAGKPISEVAREFGLDEARIVKLASNENPLGMPASAKAAIAAATEDLGRYPDSNGFELKAKLSEKYDVPAEWLTLGNGSNDILELAAHALVRNGESIVYAEYSFAVYALATQEVGARAIEVKSRAYGHDLDAMAAAIAPDTKLVFIANPNNPTGTFVSAAEIEAFLAKVPPHVVVVLDEAYNEYLDAGQQYESVAWVRKYPNLMVSRTFSKAYGLAGLRVGYGVAQPQLTDLLNRVRQPFNVNSLAQAAAVAALDDTAFLQRSAELNRQGKARLVEAFERSGLEYVKSSGNFVMVRVGGDDGAGARVNLALLKQGVIVRPVANYGLPQWLRVTIGLPEENDAFIAALEQALKXNS

SEQ ID NO: 8584 - protein, 435 aa, Ralstonia metallidurans
MEQLTLGPLTRASGTVRLPGSKSISNRVLLLSALATGETRVRDLLDSDDTRVMLEALKVLGVAWRREGNDCIVSGVGGNFPSKAADLFMGNAGTAIRPLTAALALQGGTYKLSGVQRMHERPIGDLVDGLRQVGASVDYLGTPGYPPLQINPAQIRIDAPIRVRGDVSSQFLTALLMTLPMAQAQSGRIEIEVVGELISKPYIEITLNLLSRFGIAVERQGWERFILPAGARYRSPGEIYVEGDASTASYFLAAGAIGGGPVRVEGVGMASIQGDVRFADALNRMGANVMAGDNWIEVRGTERDDGRLNGIELDCNHIPDAAMTLAVAALFAEGTTTLTNIASWRVKETDRISAMATELRKLGAEVEEGADYLKVTPPTSPATWQTPDAGIGTYDDHRMAMCFSLAAFGPLPVKINDPGCVAKTFPEYFEVFAGV

SEQ ID NO: 8585 - protein, 460 aa, Ralstonia metallidurans
APLKCVDAVAASLKPFEAGLKDERDGFMYLVGTPESRALRHAFFGERAASKIPDVPEGTPVRKIERVAVIGAGTMGGGITMNFLNAGIPVTMLEMKQEALERGVATIRRNYENSAKKGKLTQEKVEQRMGLLTTTMSYDDIKNADLVIEAVFEEMGVKETVFKKLDEVMKDGAILASNTSTLDVNKIASFTRRPQDVVGMHFFSPANVMKLLEVVRGEKTGKDVLATVMQIGKKIKKTAVVSGVCDGFIGNRMIEQYSRQAGYLLDEGALPEQVDKAIEKFGFAMGPFRMGDLAGNDIGWAIRKRRAVDKPDIQYSKTADKLCEMGRFGQKTGAGWYDYKAGDRKPYPNKQVNDMIVEHSKELGITRRKISDEEIVERLVFALVNEGAKILEEGIASKASDIDMVYLTGYGFPLFRGGPMLYADQVGLYNVAQSMKRYAKGYHGEAWVVAPLLQKLADEG

SEQ ID NO: 8586 - protein, 391 aa, Ralstonia metallidurans
MNEAVIVSTARTGLAKSWKGAFNMTHGATLGGHAVQHAIARAEDRSGEVEDVLMGCANPEGATGANIARQIALRAGCPVTVPGATVNRFCSSGLQTIAMAAQRVIADEGDIFVAGGVESISCVQQDMNRHMIQESWLNKNKPEIYWSMLQTAENVAKRYNIGKDRQDEYGVQSQLRAAAALEAGKFKDEIVPMTVLAGVADKATGQLMTKEVTIDADEGIRADTTLEAVSKIRTAMPGGVITAGNASQFSDGASAAVVMNARVAAAKGLQPLGVFRGFAVAGCEPDEMGIGPVFAVPKLLKKAGLKVDDIGLWELNEAFAVQVLYCADKLGIPMDRLNVNGGAIAVGHPYGVSGARLVGHALIEGKRRGVKYVVVTMCIGGGQGAAGLFEV

SEQ ID NO: 8587 - protein, 252 aa, Ralstonia metallidurans
LFDLKGRTALITGGSRGLGLQIAEALGEQGARVVLSARKADELQTAQEHLKSRGIAAEWIAADGSRDAEIARLADEALAKLGHVDILVNNAGATWGAPAEDHPVEAWDKVMNLNIRGLFLLTQRIGKLSMIPRRSGRVINVASIAGLAGNPPGSMETIAYNTSKGAVVNFTRTLAGEWGEHNITVNALAPGFFPSKMTQGSLDRMGVDKMCEGVPLHRLGDDDDLKGAALLFASDAGKHITGQILAVDGGVS

SEQ ID NO: 8588 - protein, 483 aa, Ralstonia metallidurans
KEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNAAGVPRGVYNVVHGFGPNSTGEFLTTHRGINAITFTGETRTGAAIMKAAADGARPVSLEMGGKNAAIVFADCDFDAAIEGTLRSCFANCGQVCLGTERVYVERPIFDRFVSALKKGAEGMQLGRPEDPATGMGPLISQEHRDKVLSYYKKAVEAGATVVAGGGVPDMPDALKGGAWVQPTIWTGLGDDSVIAREEIFGPCVLVMPFDSEEEVIRRANDNDYGLATAIWTTNLSRAHRVAGAIEVGIAWVNSWFLRDLRTPFGGAKQSGIGREGGVHSLEFYTELKNVCIKL

SEQ ID NO: 8589 - protein, 201 aa, Ralstonia metallidurans
MKLYYSPGACSLSPHIVLREMGLTFELEKVDLQSKKTESGSDFRSVNPNGYVPLLVLDDGQVLTEGPAIVQYLADRAPEARLAPEAGTMERYRLVEWLNFISTELHKAFAPLFNPKTPEEWKAIVNDLIAARLAYVEKKLGGQVYLMGDNFTVADAYLFTVLSWGKWVGVDIGRWPTLQSYTNRISSRPTVQAALKAEGLI

SEQ ID NO: 8590 - protein, 550 aa, Ralstonia metallidurans
  unsure (1)..(550): unsure at all Xaa locations
GLPGTLHVPQTSLFHNLEVAARRYPGKTAIQYFGTAITYAELLDDVERMAGYLQQSCGIQPGDRVVLYSQNAPQFIVAYYAILRAEAVVVPANPMWLEAELEHVVADSGAVAAFCGSELYERVASLHGKALRHVITYHYAGMLRDDGGLPVPAWLREPAPASRAAPGGAMPVDWDTARNAGQRPRAHEAGYNTLCMLAYTSGTTGNPKGCMHTHGTMMSSAVGSQVWRSSSPESVVLAVAPMFHLLGMQNCMHSPIYLGATVVLMPRWDRALAADLIERYRVSAWGAPPAMLVDFFAQPDVARRDLSSLAFLGGGGAAMPDAVANMLQERFGLPYVEAYGMTETASFLLSNPRQKPKRECLGIATFGVDARVVDPESLAELPQGEIGEIVVHGGQVMQGYWNNPQANAESFIEIAGKRFLRTGDLGFMDEEGYFFMRDRLKRMINASGFKVWPAEVENLLYGHPAIHEACVIAARDEHRGETVKAVVALRPESRGTPEADAERIMAWCRERLAAYKVPRIVEFVDALPKSATGKILWRALQEDAMRAXGG

SEQ ID NO: 8591 - protein, 273 aa, Ralstonia metallidurans
MSYITAEDGTQIFYKDWGSGRPVVFSHGWPLNADAWDAQMLFLVQKGFRVIAHDRRGHGRSDQPARGNDMDTYADDLAALLVALDIKGATLVGHSTGGGEVARYIGRHGTQRVAKAVLIGAVPPIMAKTASNPNGLPIDVFDGIRKGVADNRSQFYKDLAVPFFGFNRPGAKVSQGTIDTFWAQGMAGGIVGQYACIHEFSEVDYTEDLKKIDVPTLVLHGDDDQIVPIDNAGRLSAKLVKNATLKVYPGASHGMCVVNADAVNADLLAFLNT

SEQ ID NO: 8592 - protein, 410 aa, Ralstonia metallidurans
IFLMMLLLVAINYIDRASLSVAMPLIAKEFDLSPAMQGLILSSFFWTYAVMQVPGGMLADKYKPRIVIATATVFWGAFQALAAVCTNATSLLLTRLGLGAAEAPIYPAGGKLNAIWMTKNERGRGATLLDGGAPLGAALGSLIIAGLISELGSWRLSFVVAGVGTVLAGFVAWWYIRNSPREHLGVNEQEARHIEDALALEHSEEPTNLSGRSLDFFKYRSVWCMAISWMCFNAVFYGLLTWMPTYLSKARGFDLKQMGGASFIIFFAGFVGELIGGWIADKWKEAGGRPNVVMRTLFGIAAVVATVSIFSVAYVTDPVAVVVLLSSTLFFLRWCGLFWSVPSMLGTRNKVGFLGGVMNLGGNIAGISVPIIVGLIVQATGSYFLALMFFAACGIGLLLASTNIDYEKKI

SEQ ID NO: 8593 - protein, 233 aa, Ralstonia metallidurans
VTGGSRGIGAAVVRRLAREGAAVAFTYQSSGAVAQALAESIQAAGGRARAYHADAADAAAVTRAIDAAAADFGKIDILVNNAGVLFLGPVDTFPLEDFDKTLAVNVRAVFVAAKAALAHMGQGGRIINIGSTNADRMPFPGGAAYAMSKSALKGLVQGMARDLGPKGITVNNVQPGPVNTDMNPEDSEFAASLHGLMALQRHAHPDEIASMVAYLAGPEAGFVTGASLNVDGG

SEQ ID NO: 8594 - protein, 602 aa, Ralstonia metallidurans
AVDDVSFTVGRGEIMGLVGESGSGKSMTGYSIMGLIDPPGKVVEGRIALTSRDGVTRDLRALTPAQQRDVRGNRIAMIFQDPMMTLNPVLRIDTQMIEAVRAHDDVSKAAARERARNALARVGIPSPDERLQAYPHQFSGGMRQRVAIAIALLNKPDLIIADEPTTALDVTIQGQILYEMQTLCRESGTALIWITHDLSVVAGLADKVCVMYAGKIVESGDVRQVLEAPRHPYTHGLIDSAPSRNPRGVPLRQIPGMTPSLLNLPSGCAFRERCPYATEICATEPPLELSPDWEAVALLPSGTRPAGGRMSANVMDTPGALASGVAAETAMPPAPLLELRGVSKRFVKSLDIAAKVANVFGAKQRVEIVHAVDRVDLSIRAGEVVGLVGESGCGKSTLGRMAVGLHTLTEGERFWRGTDLDRLPPDRKREKQLAIQMIFQDPYASLNPRMRVLDIVGEAPVVHGMVEKGAQKAYVEDMLVRVGMDPTVLRRFPHQFSGGQRARIGIARALAVKPEFLVCDESVAALDVSIQAQVLNLFMRLREELNLTYLFISHDLGVVKHISDRVVIMYLGRVVESAPTEEVFAAPNHPYTQALLAEAPKL

SEQ ID NO: 8595 - protein, 451 aa, Ralstonia metallidurans
GMERLFQAQRSAFAAAPYPALADRKQGLRRLRDAVRKHADSLAQAADRDFGGRAHAETMMVDVLPSVLHINHLLGGLRRWMRPSRRSVELLFLGNSAKVVYQPKGVVGIVVPWNFPVYLALGPLATALAAGNRCLIKTSEFAPRTSAALRALLAEAFTEDEVAIVEGDADVARQFTGLPFDHLVFTGSPEVGRHVMRAAAEHLTPVTLELGGKSPAIVSSSANLATAARRIAHGKTVNAGQICVAPDYALVPEALAARFATEVLNASAALFPADRDDYASIIHDRAHQRMNDLLDDARAHGAQVMRSAMPEDGRRVPLHVVLGVTPRMRIAREEIFGPILPVFTYRAFEDVVTHIRGGTRPLAMYYFGDDKAESTTLLQRTHAGGVTLNDWGWHVLNHDLPFGGTGTSGMGNYHGAEGFRELSHAKAVFSERKWFPIELFHPPYGTFIQRL

SEQ ID NO: 8596 - protein, 525 aa, Ralstonia metallidurans
FDYVIIGAGSAGCVLANRLSADPSVRVCLVEAGPVDRSPLIHTPAGIVGILPTRHVNWAFETVPQPGLKGRLGYQPRGKTLGGSSAINAMIYIRGHRTDYDDWAALGNPDWSYDGVLPWFRRSEDYFGGADAYHGAGGELTVSALDAHPATHAFIEAGRKSGHAVNADFNGADQEGVGHYHVTIRNGQRCSASVAFLHPLRDKRPNLTVLTGGHATRLILRGNTAEGVTVRVKGRDVELHARRETIVAAGAFGTPQLLQLSGIGDEADLRPHGIAVQHALPGVGKGLIDHPDYILPFKSPDKSLMGVSLQGAAAMTKAFFEYRKSRTGLLASNFGEAGAFLRTDPSLSRPDVQLHWVTGIVDNHNRTLHTGHGMSCHVCVLRPKSRGTVGLNSANPLAPPRIDPNFLSNDDDVTTLLKGYKLSREIMHAQPLARYAGRELYVKGVSSDDQLVDLLRRRTDTIYHPVGTCRMGSDDMAVVDQRLRVRGMERLRVVDASIMPTLIGGNTNAPSIMIGEKGAAMIAED

SEQ ID NO: 8597 - protein, 298 aa, Ralstonia metallidurans
AIEITDVRKRYRNLQALKGVSFSVERGEFFGLLGPNGAGKTTLISILAGLNRANSGRVSVLGHDVVDDYRMARRMLGVVPQELVFDPFFTVRETLRLQSGYFGLTRNDDWIDEIMANLDLTNKADSNMRQLSGGMKRRVLVAQALVHRPPVIVLDEPTAGVDVELRQTLWKFISRLNREGHTIILTTHYLEEAEALCDRIAMLKFGEVVALDRTSNLLTQFAGLQLVLTLSRGTLPPALEALRTPSNPGERAHRLRLSGYEAVEPILAALREAGCEIEDMEISKADLEDVFVQIMRRE

SEQ ID NO: 8598 - protein, 250 aa, Ralstonia metallidurans
YAAGDKPILSGLSMRFPRGKVVAVMGGSGCGKTTVMRLIGGMVRPQRGSVTFNGADIDAMDQKGLYAVRRQMGMLFQFGALFTDLSVFDNVAFPLREHTDLPESMIRDLVLMKLNAVGLRGARDLMPAQISGGMARRVALARAIALDPALLMYDEPFAGLDPISLGLTASLIRNLNDALGATTIIVSHDVNETFLIADYVYFIANGRIAAEGTPDAMRGSDDPFVRQFVHAEVDGPVPFHYAGPALADDF

SEQ ID NO: 8599 - protein, 507 aa, Ralstonia metallidurans
LHLQPGELTLAQLRAVHQQPVKITLDERAFPAIDRSVACVENIIAEGRTAYGINTGFGLLAQTRIAREDLENLQRSLVLSHAAGVGEPIDDALVRLIMVLKINSLARGLSGIRRKVISALIALVNAEVYPCIPLKGSVGASGDLAPLAHMSLLLLGEGRARHRGEWLSAREALAIADLQPLTLAAKEGLALLNGTQVSTAYALQGLFQAEDLYAAASVCGALTVEATLGSRAPFDPRIHAARGQRGQIDAAAVYRHLLGETSQLGQSHAHCDKVQDPYSLRCQPQVMGACLTQIRNAADVLGVEANSVSDNPLVFAQEGDIISGGNFHAEPVAMAADNLALALAEIGSLSERRVSLMMDQHLSQLPPFLVANGGVNSGFMIAQVTAAALASDNKALAHPASVDSLPTSANQEDHVSMAPNAGKRLWEMASNVKGIVAIEWLAACQGMDFREGGKTTEALERARGLLRQSVPFYDKDRYFAPDIEDASVLIAERHLTALLPAGILPSV

SEQ ID NO: 8600 - protein, 448 aa, Ralstonia metallidurans
DSLKNLQRNLSARHIRFLALGSAIGTGLFYGSASAIQLAGPAVILAYIVGGAAVYMVMRALGEMAVREPVTGSFGRYASEYLGPLAGFLTGWTYILEMIIVCLADVTAFGIYMGFWFPEVPQWIWVLGIVMLICGLNLCNVKVFGELEFWLALVKILAIAAMIIGGTLILFLGVKMNGEHSPGLTNLWAHGGFLPHGAGGLIASLAVVMFAYGGIEIIGITGGEAQNPEKVIPRAINAVPARILLFYVLTMTVLMAIFPWTGIGSQGSPFVQIFSGLGIKSAAAVLNLIVISAAISAINSNIFGAGRMMYGMAEQGQAPRLFATTSRHGVPWVTVLAMAAALLGGVVLNYLIPEQVFVIIASIATFATVWVWLMILLSQVAMRRRLSAEEVRALKFKVPLWPVGPALAIAFMLFVIGVLGYVEDTRVALYVGAGWVVLLSLAWFLRAK

SEQ ID NO: 8601 - protein, 220 aa, Ralstonia metallidurans
EGDALEVTQRALSEVVRAQLDRGALPIVLGGGHEVAWGTWQGLRAHLDTAGDAGRVLILNLDAHFDLRTARPGSSGTPFDQIAEACRAAGQPFDYACLGVSRLGNTASLFAHAQALGVRYVEDTEMQERHLDHRLAEIDAMLAQAAHVYLTIDLDVLPAAVMPGVSAPAAYGVPISVIEAIVTHVRGSGKLRAADLAEFNPQFDRDGQSARVAARLVYRL

SEQ ID NO: 8602 - protein, 561 aa, Ralstonia metallidurans
AVPLSGDTMTPYDRKPWLSSYEPGKPHAITPEFTDALSLFRAAVARAPSLPAILYFDGSLSYAELDTQSDALACAWQDRGITRGERVAIYLQNIPQFVIALVATWKLGAIAVPVNPMNRARELRVILADSGARLLVCSETLYVDIVRPLLAEEANAENGVLPLVMTTSELEYQRRHDPRLFANTSRQETPGAESLSAVIAANAGRHPPPAALGPNDIAMLVYTSGTTGVPKGAMNTHGNVAFNAQVYRDWITLGEGEPILGVAPLFHITGLIGHIGAAFMCAAPLVLACRFEPGVMLDTLREHRPAFTIGAITVFIALMNHPNATRDCFASLTKIYSGGAPIPPSVVEAFRERFGHYIHNGYGLTETNSPTHVVPRGVEAPVDPASGTLAVGVPAYNVESYIGDDEGKPMAVGEVGEIISRGPMIVPGYWNKPQESAKAIVDGYFRTGDVGFMDERGWFYLVDRKKDMINASGYKVWPREVEDVLYTHPAVREAAVVGVPDAYRGETVKAVVSLKPGTNVTPEELAEYCKARMAAYKYPRVVMIMDELPKTVTGKILRREL

SEQ ID NO: 8603 - protein, 388 aa, Ralstonia metallidurans
FERTPEQNAICRAVTQLCSDLGAEYWAELDRETQFPEAFHRAMADAGCLGICHPERFGGAGLGITEAALIMQTVSASGAGFSGASSIHMNVFGLNPVVVFGTEAQQAAALPPLIAGRDKACFAVTEPDAGLDTTHLKTQAVRTADGSAYRVDGRKIWISTAQVASRMLLLARTTPLDAVAKPTQGLSLFYTTLDRNHIEVREIDKMGRGAVDSNMLFIDGLMVPAEDRIGEEGRGFEYILHGLNPERILIAAESVGLGRAALEAATRYARERTVFGRPIGQNQGIQHPLAQAWMALEAADMMVWKAAWLYDNGKPCGAEANAAKYLAAEAAHQACQTAVLTLGGMGYAREYHVERYLRESYIPRIAPVSAQLIMCHIAERVLGLPKSY

SEQ ID NO: 8604 - protein, 203 aa, Ralstonia metallidurans
MKLYVHPLSGHAHRAQLLLSLLGQPAELIEVDLMTGAHKSPEFLKLNPFGQIPVLVDGETVVPDSNAILVYLSKKLGRTDWLPEAPATAAAVQRWLSVAAGDIAFGPARARIATLFNAPYDLDDAVARAHVVLKRMDDALADRPWIAADHPTIADVALYSYTARAPEGFVDLRDYGKVRQWLARVEALPGFVPIVKSPVGLEA

SEQ ID NO: 8605 - protein, 507 aa, Ralstonia metallidurans
TPTDTSRFAEVVSNYDADYVSKLSGVPKKQLEQLAELYADPNLKVMSLWTMGFNQHTRGTWVNNMAYNVHLLTGKIATPGNSPFSLTGQPSACGTAREVGTFSHRLPADMVVTNPKHREEAERIWKLPPGTIPDKPGYHAVLQNRMLRDGKLNAYWVQVNNNMQAAANMMEETLPGYRNPTNFIVVSDAYPTVTALSADLILPTAMWVEKEGAYGNAERRTQFWHQLVDAPGEARSDLWQLMEFSKRFKVEDVWPAELIAKKPEYKGKTLFDVLYRNGQVDKFPLKETASDYNNYESKAFGFYVQKGLFEEYATFGRGHGHDLAPFDMYHEARGLRWPVVNGKETRWRYREGSDPYVKAGTGFQFYGNPDGKAVIYALPYEPPAESPDKEYPFWLATGRVLEHWHSGSMTRRVPELYRAFPNAVCFMHPEDAKALGLRRGVEVEVVSRRGRMRTRIETRGRDAPPRGLVFVPWFDASQLINKVTLDATCPISLQTDFKKCAVKIVKV

SEQ ID NO: 8606 - protein, 645 aa, Ralstonia metallidurans
MVELEIDGKKVEVAEGSLVMEAAQKLGTYIPHFCYHRKLSIAANCRMCLVEVEKAPKALPACATPVTPGMKVFTNSEKAVKAQKSVMEFLLINHPLDCPICDQGGECQLQDLAVGYGGSESRYKEEKRVVFHKNVGPLISMEEMTRCIHCTRCVRFGQEVAGVMELGMLGRGEHSEITTFVGQTVDSELSGNMIDLCPVGALTSKPFRYSARTWELARRKSVSPHDGLGANLVVQTKNQRVMRVVPLENEDINECWISDKDRFAYEGLNSADRLTRPMLKQGGEWMETDWQTALEYVANGLASIKRDHGADQIAALASPHSTLEELFLLGKLVRGLGSDNVDFRLRQSDFSAALKGAPWLGMPVADVSTLQRALVIGSSLRKDHPLLASRLRQAVKKGTRVAVIGAGGEDLLMPVAARINAAPSGWTAALAGVARAVAAAKGVTAPAGTEGFDGGDAAKAVADMLLSGERRAVFLGNEAVRHPQFSSLHALAQWIASETGATLGFLTEAANTVGGYVAGALPQQGGANAQAMLDAPRRAYIVLNAEPEFDAADGRKALAALNQAGTVVVLSPFRSEAALQYADVILPVAPFTETAGTFVNAEGKAQSFNGVVRALGESRPGWKVLRVLGNLLEVPGFDFDTAEAV

SEQ ID NO: 8607 - protein, 408 aa, Ralstonia metallidurans
  unsure (1)..(408): unsure at all Xaa locations
MDLNYSAADIAFRQEVRSWLEANLPAGNPRKGTQPPPPQPRRSGAWHKILAGKGWSAPHWPVEFGGTGWNATQRHIWDEENARVGAPGVLPFGVAMVAPVIMKYGNAEQKSYYLPRILDCTDWWCQGYSEPGSGSDLASLKTRAELTSDGKHYIVNGQKTWTTLGQHADMIFCLVRTDPEAKKQEGISFLLIDMKTPGITVRPIIMLDEEHEVNEVFFDNVKVPVENRVGEENRGWTYAKYLLGHERTGIARVGNSKRELGFLKRVARQQQKNGKPLLEDPVFGAKVAALEIELMALEITVLRVVSSEAAGKGPGPEASMLKIKGTEIQQMLTELMVEAVGPYAQPFDPAYLECEHEHAVTGYDDAAPLAAYYFNYRKTSIYGGSNEIQKNIISQMILGLXGDTQHEL

SEQ ID NO: 8608 - protein, 338 aa, Ralstonia metallidurans
DEQKQLADAIRRFVEKSYDFESRKKNIKGANGYGEQAWGGLVELGLTALPVPEAQGGFSGTAVDMMVVQQELGRGLVVEPYFATVVAAQALKLAGGQEALLEQVAGGELKLATAFNEQQARHELNNVTVTAKGGKLNGRKVVVTHGAQADKLVVSARTSGAQSDRDGISLFLVDTKGAGVSVKDYRTIDNLHAADVTFQDAPATLIGTEGKGWDVLEATADYAAVLLCAEAVGVMDTLNAATLEYAKTRQQFGVAIARFQALQHRMVEMMIHAEQSRSITLLAAARFDEASPEERRRYVSAAKARVGVAARSVGQEAVQIHGGMGVTDELPAAHMFKR

SEQ ID NO: 8609 - protein, 517 aa, Ralstonia metallidurans
MNANLFALFESRFPADRTACCIETHDGLYYSWDDLDRATAKLANLLTALKLPAGSRVAVQVEKSPEALFLYLATLRAGYVYLPLNTAYQEAEIDYFVGNAEPAVVVCSSNNFGWVSKVAFRHGTAHVFTLDDNRTGSLLQRAAVQPDTFETVECADDDLAAILYTSGTTGRSKGAMLTHRNLASNAQTLNEYWGWRSDDVLLHMLPIFHVHGLFVASHGALLAGAKMIWAPKLDMGQILKYLPRTTVMMGVPTYYVRMLQEPRFDKELCSNMRLFVSGSAPLLLETFDAFRERTGHTILERYGMSETVMLVSNPYDPALGERIGGTVGRPLPGVSVRVTGSEGKSCEPGVIGNVEVKGPNVFKGYWRMPEKTAEEFTADGWFKTGDVGRLGGAIVSQAGERIVPDNYLTIVGRSKDLIISGGYNVYPKEIESFIDEMPGVVESAVIGVPHVDFGEAVVAVVVRKPGMEIDEAGMIGTLKGRIANFKVPKRVHVVDELPRNTMGKVQKNVLRQQFGAL

SEQ ID NO: 8610 - protein, 946 aa, Ralstonia metallidurans
TYQDYKLIRRNGAVVSFEPNKIAVAMTKAFLAVNGGQGAGSARVREIVEQLTQNVVRALVRSRPNGGTFHIEDVQDHVELALMRSGEHEVARAYVLYREKRTQERAQANAQAVARVQEAGVSFNVTDNGVTYQLDLVALHALIDNACSGLGKAVSAEPILKETLKNLYDGVPMTQVYDSAILAARTLIEKDPAYSQVTARILLHTIRKEILGAEVTQTEMATKYAEYFPKFIARGIEAELLDEKLATYDLARLGAALDASRDFQFNYLGLQTLYDRYFLHVDEVRIEMPQAFFMRVAMGLALEEKDREARAIEFYQLLSSFDFMSSTPTLFNSGTRRSQLSSCYLTTVSDDLEGIYEALKENALLSKFAGGLGNDWTNVRALGSHIKGTNGKSQGVVPFLKVVNDTAVAVNQGGKRKGAVCAYLETWHLDIEEFLELRKNTGDDRRRTHDMNTANWIPDLFMKRVMENGEWTLFSPASCPDLHDKVGKAFEQAYLGYEAKAANGELKLFKKVPAMQLWRKMLGMLFETGHPWITFKDPCNIRSPQQHVGVVHSSNLCTEITLNTNESEIAVCNLGSVNLVAHLMQQADGTYVLDHAKLQKTIRTAMRMLDNVIDINYYAVEKARNSNLRHRPVGMGIMGFQDCLHVLRTPYASDAAVKFADTSMEAVCYYAYQASTELAEERGRYSTYEGSLWDRGILPQDSLKLLAEERGGYLDVDLSSTMDWDSLRGRIKQHGMRNSNCIAIAPTATISNIIGVSACIEPTFQNLYVKSNLSGEFTVVNDYLVRDLKERGLWDEVMVADLKYFDGSLARIDRIPQDLRDIYATAFEVEPTWLVEAASRRQKWIDQAQSLNIYMAGASGKKLDDTYKLAWLRGLKTTYYLRTMAATHVEKSTVQRGSLNAVSSGADGQSGIDAAASAAPAMPEAEGAVCTMRPGDPGFEECEACQ

SEQ ID NO: 8611 - protein, 337 aa, Ralstonia metallidurans
RRVNAADKRVINGATDVNQLVPFKYKWAWEKYLAGCANHWMPQEINMSRDIALWKDPNGLTEDERRIIKRNLGFFVTADSLAANNIVLGTYRQITAPECRQYLLRQAFEEAIHTHAYQYIVESLGLNEAEIFNAYHEVQSIRDKDEFLIPFIDTLTDPSFKTGTPENDQKLLKSLIVFACIMEGLFFYVGFTQILAMGRQNKMTGAAEQYQYILRDESLHCNFGIDLINQIKLENPHLWTAEFKAEITELFKKAVDLEYRYAEDTMPRGVLGLNAPMFKGYLRFICNRRCQQIGLDQLFPNEENPFPWMSEMIDLKKERNFFETRVIEYQTGGALSW

SEQ ID NO: 8612 - protein, 276 aa, Ralstonia metallidurans
KQVTLPGGERVPALGMGTWNIGDHRQTRADEIATLQLGLDLGLRLIDTAEMYGEGLSESLVGEAIRGRRDQTFLVSKVYPHNASRKGAAAACERSLKRLGTDHIDLYLLHWRGDVPFEETIEAFLALRQAGKVRHFGVSNLDLSDMEELWDVPGGDEVAVNQLLYNLSRRGIEFDLLPWLREREVPVMAYSPIEQARLLRSPGLKRFAQSIGKSPAQVALAWLLSRDDIIAIPKTGNRERLRENVGALDLTLSAEQLAALDELFPPPRHVQPLAML

SEQ ID NO: 8613 - protein, 324 aa, Ralstonia metallidurans
RTAILLINLGTPDAPTPKAVGRYLKAFLSDPRVVEIPRLAWLPILHGLILPFRSRASAMKYESIWLREAHMTGSPLLVYTERQAHALQLLMQQQGHDVTVACAMRYGNPSIESVMEALRRQGTEQILLLPLYPQFSGTTTATAFDEAFRVLSTWRNQPELRLVKHFHDHPAYISALHKQVGGYWAQHGKPDFARGDKLILSFHGLPRRLLDLGDPYHCECLKTGRLLGEALGLQPGQFQVTFQSRFGKAEWLQPYTAPTLAELGKVGTQRVDVFCPGFPADCIETLEEIAMEGQSEFRLAGGQDFHFIPCLNDAEAWIAGLADI

SEQ ID NO: 8614 - protein, 302 aa, Ralstonia metallidurans
SIDILAYGEPLIEFNQQPDDPSRYLQGFGGDTSNFCIAAARQGATTGYITAVGADSFGERLLALWTRERVDTRHVVVNASAPTGVYFVSHDNHGHRFDYLRERSAASRYHHEQLPLATIAQARFLHLSGISLAISTSACDAGLAAMEHARKAGAKVSLDTNLRLRLWSLARARGIMREAFSLTDICLPSWDDITILTGLDDRDAIVDYLLGCGVELVALKLGEEGSYIATQESRALVAPFPVRPVDATGAGDCFGGSFIARLAADADPFDAARYANIAAALSTTGYGAVAPIPHAETVRARL

SEQ ID NO: 8615 - protein, 434 aa, Ralstonia metallidurans
RRARVLKHLRANGGGVAIVPTAPEAMRNRDSDYPYRHDSYFYYLTGFTEPEAVLVLVAGGPGDDTNSSILFCRPKHEEREIWDGFRYGPEGARAMFGFDEAHSVEDIDKLLPPMLANRATLAYPLAATADFDARVRGWLDAVRMQGRAGVSSPSAALDVRALLDEMRLFKDAGELVTMRRAAEISAQAHVRAMRTSRHGLREYHLEAELLYEFRRHGAQSVAYNSIVATGPNACVLHYRAGPAELRDGDLCLIDAGCELDGYASDITRTFPVNGRFTPAQRELYDLVQAAQDAAIAETRAGVPYNVPHDAAVRVLAQGMLDTGLLDRNKEGTLDDVLASGSYRRFYMHRTGHWLGMDVHDVGEYRVPGPLPAGHEGERAWRPLEAGMVVTIEPGIYVRPAEDVPERYWHIGIRIEDDAVVTSGDCELITRGILR

SEQ ID NO: 8616 - protein, 681 aa, Ralstonia metallidurans
PASLLDKLWASHVIHEQSDGPSLIYIDRHLVNEVTSPQAFEGLRLHGREVWRPASVLATADHNVPTTERAAGIADPISRAQVDALERNCAATGIVNFGMNDPRQGILHVVGPERGATLPGMTIVCGDSHTSTHGAFGAFAFGIGTSEVEQVLSAQCLWMKKPRSMLVRVEGELAAGVSAKDIALALIGRIGTAGATGYVIEFAGSTIRGLSMEGRMTVCNMAIEAGARAGMVAVDETTLAYLAHRPQAPQGEAWESASAYWRTLRSDPDAVFDAVVDIGVATIRPHVTWGTSPEMVVAIDERIPDPRQEADPVRRRGMERALTYMGLEPGIKVASIALDKVFIGSCTNARLEDLRAAADVLRGRHVASNIRQALVVPGSGLVKSQAEAEGLDRVFIDAGFEWREPGCSMCLGMNDDRLAPGERCASTSNRNFEGRQGPGGRTHLVSPQMAAAAAVAGHFVDVSTVLQEKSAVKAFTVLDGLVAPIDRANVDTDAILPKQFLKSIQRSGFGPYLFDEWRYLDPGEPGQDCSQRPRNPDFVLNQPRYQGASVLLVRENFGCGSSREHAPWALEDFGLRALIAPSFADIFCNNCMKNGLLPIVLEANVVDRLFAEVDATPGYRLHVDLATQLVTTPSGDAISFSMDPFKKHCVLNGLDDIGLALQHEEAIRRYELNRIRHEPWL

SEQ ID NO: 8617 - protein, 643 aa, Ralstonia metallidurans
MGKIIGIDLGTTNSCVSILEGNTPKVIENSEGARTTPSIIAYMEDGEILVGAPAKRQAVTNPRNTLYAVKRLIGRKFEEKEVQKDIGLMPYAIVKADNGDAWVGVRDQKLAPPQVSAEVLRKMKKTAEDYLGEPVTEAVITVPAYFNDSQRQATKDAGRIAGLDVKRIINEPTAAALAFGMDKNEKGDRKIAVYDLGGGTFDISIIEIADVDGEKQFEVLSTNGDTFLGGEDFDQRIIDYIIGEFKKEQGVDLSKDVLALQRLKEAAEKAKIELSSSQQTEINLPYITADASGPKHLNLKITRAKLEALVEELITRTIEPCRTAIKDAGVKVSDIDDVILVGGMTRMPKVQEQVREFFGKEARKDVNPDEAVAVGAAIQGSVLSGDRTDVLLLDVTPLSLGIETLGGVMTKMINKNTTIPTKHAQVFSTADDNQPAVTIKVYQGEREMATGNKMLGEFNLEGIAPAPRGTPQIEVSFDIDANGILHVGAKDKATGKENRITIKANSGLSEDEIQRMVKDAEANAEEDKRARELADARNQADALIHSTRKALGEYGEKLEAGEKEKIEAAIKDLEDAARGGDKAEIDAKVNALSEASQKLGEKVYADMQAQAGEGAAAGAGAAGGAQQQAQPQDDNVVDAELQE

SEQ ID NO: 8618 - protein, 436 aa, Ralstonia metallidurans
TSVGVREHHGRDESPFPPELPDAVVFAHSTEEVAELAKLCNTHGVPLIPYGAGSSLEGHLLAVAGGISLDLSQMNRVLAVHPEDLTVTVQPGVTRKQLNQEIKDTGLFFPIDPGADASLGGMCATRASGTNAVRYGTMRENVLALTVVTADGRVIRTGTNARKSSAGYDLTRLFVGSEGTLGIITEVTVRLYPQPEAISAAVCAFPSMGDAVRATIQTIQLGVPVARVEFVDALAIRAINRHDNLTLPETPHLFFEFHGTEAGVREQAETVQDIAAEHGGQGFEWATRPEDRSRLWNARHTAYFAMLQLKPGCKSVTTDVCVPISRLADCVTETERDLNASSLPCPIVGHVGDGNFHVAILVDPDKPEEMAEAEDINRRIVQRALAMGGTCTGEHGVGLHKMGFLVQEHGEDALDLMRAIKDALDPNHILNPGKIF

SEQ ID NO: 8619 - protein, 489 aa, Ralstonia metallidurans
GESAETRRATLLAGLARILPDTAVLWKAEDTVPYECDGLAAYRQVPDAVVLPDTEEQVCAVLRLCHELGVPVVPRGSGTSLSGGAMPIAGGLVLSLAKFKRILSLDPYSRTAVVQPGVRNLAISDAAAPHNLYYAPDPSSQIACSIGGNVAENSGGVHCLKYGLTVHNVLRVRAVTMEGEVVVFGSEAPDAPGLDLLAAMIGSEGMLAVVTEVTVRLIPKPQLAQVIMASFDDVEKGGNAVADVIAAGIIPAGLEMMDKPATAAVEEFVKAGYDLDAAAILLCESDGTPEEVAEEIARMSEVLRASGATRITVSQSEAERLRFWSGRKNAFPAAGRISPDYYCMDGTIPRKHIGTLLKRIEQMEHKYGLRCINVFHAGDGNMHPLILFDGADHDEWQRAELFGSDILEACVELGGTVTGEHGVGVEKLNSMCVQFSPSERDAFFGVKAAFDPARLLNPDKAIPTLARCAEYGKMHVKRGLLPHPDLPRF

SEQ ID NO: 8620 - protein, 264 aa, Ralstonia metallidurans
FLGGGNMASALIGGLVARGVPANAIRVVDPFEDARQRLATTLGVQTLAAPDAAFGASNVIVLAVKPQQFKDAVGALAPQLKNSLIISVAAGIRLQDMQRWLGTNRLVRAMPNTPALAGMGMTGLAAAPGLSDEDRAIAKAVAEAVGQCVWVEGDDQIDAVTAISGSGPAYVFYFVEAMERAAIEMGLSAEQGRKLAVETFRGAAALAAESSEPVSTLRERVTSKGGTTYAALTSMDASGIQDAFVRAMLAAAARGREMGAEFGK

SEQ ID NO: 8621 - protein, 250 aa, Ralstonia metallidurans
MEGKVVVVTGAGGGIGRGIALGMAAAGARVVVNDLGVSMSGEGGDAGPAQRVVEEIRAAGGQAVANTDSVSTWAGGNAIVQCALDTFGRIDAVVNNAGNLRDRMFFKMNEEEWRSVIDVHLHGTFFVSRAAANYFKDQESGAYVNMTSTSGLIGNLGQANYSAAKLGIAALSKSIALDMARFNVRSNCIAPFAWSRMTSSIPAETPAEKERVARLQKMEAGKIAPVAVFLASDAAKDVNAQIFAVRANEI

SEQ ID NO: 8622 - protein, 376 aa, Ralstonia metallidurans
IREAVRDLCKQFDSAYWQRIEEHSAFPEEFVQALTHAGWLSALIPEAYGGSGLPLTAASVIMEEINRNGGNSGACHGQMYVMGCLLRHGSEAQKQRWLPGIASGELRMQSMAVTEPTTGTDTTKLKTTAVRRGDKYVINGQKVWISRVQHSDLMLLLARTTPLDQVKKKSEGLSVFVVDLREAIGNGLTVQPIRNMVNHETNELFFDNLEIPAENLIGEEGKGLKYILDGLNAERILIAAECIGDGYWFVERASSYARERIVFDRPIGQNQGVQFPIARSFVNVEAASLMRYKAAQLFDAGKPCGKEANMAKLLAADASWEAANVCLQTHGGFGFAAEYDIERKFRETRLYQVAPISTNLILSFVAEHVLELPRSF

SEQ ID NO: 8623 - protein, 569 aa, Ralstonia metallidurans
SNFLRSIIDQDLATGTYAGRADKQGDPLPTVITRFPPEPNGYLHIGHAKSICVNFGLARDYAGRCHLRFDDTNPVKEDTEYVDSIIDAVHWLGFSWDSAQAGSTPHLYFASDYFDQLYKFAETLIERGVAYVDSQSAEQIAAMRGNFSEPGKPSPFRDRSVEENLKLFREMRDGKYADGEHVLRAKIDMTAPNIVMRDPVLYRIRHAHHHRTGDKWCIYPMYDFTHCISDAIENITHSLCTLEFENNRPLYDWVLEHLRDAGVFANPLPHQYEFARLNLTYAITSKRRLKQLVDEQRVTGWDDPRMPTIVGIRRRGYTPESIQLFCDRVGVSKADSWIDMSTLEGAVRDDLDARAPRSVAVLDPLKLILDNYPEGQSEECSAPVHPKQPEMGRRVFPLSRELWIEREDFNENPPKGYFRLFPGNKVRLRYGYVIECTGVDKDADGNVIAVHANYLPETKSGTPGADSVKVKGNIHWVSAPHACEAEVRLYDRLFNDPNPDAGGKNFLDALNPESKKVVTAYLEPGLRDAKPEDRFQFERHGYFVADRVDSQPGKPVFNRTVGLKDSWGK

SEQ ID NO: 8624 - protein, 389 aa, Ralstonia metallidurans
RYIKTIAVQPELDIAPGFDSFSTPTYRGSTVVFRNLAELRAYGDRSKTYWRYGLHATPTSEALCQQLAQIEGGRHTLLFPSGLGAISLVYFGLLRTGDDVLVPENVYGPNRDHGDWMAREFGITVRPYHPSVGAGIASMIQPNTRLIWMESPGSVTMEVPDTEAIVAAAKARGVLTAIDNTWSAGVYYRPFEKGIDISVQALTKYQSGGSDVLMGAVITRDDHLHDRLKRTRMLMGWGVSADDCYLVLRGLASMPVRLAAHDRAAREVAEWLTKRPEVARVLHPALPDCPGHAEWLRDFSGASGLFSIILHSRYTREQVDAFVEALKLFAIGWSWGGAHSLAVPYHVDTMRPAGTWPPAGWENAGELVRLYIGLEDTRDLIADLKQALE

SEQ ID NO: 8625 - protein, 394 aa, Ralstonia metallidurans
MAREVVVVSGVRTAIGTFGGSLKDQAPTDMGALVVREALARAGVSGDDVGHVVFGNVIQTEPKDMYLGRVAAVNGGVSINAPALTVNRLCGSGLQAIVSAAQTILLGDADVAIGGGAESMSRAPYLAPMARWGARMGDAKLVDMMLGALHDPFHAIHMGVTAENVAKEYDISRQQQDEAALESHRRASAAIKAGYFKDQIVPVTLKSRKGDVVFDTDEHVRHDATMDDMTKLKPVFVKENGTVTAGNASGLNDAAAAVVLMERAEAERRGLKPLARLVSYGHAGVDPKTMGIGPVPATKIALERAGLTVKDLDVIEANEAFAAQACAVTKALGLDPAKVNPNGSGISLGHPIGATGALITVKALYELQRVQGRYALVTMCIGGGQGIAAIFERV

SEQ ID NO: 8626 - protein, 358 aa, Ralstonia metallidurans
KAAVMEKAGAPLVIHDVAIAEPGPREVRVRTAAVGLCHSDLHMMQGTYPLPLPAVLGHEVSGVVEAVGTQVSGLKAGDHVVGCLSVYCGHCSVCASGHQVLCQNPEVKLPPGKANRLRLAGNPLSQVFNLSGFAEEILVHENALVKIRDDMPLDRAALLGCAVITGTGAVFHSAKVPPGSTVVVVGCGGVGLSVINGAVIAGASRVIAVDMLPAKLELARKFGATDVVNAGDGDPVAQVMQLTGGGAEFAFECIGLKQTAEQCYAMLAPGGTATVIGLFRPDARIELPALDFLKEKRIQGSFMGSNRLSLDIPRLVELYMQGKLLLDDLISQRISLEDINEGFIAMQSGSVARSVITF

SEQ ID NO: 8627 - protein, 252 aa, Ralstonia metallidurans
KTALVTGSTSGIGLGIAEALGRAGANIVLNGFGDVDAALATIAATGAQSAHHPADMRKPDEIEAMIAMARERFGTVDVLVNNAGIQHVAQVEDFPAQKWDDILAINLTSSFHTTRHVIPAMRARNWGRIVNIASVHGLVGSAGKSAYVAAKHGLVGLTKVTALETAGTGITCNAICPGFVLTPLVAAQIDAIAKRDGISMEAARARLLSDKQPSGQFVTPEQLGNLVLMLCSPFGDQVRGAAWAMDGGWTAQ

SEQ ID NO: 8628 - protein, 732 aa, Ralstonia metallidurans
RADRSSGGDFDYEQARVAGRMVFFVDGLWCVSCAMALQRVLQRVPGVVSATVNFTSGSALVTWVPESIDFPLLLRKAEGLGYALSPLKGSDELEAALQRQARKIRLQLTVAVVFGMWSMLGSWVLYLNADEAAALVIAWASVVASLPVVGYSAWDFYRAAARSLRAGIAGMDVFASVAVLGSLFVSVGSLAMGSVAIYTDAATMLITFLLIGRLIEIHARQESGLAVQALRSLAPETATKLTSAGGEKAESTVLLAELAPGDTVLIRANERIAVDGIVVAGQSAVDLSLLQGESAPRSVQPGERVFAGSVNLRGPLTVHVTAGAGDRRLDVLGLRMLELFGARSSLSETAERFVRILLPVVVTASLLAFVHYLWNGSSADQALLGALSLLVAACPCAVGLAMPLAYAFTCREAARRGVLLRDSASVEALARARIMAFDKTGTLTCGQMRIVSIQTRHGGAEQDLIDLAARAEAGVAHPIAHAVVLAARQSGMSSACEPDGCQVTACAKGVTMHVPGGETVWVGERHWLLAAGVEGMPPEDGLPGLVHVANAGIGSGSLRLQDAPRDDARSSLQRLRAQGLKLWLLTGDSSAASERLTADLGIDFDRVEADCSPEEKADIVAKSPAPVAFVGDGANDGLVLAQAACGIAIPGSSSVAVSAAGVVIAHGSVGAVVETRELARKFDRIVRQNLAFSVVYNLAVIVVLFEAGVTPFAAALAMLASSASVLLNTCRL

SEQ ID NO: 8629 - protein, 256 aa, Ralstonia metallidurans
PPAPEPRMLEIRNLTKKFGGLTAVHDVSVKFETGHINAIIGPNGAGKTTFFNLIAGTHAPTSGQILLKGQDVAGLRADQIARLGVARTFQATSLFDRATVLDNLIVGHRLRTKSGLADVLFNTSRLREEEKLCREKAEAALDFVGLSHLAHELAADITQEARKRVAFALALATDPDLLLLDEPAGGVNPEETVGLAELIRKMVRHGKTVCLIEHKMDMIMRLADKIMVLNYGEKIAEGTPAQIQQDPHVIEAYLGA

SEQ ID NO: 8630 - protein, 711 aa, Ralstonia metallidurans
GRSGLVLVQPLRQEFGSLVYFLSYGKLFSSIYYELIAIGSLSMMLIIAIVISARYWDIHLLRHGQAEATRALENETINHILVNATPIGLCIVGQQDHVIVTSNLVADTLLGFSQGATMPARIIDALRQRPSQAFSDAFGPIAQIRVPGCANADAAQQCNSTTEAAPASKPQFLQITSAPAKYRGECVLFCAIQDVTAQQQLEQKLRSAQQATEAMMRARSNFFAAMSHEIRTPLNALLGNLELLGRSAGLEAHATRLRALQSSSEGLRRIVNDILDFSKIDAGEMKLVSAPFNPLDELESLSLSYAPMVTDRPIRFYAHLSPTLSTLLRGDRMRLAQIVNNLLGNAFKFTASGKISLSAEISRDAQGLATLVCRVRDTGDGMSQALASRVFQPFVQGETSTTAQYSGTGLGLSICARLSELMGGHISVESVEGVGSAFTVVIPFAEPAATAPPHGLTMLGGMVMVLCQETESGATLEAWLTRVGCQVHVLPASCAAHAWLCTSHPQIMVVTGEYGLDTIRSLRTVCPTNAVWITRNGPDRPAELESGIFEVSAYSHTAILAGVKAALVAPPRLVETTNRTASASENARPEAASHSPHQHGTVLVAEDNPLNRMLIAEQLETIGWASIVVNDGRQALAVLDQRVVDIVLTDIQMPVMNGYELLSAIKTKRPPLPVFAFSAVTHAGQASDWQARGFDGYIAKPVSLAELEHAL

SEQ ID NO: 8631 - protein, 180 aa, Ralstonia metallidurans
EARMEDVLRTLVIDVDQDHNTRETARRVAKMYLKEIFAGRYAKAPDVTEFPNVEQLNELMIVGPIRVRSACSHHLCPIIGSLWVGVMPNRHSNLIGLSKYARLAEWIMCRPQIQEEAVAQVADLLQEKMNPDGLAIVMEAEHFCMHWRGVRDTDAKMTNSVMRGSFLKDDKLRREFLTLL

SEQ ID NO: 8632 - protein, 306 aa, Ralstonia metallidurans
MSSPIVFIDGDQGTTGLLIHERLRNRTDIRLITLAAAERKDLQRRAEAINACDIAILCLPDAAAREAVATIVNPAVRVIDASSAHRTQPDWTYGFPEMAPGQAEKIANARRVTNPGCYPTGAIGLLRPLVQAGLIPGDYPISIHAVSGYSGRGRAGVEEYEGPGAASAPSYQVYGLELAHKHTPEIQQHAGLAQPPIFVPAYGAFRQGIVLTVPLALRLLAPGVDGATLHACLARHYAEADHVQVLPLSESSAVKHLDPQLLNGTNDMRLSVFPGTEHGHVLLSAVFDNLGKGASGAAIQNLNLML

SEQ ID NO: 8633 - protein, 468 aa, Ralstonia metallidurans
DTNFAQRLTETLGPDVVTTAPDDVAPWLSDWRGLYKGQAQAVIRPRTTEQVAQALALCQQAGVPVVPRGGNTGLCGGAAPDGNQTNVVLSLDRMDKIRSIDTIANTMVVEAGCILGNLRRAAEDADRLFPLSLAAEDSCQIGGNLATNAGGVNVVRYGMTRELVLGVEAVLPNGEIFHGLRTLRKDNTGYDLKQLLIGSEGTLGIITAAALRLLPRADSRAVVLAAVESPKQALELFSLLFARCGARLQAYEFFTGACLDLVLTHVEGIHAPFAERYPAYVLVEIADTAPEDVLNALLESVIGDALEQGLCLDAAVSASLAQLQSLWRLREEISEAQRADGLHLKHDVSLPIEAIPDFMTSMETRLAARHPGVRPFIFGHFGDGNLHYNLSRPLGADPKWALNEGKAVSEDVLEEVARYDGSISAEHGIGQLKRESFLALKDPLELRLMRAIKQVFDPSGIMNPGKLL

SEQ ID NO: 8634 - protein, 325 aa, Ralstonia metallidurans
NGPSLRRNPIMNELEQLRQFTTVVADTGDFQLMKQYKPQDATTNPSLIFKAVQKPEYRPLLEQAVRDHHGNSGLDGVMDQLLIAFGCEILAIVPGRVSTEVDARLSFDTEATVAKARHLIGLYEQRGVARERVLIKIASTWEGIRAAEVLQRENIRCNMTLLFSLAQAVACAEAGAQLISPFVGRILDWYKKQAGEKWDPVANGGENDPGVRSVRQIYDYYKKFGYATEVMGASFRGTDQILSLAGCDLLTISPELLEQLAGGQSAVALKLSVEQAQAGNVARIAADEPAFRWQLNEDAMATEKLSEGIRLFAADAVKLEKLVGE

SEQ ID NO: 8635 - protein, 224 aa, Ralstonia metallidurans
VHQFIFGIYPYIAAAIFLFGSLARFEREQYTWKSDSSQMLYRGNLRTGNILFHVGILGLFFGHLVGLLTPVVVWDTLGVSHGLKQAIAMSAGGVMGTMCLAGLLILLHRRLTNARVSAVTRFGDKVLLLWLLVTLLLGLSTIFESASHMDGHMMVQLMTWAQHVVTLRADAASYVAEAPLLFKAHLFMGISLFAIFPFTRLVHVWSGFASVTYLGRAWQLVRGR

SEQ ID NO: 8636 - protein, 197 aa, Ralstonia metallidurans
MPIHQVLSTLLCYPEQEWLDSLEEANLALVEWPQARDMLAPLLDELRSRPLIELQENYVATFDRSPSHSLHLFEHVHGESRDRGQAMVDLIDEYRRDGFEPLETELPDYVPLFLEYLGALSLDGKEERAEQLLGDAIHVLAAIGDRLARKESPYAAVFRVLRTLTDVQPVAQQDPPVRDMDEAMETFGPGADGVEPL

SEQ ID NO: 8637 - protein, 496 aa, Ralstonia metallidurans
MKIRAQVAMVLNLDKCIGCHTCSVTCKNVWTSREGVEYAWFNNVETKPGVGFPKEWENQDKWQGGWKRNADGSLTPRQGGKTKILANIFANPNLPQIDDYYEPFTFDYEHLQNAPLMQTPPTARPVSAITGKKMEKIEWGPNWEDDLGGEFDQRSRDKLFEDIQKDMYSTFENTFMMYLPRLCEHCLNPTCVASCPSGSVYKREEDGIVLVDQDKCRGWRMCVSGCPYKKIYFNWQTGKAEKCVFCYPRIEAGQPTVCSETCVGRIRYLGVMLYDADRIEQAASVADERDLYQSQLDVFLDPHDPKIQAEALRQGIPQSWLDAAVKSPVYKMACEWKVAFPLHPEYRTLPMVWYIPPLSPIQSAAESGFMGMNGVIPDVKSLRIPVKYLANLLTAGDVNPVLSALERMLAMRAYKRSESVDGLQDLAVLEQVGLTPAQVEDMYQIMAIANYEDRFVVPSSHKEMAEDSFDEKGSCGFSFGNGCSGGTSDGSLFGTK

SEQ ID NO: 8638 - protein, 1218 aa, Ralstonia metallidurans
KSTYSDGHGAVVNEDRKWENTYRSRWQHDKIVRSTHGVNCTGSCSWKVYVKNGLITWETQQTDYPRTRPDLPNHEPRGCPRGASYSWYVYSAQRVKYPMIRGRLMEMWREARKTMDPISAWESISQNPEKARRYKSVRGQGGFVRADWQTATEIIAAANAYTIKQYGPDRVIGFSPIPAMSMVSYAAGARYLSLIGGACLSFYDWYCDLPPASPQIWGEQTDVPESADWYNSTYLMVWGSNVPQTRTPDAHFYTEVRYKGTKTVAVSSDFGEMVKFGDIWLAPKQGTDAALAMAMGHVVLKEFHATGKSAYFRDYVKQYTDMPLLVLLREQDGTLVPDHFLRASHLDGNLDQANHPEWKTLAIDDATGEIVAPNGSIGFRWGEAAHDNGAKVGRWNLEMKDGGSGREIDQRLSLIGHEDEVVEVGFPYFGGEHDALLKRRVPTRRLTLADGTTVHVATVYDLQMANYGVDQGLGGPNVATSYDDDVPYTPAWQEKHTSVPRNLVIQVAREFADNADRTQGKSMVIVGAALNHWYHNDMIYRGIINLLMMCGCIGKSGGGWAHYVGQEKLRPQFGWAPLAFGLDWSRPPRHMNGTSFFYNHTSQWRHEKLGVDEILAPTADRARYDKLSLLDLNAKSERMGWLPSAPQLGRNPLDVVAEARAAGKDPIADTVEQLKSGKLQFACDDPDNPANFPRNMFVWRSNILGSSGKGHEYFLKYLLGTQNAVFGDENDAIKPSEVTVRPAAEGKLDLLTVLDFRMSTTCLYGDIVLPTATWYEKDDLNTSDMHPFIHPLSEAVQPLWESKTDWEIYKAIAKTFSEIAGPYLGTREDLVCTPLLHDTPGELGQPFEPKDWKHGECDLIPGKTAPSMTVVERNYHDIYKKFTSIGPLLDKLGNGGKGINWNTEHEVHEIGHLSKTVTEPGVSQGRPRLETAIDAAEMILTFAPETNGHVAVKAWDALSKITGRDHTHLAVGREHDKIRFRDVQAQPRKIISAPTWSGLESEEVSYNAGYTNVHELIPWRTLTGRQQFYQDHRWMLDFGEGACVYKPAIDTKTISPMLGKKPNGNPELVLNWITPHQKWGIHSTYSDNLRMLTLSRGGPHVWISEVEAKANGIRDNDWVEVFNVNGTLTARVVVSQRVPQGMCLMYHAQEKIVNVPGAETSGMRGGIHNSVTRAVTKPTHMIGGYAQLAYGFNYYGTVGSNRDEFVILRKMNKVDWLD

SEQ ID NO: 8639 - protein, 396 aa, Ralstonia metallidurans
RMAADYGDVVHLRMWPEHAVVVTDPQLVRELLVTHHDSLIRWERGTRVFSRVHGHSVLTAEGDAWSRKRQALQPGFMPKAVHGFVPGIVEIVDKGLATWPTRVADWPVESALTSLTMDVIVRMMFSDEIGEDARVAECAVRAISEAANADFYWPASLPDWVPWKRARRRALHTLRDLIERHLQARLRMRTDTWPDDLLSRLLCLHRDDATAWPLQAVRDECMTTFLAGHETTAATLTWWAWCMASNPSAQDAARAEVTHVLRGQAPTADSRQALRQVVQTITESMRLYPVAPVLISRRAVRPITLGPWRLPARTLFMLPLQLMHHDPRLFPEPERFQPDRFSTGSPQAPRGAYMPFGTGPRVCLGQHLATAEMTVIAAMLLQRYKLSVPEGAAHPR

SEQ ID NO: 8640 - protein, 436 aa, Ralstonia metallidurans
MNPIKVGLLGIGPSVAARSTCSSAIRRKFVAVQGRGIEIAVVADLNTERARELTGGTVDVVSDANDVVTRPDIDIVIELIGGYGIARELVLKAIENGKHVVTANKALLAVHGNEIFRGRAQEGRDRRLRAAVAGGIPIIKALREGLTANRIQWIAGIINGTTNFILSEMRDKGLDFDTVLKEAQQLGYAEADPTFDIEGVDAAHKVTLMSAIAFGMPVQFDRAHVEGITKLSAIDIKYAEELGYRIKLLGITRRREEGVELRVHPTLVPASRLIANVEGAMNAVLVQGDAVGATLYYGKGAGAEPTASAVIADLVDVTRLHTADPNHRVPHLAFQPDELSNVPVLPIDEVTSSYYLRMRVSDETGVLAEITRILAEAGISIDAMLQKESREGEPQTDIIILTHLTREKHVNAAIRSIEALQTVLSPVTRLRMEELN

SEQ ID NO: 8641 - protein, 484 aa, Ralstonia metallidurans
LTLNPGHVSLDDLRRIHRGEVRLAMAESAWAGVRAAQATVQDIIDADAVVYGINTGFGKLAQSRIAHDKLAELQRNLVLSHSVGTGSDLSVDTVRLILAIKAVSLARGHSGVRPELIEALLALANHGVTPCIPAKGSVGASGDLAPLAHMSCTLIGVGDVYVDGQRVPAAQGLVHAGLAAFTLGPKEGLALLNGTQVSTALALAGLFAAEDAFAAGLVAGALSLEAIKGSVKPFDARIHAARGQAGQIAVAGAARAMLDGSEIVDSHKMCGRVQDPYSIRCQPQVMGACLDNLTHAARILRIEANAASDNPLVFSEQGDVVSGGNFHAESVAFAADIIALAIAEIGAISERRLALLLDTGLSGLPPFLVRDGGLNSGFMIAQVTAAALASENKSLAHPSSVDSLPTSANQEDHVSMATYGARRLGEMAANTAVIVGIEAMAAAQGIEFHRPLKSSPLVEQELARIRARVAFVEADRYLAPDIEA

SEQ ID NO: 8642 - protein, 393 aa, Ralstonia metallidurans
FYASIRAELDSIRAAGLYKRERVIATPQGAKIRTADGREVINLCANNYLGLSSHPKVIEAAHEALRTHGYGLSSVRFICGTQDLHKELEGRLARFLGTEDTILYGSAFDANGGLFETILGPEDAVISDELNHASIIDGIRLSKARRLRYRHNDLDDLRAQLRQADADGARFKLVFSDGVFSMDGTVARLDEIRKICDEHGALLGIDECHATGFMGARGRGTHEARGVFGKIDIITGTLGKALGGASGGFTSGRKEVVELLRQRSRPYLFSNTVAPAIVGGSIAVLDILEGSTELRDRLEQNTQFFREGIAKLGFDIKPGDHPIVPIMVYDAEKAQQLADRLLELGVYVVGFFYPVVPKGQARIRVQMSAVHDAVTLQSALDAFGQAGRELGLI

SEQ ID NO: 8643 - protein, 368 aa, Ralstonia metallidurans
QPLLSIRDLSIALPAGGDRAHAVKDISYDLHAGEILCIVGESGSGKSMSANAIMGLLPSYLKPERGEILFQGRDLLKLDETTLLGMRGKDMAMVFQEPLSALNPVMTVGDQIAEVMRVHRAYPGEACQRRVLELLEFVGLPDPATLVHSYPFRLSGGQRQRVVIAMALALEPTLLIADEPTTALDVTTQAQILALIRRIQAEKGMGVMFVTHDFGVVAEIADRVAVMEKGVLVEIGTAQQVLNHPQHPYTRRLISAVPHGRARDGGHADDRTVLDVRNLRKTYVSGGGLFSKKRVTHAVDDVSFSVKRGETLGIVGESGSGKSTIGKCLLRLTGVDGGQMLFDGQDIARLSERQFRPMRRDVQMIFQD

SEQ ID NO: 8644 - protein, 391 aa, Ralstonia metallidurans
RAENSEIWDVEGKRYIDFAAGIAVLNTGHRHPRLVAALQAQLNRFTHTAYQIVPYASYVELAEKINQRAPGRSARKTAFFTTGAEAVENAVKIARAATGRPGVIAFSGGFHGRTMMGMALTGKVAPYKTGFGPFPGEVFHAPYPSALHGVTVEDSRRALEHLFKADIDPRRVAAIIFEPVQGEGGFNVAPPEFVRMLRAVCDEHGILLVADEVQTGFGRTGKLFAMEHYDVAPDLTTMAKSLAGGMPLSAVCGRAEIMDAPAPGGLGGTYAGNPLAVASALAVLDVLESENLIARGAELGERLTARLNSLKPRVPQIAEVRGIGAMVAVEFRRADGSPDAEFTREVQNRALERGLLLLSCGVYGNVIRFLFPLTIQDAVMNEGLDILADVL

SEQ ID NO: 8645 - protein, 521 aa, Ralstonia metallidurans
NGGQILVEQLRIQGTKRVFLVPGESYLPCIDALYDHQDAITPIVCRQESGAGYMAEAYGKLTGEPGVCFVTRGPGATNASIAVHTAFQDSTPMILFVGQVGNDFYEREAFQEIDYRRMFGQMAKWVAQIDRTDRIPEFVARAYAVATSGRPGPVVLALPEDTLWGRATVADMPRYERVHGAPTPVALDKLSTLLAGAKRPFLLVGGSGWTPTAMRQIEGFAERFGLPVGVAWRRLECFDNGHPNFAGHVGWGMVDALRQRIHEADLVIAVGTRMGEATTEGYTLVESPQPRQKLVHVYPDPDELGRVFRPTLPIAADVVSFAAAVAQLSPAQTVSREAMTAVTAANANFLAEQEPKDAPGALNLNRVACHVRDHVPDDACITVGAGNYALFAHAYHRFHGVGTSLAPTVGSMGYGLPAAISAKLENPSRTVVCYAGDGCFQMNLQELGVAMQYRLGIVILVFNNGMWGTIRAHQEREFPGRTIALGFDNPEFSQLVKAYHGHGEVVDRDEDFAPAFARALE

SEQ ID NO: 8646 - protein, 469 aa, Ralstonia metallidurans
YIDGQWTSAADGATFDCINPATGEQLARVAACGAADVDRAVAAARRAFEAGVWSAMPRRERKAVLLRLAALIETHREELALLETLDMGKPIGDTMLYDIPEAARTYAWYAEAIDKVYDEIAPTDAGVLATITREPLGVVAAVVPWNYPLLMASWKVAPALAAGNSVVLKPAEQSPLTAIRLAALAEEAGVPPGVFNVVPGLGAEAGQALGRHPDVDCLAFTGSTATGKRFMEYSGQSNLKRVWLECGGKSPHIVFDDCPDLDRAALAAAIGIFNNQGEICIAGSRLYVQRGIYDTFMAKLEAHAAAMQPGDPLDPRSAMGAIVDGRQFDRVMSYVEAGQREGARLRAGGQAARADSGGWFVQPTIFECPTQSLSIVKEEIFGPVLAVTVFDTEAEAVAMANDSAYGLGAGLWTSDLSRAHRVSRRLRSGLVWVNCYMDGDITVPFGGVKQSGFGRDKSLHALEKYQDLK

SEQ ID NO: 8647 - protein, 346 aa, Ralstonia metallidurans
SEHRIPTAGLHQWVVDLWLAAGSDAREARLTADHLVGANLSGHDSHGVGMIPKYVMSWQGDQLQLNQKVSVVHESGGILSLDGNRGMGQAVTEQAMGMGIERAREHGVCVLGLRRSHHLGRVGHWAEQATAAGMISIHFVNVLSKPIVAPHGGYDARFGTNPFTIGVPLPAQPPLVLDFATSAIALGKVRVAHNKGVAVPPGSLMDPNGHPTDDPSVMFPGAGGPQGALRTFGEHKGYVLAVMCELLGAAVTGGHTIRPETLTHEHAVWNNMLAIIFDPARLGSSTTFGHEVEAFVEWVKASRLQPGNDQIRLPGDTEREWRRARADFIPVDSSTLAQLDDAAARV

SEQ ID NO: 8648 - protein, 371 aa, Ralstonia metallidurans
IVGAYEHPTRKAPDKTVAQLHAECAKGALEDAGLTLQDVDGYFCAGDAPGLGANSMADYLGLTNLRHVDTTDTGGSAYLIHVSHAAQAIAAGKCNVALITLAGRPRTEGASGVGVGARLVTAATPDASWEMPYSPVTVNMYALAAARHMYEFGTTSEQLAWIKVAAATHAQHNPNAMLRDLVSVEDVLGSALISDPLHKLDCCVVSDGGGALVVARPEIARKLNRPIVKVLGAGETIKGQLGGNVDLTYSGAAVSGPVAFEEAGIKPSDIQYASIYDSFTITVLMQLEDLGFCKKGEGGKFVADGNLISGVGKLPFNTDGGGLCNNHPANRGGITKVIEAVRQLRGEAHPKVQVPNCTLALAQGTGGLLGS

SEQ ID NO: 8649 - protein, 405 aa, Ralstonia metallidurans
RLIGAGCRSAPTCQKNGLAEKTRNNHAERTMDESELETLRDSARRFYEAELLPHEERWAQQQCVDRDVWYKAAEAGLLCVGIPEEYGGGGGNFLHEAVIFAEQGRMLCPGLGNSLHSGIVAHYIHNFASEQQKQEWLPKMAKGELVGGLAITEPGAGSDVQSIRTAARKEGGDYVINGAKTYITNGSTANLICVVVKTDPNLGAKGISIIVVETDKVEGFRRGRTLSKVGLHSQDTAELFFDDVRVPQANLLGNVEGQGFKQLMKELSRERVITAFMSMACMERAIEETLKFAADRKVFGQTLLSMQNTRFKLAECETKLTLAKAMLSHCSASLLEGQLSSEIAAMAKWWITDACGQVVDECVQLHGGAGFMLEYPIARLYQNVRIHRILAGTNEIMKEVIAREL

SEQ ID NO: 8650 - protein, 518 aa, Ralstonia metallidurans
TLPQCLEVAALRFAQKPAYVIYGHVVTYEKLLNDVRSLAGWLQQRTGVRQGDRVLLSAQTSTQFVTAYHAILRADAVPVLANPMCRSAELEHLMNDSGAKVAIAAQELWPQMEPLLAKGLEDVMLFSYQSGLEGIGDADVPDWFSVPIALPENEKVCGWGKALSANLIPWPAQARADDLCLIAYTSGTTAHPKGCTHTHYSLMTAAVTAANWRGDTTETVFLGAAPMFHMLGLQSLVNTAIHLGATSVLLPRWDARKAAELIARYRVNRWGAAPPMLLDLLGLPNLPDSALESLALINGGGAALPEAVNKRLSEELRIHYMEGYGMTETAAMVMATPLQRPKRQCLGIPTFGVSAALVDPATLEFYPDGPTTESGELWISGDQVSPHGYWNNEPANRESYVERGGKRWLRTGDLAVRDEDGYYFLVDRLKRMINVGGYKVWPAEVESLLHSHPAIQEACVIAVTDERRGERVRALVVVRNGASLTEEELTEWSRSNMAAYKCPREIIFTDRLLRSPTG

SEQ ID NO: 8651 - protein, 263 aa, Ralstonia metallidurans
FSPRPLEGRVALIAGGSSGINLGIAQRFASAGAKVVILSRDEERITAAARTITDAGHVAYGRAADVRNFEAVASVFKEASERFGLIDVVVSGAAGNFHAPAASLSANGFKTVVDIDLIGNFNVLRASFPFLRTPGASLMSITAPGGTHPSVFQVHANSAKAGINMTVKCLAMEWGPAGIRVNAISPGPISGTTGMAKLAASPEREQQIKARLPLREYGSIRDIADTALFLASDNAKYITGAIIDCDGGSGLGDAPQMRFLKQL

SEQ ID NO: 8652 - protein, 400 aa, Ralstonia metallidurans
MNEAYIFDALRTPRGRGRADGSLYEVNPVDLLAGLMTELQQRHDLDTAQVEDALIGCVMPNGEQSGCIAKTAALRANWDWQVPGVQLDRYCGSGLETVNIAAAKVRSGWENLLVAGGVESMSRITMGGAPGPRDTKPDMVFQLKPVPTGVAADLMATLDGHTREAVDRYALQSQQRAGHARASGYFDRSVVPVKDANGLTILKQDELIREDTTLEKLGALKASFQAMGELGGFDALAQMKYPEVEKVRHIHTGGNSSGIVDGASLLLVGSEQKGRELGLTPRARVVSVAAVGAEPTIMLAGPAPASRLALKKAGLSIDDIDLIEVNEAFASVVLRFMTEMQVDPAKVNVNGGAIAMGHPLGATGGMLLGTLLDELERRNLKRGLITLCVAGGMGIATIIE

SEQ ID NO: 8653 - protein, 324 aa, Ralstonia metallidurans
IKIGINGFGRIGRMVFRAAAANFKDIEVVAINDLLEPDYLAYMLKYDSVHGRFDGEVSVEGNTLVVNGKKIRLTAVKDPSELKWGEVGADVVIESTGIFLTKEGAQKHIDAGAKKVIMSAPSKDDTPMFVFGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELENPAKYEEICAEMKAQSQGALKGVLGYTEDKVVATDFRGDARTSIFDAEAGIALDGTFIKVVSWYDNEWGYSNKCLEM

SEQ ID NO: 8654 - protein, 458 aa, Ralstonia metallidurans
MGRLVAVSNRVADPRNHAAGGLAVALSDTLNKTGGLWFGWSGKVVDASRGGTPGEGELHQIQAGNVTLATVDLSREDFESYYLGYSNGVLWPVFHYRVDLADFDSGGNLNAYRRVNQLFARKLAPLLKPDDVIWIHDYHLIPLAAELRAIGCGQRIGFFLHIPLPPRLILATIPQHEWLMRALFAYDLLGFQSHDDVEHFSRYVQGEAGAEPMGEYRFRAFHRTVRAQAFPIGIDVDEFIELGRADEARETYEMMRGQYARRRLLLGIDRLDYSKGLPQRLKAFQTLLAEYPENRSSATLIQIAAPSRESVDAYADLRRDMEGITGAINGEYGELDWMPVRYIHRSTARRRLPGLCRACNVALVTPLRDGMNLVAKEYIAAQDPEDPGVLVLSRFAGAAEQLKEALLVNPYDTRATAQAIQQALHMSLSERQARHQKLLERIRQQDVHWWSGEYLRAL

SEQ ID NO: 8655 - protein, 245 aa, Ralstonia metallidurans
MSSLPLIEPDTALFLDFDGTLADLAPRPELVQVEPELVGTLRALHTCLDGALAIISGRPVAELDGFLQPLRLPAAGVHGAELRHDGEALFMPPAPGITALMPRLEAFVARHPGLRIERKSVAVAIHYRQAPELEAQVRAMVADTLHDVDGLEGLPGKMVVEIKPAGVDKGGAIAAFMRMAPFEGRKPLFAGDDVTDEAGFVVARELGGVGVLVGERATAATVSVTGPAALRCWLHRSAHALLALR

SEQ ID NO: 8656 - protein, 257 aa, Ralstonia metallidurans
LKIATFNINGIHARLPSLLAWLEREQPDVACLQELKAVDESFPVAELHAAGYGAVWQGQKSWNGVAILAKGSDPVEVRRGLPGDAADTQSRYIEAAVAGVLVACLYLPNGNPQPGPKFEYKLAWFERLIRHASTLYASGHPVVLAGDFNVVPTDDDIYNPRSWLKDALLQPASRECYRQLLEQGWTDALRTRYPDTRIYTFWDYFRQHWQKDSGLRIDHLLLSRSLAQHMRDAGVDKWVRGEPHASDHAPAWVEIEM

SEQ ID NO: 8657 - protein, 297 aa, Ralstonia metallidurans
IALRGVCKDYGAVRAVDDVDLEIGYGELFGLIGHNGAGKSTLFRMMLGLIAASEGDIRVAGASVGGAAFRAARRQIGYLPENLVLYDNLSGLETLRFFGRMKGAPLADCELLLARVGLAGAAEKPVRAYSKGMRQRLGFAQALLGSPRVVFLDEPTNGLDPAAIHDFYAMLQALREQGVTIVITSHILAELQQRIDRLAIMGNGRILAVGSVAELRRQLDLPVTLALRVERGARAALWQHFAPLRAQGIELENGRAEYELILRCRRSLKMQVLGALHPMGGRLLDLQIQEPTLEDVF

SEQ ID NO: 8658 - protein, 451 aa, Ralstonia metallidurans
LMHAPDNQGTLKRGLKNRHIQLIALGGAIGTGLFLGIAQTIKLAGPSVLLGYALAGVVAFFIMRQLGEMVVDEPVAGSFSYFANKYCGHFAGFMSGWNYWVLYILVSMAELSAVGIYVQYWWPGIPTWISALAFFLIINAINLASVKSFGEMEFWFSIIKVAAIVGMIGFGGYLLATGTAGPDASIANLWQHGGFFPNGFSGLVMAMAVIMFSFGGLELVGITAAEADSPEKSIPKATNQVIYRILIFYVGALAVLLSLYPWEKVVTGGSPFVLIFHAMNSNVVATVLNIVVLTAALSVYNSGVYCNSRMLLGLAQQGNAPRSLMRVNRRGIPLTALAVSAIATGICVVINYFMPGEAFELLMGLVVSALIINWAMISIIHLMFRRAKAAAGKTTRFQSLGYPLTNYVTLAFLAGILVVMFLTPGLRISVYLIPVWLGVLGVSYRLRQKKA

SEQ ID NO: 8659 - protein, 396 aa, Ralstonia metallidurans
MFEHIEAFPGDPILSLNEDFQQDPRTNKVNLSIGIYFDDEGRLPVMKAVAEAEAALLSDMGPRPYLPMSGMAAYRQAVQALVFGEDCAARAEGRVATLQTLGGSGALRVGADFLKRYFPKAEMWISDPSWENHRVVFERAGFKVNTYPYYDPATGGLKFDAMLAAIEAIPQGDIVLLHACCHNPTGVDLNQDQWRQVIGVLKARKLLPFVDMAYQGFGSGLDDDAFAVRELARQNVPCLVANSFSKNFSLYGERCGGLSVVCQSADEASRVLGQLTGAVRANYSNPPTHGARVVARVLTTPALRANWEQELAAMCQRITRMRQAIHDHLREHVSGEKLSRYITQRGMFTYTGLSADQVDRLKNEHGVYVLRSGRMCVAGLNERNVGVVANAIGQVL

SEQ ID NO: 8660 - protein, 488 aa, Ralstonia metallidurans
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFP

SEQ ID NO: 8661 - protein, 320 aa, Ralstonia metallidurans
HSHPPAVSVRDLRVSFASGGKTIQAVNGVSLEVAPGEAVALIGESGSGKSVTLRALMRLHPPRRTTISGEIQVDGQSVLDLDKRGLARLRGGTVAMVFQEPLLALDPVYTVGQQIVECIRTHRGVSTSEARALALKALESVRIPSPERRLAAYPHEMSGGMRQRAMIALALSAQPRILLADEPTTALDATVQIQVLILLRELQRELGLSIIFVTHDIGAAVEIADRVAVMYGGRIVEEGPIRTLMRDARHPYTIALLQSRQHGMGRGERLATIGGAPPDLAALPPGCTFAPRCPQASAACLSEVPKAVSLGNEHRVSCVR

SEQ ID NO: 8662 - protein, 315 aa, Ralstonia metallidurans
PLLIARQLVKHFPLKSPVPLRKGGVVRAVDGVSFDVLKGETLGVVGESGCGKSTTARLLMQLTPQDSGELIFDAQGVDSRQLPMKAFRSQVQMVFQDSYSSLNPRLTIEESIAFTPRVHGVSAREATERARYLLERVGLEPKRFAGRYPHELSGGQRQRVNIARALAPRPRLVILDEAVSALDKSVEAQVLNLLMDLKAEFNLTYVFISHDLNVIRYLCDRVMVMYLGKVVEIGATESVYANPAHPYTRALLTSMPSMDPDQRTLAAPLAGDPPNPINPPSGCSFHPRCVRAEPICERREPVLTDALAGHPVSCL

SEQ ID NO: 8663 - protein, 410 aa, Ralstonia metallidurans
RKITVRLIPFLVFLFILAWIDRVNVGFAKLQMLQDLQFSEAVYGLGAGIFFIGYFLFEVPSNLLLEKIGARKTLARITILWGLASMAMIFVKTPMQFYTLRFVLGVFEAGFFPGVVLYLTYWFPAARRARINGLFMTSFAIAGVVGGPLAGFIMSAMDGVDGLANWQWLFVIEGIPSVLAGIAVLMYLPEKPVNAKWLTQQEQTIVTRDVEAEARDPNKHSSLKDAFANARVWICAAIYFCVVSGNATIAFWSPSIIKELGVQGNLQIGLVSAIPFVAGTIAMVLNGIHSDRTGERRMHCAMATLVAAVGLTLTGFLLHSAVLALIALTIASIGILAAFPVFWSLPSAFLAGTAAAGGIALINSIGNLAGFVAPYMIGWFKTSTGQLAGGLYFVAALEACATVLVIAFIR

SEQ ID NO: 8664 - protein, 228 aa, Ralstonia metallidurans
RTALVTGATKGIGLALSKHLQQLGWSVIGVARHAIEGFPGQLLTADLADIQQTDAVLAQVVAASRIDAVINNAGIALPQKLESLDLPSLQTVFDLNVRAAVQVTQACLPSLKQSPAGRIVNVCSRAIHGARDRTSYAAAKSALIGVTRTWALELAPLGITANAVAPGPVETELFRLTHPVGSDEEKRILATIPMQRLGKPEEVASLISYLISDGASFVTGQVIGIDGG

SEQ ID NO: 8665 - protein, 499 aa, Ralstonia metallidurans
STIQTLGIVGTGAMGRGIAQIAAQAGLTVNLFDTNAQAVAAARQYLQDTFTKLAEKGKMSAADGEAALARVKACAALEDLTACDMVLEAIVERLDVKRDLVAKLEAVVREDAVIASNTSSLSITAIAVGAKKPGRVVGYHFFNPVPLMKVVEVVDGISGDPAVGDRLMELSRRMGHTPVRCKDMPGFIVNHAGRGMNIEGLKVAQEGVAEFVDIDNIMREQAGFRMGPFELMDLTGLDVSHPVMESIYNQFYQEPRYRPSPITSLRSVGGLLGRKTGAGFYAYPNGQKQVPAAAPVPDARPASVWVSRANARGHAMTVKLLTALGVTVEAGNQPPADALIVVTPLGLDATSAALEEGLDATRVVAIDTLMPFEATKRRTLMTTPATSAAARDAAHGLFASDGVPVTVIRDSAGFVAQRVISCIVNIASDIAQQRIATPTDIDLAVHLGLGYPKGPLALGDTIGADLILEVLRNLNRLTGDMRYRPSPWLWRRAGLGLSL

SEQ ID NO: 8666 - protein, 352 aa, Ralstonia metallidurans
MLKNTDDLRIRELKELLPPAHLIREFACSEAASDVIYGARQAMHRILHGMDDRLIVIIGPCSIHDTRAALEYAKLLKVQRDRFAGELEIVMRVYFEKPRTTVGWKGLINDPHMDGSFKINDGLRTARELLLNISEMGVPTGTEYLDMISPQYIADLVSWGAIGARTTESQVHRELASGLSCPVGFKNGTDGNVKIAVDAIKAASQPHHFLSVTKGGHSAIVSTSGNEDCHIILRGGKTPNYDAASVQEACDAISKSGLAARLMIDASHANSSKKHENQIPVCEDIGKQIAGGEQRIVGVMVESHLVAGRQDHVQGTPVENLTYGQSVTDACIAWDDSVAVLETLANAVKQRR

SEQ ID NO: 8667 - protein, 474 aa, Ralstonia metallidurans
YQDLALYIDGEFIKGGDRREQDVINPATQELLGKLPHATTADLDRALSAAQRAFETWKKTSPLERSQILRRVAELTRTRAKEIGRDITLDQGKPLAEAVGEVMICAEHAEWHAEECRRIYGRVIPPRNPAVRQIVVREPIGVCAAFTPWNFPFNQAIRKIVAALGAGCTLILKGPEDSPSAVVALARLFHDAGLPPGVLNIVWGVPSEVSTYLIESPIVRKISFTGSVPVGKQLAAMAGAHMKRVTMELGGHSPVLVFGDADIEPAAEMLARFKLRNAGQVCVSPTRFYVQEKAYDKFLARFTEVIGSIKVGNGLDDGTQMGPLAHERRIASMEQFLDDASHRGGKIVAGGSRIGDKGFFFAPTVVTDLPDDAKLMVDEPFGPVAPVTRFKDAEEVLRRANSLPFGLASYVFTNSLKTANLVSNGLEAGMVNINHFGMALAETPFGGIKDSGIGSEGGQETFDGYLVTKFITQV

SEQ ID NO: 8668 - protein, 276 aa, Ralstonia metallidurans
RPSPDRFKLYPYPMNDTATLADQASSAPSTDSSTLVVRHLKKRYGSRTVVKDVSLDVKSGEVVGLLGPNGAGKTTSFYMIVGLVALDEGDIVLDGQHISGLAIHERARMGLSYLPQEASVFRKLNVEENIRAVLELQVVNGKPLPKQEIDRRLDSLLDDLQIAHLRNNPALSLSGGERRRVEIARALASAPRFILLDEPFAGVDPIAVGEIQRIVSFLKARNIGVLITDHNVRETLGICDHAYIISEGTVLAEGQPEEIIANESVRRVYLGENFRM

SEQ ID NO: 8669 - protein, 170 aa, Ralstonia metallidurans
LRDRIRTVPDWPQPGVMFRDITPLLQNPKTLRVLIDVFVHRYMDQNLDLVAGIDARGFILGSIIAYELNLGFVPIRKKGKLPFQTVAEEYELEYGSATVEIHADACKPGDRVLLIDDLIATGGTMMAGRKLLERLGATVVEGGAIVDLPELGGSKLLQASGLSLFTVCNF

SEQ ID NO: 8670 - protein, 396 aa, Ralstonia metallidurans
PRARHGRLPLRSRAREPQGSPIRELFKYLSDPEMISFAGGYPSAALFDVEGIGAASAQALRERPAECLQYGATEGTPALRNALAALMAERGAAVALDELLITSGSQQGFDFLVRALVEPGSLVLVEEPTYSATLQALRLAGADVRGVPSDHDGMNVDALEAMLADAPARPRMIYTVPTFANPTGATLSPARRLQLLELVARHEIVLVEDDPYGALSFDGPPPPSLLALCDQVSGARPWLVHLASLSKTLAPGLRLGWMVAAPEIVRRAVIAKQVSDLCTPPWLQLTAAHYLQAGNLPGQIAREVAVYRDKRDRLTTALHQAFGTRIRFADPAGGMFLWVSVDGIDDAAALLPHAIAEKVLFVPGTGFYAERRARPAFRLSFVGADPAQIEEGVARL

SEQ ID NO: 8671 - protein, 377 aa, Ralstonia metallidurans
IEMLRESVRNWAQAELAPRAAEIDRTDQFPMDAWRKMGDLGVLGITVAEEYGGANMGYLAHMIAMEEISRASASVGLSYGAHSNLCVNQIHRNGTAAQKAKYLPKLVSGEWIGALAMSEPNAGSDVVSMKLRADFKGDRYVLNGTKMWITNGPDCDVLVVYAKTEPDLGARGMTAFIVEKGMKGFSVAQKLDKLGMRGSHTGELVFQDVEVPVENILGAENGGAKVLMSGLDYERAVLSGGPVGIMQACMDVITPYIHDRKQFGQSIGEFQLIQGKVADMYTTLQAARSYLYTVGKNLDSLGTDHVRQVRKDCAAVILYTAEKATWMAGESVQILGGNGYINEYPVGRLWRDAKLYEIGAGTSEIRRMLIGRELFSE

SEQ ID NO: 8672 - protein, 388 aa, Ralstonia metallidurans
VVIVSAVRTPMGAFQSELSSLMAPQLGAAAIRAAVERAGIKPEQVQEVVFGCVLPAGQGQAPARQAALGAGLPLDVACTTVNKMCGSGMRAAMSVYDGLLAGSFDIAVAGGMESMTNAPYLVPKARGGYRIGHGMIYDHMMLDGLEDAYDKGRAMGTFGEDCAAKYHFTREQQDAFAMESVRRAQRATEQGDFRWEIVPVTVSGKGGDTVIDTDEGPRRIKVDKIPSLKPAFAKDGTITAASSSSINDGASALVMMRESTAKSLGLQPIARMLGHTSHAQAPGWFTTAPVEAIAKLYRKLDWNTGSVDLFEINEAFAVVPMAAMHDLDIPRDKVNIHGGACALGHPIGASGARIMTTLIGALRKTGGKRGVASLCIGGGEATAVGIEL

SEQ ID NO: 8673 - protein, 373 aa, Ralstonia metallidurans
LTPEQEMIRDAVRQFAQDVIAPQAARWDRDKTFPKDVHKELARLGAYGVAVPEALGGAGLDYLSLALILEEIAAGDGGTSTVISVNNCPVCSMLMAFASDAQKQQWLVPLAQGDMLGAFCLTEPHVGSDASALRTTATRDGDHYVLNGVKQFITSGKHADVAIVMAVTDKAAGKRGISAFLVPTSTPGYIVARLEEKLGQHSSDTAQIVFENCRIPAANMLGEEGAGYKMALSGLEGGRIGIASQSIGMARAAFEAALAYAKERESFGQPLFQHQAVQFRLADMATQIDVARQMVWHAASLKDAGRPCLKEAAMAKLFASEMAERVCSDAIQVFGGYGYVTDFPVERIYRDVRVCQIYEGTSDIQKILIARAL

SEQ ID NO: 8674 - protein, 212 aa, Ralstonia metallidurans
MALRLGDIAPDFEQESSEGRIRFHDWLGDGWGVLFSHPADYTPVCTTELGLTARLKEEFAKRNVKAIALSVDSVESHHGWIQDINDTQSTTVNFPILADGDRKVSELYDMIHPNANETLTVRSLFVIDPKKKVRLIITYPASTGRNFNEILRVIDSLQLTDNHSVATPGNWQDGDDVVIVPSLKDEEVIRQKFPKGYKAVRPYLRLTPQPNK

SEQ ID NO: 8675 - protein, 417 aa, Ralstonia metallidurans
  unsure (1)..(417): unsure at all Xaa locations
RFSRIVXRLQAFLATPKKETSMAANAEFNWADPLLLDQQLTADERMVRDAAAAYCQDKLMPRVLQSFRNEKTDVEIFREMGELGLLGPTIPEQYGGPGLNYVSYGLIAREVERVDSGYRSMMSVQSSLVMVPIYEFGTEAQKQKYLPKLATGEWIGCFGLTEPNHGSDPGSMVTRAKKVAGGYELTGAKMWITNSPIADVFVVWAKLMGDDGKEAIRGFILEKGWKGLSAPAIHGKVGLRTSITGEIVLDQVFVPEENIMPGVSGLKGPFTCLNSARYGIAWGALGAAEFCWHTARQYTLDRKQFGRPLAATQLVQKKLADMQTEITLGLQGCLRLGRMKDEGTAAVEITSIMKRNSCGKSLDIARVARDMLGGNGISDEFGVIRHVVNLEVVNTYEGTHDIHALILGRAQTGLQAF

SEQ ID NO: 8676 - protein, 299 aa, Ralstonia metallidurans
MSEFKGCPMGHGAAPQNGDGGDSGDTGNGWHGAQMDFARDMSYGDYLGLDQILSAQHPLSPDHNEMLFIVQHQTTELWMKLMLHELRAARDGVKSDQLQPAFKMLARVSRIMDQLVQAWNVLATMTPPEYSAMRPYLGASSGFQSYQYREIEFILGNKNAAMLRPHAHRPEHLELVETALHTPSMYDEAIRLMARRGFQIDPEVVERDWTQPTQYNASVEAAWLEVYRNPSAHWELYELGEKFVDLEDAFRQWRFRHVTTVERVIGFKRGTGGTEGVSYLRRMLDVVLFPELWKLRTDL

SEQ ID NO: 8677 - protein, 174 aa, Ralstonia metallidurans
EIATLGGGCFWCLEAVYQQVAGVRAVESGYTGGHVSQPTYHEVCAGDTGHAEVVRVTFDPSAINYREILEIFFSIHDPTQLNRQGNDVGTQYRSSIFTHSEAQRAVAEYVIGKLAAEHVYDAPIVTQVEPEQPYWPAEASHQNYYQEHPAQGYCAFVISPKLTKFRRDFSHRMR

SEQ ID NO: 8678 - protein, 506 aa, Ralstonia metallidurans
  unsure (1)..(506): unsure at all Xaa locations
TALAGWLQQKAGVKKGDRVLLYMQNCPQFIISYYAILRADAVVVPVNPMNRSEEFKHYVTDGQARVAICTADLAAGVMQADAELSADERLQHLLVTQYTDALPPTHVHPEDAPAGLAHRRASAAGQRHAVGQGACRRPEARPHTAGPDDMAVMPYTSGTTGFPKGCIHTHRSVMHNIVGGSTWSGSGAESVILSVLPLFHVTGMQYGMNGPIYSGATVVMLPRWDREVAGHLISRYQVTHWTNIPTMVIDFLGSPNLASFDMSSLRYIGGGGAAMPQAVAERLKTQFGLNYLEGYGLSETMAPTHSNPADRPKLQCLGVPTFNTDARVVDPVTLKELAPNEVGEIIVRGPQVFKGYWGKPDATRDAFIEFEGQTYFRTGDLGRMDEEGYFFITDRLKRMINASGFKVWPAEVENLLYKHPAVQEACIIGTRDAYRGETVKAVVVLRADAKGKTQPEDIIEWAKEHMAAYKYPRVVEFVDALPKSGTGKVMWRQLQETENVRQAGXA

SEQ ID NO: 8679 - protein, 296 aa, Ralstonia metallidurans
MENRVTKAVFPVAGLGTRFLPATKASPKEMLPVVDKPLIQYAVEEAMAAGITEMIFVTGRSKRAIEDHFDKAYELEAELEAKNKQALLDVVRSIKPANVECYYVRQPEALGLGHAVLCAAKLVGDTPFAVMLADDLLDGGKDLPVMKQMVDIYNHYNCSVLGVEEIAPEQSRSYGVIDGREWDDRVIKMSAIVEKPAPEKAPSNLGVVGRYILTPRIFDHIRELKPGAGGEIQLTDAIQSMLDQEQVLAYRYKGVRYDCGSKLGYLKATVEFALRHPRCATSSAPICRSAAPARQA

SEQ ID NO: 8680 - protein, 898 aa, Ralstonia metallidurans
VTLEIDGVSVTVPAGTSVMRAAAEAGVGVPKLCATDSLKAFGSCRLCLVEIEGRRGYPASCTTPVEAGMKVRTQSEKLGDLRRGVMELYISDHPLDCLTCPTNGNCELQDMAGVVGLREVRYNDGAGTAPPIATHTHLAKDESNPYFTYDPSKCIVCNRCVRACEETQGTFALTISGRGFDSRVAAGTSQPFMESDCVSCGACVQACPTATLTETSVIQLGQASHSKITTCAYCGVGCSFKAEMKGNEVVRMVPYKDGAANEGHACVKGRFAWGYATHKDRILKPMIRARITDPWREVSWEEAIGYAASQFRRIQAEHGKDSIGGIVSSRCTNEEGYLVQKLVRAAFGNNNVDTCARVCHSPTGYGLKTTIGESAGTQTFRSVAKADVIMVIGANPTDGHPVFASRMKRRLRAGARLIVVDPRRIDLVESPHIRADYHLQLRPGTNVAVVTSIAHVIVTEGLLAEQFIAERCEDRAFQQWRDFVALPENSPEALEAETGVPAEQLRGAARLYATGGNAAIYYGLGVTEHAQGSTTVMAIANLAMATGNIGREGVGVNPLRGQNNVQGSCDIGSFPHELPGYRHVSDSTVRGSFEAAWNVEINPEPGLRIPNMFEAAITGSFRGLYCQGEDIVQSDPNTQHVAEALSSMECIVVQDIFLNETAKYAHVFLPGSSFLEKDGTFTNAERRISRVRKVMPPKAGYSDWEATILLSNALGYPMHYNHPSEIMDEIARLTPTFAGVSYKKLEELGSIQWPCNAEAPEGTPTMHVDTFVRGKGKFIITKYVPTSEKVNRKYPLILTTGRILSQYNVGAQTRRTHNVHWHDEDRLEIHPHDAEERGIKDGDWVGIQSRAGETVLRAIVSERMQPGVVYTTFHFPESGANVITTDNSDWATNCPEYK

SEQ ID NO: 8681 - protein, 349 aa, Ralstonia metallidurans
MKITLDSARQFARSILAAQGVPADIADDVAEHLVEADRSGYVSHGLSILPNYRRAIESGNVNPTGRAACVLDRDMLMVFDGNGGFGQHVGKTVMTRAIERVRQHGHCIVTLRKSHHLGRMGHYGEMVASAGFVLLSFTNVINRPPVVAPFGGRVPRLTTNPLCFAGPMPNGRPPLVVDIATSAIAINKARVLAEKGEPAPENSIIDAEGNPTTDAGVMFDDQPGSLLPFGAHKGYGLGVVAELLAGVLSGGGTIQPDNPRGGVATNNLFAVLLNPELDLGINWEREEVEAFVRYLHDTPPAPGFDQVQYPGEYEAMHRAAAATHLEINPKIWSHLAALAGDLGVDMPAA

SEQ ID NO: 8682 - protein, 505 aa, Ralstonia metallidurans
RLCKILFVILYYGLDELVLSGFKNRRIKFLVRVITIGRKLDQPRGERLRMALTALGPIFVKFGQVLSTRRDLMPPDIADELAKLQDQVPPFESAVAVKIIEKSLGRRLTELFETFEHEPVASASIAQVHFATLRGGPSHGREVAVKVLRPGMLPVIDSDLALMRDMATWLERVWVDGRRLKPREVVAEFDKYLHDELDLMIEAANASQLRRNFAESDLLCVPEVFWDWCTSSVFTMERMHGIPISRTESLKAAGVDMHKLAEEGVEIFFTQVFRDGFFHADMHPGNILVSVRPETFGRYIALDFGIVGALSEFDKNYLAQNFIAFFRRDYHRVALLHVESGWVPPETRVEELESAVRACCEPYFDKPLREISLGMVLMRLFQTSRRFNVEIQPQLVLLQKTLLNIEGLGRQLDPDLDLWKTAKPFLERWMYEQVGWQGAWERIKIEAPQWAKMLPDFPRLAHQFLERRALQNNEGQERLLTQLVAEQRRTNRRLSTALLLMGGFL

SEQ ID NO: 8683 - protein, 395 aa, Ralstonia metallidurans
LQDAYIVAATRSPIGKAPKGAFKNTRPDDLLATILQAAVAQVPSLDPALIEDAIVGCAIPEAQQGLNVARIGALLAGLPNTVGGITVNRFCASGLSAVAMAADRIRVGESDVMIAAGVESMSMVPMMGNSPSMSPSIFERDENIGIAYGMGLTAEKVATQWKVSREDQDAFSLASHQKAIAAQQAGEFKDEITPIEVVERFPDLASGQINVKTRTISLDEGPRPDTSVEGLGKLRAVFANKGSVTAGNSSQTSDGAGALILVSEKILKQFNLVPRARFVSFAVRGVPPEIMGIGPKAAIPAALKAAGLTQDQIDWIELNEAFAAQSLAVMRDLELDPAKVNRMGGAIALGHPLGATGAIRSATVVHALRRHNMKYGMVTMCVGTGMGAAGIFERV

SEQ ID NO: 8684 - protein, 525 aa, Ralstonia metallidurans
LRLSSTLFTELREILFSKVTQSAVREIALQVFRHLHALSLRFHLDRQTGGMSRDIERGTRGIQSLISYSLYSILPTLVEMSLVIGFFVVRYDIWFAAITICALAGYIVFTIVVTEWRTHFRRKMNELDSRANQKAIDSLLNFETVKYFGNEEYEARRYDENLRTYRTAAIRSQNSLSFLNFGQQAIIGLGLILILWRATVGVAAGKLTLGDLVLVNTLMIQLYIPLNFLGVIYREIKQATTDMDRMFVLLGTQQEVADTPGAPVLAVNGAEVRFRHVGFGYEKNRVILDDVDFTIAAGTTTAVVGHSGSGKSTLARLLFRFYDVTRGSIEVDGQDIRKVRQVSLRASIGIVPQDTVLFNDSIYYNIAYGRPEATREEVIEAARAAQIDTFISELPQGYDTPVGERGLKLSGGEKQRVAIARTLLKNPPILVFDEATSALDSRTEQAIQSELMRLAQNRTTLLIAHRLSTVVHADQILVMDRGRIIERGTHAELMRANGHYAEMWQIQARNAAEGSPDADALAIDV

SEQ ID NO: 8685 - protein, 391 aa, Ralstonia metallidurans
LGSLARWVETLKRPKRAMIVDVPIELDNGTIAHFEGYRVQHNLSRGPGKGGVRFHQDVTLSEVMALSAWMSVKNAAVNVPYGGAKGGIRVDPRTLSHGELERLTRRYTSEINIIIGPSKDIPAPDVNTNAQVMAWMMDTYSMNSGSTATGVVTGKPISLGGSLGRHEATGRGVFVVGSEAARNLGMDVKGARVAVQGFGNVGAVAAKLFHEAGATVVAVQDHRTTLFDPAGLDVPKMMEYASHSGTIEGYRAEVISTEQFWEVDCDILIPAALEGQLTASNAPKIKAKLVIEGANGPTTPEADDILRERNILVCPDVIANAGGVTVSYFEWVQDFSSFFWTEEEINERLVRIMQEAFRAIWQVAQDNKVTLRTAAFIVACTRILQAREMRG

SEQ ID NO: 8686 - protein, 357 aa, Ralstonia metallidurans
MSQYRIAVIPGDGIGTEVMPEGIRVMDATARRFGIDFQWDHFDFSSYAYYERHGKMLPDDWFDTLVKYDAIYFGAVGWPAKIADHVSLWGSLLQFRRSFDQYVNLRPVRLMPGIKSPLADRKPGDIDFYVVRENTEGEYSSIGGRMFPGTEREIVMQETVMSRHGVDRILKFAFELAQKRPKKHLTSATKSNGISITMPYWDERVEAMAANYPGMKVDKYHIDILTAHFVQHPDWFDVVVASNLFGDILSDLGPACTGTIGVAPSGNINPDKVYPSLFEPVHGSAPDIAGQGIANPIGQIWCGAMMLEHLGHAEAGAAVLAAIEQVLAAGPGHAPLTRDIGGTASTADLGQAIAEAL

SEQ ID NO: 8687 - protein, 454 aa, Ralstonia metallidurans
TFESFGLDPRILRALTEQGYTKPTPIQAQAIPVVLLGKDVMGAAQTGTGKTAGFALPIIQRLLPLANASASPARHPVRALMLTPTRELADQVYDNVARYAKHTDLRSTVVFGGVDMNPQTDALRRGVEILVATPGRLLDHVQQKSVNLSQVQMLVLDEADRMLDMGFLPDLQRIINLLPAQRQTLLFSATFSPEIKKLASSYLKQPVTIEVARSNSTNENVRQVVYQVQDGHKQAAVVHLLKQRANEQQSRQCIVFVNSKIGCSRLARHLEREGINAAAIHGDKTQTERMQTLDGFKNGTIDALVATDVAARGLDIPAMPCVINFDLPFSAEDYVHRIGRTGRAGASGDALSIFVPGNDDRLLADIEKLIKRSIPRGSLDGFDPTGERARQEDSDRRRARTEVRRVRDNGEGEEQQRRRRTEPNGRQAFRPSDDPSSRVRTSRRAATRRHRRPR

SEQ ID NO: 8688 - protein, 158 aa, Ralstonia metallidurans
LLTLIVARARNGVIGRNNTLPWRLPEDLQHFKRTTMGAPIIMGRKTWDSIGRPLPGRRNIVVTRNRDLHIEGADVVGSIEDAQRLCIGAEQVFLIGGAQLYAEALPSADRLIVTEIDADVEGDAFFPAVDRTTWVETARELHHSETNGFDYAFVTYER

SEQ ID NO: 8689 - protein, 433 aa, Ralstonia metallidurans
FAKLGLDAAILRALAEANYNTPTPVQAQAIPAFLAGRDLLVSSQTGSGKTAAFMLPAIQRISEKPATHRPTEPAKRMKGKRPRPSPAQPSLLVLTPTRELALQVTEAAAKYGRHLRRIVCASILGGMPYPKQLAMLARMPDILVATPGRLLDHIEAGRIDLSALEMLVFDEADRMLDMGFADDIDAIVAATPASRQTLMFSATLDARIAQLASRQLRDPQRIEIAAARADHSNIEQRLHFTDDMSHKERLLDHLLRDASLKQAIVFTATKRDADSLAERLSDTGFSAGALHGDMTQGARNRTLTALRRGNLRVLVATDVAARGIDVPDITHVVNFDLPKQAEDYVHRIGRTGRAGRSGVAINLVNHGDMFQWRRIERFTNNRIDASVIEGFEPRRSPKPRSNFGGKPGGRDGFRGNGGTGGGYRGNNGSGGYR

SEQ ID NO: 8690 - protein, 460 aa, Ralstonia metallidurans
MSFSELGLSDKLVRAVAEQGYTTPTPIQAQAIPAILKGGDLLAGAQTGTGKTAGFTLPMLQLLSETAARANGGNAPRGARPNVRALVLTPTRELAAQVEESVRNYGKYLKLRSMVMFGGVGINPQIEALRRGVDIVVATPGRLLDHVAQRTIDLSHVELLVLDEADRMLDMGFIHDIRKVLNVLPPKRQNLLFSATFSDDIRALADRLLDNPASIEVARRNTTAETVAQRVFPVDRERKRELLAHLVRQHDWHQVLVFTRTKHGANRLAEQLTKDGLSALAIHGNKSQSARTRALTEFKAGTLRLLVATDIAARGIDIDQLPHVVNFDLPNVPEDYVHRIGRTGRAGAEGEAISLVCVDEHGLLRDIERLIKRQIEQVLLPGFEVDPSIKAEPIQKGRQQQRGGQPRGNGQGNAGNGGERRQPRAAQGERQEAPRQPRPAQPARGEARNGNAGGSGNAPR

SEQ ID NO: 8691 - protein, 385 aa, Ralstonia metallidurans
MNIHEYQGKEILRKYNVPVPRGIPAFSVEEALKAAEQLGGPVWVVKAQIHAGGRGKGGGVKVAKSIDEVKTYATNILGMTLVTHQTGPEGKKVNRLLIEEGADIKKELYVSLVVDRVSQKVALMASSEGGMDIEEVAAHTPEKIHTLIIEPSEGLKDSDADDIARKIGVPDASVPQARQALQGLYKAFWDTDASLAEINPLILTGDGKVVALDAKFNFDSNALFRHPEIVAYRDLDEEDANEIEASKFDLAYISLDGNIGCLVNGAGLAMATMDTIKLFGGEPANFLDVGGGATTEKVTEAFKLMLKNPNVQAILVNIFGGIMRCDVIAEGVITASKAVQLGVPLVVRMKGTNEELGRKMLADSGLPIISADTMEEAAQKVVAAV

SEQ ID NO: 8692 - protein, 293 aa, Ralstonia metallidurans
MSILINKDTKVITQGITGKTGQFHTRGCRDYANGKNCFVAGVNPKKAGEDFEGIPIYASVKDAKEQTGATVSVIYVPPAGAAAAIWEAVDADLDLVVCITEGIPVRDMMEVKDKMRRQNKKTLLLGPNCPGLITPDEIKIGIMPGHIHRKGRIGVVSRSGTLTYEAVGQLTALGLGQSSAVGIGGDPINGLKHIDVMKMFNDDPETDAVVMIGEIGGPDEANAAYWIKENMKKPVVGFIAGVTAPPGKRMGHAGALISGGADTAQAKLEIMEACGIKVTKNPSEMGRLLKAML

SEQ ID NO: 8693 - protein, 225 aa, Ralstonia metallidurans
  unsure (1)..(225): unsure at all Xaa locations
WRTLLAPCLGKAEWSSLCAFVDEERAAGKPVFPHAVFHALHLTPPDAVKVVILGQDPYHGTGVVDGLEIPQAHGLAFSVPEGVKVPPSLRNIFKEIGAEYGVAPTRASGNLEGWARQGVLLLNTVLTVEQGQAASHAKRGWEAVTDCVIHALAASRPNLVFLLWGSHAQAKRALLEGQTHCVLEAPHPSPLSAHRGFLGCGHFRQANDWLERHGRDGIDWQATXP

SEQ ID NO: 8694 - protein, 335 aa, Ralstonia metallidurans
LSQDSAMSTFPEFRPRRMRRDDFSRRMMRENRLSPDNLIYPVFILEGQNQRQTVASMPGVERVSVDLLMPVAEDCVKLGIPVIALFPVIDPSLKTPDGIEATNPEGLVPRAVRALKDRFPELGVLTDVALDPYTSHGQDGVLDENGYVINDITVEILVKQALVQAEAGVDIVAPSDMMDGRIGAVRNALEEAGHIHTRIMAYSAKYASAFYGPFRDAVGSASNLGKGNKMTYQMDPANTDEALREVAQDIMEGADMVMVKPGMPYLDIVRRVKDEFRFPTYVYQVSGEYAMLKAAAQNGWLDHDKVMMESLLAFRRAGADGILTYFARDAARLLQ

SEQ ID NO: 8695 - protein, 415 aa, Ralstonia metallidurans
DFFSRRDGILAVEQVPLTRIADQFGSPTFVYSRAALTAAYNAYAAACKGRNAHVQYAVKANSNLAVLQVFAQLGAGFDIVSGGELLRVIAAGGDPRKVVFSGVAKNVADMELALSHDVRGFNVESIPELDRLNAVAGRLGKRARVSLRINPDVDAKTHPYISTGLKANKFGVAFEDVLPTYRAAAALPNIEVTGIDCHIGSQITEVAPYLEALDKVLDVVEALEAEGIKLEHIDVGGGLGITYNDETPPDITKFATTLIDRVAARGHGHREVLFEPGRSLVGNAGVLLTRVEFLKPGAAKNFCIVDAAMNDLARPAMYEAFHRIEPVAPRNDAGVMYDVVGPVCESGDWLGRDRTLAVQAGDLLAVMSAGAYGFVMSSNYNTRGRAAEVMVDGDTVHLVRERELPADLFRNERLL

SEQ ID NO: 8696 - protein, 169 aa, Ralstonia metallidurans
ANRPNIFFVGLMGAGKTTVGRTVARRLNYPFFDSDHELEARCGVRIPIIFEHEGEAGFRDREAQVIAELTGRSGIVLATGGGAVLREVNRAALKANGTVVYLRASPHDLWLRTRHDRNRPLLQTEDPKGRLEALYAERDPLYREVADFIIETGKPTVAQLANMVLMQLE

SEQ ID NO: 8697 - protein, 355 aa, Ralstonia metallidurans
MITLEVDLGTRSYPIHIGSGLLDRADLLAPHVRGQHAVIVTNETVGPLYAARVEAVLAGLGKTVRTVVLPDGERFKHWETLNLIFDALLQAGADRKTTLIALGGGVVGDMTGFAAACYMRGVPFVQMPTTLLAQVDSSVGGKTGINHPLGKNMIGAFHQPNAVIADIDTLRTLPPRELAAGMAEVIKHGAIADADYFAWIEDHIAGLNACDTGLMAEAVRRSCEIKASVVAQDEREGGLRAILNFGHTFGHAIEAGMGYGEWLHGEAVGCGMVMAADLSHRLGFIDVETRARIRTLTQAAMLPVVAPDLGIDRYIELMKVDKKAEAGSIKFILLRKLGSAFITTVPDADLRETLR

SEQ ID NO: 8698 - protein, 405 aa, Ralstonia metallidurans
KSHITTWILIAMILGAAVGYACYIAFPDPKMAKEVAGYISLITDVFLRLIKMIIAPLVFSTLVIGIAHMGDAGTVGRVGGKAMAWFITASLVSLTLGLIMATVLAPGHNIGLPLPDVGSATNLKTNAFTLKDFVTHLVPKSVGEAMANNEILQIVVFSIFFGTAISMLGERGARMAGVIDDLAQIMLKITGAVMWLAPIAVFAAIASTVTTQGLGILVTFAKFMGSFYLSLFVLWALLALAGYIFLGSRVFTLIRLIREPFLISFSTASSEAAYPKLLDSLDRFGVDRKISSFVLPLGYSFNLDGSMMYCTFAVLFIAQAYDIHLPLGTQITMLLLLMLTSKGMAGVPRASLVVIAATLNQFGIPEAGLLLIMGVDQFLDMGRSATNAVGNSIAAAVVAKWEGQL

SEQ ID NO: 8699 - protein, 348 aa, Ralstonia metallidurans
YAVKANSDAPVLRALLGVADGFEVASFGEIERVRGVDAEVPIAFGGPGKTDAELEGALRLGVGLIHVESTLQLSRLDAVARRQGRCADVLLRANPAYGLPGATLQMGGGATQFGIDEALLPDVLAQSRTMPNVRVVGLHVHAGSNSLDADTHLALIDRHIALAKRLRDLHGLTLEWLNVGGGIGIDYQNPERHFDWDRFCHGLAALLRETAPSTRIVFECGRFISAGCGCYVAEVIDLKRNHDKWFAVLRGGTHHFRLPVSWQHNHPFQVLPNDHWDYPFPRPVVERQPVTLCGELCTPKDVLAREVPVDRLRVGDRIAFTMAGAYGWHISHHDFLSHPHPERVFIGG

SEQ ID NO: 8700 - protein, 337 aa, Ralstonia metallidurans
MKAAVVRAFGAPLTIDEVPVPQPGPGQIQVKIEASGVCHTDLHAAQGDWPVKPSLPFIPGHEGVGFVSAVGANVKRVKEGDRVGVPWLYSACGYCEHCLQGWETLCEKQQNTGYSVNGGYGEFVVADPNYVGLLPKNVDFIEIAPILCAGVTVYKGLKVTDTRPGQWVVISGIGGLGHVAVQYARAMGLRVAAVDIDDAKLAFARKLGAEVAINARTTDPAAFLQKEIGGAHGVLVTAVSPQAFSQAIGMVRRGGTISLNGLPPGDFPTPIFDVVLKAITIRGSIVGTRSDLQEALEFAASGVVKATVSTEKLDSINSIFDRMKAGQIEGRIVLDFS

SEQ ID NO: 8701 - protein, 243 aa, Ralstonia metallidurans
GPGWSIGRAASVTYARLGARVCVVDRDAASAAETTALIRAEGGAAETFVGDVAEEAEIARLFAEAREHFGPIDVLHHNVGIGKTGGVLDTDVRDFDAAHNVNVRSLLLASQQVLPSMVERGRGAIVTVSSVAGLRYIGYPHLSYSVSKAALIQFTRMIAQQYAGSGIRANCVVPGLIDTPRIAHTVAKQFSADSLDDARAARARQVPMQRMGTAWDVAHACAFLASDAAAYITGTELVVDGGI

SEQ ID NO: 8702 - protein, 490 aa, Ralstonia metallidurans
RAADRWPDNVAIDAPGGSLRYRELAGQVAALATHFMTLDPAPQSRVGICAGNSAEHIVALLAVLASGKIWVPLNPKSTQPELRRIIDATTPSIVVLDAASEALLGDAPGTRLYTDYADHASGGADVLSAVVLRYPDATRPVLDLHRDATQAIKFTGGTTGAPKGVMQPYRAWMTNIVNQIHAWGFTEADRYVMAAPITHGTSTYVMPILAQGGCHVIMEGSGAEAVRATFRDRAGTVCFMPPTLIYMLMALPGTSRADYPALRRLIYGGAPMPPQKIQQAREFFGSVVATTYGQTEAPQLLTVIGPDDLADERRMASVGRATWFSEVAIMSPDGRLLPRGEVGEVVARGDLVMTGYWNRPDLTAATIVDGWLHTGDRGMLDAQGFLYLKDRLREVVITGGFNVYPIDVENALGQHPAVHECAVFGVPDDKWGEAVHAAVQLREGCAVQATELIAFVRERLGPVQTPKQIHFHTSLPRSTVGKVLKNTVRD

SEQ ID NO: 8703 - protein, 890 aa, Ralstonia metallidurans
TPWHAMTADEVEQRFKVDPSQGLEADDAAARLGTYGPNRLPQGKKRGAIARFVSQFNNILIYVLIASAFTKLMLSLWLDASIIFAVVILNSLLGFLQEGKAEEALDSIRNMLSTDARVLRGGAARLLDAEELVPGDVVLLESGDKVPADLRLVEARNLRTEEAALTGESVPADKTTVPMPAKSTVGDRENMAFSGTMVVSGRATGVVVATGSQTELGRINEMLGQVNPLETPLLRQITKFGYVITAAIGVLSVVLFSWGHWLGKMSFVELFQAIVGIAVSIIPEGLPALITITLAIGVKRMAQRNAIIRRLPAVETLGSVSRICSDKTGTLTMMEMMVTSVVTADASYAVTGHGYAPEGALSTEGKPLDAVPLPLALIGRVSMLCNDAELFEDDGRWKVEGDPTEGALYPLATKLGMDRTAEGVAAPRIDAIPFESEHKFMATLNRSADGEMLLVKGAPEVILEHCDHQQTANGAVPLDRAYFVREGDRMAAQGERVLGLAWLPDPGLPQGGLEPKDLPSTLVFLGLVGLMDPPRKEAIDAVRECHEGGIRVTMITGDHKVTAAAVAGMLGIGDGRTAVAGTEIEAMNDAALRECVREVDVFARASPEHKLRLVKAMQANRQVVAMTGDGVNDAPALKKADIGVAMGIKGTEVTKEAAGMILVDDNFASISAAVKEGRTVYNNIEKAMLFMLPTNIAQGAVIAIAILIGFTLPITAPQILWVNTVSSVALGLAMSFEPHEADVMGRPPRSIDRSIVTGFGVWRICFIGVALVIYTLAAFFVMKAHGAADEMARTAAVNAISLGQIFYLINSRHLLESSLSVRAHTSNPYLWYGIGGVVVLQLLFTYWYPFQLIFDTQALTVEHWLWLIAGAVVLFFVVEFEKLVIRSFPP

SEQ ID NO: 8704 - protein, 263 aa, Ralstonia metallidurans
KIAIAGASGRMGRMLIETVLNTDGVTLAGALDVPGAAALGQDAGLFLGRETGIKISSDIEAVLSAADCLIDFTRPEGTLAHLAVAKRLGKKMVIGTTGFDAAGKQALADAAKSIGVVFAANMSVGVNATFKLLEVAAKLLSTGYDIEIIEAHHRHKVDAPSGTALAMGEVVAKAIGRDLDECAVYAREGHTGPRDAKSIGFATVRGGDIVGDHTVMFAGIGERIEISHKSSSRQSYADGAVRAARFLADKPSGMFDMQDVLGL

SEQ ID NO: 8705 - protein, 273 aa, Ralstonia metallidurans
GLWLPMVTPLHHGQVDFDGVQRLAAHYADAGVDGLIVLGTTGEGGLLTDVERLQVAAATLEAVQGTVPVIAGVGGVATHAVCEQVRRLERLDLAGYLVPPPYYLRVSDEGIAWHLRSVASHTARPLMLYNVPKRTGCTISPDLTWRLAAHPQIVALKECDAAGMRALAGQDRLDVFCGDDAAMLDHLLRGGAGIVPASAHIRPDLFVRLIQLARTGREEAARALFRQLSPLIGMLFDEPNPAPVKAALALCGLARPEVRRPLMPASKSLVARL

SEQ ID NO: 8706 - protein, 494 aa, Ralstonia metallidurans
MKNRNVILAIDEGTSGTRAAVVASDGHVSCQQYTTLQVDSPRPGVVEQDANVLLEKTLEVCRATLAEAERNDLCIVALAIATQRSTGVLWDTVTGRALVPAMVWQDTRYAADLDQMASTWDPRLRATVGRPAGVRSAYLWAARHLRETRAVADAWRDRRLAFGTVDSWLLWHLSTERACVTTPTNATSCSAYVLGEHRYLTEWVEALGFPQELLPELRQDADDFGRTRRDLLGVDVPILACAGDQLAGAVGLGCLDAGQSMCLHGTGSFVDLVIGPDLPERSGQSDSTLTMTARRFEGVSHFSVETFVATTGSALNWVCDKLHWFESAKQISALAASVPSSRGVTFIPALTGLRVPQMRPEARAALNGVSMATTQAEIAYAILEGIAHSVASCIDANRDIAGVPVRDLVVGGGLSGSDALLQMQADLTGLPIHRMQETDRASLRGIAYLAGASGLMWDSLQQARTTTLPDAVFMPRIGDDEREERRALWHARVA

SEQ ID NO: 8707 - protein, 511 aa, Ralstonia metallidurans
LESEAFDILIVGGGVTGAYAALDASLRGYRVALVEKNDFASGTSSKSSKMVHGGLRYIEQGNLGLVRHSLLERQRLRRNARHLVQRLPFLFPVMERDGVFDKRLAKAFEGLLWTYDLAGGWREGILHQKLTKAEVLSHCPTFNDEHLKGGFLYFDARVDDARLTLNIARTAAFHGAVVTNHALVTEITRHASGKVDGAIIQADGREIRARADVVIMATGVWLRDWTGGRKGEQKTLNIRPAKGVHVAIPWLKIRNDCTVTIPVPGRSRRATITRWGNVSYLGTTDEDYEGDLDNVMCTRQELDFLLEGARSALKTDIAPEDVVGSIAGCRPLVAPPGGKTLEVRRDHHIHIAGDGLVTIVGGKLTTSRHMAEQTVDAAQKVLGKRAKCRTKSAFLLGAAGYDPQAIVASGGMSAHLGERYGTEARFVSDILQADPALARPIVEGLPHSEAEIVYAVRHEMAGTVDDVLSRRIRARLMARDASAQAAPRVAQILQAELGLSGQAVAQQVSDY

SEQ ID NO: 8708 - protein, 460 aa, Ralstonia metallidurans
VAIDNDTLDALRKAADHVLTATSDVVEWTRDWWAGSMMTETGGKPATPRGVIVRVSTIEQIQAVMRIAHAKAIPVTVSAGRSNVTGAALPVRGGIVLDVCDVNRLLGFDRESQIVEVESGMFGDIFEQTIQQEYGMTMGHWPSSYAISTVGGWVACRGAGQLSTRYGKIEDMVVGMDVVLADGSLVTVGGYPRAALGPDLMQVFIGSEGTLGVIVRVRLKLHRLPDYGRAIAYGFKTFAIGLDACREIMQRGANPAALRLYDELESGVQFGLPETNVLLVADEGTKEMVDAVMAISERVCAELGDRLDGDAIFERWLDTRYLTGKSAEGFKRSPGFVADTLEMAGPWSDLAAIYTDVVAAINAVPGTLAGSAHQSHAYVDGACLYFSLRGDVAVGDRQKWYRAAWDAANAVLIQYNAALSHHHGIGLLRAPYMAPSLDTAFPVLVAVKRALDPQNILNPG

SEQ ID NO: 8709 - protein, 537 aa, Ralstonia metallidurans
MLGLMQDRPLLISSLIEHAATYHPTREIVARTVEGPIHRTNYAEIHRRAKRVANALASLGVGVADRVGTLAWNTHRHFELYFGVSGSGAILHTVNPRLFPEQIEYIVNHAEDKVLFFDIGFAPLVEKLAPALKSVQHYVAMTERANMPAIDVPNLLCYEDLLAEHSDTYDWPELDERAASSLCYTSGTTGNPKGVLYSHRSTVLHSLVACAADAFAVGASTSVLLAVPMFHANAWGMPYAAAMVGAKMVMPGPHLNGQSLYELMRDEGVTVSQAVPTVWLMLFQFLDEHPEIDMKALGLKIIGSGGAASPRSMIERCERDFGVEYLQAWGMTETSPIGTTGRLLPKHAALPKDEQTTIKMKAGRAVWGVGLKIIGDDGQELPHDGRAFGHLHVRGPWIASGYFKHTGGEVLDKDGWFPTGDIGTIDPDGYVQLVDRAKDVIKSGGEWISSIDLENAAIGHPAVHEAAIIAVAHPKWQERPLLLAVKRPGKDVTREELLQYLSERVVKWWVPDDVVFVDQLPHTATGKLLKTKLREDY

SEQ ID NO: 8710 - protein, 493 aa, Ralstonia metallidurans
PSGVATIFAQRSTTFSQLIDRVARLASALRGQGVAAGDRVAMLALNSDRYVEYIFGTLWAGAALNPVNTRWSVAEIAYSMEDCGTSVLLVDDNFLDLIGPLRERCPCIQTVIYCGDAETPAGMIDYEQLVRSSAPIADSLRSGHDLAAVLYTGGTTGAPKGVMLSHANIASNVLSSLAAASRPPVTSILQMAPMFHIAALSFVFQAVTRLATQVILPGFDPKAAIRDLSRYRINEVFTVPTMLKMMLDDPTFADHDLSSLRNIIYGAAPIDGALLQRAMAQIPSSQFLQAYGMTETSPVSAILAADCHVVGSPRLKAAGRPAPACEVRIVDPATDEDCPTGTVGEVAVRGPGVMLGYWNKPEETARALRNGWMHTGDAGYLDADGFLYVTDRIKDMIISGGENVYSTEVENAILTHPAVQLCAVIGIPDEKWGEAVHAVIVVRPGHELSVDAVHAHCRERIASYKCPRSVEFRADMPLSAAGKLLKYKLREVY

SEQ ID NO: 8711 - protein, 410 aa, Ralstonia metallidurans
  unsure (1)..(410): unsure at all Xaa locations
PRGDSSDSTRHGCGHRSXDRPSVVSLPSITMSQTRRLIFDADHEQFRASVARFVQNEITPYVDQWREQGCCDRAIFEKAGEQGLLLMWADEAYGGAGVTDFRYEQILFEELIRHGDVGVYLTLHSRLVAPYIGRLGTEAQKRRWLTGAASGKTILAIAMTEPGAGSDLAGIGARAERRDGGWVINGAKTFISNGHNADAVIVVARTNPDERRAFGLFVVERGMAGFERGRRLKKLGLDAQDTAELFFNDVFVPDENVLGNPARGFAYLAEGLEEERLLCACQSIAHAQSAFDLTLPYVKERRAFGRPIGALQNTRFVLARRRAELDAMQIWLDALVMEHNAGRLDAVTAASAKLLSTELENRVIDDCLQLHGGSGYMDEYRISRMYRDARVSRIFAGASEIMLEIISRSL

SEQ ID NO: 8712 - protein, 390 aa, Ralstonia metallidurans
MSEAYIVSAVRTAGGRRNGRLSGWHPADLAGQVLDALVERSGADPSMVEDVIMGCVGQAGEQSSNIARGAVLASKLPESVPATSVDRQCGSSQQALHFAAQAVMSGTMDVVIAAGVESMSRVPMGTPSTLPRKNGLGHYVSPQMQARYPGVEFSQFTGAEMIAKKYKLDKTALDAYALRSHQLAAAATKAGRFEQEILPLAARMNDGSDLGEFHTIDEGIRFDATLEGIASVKLIAEGGSVTAATASQICDGASGVMVVNERGLKMLGVKPLARIHHMSVLGHDPVVMLEAPLPATERALKRAGMRIDDIDLYEVNEAFAPVPLAWLQALGADADRLNVNGGAIALGHPLGGSGTKLMTTLIHALHQRGKRYGLQTMCEGGGMANVTIVE

SEQ ID NO: 8713 - protein, 373 aa, Ralstonia metallidurans
MDFKLSEEHQAFADSVARFAQDKLKDGALARAHSPHYPWDTAALLAEQGLLGIAFSEEDGGQGGTLMHAVLAIEQIALVCPRSADIVQAGNFGPIRTFVEYASPEQKARYLPDLLAGRKVVSLGMSEPDAGSAVTELKTSARLDGDSYVINGSKVFSTHSPDAELFLIYVRFGPGVGGIGSVLVERGTPGFQVGEPSSFMNGEQWSQLYFDDCRIPVENVLLGPGGFKKQISGFNVERLGNSSRALALGRHAFNVAREHAMTRKQFGRELCEFQGIQWKFADMAMKLEQAQMMLYRAALEGEHGLPSAQSTAMAKLACNMAGWEVSNEALQVMGGMGFSQESLVEYCVRRTRGWMIAGGSIEILKNRVAEGVF

SEQ ID NO: 8714 - protein, 604 aa, Ralstonia metallidurans
VAKKPNILFIMADDLGYSDLGAFGSEIRTPNIDALVRDGRILTNHHTAAVCAVTRSMIISGTDHHLVGQGTMANSDPNYVDENGKPIPGYEGYLNDRALSIAQLLKDGGYHTYMAGKWHLGSGLPNATNQGAAVGTSAPGQTPVSWGFEKSYALLGGGGDHFGRNGATAYVEDDHYVTPNTTSFFSSDFYTSTIIKYIDSSTGKNTDGKPFFAYLTYQAPHSPLQAPAGYIDRYKGVYDAGYEPIRAARLARQKALGLIPADFTPNPGRDETLAVTPATANWGTPQASYVSATRSVAQGGVDTRVMNANKKWDSLTADQKKAQARYMEIFAAMVENLDDNVGRLVQHLKDIGEYENTVIVFQSDNGPEASYYEFSGKYDQDYDTKNADPAVFPTLGTPAYKGTATIDYGQRWAEVSATPFKLWKSFPSEGGHSVPTIVKLAGTASAPPQSRVTAFTHVVDLAPTFLDLAGVSAPTKPAAPLYDSKGIDRNAGKVVYDGRNVYPITGLSLLPTLQGKTTGPSRTTFSEELYGRTYVYSDNWKAVWIEPPFGPADGEWTLYDIRADRGETNNLAAQRPDVLSDLKGKWNDYAARVGAVLPKVPGMI

SEQ ID NO: 8715 - protein, 858 aa, Ralstonia metallidurans
YSIASATAGGAEAIARLPYCLRVLAENVLRHIGTNDVEEADFCRLLAWHPSSGDVIPVPFHPARVLMQDYTGIPALVDLAALRDAIADLGQPATRINPRIPVDLVIDHSLIVDQAGHPGALTYNLGREFERNTERYRLAKWATAALSNVRVVPPGNGILHQINLEHIAGVVCTQQAGLHVVAFADTMVGTDSHSTMVNGIGVLGWGVGGIEAEAAMLGLPMTVPLRRVVGVRLSGSLQAGVTATDLVLTLTQRLRAFNVVDTLVEFFGPSLAALAVTDRATIANMAPEYGSTAAFFPIDAETLRYLAASGRDAAQVALVEAYARAQGLWRSADAREPEYSSVLEFDLSSVRPCAAGPKRPQDRVELDAIGDSFRAAFPSAAPARETLSDGAVAIAAITSCTNTSNPAVMIAAGLLARKARARGLQARPWTKTSLTPGSRVVGAYLEASGLQADLDALGFHVAGYGCATCGGNSGQLDEAVEQQIRDENIVVTAVLSGNRNFEARIHPMARANYLMSPPLVVAYALAGNIQVDLTRESLGNGNDGQPVYLHEIWPTDAEVQNVLRTVLTPDLFETQYSQLFDGSPAWRALEAPSSALFPWDSSSTYIRKPPFLDHCDGSATAPVEDIVDARILLMLGDSTTTDHISPVGNIPADSPAGLYLRDHGVKPVDFNAYGSRRANHEVMVRGTFANIRLSNELVPGVLGGQTKCLPGGEIMPIHDAATRYAAQGVPLLIIAGREYGTGSSRDWAAKGTNLLGVRAVIAESFERIHRSNLLMMGVLPLEFPSGVTRKTLGLDGTETFGIEAIDEQARPGATVRATLRRADGSSVVLELDCRIDTANEFKVWRAGGMMRFVLHQLS

SEQ ID NO: 8716 - protein, 425 aa, Ralstonia metallidurans
KFETRSVHAGYSPDPTTKAVAVPIYQTAAYAFDNAQHGADLFDLKVPGNIYTRIMNPTTDVLEKRIAALEGGVGALAVASGQAAVTAAIQTITEAGDNIVASSALYGGTYNLLAHTMPQFGVTTRLADHRCPESFEALIDDRTKAVFVESIGNPAGNVTDIAKIAAIAKRHGVPVIVDNTVATPYLLRPFEHGADIVVHSLTKYLGGHGTSIGGAIVDSGKFPWAKYPSRFPKLNTPDASYHGVTYTEAFGPAAYIGRARVVPLRNMGAALSPFNAFLILQGIETLGLRMDRINDNTLAVARHLSQHAKVGWVNYAGLEDNQDYALAKKYMNGKASGLLTFGVKAADGDGRAAGARFLDALQLFTRLVNIGDVRSLATHPASTTHRQLSPEELAQTGVGLDTVRLCVGIEHIDDLLADIDQALQA

SEQ ID NO: 8717 - protein, 385 aa, Ralstonia metallidurans
MFTPCPTERSRDIADRVERFVRDVVAPYEQDPRCSAHGPTEELVLELRAKARAAGIMTPHILPDGGHLSQLETAAVLKRSGLSPLGPVAVNTMAPDEGNMFLLGKVATAAQKARFLEPLVRGEARSAFFMTEPAEEGGAGSDPSMLSTTAVRDGNDWVLNGRKKFITGAEGARVGIVMARTGDGERAQATMFLVDLPHPAIRTERVIDTIDSSMPGGHAQVLIDGLRLPADQVLGEVNEGFRYAQVRLSPARLSHCMRWFGTVTRADEIARAYATTRKAFGKLLIDHEGVGFMLADNLIDLQQAALMIDWCAGVLDTGSAGTTESSMAKVAVSEALFRVADRCVQILGGNGVSRDTIVDQAFRELRAFRIYDGPTEVHKWSLAKK

SEQ ID NO: 8718 - protein, 244 aa, Ralstonia metallidurans
LLGLDGKRALVTGASSGLGAHFAQRLAAHGAEVVLAARRVDALQSVAKQLEPYGRARCVALDVTSASSRAAMVEEAGPIDILVNNAGLVREGAALKHSEEDWDVVLDTNLKGMFFMAQALASGMRERGGGSIINVASILGLRQAGGVVSYAVSKAGVVQLTRTLALEWARHGIRVNALAPGYIDTEINHDFWQTDAGKALIQRIPQRRLGQPDDLDGPLLLLASDASRYMTGAVLPVDGGHLVN

SEQ ID NO: 8719 - protein, 540 aa, Ralstonia metallidurans
DAINGVPADANIGYTWKTYAERLEEAGVSWISYQNMPDEWGDNMLGAFQTFRRANLASGFPVSSGGSPGKPYTNTGQAVPYHAYDAATDNTANPLYKGVANTLPGDKPDQYLDAFRKAVLDNKLPQVSWINAPSIYCEHPSPSSPVQGAWFLQEVLDALTANPDVWSKTVLLINFDENDGYFDHVPSPSAPSKNPDGTYAGKTTLADADLTAEYFTQGAPAGSTGQPAPDGRVFGPGPRVPLYVISPWSRGGWVNSQVFDHTSVLRFLEARFGVREPNISPFRRAVCGDLTSAFNFKTPNNEPMPTLGGRTTRELADKLRADQQKLQQVPVPRDMQLPLQAAGARPSRALPYELHTSARCRASGQVELVFANSGTQAAVFHVYDGFKLDRIPRRYAIEAGKTLSDTWDAARDNFGKYDLWVLGPNGFHRHFKGDLNRLTGTQAAPEVRVCYDVANGNVYVDLMNKGGQPCVFTVTPVAYRQDGPWTANVAAGASTTQHWELQASGQWYDFAVTCSSDASFYRRFSGRVETGKHATSDPAM

SEQ ID NO: 8720 - protein, 251 aa, Ralstonia metallidurans
RLAGRRILVVGAGQRVIDDPDPPVGNGRAISLLFAREGATLTCVDISEPAVAETCRQAKDLGATVFAEVADVERAETIAPLVERAARQMGGLDGLVMVVGISSALPIDKQDANTWDREYAVNVRSNMLFAQQAMRHMEPGSSIVLMSSLAALRNSSGNPAYESSKAAQVALARSIAMAGQKQGIRCNSLLPGLMDTPMGRAATARRPARVGGALPFGRQGTGWEVAYACLFLMSHESSYVNAHALQVDGGL

SEQ ID NO: 8721 - protein, 382 aa, Ralstonia metallidurans
LKGQVAVIGIGESQYYRHGKSPDSEFKLALQAILAACKDAGIDPREIDGFSSFSDDRNDPSRIAAALGLPRLRATTMQWGGGGGGCCAAVANGAASIQAGLADCVVVFRSLAQGQFGRFGRTSGVDTISGEKAYLMPYGVLTPPQRFAMRARRFMHDHGVRQEALRAIALASYHHAQSNPRAVMYGKPLSEEKYDQSRWIAEPFHLFDCCMENDGAAAVILVSAERAKDFPGKAAYILGAAAGSGYRTGAIPHNSPLYGSASFDTVAPDLFKMAGISHTDVGVVQSYENFTGGVVMALAEHGFFKPDEANEFLTLENLIAPSGKLPLNTSGGNLAECYMHGFELVLEAVRQIRGTSCNQAPKNDVALVIGGPMVTPVSNLLL

SEQ ID NO: 8722 - protein, 350 aa, Ralstonia metallidurans
MKSYDIVEWGKPLQEVLRDRPKPVGTEVLVKVQACGICHSDLHIRDGLLDLGNGKHISFESVGVKLPFTMGHEIVGVVAEAGSEASVKAGTPCVVYPWHGCGTCLNCTNGREVDCESGRALGTRKPGGYSDYVVVPHEQYLLDYGNLDPLLAATCACSGLTSFSALKKLPPMLEADTLVLIGAGGLGLAALGLAPQLTSARLVVADIDDEKLARASAAGAHEVVNLRSENAARDLRKAAPNGIRAIVDFVGSAQTTGVALESVARGGTVVVVGLFGGAISLSTALLPMRNVTLRGSYVGSVEEMRALLDLLQEKGKGSPVNLKSLPMSAVNEALEELAQGRVAGRLLAIP

SEQ ID NO: 8723 - protein, 441 aa, Ralstonia metallidurans
AETLEVINPATGEACAIAPVASLRQLDEAVDAARRSQQSWGGLPLTERRTALKGLATILREHVAELAALLTLEQGRPLAQTEAEVMRAAMLLEAMLTIDIDDEILREDESGRVILQHKPIGVVGAIAPWNVPIGLAVPKITHALYAGNTVVLKPSQYTPLATLRLGEYASNLFPPGVLNVLNGGNDLGERICTHPDIAKISLTGSVPTGKRVMASAAASLKRLTLELGGNDACIVRQDADVDKIAPALFAAAFINSGQVCMAIKRLFVHQDLHERLVEKLGGLAAKAKVGDGFDSTSQMGPVQNRAQYESVKAVLAEVAADPAAIIVAGGEALSRQGFFIAPTVVSGVREGNSLVDKETFGPVLPVLSFQTDEEAIERANAGSMGLGASVWGNDLKMAEHVARQLVAGTVWINRHVGVDPLVPFGGAKESGLGRQFGKAGL

SEQ ID NO: 8724 - protein, 378 aa, Ralstonia metallidurans
VGRHQTADDAALQTLEHEIMTRLVVDAVKDAGVDKQDIQSLVFTLPRPYTRQKYFHTFLMGQLRLSCRGNVMEVMGNGMTAALAFDQACNDIMLGRSEVSLALGINMESAVSAAEHMMSSMRTTGDVDFHTSAGFTPIAWYAMDAMRYMHEHGATREELCSVAVKNRFHASMNPLAQYRKPVTLEEVVQQRPIVEPLGLYDVPPRGDGAACLVLASEDVARELGRPYVLVKGRGFFHDGSHQISDVPNDMIAFESARQAASVAYEQAGISAKDVDVAELYAPCTIVEVLVSEAIGLIPKGHGARAAFNGETRLGGHIPISTSGGLTSRGHPAYVTSLYNYVELAEQLRGRAGERQVKNAQFGLATGELGNYNAAMIHV

SEQ ID NO: 8725 - protein, 374 aa, Ralstonia metallidurans
LTEDQRMMREGVLDLLNRVLPWEKVRKMDEAREFPLEAYEALADAGYIGLFYPEHLGGMGGSYRDITVLLETLGYYYTGIAQAITTSAVYAGMHIAKFGTPEMQQELIPKIISGKAKLALCMSEPGTGSDVAGLKTYAEPAGDEYILNGNKVWITCGHVADYFVVITRTDREGGRHQGISTLLVDAKAPGVTVRPLQMLGRRTTHANEVFFDNVRVPAKNLFGGEGRAWKNIMSCLGLERLGLAAISAGHCFKITEYARDYAKERVQFGKPISDFQVIQHKLADMLILSETARQVVYRAADVLDAGQAAVTEASIAKVVASENNFKCADIGMQIMAGAGYSMEYDMQMFFRDSRVGPIGGGTNEIQRNILAKQM

SEQ ID NO: 8726 - protein, 386 aa, Ralstonia metallidurans
MDLRLSPAQEAFRAEVRAFIEERLPEDIRARLRAGHPAQKEDTVTWQRILNERGWAAPHWPRKFGGAELGQLERLILLDEMFRAPTPLPQVFNVTMLGPVLMKFGTPEQCEYFLPKLANLDLWFCQGFSEPGSGSDLASLRTAAKRDGDHYVVNGQKIWTTTAHWADWVFALVRTNPEAKKQEGISFLLIDLKSPGITIRPIRSIDGDHHLNEVFFDDVRVPVENLVGEENKGWNCAKFLLGNERTGIANVGLCRERLDYARELADRTVQGENRLIDDPKLRSEIATLDAEVRALEVTNWRFLLTPNEQARIPAFASVLKLKGVELQQDINALLARLAGPQGLEKRGKRDTDRGPLTPRYFYSRAASIYGGTSEVQKDILAKAIVG

SEQ ID NO: 8727 - protein, 352 aa, Ralstonia metallidurans
NFELNEDQRALQESVHRLLNERYGFENRRQYVEADAGHDEKTWSALSELGLTALLVPEDLEGFGGGAVDLFPVMQELGAVLSLEPLLATNFLPATALRTYAGDARAKEALQSIASGERRIAWAHDEVEARHTDWWISTRATKTGEKWLLSGQKFNVVGANDAHQYLVSARVQGSTEDTDGCALFLVNADAKGLSVRNYKLVDDTPAGELTFSNVSALPLGEAGDGHQSLRAIESALAMGIAAACADMVGAAGAAFQLAIEYVNTRKQFGRLIGENQALRHRASEMLVSLELAKSMAIAAAVAVDDQDSEGAELDLHRAKLSVAKHARAVAHGAIQLHGGIGMTEEYAVGHYL

SEQ ID NO: 8728 - protein, 243 aa, Ralstonia metallidurans
RTIVVTGAAQGIGKAVVELGIELGANVVAVDLNGETLNAALAPLPAERVMAVAGSVADSALATRAVADAVSRFGAVHGLVNNAGIIRPAMIDKMTDQQWTDVIDVHLSGSFYWTRAVGQHMVSRAKDGDKTGGSIVNISSDAGRKGSIGQINYAAAKAGMLGMTMTAAREWGRYNIRSNSVCFGVVETPMTEVVRGEKFRDGMLAQIPLGRWSTPEEVVKTVCFLLSDGSSYVTGQHLGVNGG

SEQ ID NO: 8729 - protein, 450 aa, Ralstonia metallidurans
SIDTPSTIEVVNPATGEVFAQAPDCNAEMLDAAVSAARNALPSWAKTTWAERQELLGRIGSVYLAHQEELARLLTAEQGKPLSRARTEVAGAAYWFAEFARMTLPDLIVQDNDQAYIVVRRVPVGVVGAMVPWNYPVILAAWKIAPALLTGNTLVLKPSPFTPLVTLRVGELMRDVLPPGVLNIVSGGDSLGPRMSAHPGFDKLSFTGSTVTGKRVMESASKDLKRLTLELGGNDAAIVMPDVDIEEVATKLFWGAFVNSGQICIAAKRVFIHESIYDKFSEVLVRLAKSTPMGPGDRDGVELGPVQNRAQFDRLCGLLQDCKDRGFNLLTGGEVEKGPGLFFPVTLVDNPSDDSRIVREEPFGPILPLLKFRSIPEVIERANASEYGLAGSVWCRDESIAMDIARRLQTGTVWINQIQAVTPHTPMAGHKQSGLGVENGEEGLASYTLP

SEQ ID NO: 8730 - protein, 261 aa, Ralstonia metallidurans
QLEKKVVLVTGAASGIGRQTCVTLAAAGARVFASDLNEEGAAQTVALIRDAGGVADSLAHDVTEESAWHAVVQKIESASGRLDGLVNSAGLMVVRPFLETDLALYRRQQAVNVDSVWLGCQAVCKLMTKTAAEFGSASIVNLSSILGLKGGSMHSAYCTSKGAVRLLTKALAVELGRSRIRVNSVHPGLVETPLGLGSMKDMISHGVPLGSLDAAVDMVAHRTPLGRWAQPVDVANVIAFLCADESRFVTGTELTVDGGYS

SEQ ID NO: 8731 - protein, 651 aa, Ralstonia metallidurans
WTPSAAFTESSHLAAYMKWLRGARGLDFRDYASLWQWSVTDIEAFWQTIVDYFDVRFDTPAQRVLDRRTMPGARWFEGATLNYAQQIFRHAGTGLARQRTAIRHAGEAQPLADISWDTLESQVASVAHALRQMGVTRGDRVAGYLPNVPETIVAFLATVSVGAIWSGCAPDMGQVAVIDRFRQIEPKVLIAVDGYRYGGKTYDRAPVVADLVAALPSLTDLVIVPSIGSNVTPEPHARRHTWSDVLAHDVPLEITPVPFDHPLWIVYSSGTTGMPKPIVHGHGGIVIEQLKLMAFHNNLGTDDVFHWYSSSGWIMWNAQVAGLLLGTTIALYDGNPAWPDAGVLWRFVDQARVTMFGAGAAFFTNCMKAGVEPAEIADLSRLRGLGSTGSPLPEEAYDWIYGHVRADIWLAPMSGGTDFAGSFVAGCPLLPVYQGEMQCRCLGAKVEAFDDNGKPLIDEVGELVCTEPMPSMPLFLWGDADGKRYRDSYFDTYPNAWRHGDWIRITPRGGAIIYGRSDATINRYGIRMGTSELYRVVEELPEVLDSMVVDLEYLGRESYMPLFVVLREGMALDDALRDTLRARIRVALSSRHVPNEILQVPGVPRTLSGKKMEVPIKKLLLGHAPEKIANRDAMANPECLTWYFAYAEDYL

SEQ ID NO: 8732 - protein, 448 aa, Ralstonia metallidurans
IEPSIFKAYDIRGIVGKTLTPEVARLIGLSFGSAAAEQGERAVVVGRDGRLSGPDLLGGLVEGLRAAGLDVIDLGMVATPMVYFGTNIELDGRRATSGIMVTGSHNPPDYNGFKMVLGGKAIYGEQIQALRQRIEAGNFAKGNGGYKLVDVRQQYLDRIVGDVKLARPMKIALDAGNGVAGAFVGDLFRALGCEVTELFCDVDGHFPNHHPDPAHVENLQDLIQCLRDTDCELGLAFDGDGDRLGVVTKDGQVIFPDRQLMLFAEEILSRNPGAQVIYDVKCTGKLAPWIRQHGGEPLMWKTGHSLVKAKLKETGAPIAGEMSGHVFFKDRWYGFDDGLYTGARLLEILSRHADASAVLNALPNSNCTPELQLKCAEGEAFTLLDKIRANAKFDGAKEVITIDGVRVEYPDGFGLARPSNTTPVVVMRFEADNDAALARIQAEFKRVI

SEQ ID NO: 8733 - protein, 290 aa, Ralstonia metallidurans
RKGIILAGGSGTRLYPITRSVSKQLLPVYDKPMIYYPLSTLMLAGIRDVLIISTPEDTPRFSEMLGDGSNWGINLQYAVQPSPDGLAQAFIIGRDFIGNDPSTLILGDNIFHGHDLVRQLERSSAQQQGATVFAYHVHDPERYGVVEFDENFRAVSLEEKPAKPRSHYAVTGLYFYDNQVCDIAAEIKPSARGELEITDVNKRYLEMSQLEVEIMGRGYAWLDTGTHDSLLEAASFIATLQNRQGLMVACPEEIAYRSKWISAEQVERLAKPLLKNAYGKYLQHIISETI

SEQ ID NO: 8734 - protein, 342 aa, Ralstonia metallidurans
ILVTGGAGFIGANFVLNWLAQPGADSVVNVDKLTYAGNRKTLASLDGDSRHVFSQTDICDRDALDRLLAEHKPRAIVHFAAESHVDRSIHGPAEFIQTNIVGTFTLLEAVRAYWNGLDAEAKAAFRFLHVSTDEVFGSLGPADPQFSETTAYAPNSPYSASKAASDHLVRAYHHTYGLPVLTTNCSNNYGPYHFPEKLIPLMITNALSGKPLPVYGDGQNVRDWLYVGDHCSAIREVLARGRVGETYNVGGWNEMTNLDVVHTICSLLDQLKPKAAGSYSDQINFVKDRPGHDRRYAIDARKLERELGWKPAETFESGLRKTVQWYLDNQPWVQDVISGEYR

SEQ ID NO: 8735 - protein, 317 aa, Ralstonia metallidurans
RNPQLTKNGELKHLLSIEGLSRDMITHILDTASQFVSLSDSDREVKKVPLLRGKSVFNLFFENSTRTRTTFEIAAKRLSADVLNLNINASSTSKGESLLDTINNLSAMSADMFVVRHASSGAPYLIAEHVAPHVHVINAGDGRHAHPTQGLLDMYTIRHFKKDFTNLTVAIVGDILHSRVARSDIHALTTLGVPEVRAIGPRTLLPSGLEQMGVRVFHNMEEGLKGVDVVIMLRLQNERMTGALLPSAQEYFKAYGLTPERLALAKPDAIVMHPGPMNRGVEIDSAVADGPQSVILNQVTFGIAVRMAVMGIVAGNN

SEQ ID NO: 8736 - protein, 272 aa, Ralstonia metallidurans
VVVTRPAGQSRQLTEALQAAGLDVLSFPLLAIGPAADDVPLRAELGRIEDYALVVFVSPNAVSYGLDTLAQVQNAPGGARWPESVPVAVVGPSSVVALAERGITPPAYRVIAPAGAQGNDTAGDAARFDSEALWSELDTSPGAFAGRKVLIIRGSGGREWLADRLRDAGASVEAVEAYSRTLPEPSGMQWQAVRDSLKPDAPPYAWLLTSSEAVRNLDGLARLHLSPQEHERLKQMQCIAPHARIAAQAQSLGFAHVLPAAPGDAGLLAACT

SEQ ID NO: 8737 - protein, 302 aa, Ralstonia metallidurans
IASRESRLAMWQAEHVRAALQQYYPSCDVSILGMTTRGDQILDRTLSKVGGKGLFVKELEVAMSEGRADLAVHSLKDVPMELPEGFTLTAVMEREDPRDALVSAQFASLEEMPAGTVVGTSSLRREAALRSRFPHLVIKPLRGNLDTRLGKLDRGEYGAIILAAAGLKRLGLGDRIRALIAPESSLPAAGQGALGIEIRADRPELAEWLAPLNHLPTLLAVSAERAVSRRLGGSCQVPLAAHARWRDASLQLDAFVALPDGSRQVRAHATGPVATVADAEALGTAVAGDLLAQGADGVLAAL

SEQ ID NO: 8738 - protein, 929 aa, Ralstonia metallidurans
LREDIRFLGRLLGDCVREQEGDAAFDLVETIRQTAVRFRRENDRAAGTELDRLLKRLSRDQTNSVVRAFSYFSHLANIAEDQHHNRRRRVHALAGSPPQPGSLSRALQAIDAAGVTGKQLREFLDDALIMPVLTAHPTEVQRKSILDAEREIARLLAERDLPMTTRERDHNTAQLRARVTTLWQTRMLRNTRLMVVDEIENALSYYRTTFLQGIPRLMAELEEDIAEVFPRRSKTGATPAPLAPFLQMGSWIGGDRDGNPNVTAETLEHAARQQATLLFDWYLDELHALGAELPLSSLMVDASPELLALAEASPDHSEHRADEPYRRALIGMYARLAATSQLLTGHVAQRHPVADVAPYENAEAFAADVQIVVDSLRTHHGEALARGRVDALVRAIAVFGFHLASIDMRQVSDVHEAVIAELFATAGIESDYAALPEARKLELLLAELRQPRLLTLPWHDYSEQTRSELAIFAMARDLRARYGARIARNYIISHTETLSDLIEVMLLQKEAGMLRGTLGSKTDPARMELMVIPLFETIEDLRNAAGIMESLLDLPGFDSVIAHHGVEQEVMLGYSDSNKDGGFLTSNWELYKAELALVKLFEERRVKLRLFHGRGGTVGRGGGPTYQAILSQPPGTVNGQIRLTEQGEIINSKFANAEIGRRNLETVIAATLEASLLPTQNAPKDLATFEGVMQQLSDHAFSAYRDLVYETPGFKDYFFATTPITEIADLNLGSRPASRKLMDKKHRRIEDLRAIPWGFSWGQCRLLLPGWFGFGSAVQALLDAAPDEKSRKATVATLKRMVKSWPFFSTLLSNMDMVLAKTDLAVASRYAGLCEDTALRKAVFSRISAEWHLTSDMLGLITGRQERLADNPLLARSIKNRFAYLDPLNHLQVELLKRYRAGKDGDDVRVRRGIHLTINGVAAGLRNSG

SEQ ID NO: 8739 - protein, 455 aa, Ralstonia metallidurans
WSARFSEPMSDLVKRYTASVFFDKRLALFDIQGSLAHAAMLAKQGIIAEADRAEIERGMTQIRGEIESGAFEWKLDLEDVHLNIEARLTALVGDAGKRLHTGRSRNDQVATDIRLWLRSEIDSIVGLLGDLRGALLDLAEKNADTILPGFTHLQVAQPVTFGHHLMAYVEMFTRDAERMADCRRRVNRLPLGAAALAGTSYPIDREFVATQLGFDGVCRNSLDAVSDRDFAIEFLAAASLIMTHVSRFSEELVIWMSPRVGFIDIADRFCTGSSIMPQKKNPDVPELARGKTGRVYGHLTGLLTLMKGQPLAYNKDNQEDKEPLFDTVDTVVDTLRIFADMVPGISVKPDNMRAAALQGYATATDLADYLVKRGLPFRDAHEAVAHAVRACDDRHCDLADLTVEQLREVSGLGDKASLIGDDVHSVLTLEGSVASRNHIGGTAPDQVRAAIAAAR

SEQ ID NO: 8740 - protein, 747 aa, Ralstonia metallidurans
VIIIDEDFRSENISGSGIRALAEAIENEGMEVMGLTSYGDLTSFAQQSSRASTFIVSIDDDEFVRADDQPEAAAIEKLRAFVTEVRRRNTDLPIFLYGETRTSRHIPNDILRELHGFIHMFEDTPEFVARHIIREAKVYLDSLAPPFFKALIDYAQDSSYSWHCPGHSGGVAFLKSPVGQVFHQFFGENMLRADVCNAVEELGQLLDHTGPVAASERNAARIFNSDHMFFVTNGTSTSNKMVWHANVAPGDIVVVDRNCHKSILHAIMMTGAIPVFLMPTRNHYGIIGPIPKSEFDPETIRRKIENHPFASKAKNQKPRILTITQGTYDGVLYNAEQIKEMLTSEIDTLHFDEAWLPHAAFHDFYRDMHAIGRDRPRSKDALVFATQSTHKLLAGLSQASQILVQDSETRKLDRYRFNEAYLMHTSTSPQYSIIASCDVAAAMMEAPGGTALVEESIQEALDFRRAVRKVEADYDVANNGDWWFKVWGPDALAEDGIPDREEWMLKANERWHGFGDLADGFNLLDPIKATIITPGLDVDGEFSERGIPAAIVTKYLAEHGIIIEKTGLYSFFIMFTIGITKGRWNSLVTELQQFKDDYDQNQPLWRVLPEFVGKHPQYERLGLRDLCDAIHSVYKANDVARVTTEMYLSDMEPAMKPSDAWAMMAHREIERVPVDELEGRVTAILLTPYPPGIPLLIPGERFNRTIVKYLKFAREFNKLFPGFETDIHGLVEDEVDGQKAYFVDCVK

SEQ ID NO: 8741 - protein, 477 aa, Ralstonia metallidurans
ETYRNYIDGEWCDSASGRTVDNVNPADTRDIVSRHAASDARDAAAAVAAAAAAFDGWKKTPIGKRAKILNDAAAHLEANADTIATELTREEGKALNLARDEVMRSAQTLRFYAVEGQTFSGESYPNDDPDMLVYSLREPLGVVTVISPWNFPVSIPARKIAPALITGNTVVFKPSSDAPLSGYRLAEAFVRAGIPKGVLNFLTGSAAEVGPTIVESREVRAVSFTGSTSAGEQIHKSVPMTTRTQMELGGKNPLIVMEDADLDRAVDLAVKGGLSLSGQACTGTSRILVMRDVKQAFTEKLVAKVKALKIGSGMTAGMDLGPLATRKQLETVLSYIAIGKQEATLLCGGEQLSDGDFAHGYYVAPTVFTDVTQSMRIAREEIFGPVLAIIEVDSYADAIAQANDTEYGLSAAIATRNPRYMHDFTRDIESGTVKINRTTTGNLVNAPFGGLKRSSTSTFRESGRAGLEFYTQIKTVY

SEQ ID NO: 8742 - protein, 400 aa, Ralstonia metallidurans
MSEAFIVDAIRTPIGRYAGSLSGVRADDLGAVPLKALMARNASVDWSAIDDVIFGNANQAGEDNRNVARMSALLAGLPDAVPGATINRLCGSGMDATGTAARAIKAGEANLMISGGVESMSRAPFVMGKATSAFSRDAQIFDTTIGWRFINPAMRAAYGVDSMPETAENVATDYKIGREDQDLMALRSQEKASRAQADGTLAQEITPVTIPQKKGDAIVVDRDEHPRATSMEALAKLRGVVRPDGTVTAGNASGVNDGACALLLASEAGLKQHGLKPRARIVGMATAGVAPRVMGIGPAPATQKLMKQLGMTLDQIDVIELNEAFAAQGLAVLRQLGIADDDKRVNPNGGAIALGHPLGMSGARLVTTAMYQLERTGGRFALCTMCIGVGQGIAMVIERV

SEQ ID NO: 8743 - protein, 282 aa, Ralstonia metallidurans
KAEILAEALPYIRKFHGKTIVVKYGGNAMTEEKLKHGFARDVILLKLVGMNPVVVHGGGPQIDEALKKVGKVGTFIQGMRVTDEETMEVVEWVLGGEVQQDIVMLINQYGGQAVGLTGKDGGLIRAKRLQMPDRENPGTFIDIGYVGDIEAINPAVVKALQDDAFIPVISPIGFSDDGQAYNINADVVAGKMAEILKAEKLVMMTNIPGVMDKKGNLLTDLSAREIEELFADGTISGGMLPKISSALDAAKSGVHSVHIIDGRIEHSLLLEILTEQAFGTMI

SEQ ID NO: 8744 - protein, 310 aa, Ralstonia metallidurans
KVFVDGQEGTTGLRLLDYLSGRTDVELLRIADDKRKDPQERARFLNASDVSFLCLPDVASREAVSLVTNPDTCVIDASTAFRTADNWAYGLPELTRGQREKVRSSKRIAVPGCHASAFVLAVRPLVEAGLMPADYPASAFSLTGYSGGGKSMIAEFEAGGNPKLMSPRPYALGLAHKHLPEMRVQTGLSQAPIFNPIVGNFLKGLAVTVPVYPGLLSRKADAEAILDIYRKHYEGEQFVRVHPFNSDANLDNGFFDVQANNDTNRVDLFVFGNEERLNLVARLDNLGKGAAGAAVQCMNVHIGADEATGL

SEQ ID NO: 8745 - protein, 255 aa, Ralstonia metallidurans
MLRIISANLNGIRSASKKGFFEWMGKQEADMVCVQELKAQEADMTEAFLAPHGYHGYFHYAEKKGYSGVGLYTRHKPERVIIGFGNTEFDAEGRYVEVQYPHLAVISVYVPSGSSSEERQQAKFRFMEAFLPHLLELKASGREIVLCGDVNIAHKEIDIKNWKGNLKNSGFLPEERAWIGELFDNHGYVDVFRQLDPRPEQYTWWSNRGQAYAKNVGWRIDYHLTTAKIAATAKATSIYKDEKFSDHAPLSIDYD

SEQ ID NO: 8746 - protein, 283 aa, Ralstonia metallidurans
MKLQFTKMHGAGNDFIVLDGIHQKLDLTDAQWRALANRHFGIGADQILIVEKSSRDDVDFRYRIVNADGGEVEHCGNGARCFVRFVTDRGMTDKQSVRVEVMNGVITLKLQDDGQVTVDMGEPELTPARVPFIADGLPTRAEAQDTLYGLEVNGRTEWISPVSMGNPHAVQIVDDVEQFPVLQDGPVIEHHKSFPNRVNAGFMQIVDRNTVRLRVFERGAGETLACGTGACAAVVAGIRRGLLDSPVKVHTHGGDLTIAWQGAGQPVQMTGPATTVFEGTIDL

SEQ ID NO: 8747 - protein, 379 aa, Ralstonia metallidurans
LFTSESVSEGHPDKVADQISDAVLDAILAQDKYARVAAETLCNTGLVVLAGEITTTANVDYIQVARETIKRIGYDNTEYGIDYKGCAVLVAYDKQSPDIAQGVDRASDDYLNQGAGDQGLMFGYACDETPELMPFPIYYSHRLVERQSLLRRDGRLPWLRPDAKSQVTVRYVDGRPHSVDTVVLSTQHAPDISQAQIREAVIEEIIKPVLPAEMLKETKYLVNPTGRFVIGGPQGDCGLTGRKIIVDTYGGASPHGGGAFSGKDPSKVDRSAAYAARYVAKNVVAAGLARQCQVQVSYAIGVARPINVTVYTEGTGKISDEKIAALVQEHFDLRPKGIVQMLDLLRPIYEKTAAYGHFGREEPEFSWEATDKAAILRAA

SEQ ID NO: 8748 - protein, 433 aa, Ralstonia metallidurans
LRRLRRLVQANHDAIAAAISADFTNRPHQETALLEVFPSVAGIDDALRHGKRWMRVRRASTGLWFKPGRSRLMPQPLGVVGIVVPWNYPLYLTIGPLTGALAAGNRAMVKLSEYTPRFSALFAQLVQAAFAPDEVAVINGDAEVAAAFSTLPFDHLLFTGSTNVGHHVMRAAAANLTPVTLELGGKSPAIIGPHADFERAVERILVGKLLNAGQTCIAPDYVLVQADQRDRFAEAARRCASRLYPDIARNPDYTSIISPRHFDRLVSMIAAATAAGAHAVPLTDATPDAAARRLPPVLLTDVPDNVMAMQEEIFGPVLPVVTYRSIEDAIGFVNARPRPLALYVFDKSGDVVDRVMRQTVAGGVTVNDTLFHIAQDDLPFGGVGPSGMGVYHGKAGFETFSKLKPIFHQAGLNGAGLLKPPYGKRFESMLKLL

SEQ ID NO: 8749 - protein, 539 aa, Ralstonia metallidurans
FDYLVVGAGSAGCALAGRLADSGNDSIALLEAGGHDHHVLVRTPAAGAAFLPRAGSRNVGYRTVPQEGLDGRRVSQPAGRGLGGSSLISAMIYTRGRPADYDAWADAGCDGWSWDDVLPYFRRAECNERLAGEDDDPLHGGTGPLHVSDLRSPNPFAHHFIDAAQRAGIVRNGDFNGDEQEGVGWYQVTQHNGERWNAARAYLHGGNARNRTSNGGRSHLHVLTGVQVLRVLFERRRAVGVVAWRDGKELEIRARREVILAAGAFGSPQLLMASGVGPMMHLREFGVPVVHDLPGVGANLQDHVDVAVQRRVRASELFGISLGSAFRLIGESLRYRRGRSGMLTSNLAEAGAFVRSRPGLAEPDLQLSFVVGLVDDETRRLRLGHGYACHASVLRPRSRGVVRLASPDSRKAPLIDPHYLSDPQDMDGLLDGLRIARRILAQAPLAAFGGQDLRLGQLRDDGGNDEAARAWIRAHAQSACQPVGTCRMGMDPLAVVDPQLRVRGIEGLRVVDASIMPTLIGGDANAPAIMIGERAHDLI

SEQ ID NO: 8750 - protein, 466 aa, Ralstonia metallidurans
LKQDYIVADIGLAGWGRKEIAIAETEMPGLMAIRDEFAAAQPLKGARIAGSLHMTIQTAVLIETLKALGADVRWASCNIFSTQDHAAAAIAASGTPVFAFKGESLKEYWDFTHRIFDWADGGTPNMILDDGGDATLLLHLGARAEKDASLIAKPTSEEETFLFAAIKEKLAKDSTWYSRNLAAIRGVTEETTTGVHRLYQMAQKGELKFPAINVNDSVTKSKFDNLYGCRESLVDGIKRATDVMIAGKIAVVAGYGDVGKGSAQALRALSAQVWVTEIDPICALQAAMEGYRVVTMDYAAEHGDIFVTCTGNYHVITHDHMAKMKDQAIVCNIGHFDNEIDIASVEKYEWDEIKPQVDHVKFPDGKKIIILAKGRLVNLGCATGHPSYVMSSSFANQTIAQIELWAERDSGKYPVGVYVLPKHLDEKVARLQLRKLNAQLTELTEQQAAYIGVKKEGPYKADHYRY

SEQ ID NO: 8751 - protein, 769 aa, Ralstonia metallidurans
ERVTYRIENMDCPTEEALIRDRLGKLPGVTALDFNLMQRVLGVQHTLATSAPIEKALASIGMQAARQDMQTATTVLRIAKMDCPTEESLIRGKLQGMPGVQGMDFNLMQRTLTVRHTPDAIKPAVEAIESLGMEAEVQRTDEPRDAPVAAHKTNWWPMAVSGVAAVAAEGVYWVNDGNHWAVIVLALVSIFTGGLSTYKKGWIALKNLNLNMNALMAIAVTGGMAIGHWPEAAMVMFLFALAEVIEAKSLDRARNAIRGLMDLAPETATVRQADGSWTELPAKEVAKGAVVRVRPGERIALDGLITSGRSAINQAPITGESLPVEKAEGDQVFAGTINETGSFEYKVTAGASDSTLARIIHAVESAQGSRAPTQRFVDQFARVYTPAVFAVSVLVAVVPPLAFGGAWFDWVYKALVLLVIACPCALVISTPVTIVSGLAAAARRGILIKGGVYLEGGRKLKALALDKTGTLTHGKPEQTDFVPLIGEAQEVAAWAASLAARSDHPVSQAIARKANRDGIALHEVDDFAALPGRGVRGRVAGRMLHMGNHRLAQELGLSEATLQARLETLERQGKTAILLMDDATVLGIFAVADTVKETSREAVADLQALGVRTLMLTGDNQHTAAAIAAQVGISEARGDQLPEDKLKTIESLVGGEGQVGMVGDGINDSPALARADIGFAMGAAGTDTAIETADVALMDDDLRKIPAFIRLSRSTAAILTQNIVLALGIKAVFLALTFTGHATMWMAVFADMGASLLVVVNGLRLLKFK

SEQ ID NO: 8752 - protein, 557 aa, Ralstonia metallidurans
TLHIEGMTCTSCAEHVQQALTNVPGVRAASVSYPQRQAEIEADAGVSVAPLVAAVATLGYRARLTDTPNKPAGLLDKALGWLGGETKHVGGEQALHVAVIGSGGAAMAAALKAVEQGARVTLIERGTIGGTCVNVGCVPSKIMIRAAHIVHLRRESPFDAGLPAAAPAVLRERLLAQQQGRVEELRHAKYEGILASTPAITVLRGEARFRDTRTLTVATADGGTHEVNFDRCLIATGASPALPPIPGLADTPHWTSTEALESSSLPERLAVIGSSVVAVELAQAFARLGSQVTILARSTLFFREDPAIGEAVTDAFRAEGIEVLDHTQASHVAYAGGEFVLTTGQGEVRADKLLVATGRAPNTRSLNLEAAGVEVNAQGAIVIDRAMRTSAPHIFAAGDCTDQPQFVYVAAAAGTRAAINMTGGDAALDLTAMPAVVFTDPQVATVGYSEAEAHHDGIETDSRLLTLDNVPRALANFDTRGFIKLVAEAGSGRLIGVQAVAPEAGELIQTAALAIRHRMTVQELADQLFPYLTMVEGLKLAAQTFNKDVKQLSCCAG

SEQ ID NO: 8753 - protein, 766 aa, Ralstonia metallidurans
YRIENMDCPTEEALIRDKLAKLPGVGGLEFNLMQRTLAVSHQMASPGPIEEALSAIGMRAVRMDEATPLQNTVLAIHQMDCPTEEALIRSKLAGIPGVASLEFNLVQRTLHVWHAADTLSHVLTALKSLGFDAEVRSAGAPAAAEAPGPARTNWWPLAVSGVAATLAEVVYWLHGGNHWGVVALALAAIFTGGLTTYKRGWIALRNRNLNMNALMSIAVTGAMLIGHWPEAAMVMVLFALAEVIEAKSLDRARNAIRGLMDLAPDTALIQQADGSWAEVDAKAVAVGSRIRVKPGERIALDGQVIEGRSTVNQAPITGESLPVEKIEGDPVFAGTINESGSFEFRVTAAANASTLARIIHAVEAAQGSRAPTQRFVDQFARLYTPVVFAVALAVAVLPPLVFGGPWLDWIYKALVLLVIACPCALVISTPVSIVSGLAAAARHGILIKGGVYLEEGRKLKWLALDKTGTITHGKPALTDFVVWGDANPATSRLLAASLAARSDHPVSLAVARAAEGEGLIPCDVADFAALPGRGVRGSVDDHSYHLGNHRLVEELGVCSPELESRLAALEAEGKTVVMLVGPEGVQALFAVADTVKENSRQAIADLHTLGVKTMMLTGDNPHTATAIAGQVGIDRSRGNLLPEDKLREVEQLSTDGKTGMVGDGINDAPALARADIGFAMGAAGTDTAIETADVALMDDDLRKLPTFVRLSRATASVLKQNIALALGIKAVFLVLTFTGQATMWMAVFADMGASLLVVGNGLRLLR

SEQ ID NO: 8754 - protein, 416 aa, Ralstonia metallidurans
MQLLAIGINHTTAPVSLRERVAFPLEQIKPALGALRTHLSGRNGTEAAILSTCNRTEIYCATDVLKPGEEGFEHTLRWLAQHHNVPASELAPHLYALPQSEAVRHAFRVASGLDSMVLGETQILGQLKDAVRTAGEAGALGTYLNQLFQRTFAVAKEVRGQTEIGAHSVSMAAAAVRLAQRIFESVSTQRVLFIGAGEMIELCATHFAAQTPRQIVVANRTVERGEKLAEQLSEQGLTTQAIRLQDLGDRLHEFDIVVSCTASSLPIIGLGAVERAVKRRKHRPIMMVDLAVPRDVEPEVARLDDVFLYTVDDLGAVVREGNALRQAAVAQAEAIIDSRVLNFMHWLETRSVVPVIRELQSQGEAIRQAEVERARRMLARGDDPAAVLEALSGALTRKFLHGPTHALNHTQGEDRE

SEQ ID NO: 8755 - protein, 514 aa, Ralstonia metallidurans
ASSATGDARMKAQEIAACWQAMDLPPPWTPAEGAAPGVLAVRSPIDGEVFGQLAMCDAALANARIARAHAAQTTWALTPAPARGEVVRRFGEALRANKDALGRLVSLESGKILQEGLGEVQEMIDICDFAVGLSRQLHGLTIASERPAHAMRETWHPYGLCGVISAFNFPVAVWAWNAALALVCGNGVVWKPSEKTPLCALAAQGLLDRVFERHAPQFDGLSCVLTGGRQLGEHLVQHPAVRLMSATGSTRMGREVGMACAAHFKRAILELGGNNAAIVTPSAELEMTIRAMTFAAAGTAGQRCTTLRRAFVHADLIETVTNRLRQVFARLPVGDPLEDGTLVGPLIDHAAGDTMANALASCRAQGNVVHGGERLLGDRYPHACYVRPALVLTDAQHDTMLTETFAPILYLMPYTSLDEAIALNNAASHGLSSCIFTESLREAERFLSSAGSDCGIANVNIGTSGAEIGGAFGGEKATGGGRESGSDAWKGYMRRATNTINYGDALPLAQGIRF

SEQ ID NO: 8756 - protein, 263 aa, Ralstonia metallidurans
IRVAVGGVTGWAGGELARGVAHAADMTLVAGLSRGAAGQALAKLTGHADTPGIAVASIEELNQTPYDVYVEYTKPTIAKHNILQALARGAHVVVGTSGLTDDDYVEIDAAARKADRGVLACGNFAITVVLLQKFAEMAARHLEHWEIIDYAKAGKVDVPSGTVRELAFRLGQVKAAAQVVPIDEVNGPKETRGATMSGTQVHAVRLPGYQLGVEVIFGADGQRLHLKHEAGDGSKPYVSGGLLAIRKVHTVRGVVRGLDKVME

SEQ ID NO: 8757 - protein, 461 aa, Ralstonia metallidurans
VDASRHRYSVRSTKCADRRPRMAADLWFESLHRTGTEVLDRGNRLAGGLRRLGLEEGAVVAVMLRNDPVFADVVFACRTAGVYYCPINWHFTPEEARFLLEDSSARVLIIEADLFPSMREVIPAGMTVLTVNGSDADATITIAYEPWLATQSPYDGPRVAPRGHLAYTSGTTGRPKGVLRSAVPLGELEDQTARMRSVVAKAIGIVPGCRALMSAPLYHSAPGVFIQNALQMAERLVLTPRFDAEQVLALVEKHRIDVLYLVPIMYVRLLKLPPEVRARYDLSSIRFVASTGSPCAPEVKRAMLDWFGPVIHETYASSEAGMVTVATPEDAAERPGTAGRPVDAASVRIIDESGRPCAPGEVGLVYVRQPAYPDFTYLNNDAARRTIDVDGRVTLGDMGYLDADGYLFICDRASDMVISGGVNIYPAEIEHELVRYPGVADCVVFGVPDDEYGERLHGVIQ

SEQ ID NO: 8758 - protein, 110 aa, Ralstonia metallidurans
LARVAATLESRKPENGGDPEKSYVAKLFKKGDDAILKKIGEEATETVMAAKDARAADLADEAVSKVVYEVADLWFHTMVLLARIGRTPEDVVNELARREGLSGLVEKASR

SEQ ID NO: 8759 - protein, 255 aa, Ralstonia metallidurans
MLAKRIIPCLDVTNGRVVKGVNFVELRDAGDPVEIARRYDEQGADEITFLDITATSDGRDLILHIIEAVASQVFIPLTVGGGVRTVEDVRRLLNAGADKISVNSSAIANPQLVSDATGKYGSQCIVVAIDAKRSSAPGEPPRWEVFTHGGRKATGLDAVEWAREMARRGAGEILLTSMDRDGTKSGFDLELTRAVSDAVPVPVIASGGVGGLQDLADGIRLGHADAVLAASIFHYGEHTVGEAKAFMAREGIPVR

SEQ ID NO: 8760 - protein, 194 aa, Ralstonia metallidurans
RVAEVTRNTSETQIRVSLNLDGTGRQKLASGVPFLDHMLDQIARHGMFDLEVEATGDTHIDDHHTVEDVGITLGQAVARAIGDKKGITRYGHSYVPLDECLSRVVIDFSGRPGLEFHVPFTRARVGSFDVDLTIEFFRGFVNHAGVTLHIDNIRGINAHHQCETVFKAFGRALRMAVELDPRAANTIPSTKGTL

SEQ ID NO: 8761 - protein, 255 aa, Ralstonia metallidurans
VDAPVPGFVMYPMSAQFAGLEFVGVPLRPDFTLDRAAMLAAMAEHKPAIIYLAYPNNPTGNLFDADDMAAIVRAAQGEVCQSLVVVDEAYQPFAQESWMPRLTEFGNLLVMRTVSKLGLAGIRLGYVAGAPEWLSQLDKVRPPYNVNVLTEATALFALEHVAVLDDQAAKLRAERSKLVEAMAGMPGVTVFPSAANFVLVRVPNAAQIFDRLLARKVLIKNVSKMHTLLANCLRVTVSTPEENAQFLEAFKASLQ

SEQ ID NO: 8762 - protein, 394 aa, Ralstonia metallidurans
VNIHEYQAKELLRRYDVAVPNGCVAFTPEEAAQAARKLGGPIWVVKSQIHAGGRGAGRFAGDPSGKGGVRVVKSIDEVQANASQMLGATLVTKQTGPAGREVRRLYIEEGCDIARELYLGMLIDRATSRITVMASTEGGMEIEEVAAHTPEKILKVAIDPASGIQPFHARRLAFGLGLSGKQVAAATRFILSAYRAFTELDASIVEINPLVVTGSGDVIALDAKFNFDDNALFRHPDIEAMRDESEEDPAETEAARHALNYVRLDGNIGCMVNGAGLAMATMDIIKLYGGEPANFLDVGGGATKERVTAAFRLILADPKVEGILVNIFGGIMRCDVIAEGVIAAARDVDLTVPLVVRLEGTNVELGKTILRDSGLPILSANHLADAAEKVVAAV

SEQ ID NO: 8763 - protein, 285 aa, Ralstonia metallidurans
MAVLIDQHTRVICQGFTGAQGTFHSEQALAYGTKMVGGVTPGKGGETHLGLPVFDTVSAAAHATGADASVIYVPPPFAADAILEAVDAGIGLIVCITEGIPVIDMVRVKRALSGSASRLVGPNCPGVITPGQCKIGIMPGHIHKPGRIGVVSRSGTLTYEAVAQTTATGLGQSTCIGIGGDPVNGTNFIDSLELFLADDQTEGIIMIGEIGGSAEEEAAQFLRDARTRKPVVGFIAGSTAPPGRRMGHAGAIISGGTGTAEAKIEAMREAGIHVAASPAELGNTM

SEQ ID NO: 8764 - protein, 437 aa, Ralstonia metallidurans
FHEFVAVDLAHTTMLVEQGILSAETGRAILEQLLIIRRMQPSAFPVDVRKGSLLLQIESYLFGAIGEDVGGQMHTGRSRIDQGATVRRLYKRNRMLDVMDQLNVFQEAIAEQARHHAHTIMPGYTHMQQAQPWVFGHYLLSFSSRLHDSFERLAQAYGRVNRNPLGTVGLAGTSWPLNRERTTELLGFDGQIENSKLGREAFDAADAICALSFIMADLNDLATDLHIWSSAEFGLVESDDSYCGTSSIFPQKKNPVALETIRKAAGPAVTWLSAALATFRAEGTGDQAMRSVSHIDEALATTESMLDLFTGVMETLIVHQDHMAESLKGSWCTASNLADVVVRERRLSFRQVHHIVARAVRNCVAQGLRPDQLTSSRLDEAALETVGIALNLGDAAVRDALDPVRFVETRITEGSVGPQQVARLLERAAQERAADRQ

SEQ ID NO: 8765 - protein, 234 aa, Ralstonia metallidurans
MSHKTFLITGASKGIGRALSHRLAAAGHKVIGVARNADPGFPGILVPIDLTDPVATEHALTTLRSEHVIDGVVNNVGFIELAPLGNIDLDAMDDMFRSNLRPAVQLVQALLPDMRERGWGRIVNLSSLVVLGVANRSVYAAAKSAMISFTRTWALELAPTGITVNAVAPGPVETEMFRANTPQGSDAEKRFLSMVPMGRLGKPDELAAAIEFLLSEPAGFITGQTLFVDGGASI

SEQ ID NO: 8766 - protein, 483 aa, Ralstonia metallidurans
RLTPAIITTVVLVTLLLTPTPAGLKDNAWDLVAIFLTTIVAIILKVMPIGVMAMMAIVIVSLAQVTSNSSKGAIADALSSFDSPLIWLIVVAILISRGLKKTGLGSRIGLMFIALLGKRTVGIGYGLAICELVLAPFTPSNTARGGGIVHPIMRSIAGAFDSDPANGTQGKVGTYLALVNYHANPITSAMFVTATAPNPLVVDYVAKASGQSLHLSWTTWALCMLLPGLVCLLLMPLVIRVLCPPELKATPNAIEYAKGELARMGPLGGKERVMIGVFAMMLVLWANVPAMIWGPTFTLDPTVVAFLGLFALIITGTIDWDDVLSEKSAWDTLIWFGALVMLAEQLNKLGVIAWFSADMRDAIAASGMGWLSIAAILVLAFVFSHYLFASTTAHISAMMLAFLTVGAQLIPQPYIAPFMLMMTAGSAIMMTLTHYATGTSPIIFGSGYVTMGQWWRVGAVMCVFELVIFAVVGGIWWKILGFW

SEQ ID NO: 8767 - protein, 414 aa, Ralstonia metallidurans
AQLMATDVLVIGGGGGGCAAALTAAKHGARVILATKLRLGDSNTVMAEGGIQAAIGEDDSPQLHFEDTLRAGHFCGDPALVAQMVMDGPDVIRWLIQLGMMFDQEEDRPIGGNLLRKKPGGASAARILSYRDYTGLEMMRVLREAVDLDPGIEVWNRCPAVELLSDERGNCAGAVIYNLESRTFVLVRAAAVIIATGGAGRLHLNSFPTSNHFGATADGLVLAYRIGARLRELDSFQYHPTGIAYPPHLAGGLISEAARSAGAKLINGEGERFVDELKARDIVASAILRECAQGRGIIREGQVGVLLDTPTLEMEHPGILDKRLVTLSHLAHKCGHDAAKEPFLVYPTLHYQNGGVAIDGHGTTSVSGLYCVGEVAGGIHGRNRLMGNALLDILSMGRRAGASAAEAKRSAVAS

SEQ ID NO: 8768 - protein, 345 aa, Ralstonia metallidurans
MGTVARFEIGFTRYLSPDGSPEPDLPDFARDPATLLPLYRAMVLTRQFDLKAIAMQRTGQIGTFASALGQEAIGVGVATAMRRDDVLVPSYRDHAAQFVRGVTMTESLLYWGGDERGSAFAAVPYDFGNCVPIGTQVGHAAGVAYTFKLRQAPNVAVCILGDGGTSKGDFYEGMNMAGAWHVPLVIVINNNQWAISMPRAKQTAAATLAQKAIAAGIPGEQIDGNDVIAVRQRVGAAIEHARHGGGPTLIEAVSYRLGDHTTADDASRYRDEASVKEAWRCEPIIRLRDYLARLGAWDAAQEEALIKECQQAVGAAVQAYLALPHPDASAMFDCLYETLPDAMAE

SEQ ID NO: 8769 - protein, 320 aa, Ralstonia metallidurans
LHMVEAVNLALAHALANDPDVVLLGEDIGVNGGVFRSTVGLQSRFGEARVIDTPLAEGAIVGAAIGMAAMGLKPVAEIQFAGFIYPAIDNILNHAGHMRHRTRGRITCPMVVRAPSGAGIHAPEHHSESPEALFAQMPGIRVVMPSSPARAYGLLLAAIRDPDPVIFLEPTRLYRLFRQEVADDGQALPLDACFTLREGTDLTLVSWGAMLRETLAAADVLADDGVSAAVIDVATLKPLDMETILESVAQSGRCVIVHEAPRTAGLGAEIAANLADAGLYSLSAPVQRVTAPDTVVPLARLEHSYMPSVARIVDAARRAL

SEQ ID NO: 8770 - protein, 372 aa, Ralstonia metallidurans
  unsure (1)..(372): unsure at all Xaa locations
KLPDLGEGLQEAEIVNWHVKPGDTIAADQPLLSVETAKAIVEIPSPFAGQVAKLFAQPGDIVHLGAPLVGFEARGRPTMPARWXAPXRSARMWSMKASRAXAPPAFPADMASKATPAVRALARKLSVDLSMVTPSGHDGVITATDVQRVATTLADVGAPDVLRGVRRAMAQNMARAQSEVAAATVMDDADLHAWQATGASVTGQDITIRLVRALVAGVRAEPALNAWYEGRTGRRHLLERIDVGIAADLPEGLFVPVLRNVGKRDAADLRAGLDRMRADVVARTIAPEEMRGNTITLSNFGMIAGRYAAPIVVPPTVAILGAGRVRDEVVASGGVPAVHRVMPLSLTFDHRVVTGGEAARFLRAVIEDLERP

SEQ ID NO: 8771 - protein, 216 aa, Ralstonia metallidurans
MAIRLGEEAPDFTADTTEGKIHFHEWIGDSWAILFSHPKDFTPVCTTELGYMAKLKPEFDKRNTKIIGLSIDPVGDHSRWVKDIEETQGATVNYPMIGDHDLKVAKLYDMIHPEASGGPRTAADNATIRAVFMIGPDKKVKAMLVYPMSAGRNFDEVLRLLDSLQLNAKHTVATPVNWKPGDDVIIPTSVSDDDAKKKYPQGFKTLKPYLRTVAQP

SEQ ID NO: 8772 - protein, 536 aa, Ralstonia metallidurans
  unsure (1)..(536): unsure at all Xaa locations
MDVTEMQRYNTLLATASREAEAATEAKSRFLATMSHEIRTPLATVIASLDLLRESELSTHQREELDLADHSAKLLLEILGDILDFSRIEAGEMKLEQAPIDLRLIIEDVLRIQARQIEKKGVILDFYVEAGLAATLLGDAVRLRQIVLNLVGNATKFTLQGSIVVRALLIADHPETQTIQLEVSDTGIGIPAEKQAALFKAFSQADVSTTRRFGGSGLGLSICSRLVQAMGGAVVLTSTPGVGSTFRVELTLPVVERSTRMVEFAKTHIAIDVSRADDAAVFREHAVALGMQLAPLDCLNPSDIAVIDEDAASDKVPVGVLTIPYGKKHGNLSGPPIWWSEFRAACLDAVLRDTHRFPAQGQDVTATPPISDSLAGLTSLPILVAEDHTPFQIVIRRQIEKLGLACDVVSDGKEALAAIRNKQYGMILTDCHMPYMDGYELTSAIRASEAQGQRLPIVALSADASDEQRHRGRAAGMDDFLLKPLKLPELRACIQRWVLRXFQVGGLWDSLPRPRRASWRPPYRKLLHVGTPHSGF

SEQ ID NO: 8773 - protein, 553 aa, Ralstonia metallidurans
FVAARDFLLRHRADYDRAYGEFAWPQLGEFNWALDYFDVMAQGNDNPALWIVDSPNDAGAPLSFREMSGRSSRMANYLRGLGVSRGDRLLLMLPNRVELWDVMLAAMKLGAVVLPATTQLSPDDVRDRVQLGEARFVVVDGAELGKFEDVDASVTRIAVGERVAGWHHIGDAYQASPTFVPDGVTRATDLLLLYFTSGTTSKPKLVEHTHQSYPVGHLSTMYWIGLQPGDIHWNISSPGWAKHAWSCFYAPWNAQACVFIYNFARFAPRDALDVLVQRNVTTLCAPPTVWRMLVQEPLASYAVKLREIVGAGEPLNPEIIERVQSAWGITIRDGFGQTETTCQIGNPPGQPVVPGSMGRPLPGYRVDLVDLDDHPANEGEIVLSLASRPLGLMAGYSNNEKATAEAMRNGFYHTSDIAMRRDDGYLVYVGRADDVFKASDYRLSPFELESVLIEHEAIGEAAVVPSPDPVKLYVPKAYVTVRQGYEAGPELARAVFRFSREKLAPYKRIRRLQFSELPKTISGKIRRVDLRRREMEREDQSSRMPGEYWEEDF

SEQ ID NO: 8774 - protein, 241 aa, Ralstonia metallidurans
LQGRVAIITGAAAGIGFATAERFAAEGAKLIMCDVQEARVREAAERLAAKGAQVEAHKVDVTRRDEVDAMVAATLARHGRIDVLVNNAGITKDARLAKMTEAQFDAVIDVNLKGVFNCSQAVASIMSEQGSGVILNASSVVGLYGNFGQTNYAASKFGVIGFTKTWARELGPKGVRVNAVCPGFVNTEILQTVPEKVLDGMKEHCWMRRLAEPSEIAAIYTFLASDDASYVNGTTIEASGG

SEQ ID NO: 8775 - protein, 278 aa, Ralstonia metallidurans
SVDRYVVVGNPISHSRSPAIHAAFARQTGEAVQYDRLEAPLDAFADTMREFLAGGGHGFNVTVPFKLEAYDLADRLTPRAEAAGAVNTMWIEDGLIHGDNTDGIGLVRDIQDNLDVLLEDKRILVLGAGGAAMGAMLPLIECRPARIVVANRTASRASDMVEEFVEAADQYNVELWAGGLDALDALSEDERCDVVINASSSSLQGEVPPVPEHLLGEGVLAYDMMYGAQPTVFLAYAAKCGARTADGLGMLVEQAAEAFYNWRGVRPSTAPVLAELRA

SEQ ID NO: 8776 - protein, 165 aa, Ralstonia metallidurans
NLFFIGFMGAGKTTIGRAVAHELGRPFFDTDHEIETRCGVRIATIFELEGEEGFRQRESRVLDELTQRSGIVLATGGGAVLRPENRAMLRARGQVVYLDASLPEIWRRTRRNRNRPLLQTDNPRARLEALFCERDPLYREIAHIVMPAHGGSIAQAVANVLARLD

SEQ ID NO: 8777 - protein, 577 aa, Ralstonia metallidurans
  unsure (1)..(577): unsure at all Xaa locations
MTTELKKLLIANRGEIALRVQRAARDLDIGTVAVYSQDDAGCRHRMLADEAIALDGAGPAAYIDIAGIIAAAKASGSDAVHPGYGFLSERADFAQACIDAGIRFIGPTVEHLALFGDKGRALQLAAECDVPVMPATHGGASLEEIERFFDAQGDAGIVIKAVGGGGGRGMRVVRRREDLAEAYARCRSEASSAFGVDALYAERLVSRARHIEVQIAGDGQHVIALGERDCTLQRRFQKLVEIAPSPVLKPELRAEIIKAALRLARRVNYQSLGTFEFLVEESESGEQKRFVFIEANPRLQVEHTITEQVTGVDLVALQIGLASGRTLVELGLDPASPPQPRGYAIQVRVNAEMTDAQGLARPAFGRLERFEPPAGPDVRVDSHGYAGYEPSPNFDTLLAKLIVSSAAPGFEAAVRRLQRSLAEFRIVGVPTNLNLLRALAQREDFLTQDVHTRLFESILPALDGVGGNHRRSRARAGRAFRRRIPCNARPREPRDPRAGGXRGTGRRARGIRAPLTGRVVDIPVQLDEIVKPGQTVAVLDAMKMEHAIVAPCAGRVVDLRPEKGALVSEGHMLIVLE

SEQ ID NO: 8778 - protein, 492 aa, Ralstonia metallidurans
VAIRLQAERELQRAHRLAEDANAAKSIFLAAMSHEMRTPLYGMLGTLELLSLTALDDRQRQDVGTIQTSSATLLSIIDDLLDYTKFEGGQLTLESVAFDPVELVEAVARSHAPLALRKGLALTCYVQADLPWLIGDPVRVRQALDNFLTNALKFTSEGHVGIRAFRAASTPSDETTLCLVLEVLDTGIGMSPGTQAQLFEPFVQGDATTARRFGGSGLGLSICRRLARRMGASIVVESELGRGSRFSFSVPLEIGEARQSVEPALPNVVVRAQDPVWRADVIAMIRQSGGRAIACQGDATDPGTILLIADETQGPVPNGYAGVVRLKASGPLEAVARPDGLVVSAYHQAGIVRALCRAAGIPLTSTASPVQRSTQMLKLDLQVLAVDDHPVNRRLMQQQLEQLGCRTTMVSSGEDALLACRQGQFDAVLTDVHMPGMDGYALAHALRADGFTIPIIGVTASVATGEAERCVASGMNGHLTKPVLLQALADSL

SEQ ID NO: 8779 - protein, 456 aa, Ralstonia metallidurans
TSFATLPLSAAMQATLVQLGYDAMTPIQAASLPLALAGHDLIAQARTGSGKTAAFALSLLHRLDPRPLDVQALVLCPTRELADQVTQEIRRLARAEDNVKVLTLSGGTPIRPQVESLVHGAHVVVGTPGRIIDHLDRGSLNIDAINTLVLDEADRMLDMGFHDDIAFIASHAPKDRQTLLFSATYPAAIDKLAHRFLRQPKTVKVEEAHDAATITQRFYEVEEGDRLNAVGRLLDHFRPATTLAFCNTKARCRDLADLLRAQGYAALELHGDLDQRDRDQVLVQFANRSCSVLVATDVAARGLDIAQLEAVINVDVTPDPEVHVHRVGRTGRAGEAGSAFSLVSLDEMGRVGNIEQHQGGEFEWHALDELKPSGGGRLLPPMVTLQMLGGRKEKIRPGDILGALTGEAGFTKEQIGKISVMEMSTYIAVDRAIGREAVKRLNEGKVKGRKVRVRML

SEQ ID NO: 8780 - protein, 238 aa, Ralstonia metallidurans
KRAIVTGGSRGIGKAIALQLAQEGVDVVVAARGRAALEATAAELATLTGRRIVPLAVDTSSKASVDSMVNQAIAALGGIDILVNAAALPGGISSASRLDEIDDAQAIEDIDIKVIGYLRTARALAPHLIANGWGRIVNIGGLAIYRTGRPIATLRNVGVAAITKNLADELGPKGINVTAVHPGATRTETTDAAFEAWAAARTSLGRIVEAREVAAVVAFLASPVSVAINGDAISVAGG

SEQ ID NO: 8781 - protein, 243 aa, Ralstonia metallidurans
VVLITGATAGIGRATALAFAAKGARLVCSGRNAAAGDALISELREMGAEADFLAADVSREDDVMRLVSHAVERFGCLDIAVNSAGTEGTPGSIVEQTVQSYATTFDANVLGTFLCMKHELKAMIGQQRGVVVNLSSTMGSRGNPRNPMYVASKHAIEGLTKSAALDVIQANVRVNAVAPGPIETAMLGRIAGGADRLASVAATIPAGRVGTPEEVADAILFLASDQSTYITGQILHVNGGKTA

SEQ ID NO: 8782 - protein, 270 aa, Ralstonia metallidurans
MKDFHNKVAAITGAGSGMGRCLAIQLAQSGCHVAISDCNEAGLAQTVAEVRRVAPMVQVTSHRVDVADRAAVHAWADDVARAHGRVNLIFNNAGVALSSTIEGMAYDDLEWIIGINFWGVVYGTKAFLPHLKASGEGHVVNTSSIFGLFAQPGMGAYNASKYAVRGFTESLRQELDLMDCGVSATTVHPGGIKTNIARASRVSSSVNGLLVRDAQQGREEFEKFFITTADKAARVILDGVRANKRRVLIGPDAYAADALSRVLPAAYQSL

SEQ ID NO: 8783 - protein, 600 aa, Ralstonia metallidurans
VKNQKLVAWVADIAALTKPDQVYWCDGSQEEYDRLCEQMVAAGTMRRLNPAKRKNSFLALSDPSDVARVEDRTFICSQKQEDAGPTNNWTAPAEMRQTLNGLFDGCMRGRTLYVVPFSMGPLGSPIAHIGVELSDSPYVAVNMRIMTRMGRAVYDVLGADGEFVPCVHTVGKPLAAGEKDVAWPCNPTKYIVHFPETREIWSFGSGYGGNALLGKKCFALRIASTMGRDEGWLAEHMLILGVTSPEGKKYHVAAAFPSACGKTNFAMLIPPKGFEGWKVTTIGDDIAWIKPGKDGRLYAINPEAGYFGVAPGTSEKTNFNAMATLKENVIFTNVALTDDGDVWWEGMTKEAPAHLIDWQGKDWTPEIAKSTGAKAAHPNARFTAPASQCPSIDDNWDNPAGVAIDAFIFGGRRSSTVPLVTEARNWTEGVYMAATMGSETTAAAAGQQGVVRRDPFAMLPFCGYNMSDYFGHWLALGKKLEAAGAKLPRIYCVNWFRKDADGNFVWPGFGENMRVLSWMIDRVEGRGEGAEHVFGTSPRYTDLNWNGLAFTAEQFTQVTSIDRDAWQKELALHDELFTQLKHNLPQALAETKDALAKRLS

SEQ ID NO: 8784 - protein, 695 aa, Ralstonia metallidurans
  unsure (1)..(695): unsure at all Xaa locations
MSKALIIAEKPSVAADIARALGGFTKHDEYFESDDYVLSSAVGHLVEIAAPDDYEVKRGKWSFANLPVIPPHFDLRPIAKTESRLKVLNRLIKRKDVTALINACDAGREGELIFRLIAQQAKAKQPVRRLWLQSMTPQAIRDGFAALREDEEMLPLADAARCRSEADWLVGINGTRAMTAFNSKGGGFFLTTVGRVQTPTLSIVVEREEKIKHFVPRDYWEVRAEFIAAAGLYEGRWFDPKFKKNEFDPEARDSRLWSEAEAKSIVAACRDKQGTVTEESKPSTQQSPALFDLTTLQREANSRFGFSAKNTLGLAQALYEKHKVLTYPRTDARALPEDYLDTVKQTMDMLADSSPNYLPHAKKILSSGWVKPNKRIFDNSKISDHFAIIPTLQAPKNLSEPEQKLYDLVVRRFLAVFFPTAEFQVTTRITEVAGHHFKTEGKILVNPGWLVIYGREAQGKDDKDANLVPVQKDEKVKTDKVESVGLTTRPPARYNEATLLSAMEGAGKLVDDDALREAMAGKGLGTPATRAAIIEGLLAEKYLVREGRELIPTAKAFQLMTLLRGLGVEELTQAELTGEWEHKLSQIERGRLKRDEFMREIAQMTQQIVKRAKEYDNDTIPGDYATLDTPCPQCGGQVKENYRRFACTACESRSARSLAAASSRSRKSRNCCXRRKSARCRDSAARWAGVRGHPE

SEQ ID NO: 8785 - protein, 492 aa, Ralstonia metallidurans
LLDSNVRKYPDKPFLRYAGQSITYAEFDALSRGAAIVLADHGVGAGDRVAVLCFNTPGMVAAMFGAWRLGAVAVPVNHKLQTPEVDYILEHAGVKVCVFDGSLASVVSRLQTPVKLLATSTDAAGFDSFDAQLPAAGTYNALPPADDAIAQILYTSGTTGRPKGCVLTHRAVCMAGMTAALALSMQRDERTLMAMPLWHSSPLNNWMLGTLYVGGTVILLREYHPLHFLQTAQDERATLYFGAPVSYLLPLQMKIDVTAFDLGSVRAWIYGGGPIGADTARQLAQLYRSDRFYQVFGMTETGPSGTVLYPEEQVAKAGSIGRVATPGLDMRVVRTGGADAGPGEIGEIWIKADSNMLGYLDNEAATREVMRDGWYRSGDLARLDADGFLFVVDRTKDMIITGGENVYSKEVEDVLGAHPDVQDVAVIGRPHDQWGETVVAVLVPRPGTQPDPEGIKAFAAERLARYKVPREFLIRDTLPRTPTGKLMKHVLR

SEQ ID NO: 8786 - protein, 368 aa, Ralstonia metallidurans
MDFTYSEEQRMLADSLRRFVESEYSFEKRRRNAREHGSFDRGIWSSLAEMGVLGLAVPADHGGFGHGPASQVVVQRELGRALVQEPVIPSGVIATAILAHHAPAALQAEWLPAIASGDKIFTLAYLEPDSRYRPEVARTTARKAGADGYVLNGRKSVVWHGAAADTYIVSAMLDGALALFLVSRDAKGLAVTGYPTMDRLSGAGLQLADVPATLVTTNGLEALELGLDHGVAAQCAAAAGAIERLIEITAEYLGTRKQFGKPLASFQALQHRVADMLLQKELALSMAYVAAQGLDATDAAERRRKVSAAKVVTAKAARFAGQQAVQLHGGMGMTDELEVGDYFKALTMVDVLLGDTDLHLERYGEAMA

SEQ ID NO: 8787 - protein, 499 aa, Ralstonia metallidurans
HHLLDRWLTESPDQPFIHLPDGRSLTFADLGALTTAAEAELLALGVLPGDRVLVVAENCPEHAALILACSRVGAWSCGVNARMAPAEIDAFAAKADARVIYFTAAASRAASAHARRFDAVPSALNGMEHSHVRANAMPEGQPLQDQVAALIFTSGTTGEPKGVMLTHDALIHFARVTCEARALSPVDRSYAFVPMTHIFGLGTVLLSSLLAGAQLVMRPQFDPADLLDALAHCGVSQLQGPPTLYSRLLAHLQHEGITTPTAPALRYLYTGAGPLDLSLKQRVEATFGLTLHHGYGLSEYAGSVHVTRLGDRRADTSAGYAVAEAEVQVTDPVTGTPLPLGERGELWLRGRGLMPGYFRDPDATAKAMREGGWYASGDLGEMHADGALFVVGRLKEMIIRSGFNVYPAEVETALNTHPSIQRSAVVGCRESDGNEEIIAFVELRPGATLDVAALQNHLRERLAPYKRPARIVALPELPTNNNGKILKRELQEQAASLLS

SEQ ID NO: 8788 - protein, 490 aa, Ralstonia metallidurans
ATRTPHNVAVREGDRVVSYAQLWEGVELAQRYLEAQGVGTGDRVLIVAENSLAMITLIFALSELGAWPVVTNARLTAREIEEIRAHCTPRLMLFTHAASPDALRHGLRYRAREISPPGLGPLMAADADAGSEREPAELARDVAALIYTSGTTGQPKGVMVTHRGLLHYARVTAEIRRMGPEDCAFAIMPMSHIFGLATLLLATFQAGGSLYLVARFNVADACAALQRDEISILQGVPAMFSRILAYLGKSGVTTLHPKRLRYLYTGGGPLDLALKRNVEAMFGQPLHHGYGMTEYAGSLFITRTDRPRSDSSAGEIVEGAELRVVGPGGEPVPEGSPGELWVRGPGVMRGYYRAPEQTAEALRPDGWLNTGDIGRIDQDGALFIVGRTRDLIIRSGFSVYPIEVESVINSHPSVRLSAVVGNPAEDGDEEIIAFVEIREGETFDERDLHAYLAERLSPYKRPARIVRVSAVPTTASGKLHKHRLRGMIAE

SEQ ID NO: 8789 - protein, 507 aa, Ralstonia metallidurans
QLYTSAFRACPQALALVEDGVTLTYEALARRSYRMARLFHARGLQRQDVVAFLVGNRVEAVVAIIAAQLAGLKAVSLHPMASEEDHAFVLADAGVKALVVDDARFAARAQVLLARVANVLMMPLDDGVLGAGLASQAAAMDDAELEPGDDAAEISKISYTGGTTGRSKGILHTHRTVVTMLQAMLATYEWPQQIRYLVTTPISHASGSLILPTLLRGGTVYLCDKFSPSDFVSRVAEQRINLTFLVPTQIYALLDHAGLAEADLSSLELVLYGASPIAPSRLQEALNRIGPVFGQVYGQAEAPMTISYLSRRDHDLSRSHLLSSCGKVMVGNQVKLLDSARREVPVGEVGELCVRGPLVMDGYLNRPEENEKVFAGDWLHTGDMARRDAAGYLYIVDRAKDMIITGGFNVYPSEVEHCLAQHPAIAMSAVFGVPDEKWGESVTAIVVPKPGQTPDANELIEFVKSRKGVVNAPKTVIFAEQLPMTALGKIDRKAIRGSYWNGKDRQV

SEQ ID NO: 8790 - protein, 427 aa, Ralstonia metallidurans
MSRNQQLFDRAQQTIPGGVNSPVRAFRSVVGTPRFITRSEGAYMWDADGQRYIDYIGSWGPMIVGHAHPDVVRAVQETATQSFSFGAPTEAEIDMAEEICKLVPSIEQVRLVSSGTEATMSALRLARGFTGRDLIIKFEGCYHGHADSLLVKAGSGLLTFADTTQNAPSSAGVPADVTRHTMVLEYNNVTQLEEAFARHKGEIAAVIVEPVAGNMNLVRASEAFLTAMRNLCSEHGSVLIFDEVMTGFRVALGGAQAHYGIKPDMTCLGKVIGGGMPAAAFGGRRDIMAKLAPLGGVYQAGTLSGNPLAVAAGLTTLRLIQAPGFYDRLATQTRKLADGLTKAAREAGVPFCADAIGGMFGIYFTNEVPGSFAEVTKADVGRFNRFFHAMLAEGVYLAPSAFEAGFVSAKHDDAIIEATVAAAAKAF

SEQ ID NO: 8791 - protein, 286 aa, Ralstonia metallidurans
FRGIWLPLVTPFHRGEVDFDALQRLVGHFSVTGIAGFVVCGSTGEAAALEEPEQLAVLDTVLECANGLPVIMGLAGNHLGHVLARLGRCNERPLAGVLAPAPYYIRPSQDGLRDYFRRLADASRAPLVLYDIPYRTGTTLMLETLLSLADHGNIGAIKDCGGNALNTQALIADGRLAVLAGEDHQLLGTLALGGQGAIIACAHFHPERFVAIWRAVSEGRLDEARRLFYALMPLIQTLFAEPNPGPIKALLARHGWLRDELRAPMTCASPELANQLAAMFDAMDIV

SEQ ID NO: 8792 - protein, 845 aa, Ralstonia metallidurans
RLNDHCARALADAASLCETRAHRDIEVEHWLIKLMEQGDGDLLAILRRYELDVDGIWNGLLAAVDHLPHDLRGRPGLSQRLGQWLEAAWMRASLESTAPGVDRSIRSAHLLAALAETPHLLRAPDAWPLLSVSAAQIERLMPELDEISVEATSPITPSQGPATIATRRPAGQPDNSALSRFTTDVTQKARDGKIDPVFGRDVEIRQMVDILARRRKNNPILVGEPGVGKTALVEGLALKIAEEDVPTAIRDVTVLTLDMGLLQAGAGVKGEFEQRLKNVIEAVQQSPTPILLFIDEAHTLIGAGNTAGGADAANLLKPALARGELRTIAATTWSEYKQYFERDAALERRFQMVKVDEPDDENACLMLRGLKDRYAQHHNVHITDAAVAAAVRLSRRYLTGRQLPDKAVDLIDTAAARVRMSQEARPVAICTLEAERAALGVEYLALQQDQGATGEDKRNRLSAIETRLRELAIELGQLEFELAAQKDAADKLMVLRAQWQAATDASERHDLASSIQAAHQVLAAHGQATLLHAEVAETVVAQVIADWTGVPVDNLLSNELATLLELEARLGRVVVGQDEALAALGKSLRASKAGLKSEEAPLGVFLLVGPSGVGKTETARALADLMFGGERSLITINLSEYQEAHTVSQLKGSPPGYVGYGEGGILTEAVRQRPYSVVLLDEVEKAHRDVLNLFYQVFDRGFMRDGEGRVIDFRNTVILMTSNLGSEQILAATDATTEAGVEIPASALMETIRPLLIDRFQPALLARFQTIVYRPLAAEAMATIVGMKLAKVAERIERRFDVPLRCDDALVAELVRACLLPDSGARNIDSLLDQQILPVLSRELL

SEQ ID NO: 8793 - protein, 538 aa, Ralstonia metallidurans
TVPALLANTAALHGSRPAVVFREQNIRWTWNEFSAEVDRMASGLHALGLRKGDRVGIWSPNRFEWLLTQFATARVGLVMVNINPAYRLAELEYALNKVGCKAIIAPEAFKTSRYLDMLATLAPELAKAEPGALNAARLPLLRWVIRMEDVPTPGMLTFRELLARGANVPKTELDEITAGLDARDPINIQFTSGTTGAPKGATLTHRNIVNNGRSIAGAMRFSEQDKLCIPVPFYHCFGMVLGVLACVSTGASMVFPGEAFHPGATMAAVSEERCTALHGVPTMFIAQLDDPDFSKYDFSSLRTGIMAGAPCPVEVMKRVMADMHLAEITIAYGMTETSPVSFQSATDDPIDKRVSTVGRVQPHLECKVVDVDGQTLPIGATGELCTRGYSVMLGYWDDEERTREAIRDGWMHTGDLATIDEEGYCNIVGRVKDMLIRGGENVYPREIEEFLFRHPKVQSVQVFGVPDEKYGEEVCAWIVLKPGQSATDEEIRNYCRDQIAHYKIPRYIRFVDEMPMTITGKVQKFVMRDQMTQELGIS

SEQ ID NO: 8794 - protein, 366 aa, Ralstonia metallidurans
RVQHSSAIGPYKGGMRFHPTELSVLKFLGLRQTFKNALTTLPMGGGKGGSDFDPKGKTDAEVMRFCQALITELYRHLGPDTDVPAGDIGVGAREVGFMAGMMKKLSNQSACVFTGKGLAFGGSLMRPEATGYGTVYFAQEMLHRRGREFDGLRVLLSGSGNVAQYAAEKAIELGAKVLTVSDSGGVLHFPEGMNREQLDALMTFKNDTRGRLSDFAEQHGLRFEAGKTPWHVPADVALPCATQNELNGQDAERLLSNGVFCVAEGANMPSTLDAVDRFVAARILYAPGKASNAGGVATSGLEMSQNAMRMAWHHAEIDEKLHAIMKDIHGNCIHYGQKEDGYINYVEGANIAGFVKVADAMLAQGV

SEQ ID NO: 8795 - protein, 242 aa, Ralstonia metallidurans
RIAVVTGGMGGLGEAIAERLLSDGFRVVVTHSLGNDHVATWLREHSTQQREFVAYPVDVADFESCQQCAARILSEVGPVDVLINNAGITRDSTLRKMTHEAWRAVMSTDLDSVFNMTKPFCEGMVERRWGRIVNISSINGSKGAFGQTNYAAAKAGIHGFSKSLALELASKGVTVNTVSPGYLDTKMVRAVPQDVLDQHVIPQIPVGRLGQPKEVAALISYLCSDDGAYVTGANLAINGGQH

SEQ ID NO: 8796 - protein, 506 aa, Ralstonia metallidurans
MRYAHPGTPGAIVSYKPRYGNFIGGEFVPPVKGQYFTNTTPVTGEAIAEFPRSTAEDINLALDAAHAAAGAWGRTAVQDRSLILLKIADRIEQNLELLAVTETWDNGKPVRETLNADIPLAVDHFRYFAGCIRAQEGSAAELNEHTVAYHIHEPLGVVGQIIPWNFPLLMAAWKLAPALAAGNCIVLKPAEQTPLGINVLMELIGDLLPPGVLNVVHGFGKEAGEALATSKRIAKIAFTGSTPVGSHILKCAAENIIPSTVELGGKSPNIYFEDIMQAEPSFIEKAAEGLVLGFFNQGEVCTCPSRALVQESIYNRFMDAVMTKVAAIKRGDPLDTETMVGAQASEQQYNKIRGYLEIAREEGAECLVGGDVEVMPGSLAKGYYIKPTLLKGRNDMRVFQEEIFGPVIAVTTFKDEAEAVRIANDTEYGLGAGLWTRDINRAYRVGRAIQAGRVWTNCYHLYPAHAAFGGYKKSGVGRETHKMMLDHYQQTKNLLVSYDTQPLGFF

SEQ ID NO: 8797 - protein, 373 aa, Ralstonia metallidurans
RVAIQRFIDEELRPLERELDLGAEDPWPRDVLRNVWRRSSELGLYAACLPVELGGKGLNIAEQCALKADLAASGAVLAPHVLGDLGGPPRVGNMLKYATPDQIERYFQPVIRGEKSTCFALTETHSGSDVQSIRTSAVVDGDDLVINGEKHYISGAPFADFAIVMCVTDAATAPPSITAVLVDLDLPGVTVSTEYVPMSGQHIDGDIRFENVRVPRANIFGGEGRGFKLGMSRINVNRLLHCPSMLGLAMSAYKASVQYAGARRQFGGPIARFQAIQHMLADMAAALWACESMIAQTAMLADAGADLRMKAAACKLFVSERCFEVADKAVQIHGNVGVTRGHPVEQTWRKLRMFRIFTGTSEIQRNTIAKAIL

SEQ ID NO: 8798 - protein, 506 aa, Ralstonia metallidurans
MTFAYFLRRAARYWGDNPAVLYRDRVLTYRQLDKRSTRLANALLALGLTRGDRVAIQARNCPEIVEIECALYKAGLVKAALNPRFTAEEASDVVENCTPRVMIVGPGYTRYQRESRGFGCVEHFFAIAGAEGQYGAYEALIDGGATTAIDYVPQPDDLAVLHFSSGSTGKIKAAMQSYGNRLASMRKMILGMDRPARPGDRLALIGPITHASGMLMQPYLFLGATLVLFEKFEPAHFLAEVPRLNLTHVFMVPAMINLLLAEPTLATADLSCLKTLAYGAAPMAPARIREAWERIGPILSQGYGASESTSGVTRLSTADHAEALARHPERLASCGRAMGETEVRVVNERGEEVCDDEIGELVIRGEDVFQGYWGEPGLTSEVLVDGWLHTGDLARVDADGYLYLVDRKKDMIISGGFNVYPTEVEATLYQHPDVMEACVISVPDETWGESVKAVVALWPGRQASASELIGHCRARIADYKSPRTVDFVAELPKNASGKLARKVVRE

SEQ ID NO: 8799 - protein, 498 aa, Ralstonia metallidurans
ARERAGAIAYAFEGRETTFADFDRHTDRVAQALLADGVKAGDRIAYVGKNSDHYFELFFGAAKMGAVIAPVSWRLAGPEIQYIVSHCDATLVFVGPESSASVRNLLPALPLVRRAVAMEGGEPDWPAYTEWRDACPDTPPAHEAKPADVVLQLYTSGTTGRPKGVMLMHRNLTSGTEISMREGADWSQWNDEDVSLVAMPVAHIGGSGWGVRGVLVGCKGVVAREFDPGKVLDYIEHDRISKLFMVPAAMQIVLRDPRARQVDYSRLKHMLYGSSPIPAALLREGMAVFGCGFVQQYGMTETTGTIVALPPEDHTPADVPRMRAAGKAMPGSEVAVVGPDGQRLAAGEVGEVVIRSPQNMAGYWKQEEETARTIDADGWLRSGDAGYMDADGYLYIHDRVKDMIISGGENIYPAEVESAIYGHPAVADVAVIGVPDERWGEAVKAMVVLRPGVAADADSILGWARERIAGFKVPKSIDFIDAMPRNPSGKLLRRALRE

SEQ ID NO: 8800 - protein, 692 aa, Ralstonia metallidurans
SAAGWRPDCWRAFARDLGLLGIGIPERFGGLGGGIIDHIVVMEQFGRHLVLEPYLGTAILAVDALQYANETLAAEALPAIAAGELVVGWAHAEPESRYGMMVRTRADAAAGGYRLHGRKALVTGAPWATHFIVSANTEAGPTLFWVERTAPGLTLIEAPTFDGGRTADLILTDVPVSAAQVLGMPGGALPLLEQLGDTAAVALCAEATGATARMLENTIEYARQRQQFGQAIGSFQALQHRMADMYMLHEQAVALTQVAAMRLAGEPHERALGASTAKAHVDEAGRRIGQGAVQIHGGMGVTEETAVGHYFKRVTAIGLQFGNVAYHLRRCVDLALPGQRIRTAMDIDESPQDLQFRAEVRAWISEAFDDELRAMMAQSKNGYLDKAAQVRWQKALHARGWAAPNWPQAHGGPGWTPTQRHLFQSELAAAGCPPVSPMGLKMVAPVIMKYGSPEQQARFLPRILASDDWWCQGYSEPNSGSDLASLQMRATRGVDANGEHYILNGSKIWTTHAQWADWMFCLVRTSREGRPQEGITFLLLDMRTPGITVSALPTLDGPMEGQQEVNQVFFDDVRVPAAQRIGEEGMGWTIAKYLLEFERGGSFAPMLHRQLDKVAAMAAAQPGEDGTGRLVDDPVFRQRLGATYVRVAATEAAELRLFSGVASGTSIGAASSMIKLVGTETAQAISELAVDV

SEQ ID NO: 8801 - protein, 373 aa, Ralstonia metallidurans
SGDLEIFQDGIRKFVERELAPNEDRWWKQQYIDREVWYKAGEMGMLCASIPEEYGGGGGTFAHEAIITMEQGRAGVSSLGTNVHSGIVAHYILRYGTEEQKRKWLPKMATGELVAAIAMSEPGAGSDLKSVKTRALKEGDSYVINGSKTFITNGYHANLILVICKTDPEAGARGVSIVVVETDGQQGFRRGRILEKMGQKGQDTAELFFDDMRVPCANLLGTEEGKGFYQLMQQLPQERMIIALGALASMERALGLTIEYVRNRKVFGESLIELQNTRFRLAECKTNATIARSFVNDCMEKILRGELDPGTAAMAKWWCTQRSCEIIDECLQLHGGYGYMMEYPIARMYVNARVSKIYGGSNEIMKELIAREL

SEQ ID NO: 8802 - protein, 247 aa, Ralstonia metallidurans
AVVTGGASGLGLASAKRLVEKGVKVVIADISEERAAAALDALGPNATFVQADVTDTDQMTRVFDAAVAMGPLRALVHCAGLGGAVRVVEKDGSPGSLEAYERVVRINLIGTFNVLRLGAARMATNEPVDGERGACVLTASVAAYEGQIGQIPYASAKAGIVGMTIVAARDLAQRMIRVCTIAPGLFDTPLLARLPDNVKASLGAMVPHPARLGAPDEYASTALHILENPMLNGETIRLDGAIRMAPR

SEQ ID NO: 8803 - protein, 390 aa, Ralstonia metallidurans
MQQAFIIDAIRSPLGRSKPGSAFTELHATELLAQVLSQLVRRNDLDPGLVDDVITGCVTQAGEQSAGVGRVAWLAAGFPEHVPATTIDRKCGSSQQAVHFAAQGIMAGAYDIVIACGIESMSRVPMGAARIGQNPYGPSFEERYAPGLVGQGVSAELVAAKWELSRHDMDSYSARSHQRAAATQAAGGFKREIVGIQTVNGLVEQDETIRANTTVERLATLESPFRNDELSARFPQIGWNVTAGNASQISDGAAAILIVSERMATKLGLKPRARFVGFDVIGANPLEMLTAPIPATQRVLAKTGMTLEQIAHYEINEAFASVPMAWQKTMKADGARLNPRGGAIALGHPLGASGVRLMTTMLHALEDSGERFGLQSMCEAGGMANATIIE

SEQ ID NO: 8804 - protein, 509 aa, Ralstonia metallidurans
LHDWATVAPQKPALIQAESGHVITYGELDARAIRAAQWLVSRGLEAGDCIAVLVENHPGLIEIASAARRVGLYYTAVNTHLSPAEAAYVLKDCGAKLLIASPAMLPLVEAVRAADAHALDLPVFVLAGASNLPPGFEAYEAAISAFAPDATLPPRPVGRDMLYSSGTTGHPKGIRRPLTPYEDRDKPELEIIAWRRAFGFDENTVYLSTAPFYHAAPLRYIMRTLDVGGTCVAMSKYDAEGALAAVERYRVTHSQWVPTMFVRLLGLPDEARRRYDLSSMKVAIHAAAPCPVHVKQAMLDWWGDILYEYYAGSEGAGTTSIGPLEWRKYPGSVGRASAGVIHIVDNAGNELPPNEVGMIYFSGVATFSYHNAPEKTRSAYNDKGWATYGDLGYVNEEGYLFLSDRRADLILSGGVNVYPQEIESVLMQHPSVADVAVIGVPDPELGEVPKAVIELRDGKAATPDLAQDIVDYCQGRLGRLKLPRTVVFDERLPRTPTGKLLRRELKDRH

SEQ ID NO: 8805 - protein, 262 aa, Ralstonia metallidurans
LQGKVAVVTGAGSGIGRAVAQALAQRGCHLALADRNQEGLAETAALPELNSVKVSLHTLDVADRDAVAAFPQTVLAHHDRIDLLVNNAGVALAGSFEQVSETDFDWVMAINFHGVVRMTRAFLPLLHRSDDARIVNISSLFGLISPPGQSAYSASKFAVRGFSNALRHELADSRVGVTVVHPGGIATSIARNARVSADIPQAQMQERLANSQKMLRMPPPKAADIIVRGIEKRSARVLVGSDAVVMSWLERLFPVRYWNLLA

SEQ ID NO: 8806 - protein, 366 aa, Ralstonia metallidurans
RRRALITGITGQDGSYLCEYLLDKGYEVHGIKRRSSLFNTERIDHLYEDPQAPDRRLILHHGDMTDTASLVRVVQQSRPDEVYNLAAQSHVQVSFEEPEYTANTDAVGTLRLLEAMRILGMEQSTRFYQASTSELYGLVQEIPQKETTPFYPRSPYAVAKLYAYWITVNYREAYGMYACNGILFNHESPVRGETFVTRKITRAIARIALGLQEVLYLGNLSALRDWGHARDYVEMQWLMLQQETPRDFVIATGEQHSVREFVTLSAQKLGLTVTFEGSGVDEVGIISHIDTSRRELSSRCKVGDVIVRVDPRYFRPTEVETLLGDPTQAREQLGWSPRITFDELVHEMIEADFVAARRDALVKMAG

SEQ ID NO: 8807 - protein, 375 aa, Ralstonia metallidurans
LLRASVQRFIDDRLKPAEDTLEEIDDVPADIVADMKEMGLFGISIPESYGGIGLSMSQECDVVYDLGHTAFAFRSVFGTNVGIGSQGILMDGTEEQKQTYLPKIASGELIISFALTEPNAGSDAASLQTRADLDGDHYVINGTKRFITNAPRAGAFTLMARTGGQGASGISSFIVPADTPGISLGKPDKKMGQRGTKTCDVVLENVRVPAANIIGGVPGVGFKTAMKVLDRGRLHISALACGMAHRLITDAVAYAKERKQFGKPIGDFQLIQGMLADSQAELYAGLSMVRDCAQRYDAKPAGKSDPEVSMLASCTKMFCTEMVGRVADRAVQIHGGAGYIAEYKAERFYRDVRLLRLYEGTTQIQQLIIAKQLLR

SEQ ID NO: 8808 - protein, 169 aa, Ralstonia metallidurans
MSSHHIIDSPLGDMLLRADGGALTGVFFAGQKYYPGLARPTPVSAMPAADARVLEQAAMELGAYFDGALHGFSVPFRLVGSAFQQRIWQALCDIEFGETSTYGQLGAGLGLPPSHSRAVGGAVGRNPLSIIVPCHRVLGASGDLTGYAGGVDRKRALLTLEGVLYPGQL

SEQ ID NO: 8809 - protein, 441 aa, Ralstonia metallidurans
MTTILQHIPSGQRVGIAFSGGLDTSAALLWMRQKGAIPYAYTANLGQPDEPDYDDIPRRAMAYGAEAARLVDCRTQLVAEGIAALQCGAFHISTAGVTYFNTTPIGRAVTGTMLVAAMKEDGVNIWGDGSTFKGNDIERFYRYGLLTNPGLQIYKPWLDQQFIDELGGRAEMSEFMRQHGHAYKMSAEKAYSTDSNMLGATHEAKDLEHLDSGIRIVQPIMGVQFWRDDVEVKREEVTVRFEEGQPVALNGKTFANAVDLLMEANVIGGRHGLGMSDQIENRIIEAKSRGIYEAPGLALLFIAYERLITGIHNEDTIEQYRDNGRRLGRLLYQGRWFDPQAIMLRETAQRWVAGAVTGEVTIELRRGNDYSILNTTSPNLTYKPERLTMEKGESMFTPLDRIGQLTMRTLDIVDTREKLQTYAKSGLLSNQTSAALPKLED

SEQ ID NO: 8810 - protein, 594 aa, Ralstonia metallidurans
  unsure (1)..(594): unsure at all Xaa locations
MPFALHGIPVSRGVAIGRAHILAPAALDVSHYLVDEDRLEAEVERLRSARAAVRAELITLKRDLPRDAPEEMGAFLDVHAMILDDEALSREPETLILQRRYNAEWALTTRLEELMRQFDEIEDEYLRERKADIEQVVERILKVLAGAPVLAPAPVPTLAPDGEATPGVIVVAHDIGPADMLQFKHTVFHGFVTDLGGRTSHTAIVARSLDIPAAVGVKNASELIRQDDWIIIDGDAGLVIVDPSAIILEEYRHRQSERALEKKRLQRLRHMPAVTLDGLEIELLANIEMAEDAGAALSAGAVGVGLFRSEFLFMNRRDELPDEDEQFHAYRNAVEAMHGLPVTIRTIDIGADKPLDGRGDDFETALNPALGLRAIRWSLSEPGMFLTQLRALLRASAFGPVRILIPMLAHAGEIDQTLDLIEQAKRQLDERGLPYDPGIKVGAMIEIPAAVLLLPLFLKRMDFLSIGTNDLIQYTLAIDRADNAVAHLYDPLHPAVLQLIARTIREANHAGVPVAVCGEMAGDPAMTRLLLGMGLREFSMHPAQLLRVKQEVIHADCERLSKAVDQILNCYEPDELTAALKQLTAXRHPETLKI

SEQ ID NO: 8811 - protein, 610 aa, Ralstonia metallidurans
AYLSRLNPEQRAAVEYDGDAPLLIIAGAGSGKTNTLAHRVAHLVVNGADPRRILLLTFSRRAASEMGRRVERIVDQALGIQTGAGRAALQWSGTFHAIGARLLREYAETLGLAPTFTISDRGDAADLMHVVRHDLGLSEQTSRFPRKETCLAIYSRVVNTQLPLEVVLKTQFPRYAMWADALKGLFAAYVEAKQKQQVLDYDDLLLYWAQAMTEPALAQDMGARFDHVLVDEYQDTNALQASILLALKPQGRGLTVVGDDAQSIYAFRGATVRNILDFPTQFSPPAEQVTLSQNYRSTQPILGAANAVIGLAAERFTKDLWSLRESAEKPGVVVVNDEAEQARFVVEQVLARREAGLSLTQQAVLFRAADHSAQVEIELARRNIPFVKFGGLKFLESTHVKDVMAVVRWLENPRDRMAGFRTLQLLPGIGPKTAARVLEGLEAATEPLIALEAFEPPPAAAPAWDELVTLARALMAPTSPWPSEFEQVIAWYMPHLERMHDDAAARQADLQQIERIAATYASRERFLTELTLDPPSASSDESGVPSRDEDYLILSTIHSAKGQEWKAVYVLNAVDGCMPSDLATGTTEEIEEERRLLYVAMTRARDHLDI

SEQ ID NO: 8812 - protein, 529 aa, Ralstonia metallidurans
HPADIDGHHLTPDTVAAIARGQRAAIVPEPVLGKVADARARFEQVAAANVPIYGVSTGFGELVHNWVDIEHGRALQENLLRSHCAGVGPLFSRDEVRAMMVARANALARGYSAVRPAVIEQLLKYLEAGITPAVPQVGSLGASGDLAPLSHVAITLIGEGKVLTEDGGTAPTAEVLRERGITPLALAYKEGLALINGTSAMTGVSCLLLETLRAQVQQAEIIAALALEGLSASADAFMAHGHDIAKPHPGQIRSAANMRALLADSARLSGHGELSAEMKTRAGEAKNTGTGVFIQKAYTLRCIPQVLGAVRDTLDHCATVVERELNSSNDNPLFFEDGELFHGGNFHGQQVAFAMDFLAIAATQLGVVSERRLNRLLSPHLNNNLPAFLAAANEGLSCGFAGAQYPATALIAENRTICSPASIQSVPSNGDNQDVVSMGLIAARNARRILDNNQYILALELLASCQAAELAGAVEQLAPAGRAVFAFVRERVPFLSIDRYMTDDIEAMAALLRQGALVEVVRGAGIELA

SEQ ID NO: 8813 - protein, 416 aa, Ralstonia metallidurans
RKPFYKILYVQVLFAIFVGILLGHYWPDTGVAMKPLGDAFIKLIKMIIGPIIFCTVVSGIAGMRDMKKVGRVGGKALLYFEIVSTFALLLGLIATHALKPGVGFNIDPATLDTKSIAQYVSKAHGQSTVEFFMHIIPDTIFSAFANGDILQILMVSMFFGSALAVVGERARIIHDMVDQVSKVFFHIVHVITKVAPIGAFGAMAFTIGKYGLGSLIPLLKLIGTFYLTAIVFVLVVLGTVARLTGFSIIRFVAYIKEELLIVLGTSSSEAALPHLMEKMEKLGCSKSVVGLVVPTGYSFNLDGTNIYMTMAVIFIAQATNIELTLMQQLTILAVAMVTSKGASGVTGSGFITLAATLAVVPTIPVAGMVLILGIDRFMSECRALTNIVGNGVATVVVSAWEHELDRARLTRVLRGE

SEQ ID NO: 8814 - protein, 641 aa, Ralstonia metallidurans
ESSATTFPRCLLAHATQRPDHPAYREKDLGIWQTYGWSQTANEVRALACGLAALGFRRGMNLAVVGDNRPRLYWAMTAAQALGGIPVPLYQDAIANEMIYVLDDAEIEFAIVEDQEQVDKLLEVESQLAARGRAVRHLIYEDPRGLRDYDHPSLLSYERVQEIGREFDRANPGFFDAAVQAGAPEDTAIILYTSGTTGKPKGVCHSHAGLIGSARNGCKFDGLGADDDVLSYLPMAWVGDNLFSYAQALVAGFTVNCPESRETVMTDLREIGPTYYFAPPRIYEGLLTQVMIRMEDAGWIKRRLFQWAMNVARRCGADILDKRPVATLDRLRYALGEALIYGPLRNVLGMSRIRVGYTAGEAIGPDLFRFYRSIGINLKQFYGQTETCAYVCLQPDGQVKFDTVGPAAPGMEIRIAENGEVLVRGVGLLKNYYKRDDATREAINDEGYFLTGDAGVIDADGHLKIIDRAKDVGKLADGSMFAPKYIENKLKFFPYIKEAVAFGTDRDRVCAFINIDFDAVGNWAERRHLPYAGYVDLAAQPDVIAMIAECVEQVNADLAADAMLAGSQIARFLILHKELDPDDDELTRTRKVRRGFIAEKYGVLVEALYAGKPEQFIETRVKFEDGREGSVSATLKLVDVK

SEQ ID NO: 8815 - protein, 276 aa, Ralstonia metallidurans
GIVGAGTMGNGIAQACAVVGIDVVMIDISDAAVQKGIATVAGSLDRLIKKEKATEADKAAALARIHGSTSYDDLKRADIVIEAATENFDLKVKILKQIDGIVGPDVIVASNTSSISITKLAAVTSRADRFIGMHFFNPVPMMALVELIRGLQTSDAAHADVEDLAKRLGKYPITVKNSPGFVVNRILCPMINEAFCVLGEGLASPEEIDEGMKLGCNHPIGPLALADMIGLDTMLAVMEVLYTEFADPKYRPAMLMREMVAAGYLGRKTGRGVYVY

SEQ ID NO: 8816 - protein, 460 aa, Ralstonia metallidurans
SLFRTKNIDAMLEVSEHDGLRKVLGAVDLVLMGIGAIIGTGIFVLTGTGALTAGPALTVSFVIAAMACGFAALCYAEFASAIPVSGSIYTYSYATLGEIVAWMIGWDLLLEYGLATSAVSVGWSGYFQSLIAGFGIHLPTVLTAAPGAVPGEHTLFNLPACLIMLAITWIVSYGVKESARLNNVMVAIKIGVVLLFIAVGVWHVKPANWQPFAPFGMTGVFNAAALVFFAFIGFDAVTSAAEEVRNPRRDLPIGIIGSLAVCTILYVTVAAIMTGIVPFMKFEGVDHPVSLALQYAGQNWVAGFVDLGAILGMTTVILVMTYGQTRIIFAMSRDGLLPEALSTVHPVHATPYTATWTVGIVFAAIAAFVPLNVLAELINIGTLAAFTLISIAILVLRRTRPDLRRGFRCPGVPVVPLLAVGFCLFLMAHLQALTWIAFLCWIGLGLIIYFAYSRRNAVLH

SEQ ID NO: 8817 - protein, 480 aa, Ralstonia metallidurans
IHHYVGGTVRRAGTDRFADVFNPATGEVAARVAMGSADDVAAAVAAAKAAAPAWAEMPPLRRARILFKFKELLDRHHDDLAALITREHGKVFSDAKGEVTRGIEVVEFACGIPNLLKTDFTDNIGGGIDNWNLRQPLGVVAGITPFNFPVMVPMWMFPVALACGNTFVLKPSERDPSPSLLIADLLKQAGLPDGVFNVVQGDKVAVDALLAHPDVQALSFVGSTPIAEYIYTEGTKHGKRVQALGGAKNHLVVMPDADLDQAVDALVGAAYGSAGERCMAISVAVAVGDVADRLVPRLAERAATLKIRNGMEDDAEMGPLVTAAHKAKVEGYIAKGVAEGAKLVTDGRGHKVDGHENGFFVGGTLFDNVKPDMTIYKEEIFGPVLSVVRVHDFAEAVDLINRHEFGNGVSCYTSDGGIARAFARQIQVGMVGINVPIPVPMAWHSFGGWKRSLFGDHHAYGEEGVRFYTRYKSVMQRWPD

SEQ ID NO: 8818 - protein, 428 aa, Ralstonia metallidurans
ESLWMPFTANRQYKSAPRLLVSASGMYYTTHDGRQILDGCAGLWCVAAGHARKEIVEAIAQQAATLDYAPPFQMGHPLEFEAATKVASLMPQGLDRIFFTNSGSESVDTALKIALAYHRARGEGQRTRIIGRERGYHGVGFGGMGVGGIGPNRKMWSANVMPGTDHLPATLNIAEAAYSKGQPQWGAHLADELERLVALHDASNIAAVIVEPMAGSAGVLIPPVGYLEKLREITSKHGILLIFDEVITAFGRLGAATGAERLKVTPDLITMAKAINNAAVPMGAVAVRREVHDAVINATPQGGIELPHGYTYSGHPLAMAACIATLDIYKRDKLFERAAEMSPKFESAVHGLRGAPYVKDIRNLGLVAGVELESRPGAPGARAYEAFLKCLELGLLVRYTGDILAFSPPLIISEAEIDQMFDTVRQAL

SEQ ID NO: 8819 - protein, 668 aa, Ralstonia metallidurans
RTLYQKLVDSHTVVTLDADNVLLYADLHIMNEYTSPQAFAGLAEQGRKVAAPGQNLAVVDHIIPTHAESPRVIQDPASALQARNLKRNCDLHGIPLFDTNDPLQGIEHVIAPEHGMIRPGMVVLCGDSHTTTYGAFGALGFGIGTSEVEHVLATQTLVYRLARDMRIRVDGPLPSGTTSKDLILHIIARISAQGARGYAVEFTGSTIRALSMEARMTLCNMTVEAGARGALIAPDATSIDYVLRRAPDIDADMAETARRAWAGLRSDADAGFDLELAFDAAAVEPFVTWGTSPDQAIPVSATVPQPADAGDSNARVSAERALEYIGVTPGVSLQGLPVQRVFIGSCTNGRIEDLRQVAAVVRGRRVAPGVRAMVVPGSGAVRDQAEAEGIAALLIDAGFEWRKPGCSMCLAMNDDVLAPGERCASTTNRNFEGRQGRAGRTHLMSPAMAAAAAVTGCITDVRELEINMDDITTIEGVGAPLPLPNLDTDQIMPKQFLRGIDKAGLDRGLLHDMRFDANGAPRADFVLNQPAWRDTRVLVAGPNFGCGSSREHAVWGLQQYGIRAVIAPSFGEIFYSNAMNNRLLLVALPQADVDQIMAAVSDPVAPASIRIDLSTMTVNAGDFAKSFSLSPRHLDMFRLGLDVIGMSLTHADAIAAFTSRHHADNPWL

SEQ ID NO: 8820 - protein, 612 aa, Ralstonia metallidurans
MCGIVGAVSHRNIVPVLIEGLRRLEYRGYDSCGVAVVRDGILERARTVSRVAELDAQTQSSGLAGHIGIAHTRWATHGKPDTVNAHPHFSDETIALVHNGIIENYEPLRDELRAVGYGFESQTDTEVVAHLIHQAYTYPSSATRGDLFGAVRAVTKRLHGAYAIAVVAKDQPDVVVGARAGSPLVVALGEDESFLASDALAVAGTANRIIYLEEGDVVEISRGGARIRDVHDHEVEREARVVEAHAAAVELGPYRHFMQKEIFEQPRALGDTLEGISAITPELFGENAAQVFSEIDSVLILACGTSYYSGCTAKYWLESIAKIPTQVEVASEYRYRDTVPNPRALVVVISQSGETADTMAALRHARSLGHTHTLAVCNVATSAMVRETELSFLTRAGTEIGVASTKAFTTQLAALYMLTLALAKVRGLPDRCAGSRSPDQPRHLPAALHGVLALEPQIIAWSEDFARRENALFLGRGLHYPIALEGALKLKEISYIHAEAYPAGELKHGPLALVTEAMPVVTVAPNDALLEKLKSNIQEVRARGGRLYVFADSDTHIQSSDGIQVIRLPEHYGALSPILHVVPLQLLAYHTACARGTDVDKPRNLAKSVTVE

SEQ ID NO: 8821 - protein, 240 aa, Ralstonia metallidurans
ALVTGAARRLGRAIALELAAQGWDVAVHCNRSRDEADALATQIRGLGRRAAVLQADLSDEAATARLIPACIDALGVPACLVNNASLFQYDVATSFSYGSLDTHMRTNVAAPLLLAREMHKALGADGNETGQLGVVINLLDQKLNNLNPDFLSYTLSKAALQTATVQLAQALAPRLRVVGVAPGITLVSGDQSDPGFVRAHGMTPLGKSSTPEDIAQAVAYLAVARAVTGTTLYVDGGQHL

SEQ ID NO: 8822 - protein, 389 aa, Ralstonia metallidurans
LQAFRQEVREFLRESLPPDLPRRKGGFRSPRADLARWQGILHAKGWGAPYWASEHGGTGWTVPQRLIFDEECSAAGAPTQDGFAQKLVGPVLNYFATPEQRAAHVPAILAGKRMWCQGFSEPGSGSDLASLRTRAERDGDHYVVNGQKIWTSYGHEADWIFLLVRTDTQVKKQAGISFLLVDMKTPGITVRPIISIDGAHHLNETFFEDVRVPVSNLVGAEGEGWKLTKFLLNNEHASTADLPTLQRFQRQLRALAATRGAGGGTLIGRHEFALRLARLEAELQAITVMVQRVAAMEADHSPAAHAMGSILKVRGTELQQKMSEFLVEALGDHGAVAYPGSHAATAGARSLPMQEVAQSIAADMLFRRATTIYGGTSEVQRGIIAKSLF

SEQ ID NO: 8823 - protein, 374 aa, Ralstonia metallidurans
FKLNDAQQMLQDSARRFVEKAYAFEARTALIQAGQTGGTRHWQTFAENGWLAAALPETCGGLGGSVIDTALIAQELGRGLVLEPFLGSGVLATQTLLAAATPSQREALLPSLAEGTRRYALAYSEADARGMPEILSTSAEAGTDGYTLRGTKTLVLGGVDADAFIVSARLADSGEPSAITLFLVDAGTPGLTCHALPLHDGTWAAELEIDGARVPASAMLGQPGEGLRALRHGLAHATAALCAELVGGMEKAVEVTADYLKVRKQFGVPIGSFQALQHRMSDMAAEMELARSMLFSLLAAIDHEDEATLLHRVSQAKAFVGRAARYVCGQAIQLHGGIGMTDEYLIGHYYKRAIVADLIFGSADRHEAICAEAI

SEQ ID NO: 8824 - protein, 169 aa, Ralstonia metallidurans
VKMFLSQLDSPLGAMLLVTDARRVVRALDFADHKSRLYRGLREHYGEVELTEIPAPAEIADALARYFHGELEALKVLRTATSGSALQRRVWAALRRIPVGTTTTYGKLAKALGFDDPRAAVEIGAANGANPIAIVVPCHRVIASNGDLKGYAWGLHRKRWLLEHENAMV

SEQ ID NO: 8825 - protein, 397 aa, Ralstonia metallidurans
TGTILIHAGDGAPPAGMLGFEALLADASPVPDAMRGGEDLASIMYTGGTTGKPKGVMQSHLNLWSSSISRLAQFPLDEATITLHAAPLFHTAAMAKAVGVFVIGGTHTMVPTFDPAEVLETLERERVNDIMLVPTMLQAILACPDFARRDVSSLKRINYGASPINGAVLDAALAAMPNVEFSHAYGLTEASPVVSVNPPANHGPVGRASGLYRSAGRPGFGVFVKVVDPNGDEVPRNTIGEIIVRGPNIMQGYWNKPEETRQALRNGWLHTGDGAYMDDAGYLFIVDRIKDMIVTGGENVYSAEVENALAQHPAVHSCAVIGVPHERWGEAVHAVVVLRPGLQAGEDELRTHCRALIASYKCPKSVEFRTELPLSAAGKILKRDLRTRYWQDQPRQV

SEQ ID NO: 8826 - protein, 389 aa, Ralstonia metallidurans
KVVVAGVGMIPFTKPGASDDYGVMGARAAKAALADAGIDYALVQQAYVGYVFGDSTSGQTAIYGVGLTGIPVINVNNNCATGSTALYLARQAVESGAVECAIALGFEQMVPGALKGAYTDRPGPMERFARVMNDVQGFDEQAPRAAQFFGGAGRAYMKEFGIRPETFARISVKARQHAARNPFAVFRNTVTLEDVMTSPKVFDPLTRLQCCPPTCGAAAAILCTEAFARKHGLDTRVAIAAQAMTTDRNSTFDEGDMRKVVGYDMTHAAATQVYERAGIGPGDVDVVELHDCFTANELITYEGLGLTPEGTAEKFILDGDNTYGGRVVTNPSGGLLSKGHPLGATGLAQCAELVWQLRGEAGDRQVAGARLALQHNLGLGGACVVTLYQ

SEQ ID NO: 8827 - protein, 270 aa, Ralstonia metallidurans
KLTNKVAIVSGSGRGIGREIALKLASEGAAVVVNDLDAEPAEAVVREITTMGGRAVACVGSVTEADFGTRFVGTALQTFGGLDIIVNNAGYTWDNVIQKMTDDQWSAIMDVHVTAPFRILRAAADYFRETSKQEAEQGREVFRKVVNISSASGVIGNAGQANYSAGKAAINGLTKALAKEWGRYKVNVNSVAFGLIKTRLTEAVAGEGHATIDIAGNEIKVGVNPQLMKNIEATIPLGRGGTPAEAAGSVYLLCIPESNYITGQVLVVGG

SEQ ID NO: 8828 - protein, 482 aa, Ralstonia metallidurans
VSLPDFDMVLFGGTGDLARRKLLPALFDAHRTGCLHPSSRILATGSHPHTTEQYKAMLEESVRPGLEHAPPEAWTSFMDRIGYVQADARQPAHFDALAEQVLARKPEVVVCYLATAPHIFVPICEQLGRTGLNAPNVRVVLEKPLGHDLDSSEAINNAVSRYFGEEQIYRIDHYLGKESVQNLMAIRFANALFEPLWRREWVQDVQITIAEELGVETRGDFYDRTGALRDMVQNHLVQLLCMVAMEPPASLSEDAIRDEKIKILKALKPILPQDVAEKTVRGQYRAGAVGGKPVVSYVDEQGIAADSTTETFVAIKAEIANWRWEGVPFYLRTGKRMQSRVAEIVVHFRDVPHAIFPRPLTLSPQNRLVIRLQPEESIRLYFLVKQPGDTVELTPTSLDLDFANSFKMRRAGAYERLLLDVIRGKLGLFVRRDEQVQAWRWVEPILDTWDQSTVPPKPYTAGTWGPAASSALMSRDGALWHE

SEQ ID NO: 8829 - protein, 528 aa, Ralstonia metallidurans
GLARNPANYVPITPLDFIARAAEVYGDRLAIVHGTVRQNWRDTYARCRRLASALTRAGVGKGDTVAALLPNTPAMVEAHFGVPMAGAVLNALNIRLDAANLVFMLRHGEAKVLLADTEFADAARQMAREVRGLKVIAVEDVLGPDAERFGDTDYESFLASGDPEFDWKMPGDEWDAIALNYTSGTTGDPKGVVYHHRGAAMNAISNILEWDMAKHPVYLWTLPMFHCNGWCFPWTVAARAGVNVCLRKFEPKLVFDLMRDEGVTHYCAAPIVHTALVNAPPSWREGLRGPVRGMVAGAPPPAAVLAQMEAMGFDLSHVYGLTEVYGPAAVCAEQDAWHTVSQEERAVLKARQGVRYHLQSGVTVLDPDTMQPVPRDGETIGEIMFRGNICMKGYLKNDKATREAFAGGWFHTGDLGVCMPDGYIKIKDRSKDIIISGGENISSVEVEDALYRHPAVLAAAVVAQPDAKWGETPCAFVELKDGASVTAEELIAHCRTLLAGFKVPKAVYFGPLPKTSTGKIQKFELRKK

SEQ ID NO: 8830 - protein, 373 aa, Ralstonia metallidurans
FPLSVWQTGSGTQTNMNLNEVIANRAIQLLGGEVGSKKPVHPNDHVNCSQSSNDSFPTAMHIAATRAIQQTLLPSLEKLQQTFAKKVEAFDDIVKVGRTHLQDAVPLTLGQEFSGYMTQVADAQSRLQQAMLRAMPVPQGGTAVGTGLNAPPGFAVAFARALATYTSLPFEPAPNRYALQAAHDALADLSGALNTTASSFLKIARDFMLLGSGPRAGVAELQLPANEPGSSIMPGKVNPTQAEALAMVCCRVIGNHTTVTLANSLGTLELNAYKPVIIYSLMQSVTLLADAASSFAEHMVEGVEPDRARIQELLERSLMSVTALNPHIGYDKAAEIAKLAVKKNLSLREAAIASGHVTNEQFDQWIDFKAMTK

SEQ ID NO: 8831 - protein, 354 aa, Ralstonia metallidurans
MPLVSMRQLLDHAAENNYGLPAFNVNNLEQVQAIMQAADEVNAPVIMQASAGARKYAGEHFLRHLIEAAVEAYPHIPVVMHQDHGQSPAICKAAIDLNFSSVMMDGSLKEDGKTPSDYEYNVDVTRKVVQMAHALGVTVEGELGCLGSLETGEAGEEDGIGAEGKLDHSMLLTDPEQAADFVKATQLDALAIAIGTSHGAYKFTRKPTGDILAIGRIKEIHARIPNTHLVMHGSSSVPQELLAEIRQFGGDMKETYGVPVEEIQEAIKYGVRKINIDTDIRLAMTGAIRRFFVENPSKFDPREYLKPAREAAKLVCKARYIAFGCEGQASKIKAVSLTDVAQQYKAGKLAQVVQ

SEQ ID NO: 8832 - protein, 478 aa, Ralstonia metallidurans
ARMTRSTKIVATIGPASSTLEVLTRMIGAGVDVVRLNFSHGTAQDHIDRAALVREAAAACGREVAIMADLQGPKIRVGKFENGKITLKPGDAFILDSACQMGNQERVGLDYKDLPRDVGPGDLLLLNDGLIVLVVDRVLGNEIFTTVRIGGELSNNKGINRQGGGLSAPALTAKDMEDIKTAMALGADYVAVSFPKNATDMEMARQLTNVAGQPHNHKARMIAKIERAEAIRPGVLEEILLASDGIMVARGDLAVEVGNAAVPALQKRMIKLAREANKLTITATQMMESMIVNPVPTRAEVSDVANAVLDGTDAVMTSAETAAGRYPVETVEAMAAICLEAEKSEVVQLDTDFLNQTFARIDQSIAMGALFTAYHLGVKAIAALTDSGATALWMSRHRIHVPIYAMTPNLASQRKMQLYRNVVPLPLQSSADRDVALEQAEELLLSQGVVQRGDFIVLTIGEPMGQPGGTNTLKIVRV

SEQ ID NO: 8833 - protein, 405 aa, Ralstonia metallidurans
RPRPALIAMTSVLRLTDLISQGKISGKRVFIRADLNVPQDDAGNITEDTRIRASVPAIQACLEAGATVMVTSHLGRPTEGEFKPEDSLAPIATRLSELLGKPVKLVQNWVDGVEVAPGQIVLLENCRVNKGEKKNSDELAQKMAKLCDVYVNDAFGTAHRAEATTHGIAKFAPIACAGPLLAAEIDALGRALGQPARPLVAIVAGSKVSTKLTILKALADKVDNLIVGGGIANTFMLAAGLKIGKSLAEADLVGDAKTIIDIMAARGASVPIPVDVVCAKEFSATAAATVKDVKDVTDDDMILDIGPKTAAMLADQLKAAGTIVWNGPVGVFEFDQFGNGTKVLAEAIATSKAFSIAGGGDTLAAIAKYGIADRVGYISTGSGAFLEFLEGKKLPAFEVLEQRAA

SEQ ID NO: 8834 - protein, 373 aa, Ralstonia metallidurans
LYFAFTVFIEPMRQSLGYGKPFLAGGFSLGLLVWAMCSFAVGRLLDRVPARKVMGTGSVLAAIGLLLWAWCPSPAVFLLMWIPLGLAMASTLYEPAFVVLRQAWGDGYQKPIVHVTLLAGFASTIFIPLAQWLVLHLGWRETLVVFAALNLFVCAPLHARLRYAVHPSYAHAATHSGTPLAGAASSGIARATLRQPVFWCVVLAFTATAVIASLLGAHLIPMLTEKGMPVAQQLIVAALIGPAQVAGRLAMARLPIDHPVRLSMPVYIVMTIGLACLALGNGYWLMFAAICYGCANGVNTMLRAMAMPELISRHHYATLNGLMMTPVLLMQAAAPWFGALLWRAAGGYWLMLWVMVALSIGALAAFAFALHQR

SEQ ID NO: 8835 - protein, 358 aa, Ralstonia metallidurans
LGDEQAMMVDTMRRWLSKHYSFEFRQQAMHTPGGCSASAWSGLAGLGITSLTIPEALGGMGQPMTDLLPLMETLGEALVLEPVPWSAVFGTQILLALPVGPSRDARLAALAGGDARCAVLCGKEPGVGKTPQPTVIAQRVGDEWQLNGDDAMVMGGTDAHHFIVAATLDDGSLGLFDLPADASGVVVQGYRFHDGRGAAEVQLTNVRLSACSMLGQGEQAATALDIGMTFATLALCADSIGAMRRALGITAEYLRTRRQFGRTLAEQQVVQHRMADHFRAWNGARHLARRVLADWDAAPPAERRRRICAAKHLSGVVGRAIAFDVLQLHGAVGLQDETPISHYSKRLVGNDLLLGSAD

SEQ ID NO: 8836 - protein, 252 aa, Ralstonia metallidurans
SVSYEVRDNIAEILLDSPPVNALNEAMIDALLQGLRRAAEDDSVRAVILASAVPRRFCAGLQLDSLRDAPPSRGYALVEKLYSGLCEAQFHLGKPSIAAVGGTARGGGMTLAIHCDMIVAADTATFGYPEIDVGLVPAIHYTHLPRIIGRHRAFDLLFTGRSFDAAEAMSLGLVNRVVPEQRVMEEARALARSLCQKSPEIMRMGRQAFMRANDIDYRRGVAGAVETFGNIFATEDAQEGIAAFVERRKPRW

SEQ ID NO: 8837 - protein, 187 aa, Ralstonia metallidurans
IPAPAVDEKAGTSHTETAVFAGGCFWGVQGVFQHVRGVTRVTSGYSGGSASNAQYEMVGTGMTGHAESVEIRYDPTQISYGKLLQIFFSVAHNPTQLNYQGPDHGTQYRSAIFPRSPVQRSIAEAYITQLDTSKAYRAPIVTRVEDYKGFFPAENYHQDFLVKNPSYPYIVINDLPKIGNLKTMFPD

SEQ ID NO: 8838 - protein, 801 aa, Ralstonia metallidurans
MTHPAASLQPSEWRLPVEGMTCASCVRRVETALAKVPGVHDVAVNLATEQATLQADSPEVLNAAAKAVADAGYDVPRAEIELNIADMTCASCVGRVERALRAVPGVVDAQVNLATERATVTVLRGAADVATLAAAVERAGYGATPVVEAAAAAVGTAEAGPGFWAGPWPVVISAALSLPLVMPMVFEWFGIHAMLPGWVQWALATPVQFVFGWRFYKAGWKAVRAGAGNMDLLVALGTSAAYFLSIWQMAEAGDAMPHLYFESAAVVITLVRLGKWLETRAKRQTADAIRALAALRPDTAQVRRNGVEQTVPLASVRVGDEIVVRPGERIPVDADVVEGSSHADESMLTGESVPVPKQPGDRLTGGSINYDGLLVARTAAVGAETVLAKIIRMVEHAQAAKAPIQRMVDQVSAVFVPIVLVIALATLLGWGLVVGDWTTALLNAVAVLVIACPCALGLATPTAIMAGTGAGARAGILIKDAEALEVAHRVSVVAFDKTGTLTVGKPEVVALHAADGDEPALLAKLAALQAGSEHPLARAVTTLATERGITVPAVTDVRALPGRGIAGIVAWQALQLGSDGLRASLQADAGALQTEAERLRGEGRTVSWLIDTDQRRVLGLVAFGDALKPGAAAAIARLREAGIRTVMLTGDNAGAAARVGKQLGLDEVQAEVMPEDKAARVVALKRGGEAVVAMVGDGINDAPALAAADVGIAMSTGTDVAMHAAGITLMRGDPALVADALAVSHRTVRKIRQNLFWAFIYNVIGIPLAAAGLLNPVVAGAAMAFSSVSVVSNALLLRRWH

SEQ ID NO: 8839 - protein, 244 aa, Ralstonia metallidurans
GTVLLVHGLAEHSGRYGHVAAALCALGLRVRAYDHRGHGASGGPRMVAPTPDSYLDDLAEIYDGAMRQWNELPIVLGHSMGGLIAARFATARVRPIRALVLSSPALALRLSNSMLTMHRVLLALMPRIRVPNPIDARLLSHDVEVGRAYRTDPLVQGTISASVLETFIRGMPQALADAPRLEAPMLMLVGGADRIVDPEGSRIFFESAPEDLREMVWFDTGYHEIFNEAEPLRGEVFAALTGWL

SEQ ID NO: 8840 - protein, 529 aa, Ralstonia metallidurans
FDYIIVGAGSAGCVLANRLTQDSDVNVLLLEAGGKDDYHWIHIPVGYLYCIGNPRTDWLYRTVAEAGLNGRSLGYPRGRVLGGSSSINGMIYMRGQREDYDDWARITGDDGWRWDNVLPFFKRSEDHHRGANEFHGAGGEWRVEAQRLRWEILECFIEAAEQAGIPRTDDFNRGDNFGVGYFEVNQRRGIRWNTSKAFLRRAAERPNLTIVTGAQVSALTFDSPDGLRCTGVQYLGGGQPHEARAKQEVILAAGAIGSPQLLELAGIGQPDRLQALGIRVRHALRGVGENLQDHLQLRSVVKVQGVRTLNTQAAHWWGKLGIGLQYAFNQSGPMSMAPSQLGAFARSDPEQPRANIEYHVQPLSLDKFGDPLHSFNAFTASACNLRPTSRGSVHIEDTDFRRAPLIAPNYLSTEEDRKVAADSIRLTRRIVSSPALARYKPQEYLPGATFQTDEELAEAAGAIGTTIFHPVGTCRMGGADDADAVVDNRLRVRGISGLRVVDASVMPLITSGNTNSPTIMIAERASDMI

SEQ ID NO: 8841 - protein, 178 aa, Ralstonia metallidurans
MAETATIARPYAEALFRVASEAGAGNLGAWSELVSEMGQVAANPDMQALATDPNISGDKLEEVFLSVLKSPVNDEARRFVKLLVENSRLTALPEIAEQFHALKNAREGSSDVEITSAFPLDASQTNELVAALERKFGRKLYAKVAVDPSLIGGVSVKVGDEVLDTSVRSRLAAMQAAL

SEQ ID NO: 8842 - protein, 510 aa, Ralstonia metallidurans
MQLNPSEISELIKSRISGLGADAEVRNTGTVISVTDGICRVHGLSGVMQGEMLEFPGNTYGLALNLERDSVGAVVLGEYEHISEGDTVKCTGRILEVPVGKELLGRVVNTLGQPIDGKGPINAKETDVIEKVAPGVIARQSVSQPVQTGLKSIDAMVPIGRGQRELIIGDRQTGKTAVAVDSIINQKGKGVFCVYVAIGQKASTISNVVRKLEEHGAMEYTIVVAATASDSAAMQYLAAYAGCTMGEYFRDRGEDALIVYDDLTKQAWAYRQVSLLLRRPPGREAYPGDVFYLHSRLLERAARVNEDYVAKFTNGAVTGKTGSLTALPVIETQAGDVSAFVPTNVISITDGQIFLETDLFNAGIRPAINAGISVSRVGGAAQTKVIKKLSGGIRTDLAQYRELAAFAQFASDLDDATRKQLERGRRVTELLKQPQYQPLQVWQLAASLYAANNGFLDNVDVKDILPFEKGLHDHLKTKFADLVNRIEDTKDLSKEDEAALRAAIEDFRKS

SEQ ID NO: 8843 - protein, 289 aa, Ralstonia metallidurans
MAGTKEIRTKIKSVQNTRKITKAMEMVAASKMRKAQERMRNARPYAEKVRNIAAHLASANPEFKHPFMVARDVKRAGMIVVTTDKGLCGGLNTNVLRAVTNELKDLQGQGVNVQATAIGTKGMQFLGRIGAKVVSHVVQLGDTPHLEKLIGAIKVQLDAYTNGEVDAVYLAYTKFINTMKQEPMVEQLLPLAADKLSQTEDEKRAYSWDYIYEPDAQTVVEELLVRYVEALVYQAVAENMASEQSARMVAMKAASDNAKNVIGELQLVYNKTRQAAITKELSEIVSGAA

SEQ ID NO: 8844 - protein, 357 aa, Ralstonia metallidurans
MTALQNDTFLRALRRQPTEYTPLWLMRQAGRYLPEYNATRARAGSFLGLAKNPAYATEVTLQPLDRYPLDAAILFSDILTVPDAMGLGLSFAQGEGPRFAHPLRTEADVAKLAVPDMASLQYVFDAVSEIRKALVQDGRQRVPLIGFSGSPWTLACYMVEGGGSDDFRTVKAMMYARPDLMHRILDINATAVSAYLNAQIEAGAQAVMVFDTWGGALADGMYQAFSLAYMRKVLQGLKREHDGQQIPVIVFTKGGGIWLEEIAGIGPDAIGLDWTVNLAKARRRTEGRVALQGNIDPTVLFASESAIREQVRGVLDSYASAGGSDGHVFNLGHGISQFTPPENVSVLVDEVHNHSRK

SEQ ID NO: 8845 - protein, 1311 aa, Ralstonia metallidurans
MATTTLGVKLDDASRERLKRVAQSIDRTPHWLIKQAIFTYLEQVERGHLPHEAGAGATADTDGADAGDATQADAAPQPFLEFAQSVQPQSVLRAAITSAYRRPETECVPVLLEQARLPQAQADAAIKMARALAARLREQKVGSGREGLVQGLIQEFSLSSQEGVALMCLAEALLRIPDKATRDALIRDKISGANWQSHLGQSPSLFVNAATWGLLLTGRLVATHTEAGLSKALTRIIGKGGEPLIRKGVDMAMRLMGEQFVTGETISEALANARKYEEEGFRYSYDMLGEAAMTEADAQRYLASYEQAIHAIGQASRGRGIYEGPGISIKLSALHPRYSRAQHERVITELYGRLKSLTMLARQYDIGINIDAEEADRLEISLDLLERLCFEPELAGWNGIGFVVQGYQKRCPFVIDYLIDLARRSRHRLMIRLVKGAYWDSEIKRAQVDGLEGYPVYTRKVYTDVSYVACARKLLSVPDAIYPQFATHNAHTLAAIYQIAGQNYYPGQYEFQCLHGMGEPLYDQVVGPVADGKFNRPCRIYAPVGTHETLLAYLVRRLLENGANTSFVNRIADETIALDDLVADPVAVVETMHKTEGVLGLPHPRIPQPRALYGKSRANSAGIDLSNEHRLASLSSALLAGTSETPRAEPLLGAAVAGTDATSEPVLNPADRRDVVGQVSEATPAETEAALVAAVNVAPIWQATPPEVRAAALERAADLMEAQMQSLMGIIMREAGKTFSNAIAEVREAVDFLRYYAVQVRASFSNDTHRPLGPVVCISPWNFPLAIFTGQVAAALAAGNPVLAKPAEQTPLIAAAAVRLLRDAGVPAAAVQLLPGRGETVGAALVGDARVKGVMFTGSTEVARLLQRNVASRLDAAGRPIPLIAETGGQNAMIVDSSALAEQVVGDVVTSAFDSAGQRCSALRVLCLQEDVADRILEMLKGAMGELTLGNPDRLSTDVGPVIDEEARGNILRHIEAMRAKGRRVHQADPGAADTPACRHGTFVPPTLIELDSIAELKREVFGPVLHVVRFPRTALDKLIDQINGTGYGLTLGVHTRIDETIAHIVDRADVGNLYVNRNVVGAVVGVQPFGGEGLSGTGPKAGGPLYLHRLLSVCPQDAVARAVRASDATGGVAAAPVSPELAALKAWAQASLPEVAEACDRLAAASPSGLGVTLPGPTGERNTYSLLPRERVLCLAQQESDLVLQLAAVLAVGSEALCVDTAQTRALSERLPAAVQSRVRMVSDWTSTDTAFDAVLHHGDSDQLRTVCEQVATRTGPIVGVQGLAHGEPNIALERLLIERSLSVNTAAAG

SEQ ID NO: 8846 - protein, 677 aa, Ralstonia metallidurans
LNSAQSEAVRYFDGPCLVLAGAGSGKTRVITQKIAHLIEDKGFEPRHIAAVTFTNKAAKEMQERIGKLMEGKTTREGKRIPLKQLTVCTFHSLGVQILRMEAEHLGLKPQFSIMDSDDCFGLVQEQLGTTDKKLIRSVQGTISLWKNGMIDPETALAQASDADEHQAAMVYRNYVATLHAYQAVDFDDLIRLPAELFARDEAVQLKWQNRLRYFLVDEYQDTNACQYQLLKLLAGGSHLRAPAFTAVGDDDQAIYGWRGATLDNLRLLQTDFPSLKVVKLEQNYRSTVRILEAANAVIANNPKLFDKKLWSEHGMGDPIAIHPMNDEEHEAESVVFRLSAHKFERRAQFRDYAILYRGNHQARLFEQILRRERIPYVLSGGQSFFDKAEIKDICAYLRLIANPDDDPAFIRAITTPRRGVGNTTLEVLGTFAGQAKVSLFEAAMMGGIEAKLQPRQLEPLRTFCESMVRLADRAKTDPATVVLDDLMEGIHYEAYLYDTFDERQAQSRWTNTLEFLDWLKRKGTRPEPEGEGEATGFDTADGFGDEGKNLLELTQTVALMSMLEGREEDPDAVRLSTLHASKGLEYPHVFLVGVEEGILPHSREDEEMGDEKIEEERRLMYVGITRAQRSLQISWCRKRKRARDTYACEPSRFIAEMKLEDSPAPKDETPAMSPKDR

SEQ ID NO: 8847 - protein, 478 aa, Ralstonia metallidurans
ETLMRRQRKAKIVATLGPASTDIAVIRQLFDAGADVFRLNFSHGTHEDHRARYDAVRQVEAETGRPIAILADLQGPKLRIGTFAAGKVAVSAGDTFVLDSDPTPGDAKRVYLPHPELFKAANAGQSLLIDDGKVRLNIESVASGSITTRVANNGTLSDRKGVNVPDAVIPIPALTEKDRKDLAFALELGADWIALSFVQRPSDILEARELIGTRAGVLSKIEKPAALQQLEEIVRVSDAVMVARGDLGVELPPERVPGVQKRILRICRQLGKPIVIATQMLESMIDSPVPTRAEASDVASAIYDGADAVMLSAESANGRHPVAAVSIMNRIITEVENDPLYRNMIDAQHEAPLSTRQDAICAALREVTQIIGAKATVTYTSSGATALRAARERPCAPIVSITPNLEIARRLAITWGVHSTVSPDVQSVDEMVEAAARAALVEGYAAPGDQITIAAGMPFGQGGTTNLLRVAEVGTEVA

SEQ ID NO: 8848 - protein, 473 aa, Ralstonia metallidurans
FDVIVIGSGPGGYIAAIRAAQLGKTVACIEEWKDDAGKPRLGGTCLNVGCIPSKALLASSEYFEQAKHGLAEHGVQVKGVTLDLAQMIQRKAAIVDKFTGGVEFLFRKNKVTWIKGHGKFKGRAADGVITVEASNGGETTSHTARNVIIATGSKARHLSGVPVDNKIVSDNEGALSFDSVPKKLAVIGAGVIGLELGSVWRRLGSEVTLLEALPTFLGALDEAVAREAAKQFGKQGLTIHLGVDIGNIEATAKGVSIAYKDKDGAEQKLVADRLIVSIGRVPNTDNLGLDAVGLAADARGFIPVDDQCRTPVAGIYAIGDVVRGPMLAHKAEDEGVMAAEVIDGQKPHIDYNCIPWVIYTEPEIAWVGKSEAQLKAEGREFRSGQFPMMANGRALGIGHPDGFIKMIADAKTDEILGVHIISANASDLIAEAVVAMEFKAASEDIGMICHPHPSLSEVMREAALAVRKRALNM

SEQ ID NO: 8849 - protein, 356 aa, Ralstonia metallidurans
AGMQAAVFQGPGKIVLQEKPIPAVGPTDALIRITTTTICGTDIHILKGEYPVERGLTIGHEPVGIIEKLGSGVTGYHEGQRVIAGAICPSFYSYACQDGCASQDGQGHSHGYKPMGGWRFGNTIDGTQAEYVLVPDAQANLAPIPDGLTDEQVLMCPDIMSTGFSGAEHANIKIGDIVAVFAQGPIGLCATAGARLRGASLIIAVDGIDDRLNISRQMGADVTLNFRNTDVVQEILRITGGRGVDASIEALGTQATFESALRVLKPGGTLSSLGVYSSDLKIPLDAFAAGLGDHRIITSLCPGGKERMRRLMNVIETQRIDLGPLVTHRFKLADIEAAYDLFGHQRDGVLKVAITP

SEQ ID NO: 8850 - protein, 247 aa, Ralstonia metallidurans
KVALVTGAARGIGKAVAQAMLADGYQVVLAGRTAETLEALAAQATAAGQTALAVQCDVSDAASVDALFGKIRERFGRLDVLFNNAGINAPGVSIDELSVEQWKAVVDTNLTGAFLCARGAFALMKSQDPRGGRIINNGSISAHAPRPNSVAYTATKHAITGLTKSLSLDGPPWDIACGQIDIGNAGTDMANRMARGVPQANGEIRPEPLMDVAHVASSVLHMANLPLETNVQFMTVMATKMPFVGRG

SEQ ID NO: 8851 - protein, 169 aa, Ralstonia metallidurans
MMEQPQATMSAEDEARMIAALGQVFDLARNGDAVALAALIERGMPPNLRNEKGDTLVMLAAYHGHANALRTLLEVGASPDIRNAMGQTPIAGAAYKGYTEIVEILLEHGADVEGASPDGRTALMTAAMFQRTDIVDILKAHGADPNARDNRGMTAADAAAFMAGRHGST

SEQ ID NO: 8852 - protein, 477 aa, Ralstonia metallidurans
LTTAFGAPVVDNQNVQTAGPRGPALLQDVWFLEKLAHFDREVIPERRMHAKGAGAYGTFTVTHDITKYTRANLFSQVGKKTDLFLRFSSVAGERGAADAERDIRGFAIKFYTEEGNWDLVGNNTPVFFLRDPLKFPDLNHAVKRDPRTGMRSAESNWDFWTGLPEALHQVTIVMSDRGIPRTWRHMHGFGSHTYSFINANMERFWVKFHFVTQQGIQNLTDEEAAEITGQDREYHQRDLFESIERGDFPRWKLCVQIMPEAEASKVPYHPFDLTKIWPKKDYPLIEVGVLELNRNPDNFFAEVEQASFAPSTIVPGVGFSPDKMLQGRLFSYGDAARYRVGVNHHQIPVNSPKAAKYVNSYHRDGTMRVDGNRGAAIGYEPNTKGEWAEQPDFREPPLTLEGTADHWNHREDGDYFSQVGALFRLMSPTQQQALFDNTARSIKGVSKHIQQTHIKHCTAADPAYGAGVAAAIEMIEA

SEQ ID NO: 8853 - protein, 561 aa, Ralstonia metallidurans
MTHLKITGMTCDSCAAHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 8854 - protein, 153 aa, Chloroflexus aurantiacus
  unsure (1)..(153): unsure at all Xaa locations
RDHVWLPYTQMKTARPPLPVASAEGVKLRLADGRELVDGISSWWATVHGYRHPHIEEAIRRQLETLPHVMLGGLAHEQAYTLARRLAGMLPGDLDHVFFSDSGSVAVEVAMKMAAQFWLNQGHRRREVLCFRGGYHGDTLARXACATXQGMHS

SEQ ID NO: 8855 - protein, 295 aa, Chloroflexus aurantiacus
SKKQRIGVLTSGGDAPGLNAVIRAVVKSASGLGWEVIGIHDGFEGLLGTKSYRVLTNADVQVLLPRGGTILRTTNKGHFGPRRSDELSEADPYVRAVKAIEEMGLRALITIGGEGTQRIALELHKLGAPVIGVPKTIDNDLAGTDRTFGFDTALQVATDAIDRLHTTAASHNRVMVLEVMGRHTGWIALHAGLAGGADVILIPEIPFSIERVAEKVMARDQQGSSFSIIVVAEGARPRGGSEMYIAEGRLGGIGHWVGEQLEKLTAKEVRVVVLGHLQRGGSPSPYDRLLSTRYG

SEQ ID NO: 8856 - protein, 237 aa, Chloroflexus aurantiacus
MEYEHSAEIKMLRQAVREFVDKEIRPIARAIDEEERVPFETMKKAAELGFLGVPFPERYGGLELGITGYCVLMEELNRVCASHATIIGAHSQLAAMSIYLGGTEQQKETYLRALIEGRKWGAWALTEPNAGSDAAHIQTTAERRGDEWVINGQKMWITNGSFADVIVVFAATDKNLGARGGITAFIVEKTMPGFRVGKVEEKMGLRASHTASLYFEDCRVPAENVLGQSYGFPLLCA

SEQ ID NO: 8857 - protein, 209 aa, Chloroflexus aurantiacus
ALTGARYASGLVCYATATNVALLPLVEANLIDRSRPIIADVKVGSSEGGATVNEASHHPERSGAVRSFAPVGHRHLAEVEQVTGLRNVHLSITAIELVRGALATVHAFASRELSEKELWQAYRTFAREQPFIRIVKERQGIYRYPEPKILAGTNYADIGFAYEPATGRIVSICAIDNLMKGAAGSAVQCMNLMCGFAETTALTFAGLHP

SEQ ID NO: 8858 - protein, 325 aa, Chloroflexus aurantiacus
EAVILSTCNRVELYGVTNPGTTAQHVVDFLAAFHRRPAASFVHTLYFYQGEAVARHLCATAAGLRSLVLGEAQIQGQVRNAYEAAQRIGSVGSILHRLFQIALVAGKRVRHETTIGKGAASVSQAGVELARRRLGDLRGREVLLIGGGEVSELAAQNLIANGADRLTIVNRTSARAAALAERYGAEMLDFGALPQALARADIVISSTAAPVPIIYRHHVAEAIAHKQRARACGECDPPTMLLIDLAVPRDIAADVAQIPGVHLFTVDDLREVVSHTIELRSAVLEIGQQIVEEQVQEFLSWMRTQEGLPVLTMLRQRAEEVRNEE

SEQ ID NO: 8859 - protein, 130 aa, Chloroflexus aurantiacus
FARLYTFAAAHRLHAPALSDEENLAIYGKCNNPNGHGHNYTLEVTVQGPIDPATGMLVDLEWLDRTVHSVIDRLHLRHLDREIPAFADRPSTAENIIVYLWNELAPLLEGRLALLRLWETRKNIFSYAGP

SEQ ID NO: 8860 - protein, 192 aa, Chloroflexus aurantiacus
  unsure (1)..(192): unsure at all Xaa locations
LQGQVAIVTGGARGIGRATTIELANAGARVVINYQRSAGAAESLAAEITAAGGEALPYQADVADEQAVTRMIQAALSRWGRIDILVNNAGITADAPMARLRPEQWQQVIETDLTSVFLCCRAVVPIMRSTGYGRIVSVSSLAALAGNVGQTNYAAAKAGIIGLSRSLAREVASXCITVNVVAPGYIETDMDE

SEQ ID NO: 8861 - protein, 229 aa, Chloroflexus aurantiacus
MIDFNGQVAIVTGGSGGIGQAVVEGLARYGARVLVGYHHNEAAATDVVAAVQSSGREAAALAIDVREPDSGNVLVATAIERWGKLDILINCAGIADYGPLSEMSSERWRQTIQTNLTGIYHTCRAALRPMMQQRYGRIVNLAALYGTSGFPGQADFAAAAGGIIGLTRALAREAAPWQITVNAVAPGMIETDLIEVIPAEIQQWSAGIIALRRLGKPEEVAAAVLFLAS

SEQ ID NO: 8862 - protein, 393 aa, Chloroflexus aurantiacus
IGHRFNPHKLLIDPYARALCGELTWDKANYGYRVDSPYGDLTIGKRDSAPYIPRSVVIDPTFDWGDDRHPNIPLADSVIYELHVKGFTRLHPEVPENLRGTYAGLASPAVIDYLKQLGVTAVELLPVHAFITDQFLADRGLTNYWGYQPINYFSPEPRYASQSDPQAQVNEFKAMVKALHAAGIEVIIDVVYNHTGEGNHLGPTLSFRGIDNVAYYRLVPDQPRYYLDDTGTGNSLDLNHPRTLQLVLDSLRYWVTEMHVDGFRFDLARTLARGPAGSDLPSPFFTAVRQDPVLSRVKLIAEPWDVGFDGYWVGRFPAPWAEWNGRYRDTVRCFWKGDPGQAADFASRFMGSMDLYHHNGRRPYHSINFVTAHDGFTLRDLVSYNEKHNEANG

SEQ ID NO: 8863 - protein, 406 aa, Chloroflexus aurantiacus
  unsure (1)..(406): unsure at all Xaa locations
ENPVFRMRVLHTNDHHARIEPVFSGNNPVHGGVSRRKALIDKIRRETALPTLLVDAGDVFQGTLYFNQYNGMADLEFYNAMGYEAMAIGNHEFDKGPQALVDFITRAKFPVLSANISVAAGNPLAGLIKPRTIIEKDGRKIGIFSLTPEDTGVLSNAGPGISFTSAIEAARQQVAALKAEGVFTIIALTHVGINVDRQIAREVGGMSLIIGGHSHTPMAPMNNVKTPPYPELIAGPDGKPVVVVTDWEWGRWLGDITVAFNASGTVIDLQGNPTEIVPSLTADQGFENRIAVFRGPIDQLRARVVGSTAVELDGSRTNVRSRETNLGNLIADAMLAKVRNSGATIAIMNGGGIRTSIPAGPITVGQILEVLTIRXQPDAGHLTGAQVIEAVNNGVSRGHGAVIPQL

SEQ ID NO: 8864 - protein, 323 aa, Chloroflexus aurantiacus
AAVIGWGMAVPQRLITNDELAQRIDTSDEWIRTRTGIRERRVAGPGESTSTLATAAGREALTMAGVSPATIDTVIVATCTPDRPFPATACTVQANLQIPRATAFDLAAACSGFVYGLTVATSLIKSGVSRRLLLIGADIFTHYINWNDRNTCVLFGDGAGAVVLEATDEPLGLLASTLSANGELEDLMAVDAGGTRMPLTADLLEAGRQYVYMNGREIFKHAVREMSDSALQVIQDAGLTVDDIALVIPHQANVRIIDAVARRLEIPPERVMVNLDRYGNTSAASIPIALYEAAQQERIKAGDNVLLTAFGGGLTWGSGLVRW

SEQ ID NO: 8865 - protein, 274 aa, Chloroflexus aurantiacus
MGVRIYKPTSAGRRNMSVSTFEEITKKEPEPRLIEPLRKKAGRNNQGRITVRHRGGGHKRFYRIIDFKRNKFGVPAKVQAIEYDPNRTARIALLAYADGEKRYIIAPLGLKVGDTVMSGPDAEIRVGNALPLSAIPLGTQIHNIELEIGRGGVLVRSAGTAAQLMAKEGDYAIVRMPSGEMRMIHLRCMATIGQVGNVDHQNIRLGKAGRSRWLGRRPRVRGAAMNPRDHPHGGGEGRAPRGMSTPKTKWGKPARGVKTRHNPRFDRFIVRRRK

SEQ ID NO: 8866 - protein, 239 aa, Chloroflexus aurantiacus
KVALITGAGQGIGRATALLFGQHGAKVAVADINEEAAQATAQAIVDAGGEAKAFFMNVGQAASVEAAVKAVVEWAGRIDVLVNNAGITRDARMIKMTEEQFDAVINVNLKGVWLCTKYVAPIMIEQGGGSIINAASIVAFEGNFGQTNYVATKAGVIGMTKTWAREFGPSGIRVNAVATGFTQTEMIAHVPEKVLEEFKGRTPLRRLGTAEDMAYAYLFLASDEASFITGEVLPVDGGL

SEQ ID NO: 8867 - protein, 261 aa, Chloroflexus aurantiacus
MIVVKIGGSAGNDYDALCDDIAERWRAGERLILVHGGSDQTNRLGEALGHPPRFVTSPSGHTSRYTDRRTLEIFMMATAGLINKQLVERLHMRGVMALGLSGLDGRLLSGKRKATIRVIEQGRQMILRDDWTGTIEQVNRDLLHMLLAAGYLPVVAPLACSEAGEAVNVDGDRAAAAIATAIGAQTLILLSNVPGLLRNFPDESSLITHIPRNDLESSMTYAAGRMKKKLLGAQEALAGGVQRVILADARIPACVSQALNG

SEQ ID NO: 8868 - protein, 348 aa, Chloroflexus aurantiacus
  unsure (1)..(348): unsure at all Xaa locations
NLHVRELTPLQPPRALKNELPITPAAAHTVAETRAAIRRILRGEDQRRIMVVGPCSIHDPEAALEYARRLQALQKPLGDQLVIVMRAYLEKPRTTVGWRGLINDPHLDGSFDMAAGLRIARQLLLAINELGVPVATEMLDPISPQYLDDQISLATIGARTSEAQTHRALASGVSMPVGFKNGTDGGIQVAVNACVSAAVPHSFLGIDEDGRSAVVRTTGNPDSFVILRGGRHGPNYHLEYIVQTTRLMREAERQPAVMIDCSHANSGSDFRRQEAVWQTVLGYMVEEPLPIIGMMLESNLFEGKQPLVADRSMLRYGVSLTDGCVGWDTTERLLHEAHLALSRRXMQA

SEQ ID NO: 8869 - protein, 392 aa, Chloroflexus aurantiacus
MAPRVLIVGASVGGATAAITLRSFGIETIMLEKELSKAKPCGGAVPPAAFREFDLPTSLIDRKVKQCLIVSPSGQETRVPVAGTIPSDDDYVAMVRREVFDSFLRQRAQERGADLIHAQLTGLRVDRRGVVATYRTPSGHEGSVWADVVIGADGAYSPTAKFLGLPHLPRAVAIQERIKLSPDKMARWEETADLYLGYEVSPDLYAWAFPKRDHIAVGIGAGPRHSTAAKQLLTNLKRRLGDALAGGQTILREAHALPMEPRPHMAFDRAMLIGDAAGLVVHTSGEGIYWAMKSGQMAAQTLAEYLDAPSAANLRHYERRWWKQYGTMYRFLRFLQMWGYGNERQMEVFTEMCRNYDVQRLTFDSYMHKQMAPAPGLAQLRMTAEIIASELQ

SEQ ID NO: 8870 - protein, 559 aa, Chloroflexus aurantiacus
HLAELADAGVTHVHLLPVFDIATIEEIREQQVPLPYDQLRALPPDSPEQQALIEPIRDLDGFNWGYDPFHYSVPEGSYSTNPDGPQRTLEFREMVQALNETGLRVVMDVVYNHTNASGQNPRSVLDRIVPGYYHRLDGDGNVTTSTCCANTATEHRMMEKLMIDSVVLWAKYYKVDGFRFDLMGHHMKDNMLAVRAALDALTLERDGVDGKSIIIYGEGWNFGEVANNARGINATQFNMAGTGIGTFSDRLRDAARGGGPFDDPRLQGFISGLATDPSDFPQGTPDAQRVKLLAETDLIKLGLAGNLKTYRMINYEGRLVPGEQIKYRGAAGGYTLDPQEQIVYVSAHDNETLFDAVQLKAAAGTPIAERARMAQLGLSLTALAQGIPFFHAGDELLRSKSLDRNSYNSSDWFNRIDWRGQENTFGSGLPPAWDNQSNWPIMAPLLANPALKPDASLMQATYEHFREMLRIRRSTPLFRLRTAAEVERMVSFFNNGPDQIPGLIVMSISDNGPSRLDPNIGQVVVLFNARSETVTITIPELANGDLPLTTSGCVSDERV

SEQ ID NO: 8871 - protein, 307 aa, Chloroflexus aurantiacus
QDKSVVVTGGAGFLGSYVVEKLHERGARRIVVPRSHQYDLRQLEAIRQLLADAQPDIVIHMAARVGGIGANRDHPAEFFYDNLMMGVQLLHESWRFGVQKFVTIGTVCAYPKYTPVPFKEDDLWNGYPEETNAPYGLAKKMLLVQGEAYRQQYGFNSIFLLPVNLYGPRDNFDLETSHVIPALIRKCIEATERGDDEIVVWGDGSPTREFIYAADAAEGILLASERYNDPAPVNIGSSYEISIRDLVTLIADLTGFRGRIVWDTTKPNGQPRRKLDVSRAWERFGFRAETTFADGLRATIAWYRSQR

SEQ ID NO: 8872 - protein, 440 aa, Chloroflexus aurantiacus
RHGPAMAITFLSAATAATAAPLNPKYRRDEFAFYYEDTQARALIVAPGEGDEARAALRSDMLLIEAAFDSNHQLTFSTSGTAGSPRRDGLATPDDIAMILHTSGTTSRPKRVPIRHRNLAASTSNIITTYQLSAADRSLCVMPLFHIHGIVASLLSQLAAGGAVICPPGFDGLKFWSWVEQERPTWYSAVPTMHQVLLARAGRNTAIIKANPFRFIRSSSAPLPPVVMEQMEEVFAAPVIESYGMTEASHQMTSNPLPPGRRKPGSVGIGFGVEVGIMDEHGQLLPAGVKGEVVVRGPNVVDGYENNPEANATAFVNGWFRTGDQGYLDEDGYLCLTGRIKELINRGGEKISPLEIDDVLLRHPAVAEALAFAVPHPTLGEEVHAAVVLREGMSADERELREHCARLLADFKVPRAIHILSALPRGATGKLQRITMAKTL

SEQ ID NO: 8873 - protein, 350 aa, Chloroflexus aurantiacus
  unsure (1)..(350): unsure at all Xaa locations
HPYALSGPTMIEQGIARLRAICEAAGYPLAGNLNRNVFLPTALGALRPTAFAPATMIAGDARQLRDGRPTLIASFGELRDFFPPLIAANLRAQGIHAEAAQLTLPPTGRQRDFNPVTLARLFDQPAFRASVGDQLAGLVRKGGYARIGMPAILGLKHATEVVRDLQNRSGALIFEIPTLPTSVAGMRLYHMLEDELIRLGGRVQLGGFVQRGEHIQQTLVAVFSEAAAREQRHTARRWVLATGGILGGGVRATPEGQLRETALDLPLQTPAGRAGWFAPRFLAEDGHPVFQSGVRVDRDLRPLDAGGQLVYDNVMVAGSALAGFDPIREGCLEGVAIATGWKAGQQXSAK

SEQ ID NO: 8874 - protein, 288 aa, Chloroflexus aurantiacus
KDYYQVLGVSRTASDEEIKQAYRRLARKYHPDVNPGDPKAEARFKEINEAYQVLSDKEQRAKYDRFGSDFRRYEQTGFGGFDYGSQDFADLFETLFGQRRTTGGGFNVRLDGQDVEQPVELTLEEAYNGTQRTVQFSNPNGTPRTITVKIPAGIDTGKRVRVPGEGAPGLNGGRRGDLYLVVTVKPHERFERKGNDLHTTIPVSMYTLLLGGQTQIPLLSGKTLTLNIPPQTQNGRVFRIAGQGMPLMHSHQHGDLYVTVSAVLPTNLSPQARKLVEELQQLTEGDRR

SEQ ID NO: 8875 - protein, 328 aa, Chloroflexus aurantiacus
PNLRQNIATREWVIIASERARRPNSFTEHRQQLLTAERPQHDPQCPFCVGNEELDLEVDRYPITGPWQVRIVRNKYPALHGDRPLVRHFEGVRRNISGYGYHEVLVEHPHHNTTLGLMTHAEVRLVLATYLSRGLAMSSDPRIEQVVIFKNHGERAGASLPHPHSQLMAVPVVPADVRHRIEEARRFFDDTGQCVFCTMLADELAQRERIVYANDDFVAFVLYAASSPFHIWVLPRKHRASFFHIAEAELDGLADVVREVFHRLYYRLNDPDFNLVLRSTPAREAENGYFHWYLAIVPRLSYMAGFEWAAGIFINPSIPEACAAFLRE

SEQ ID NO: 8876 - protein, 449 aa, Chloroflexus aurantiacus
  unsure (1)..(449): unsure at all Xaa locations
IGVLTSGGDAPGMNAAVRAVVRTGISRGCEVFAIYEGYQGLIEGGKLIRRMDWSSVGGIIQRGGTIIGTARSAAFRTREGRRRAAANLLAHGIDRLVVIGGDGSLTGADLFRREWPELLAELVAAGEFSSEQAAAHPNLLIAGIVGSIDNDFCGTDMTIGADTALHRITEAIDAISSTAASHQRTFVIEVMGRNCGYLALMGAIAGGADWAFIPEMPPQMDDWEQHMCDVLRIGREQGRRDSIVVVAEGACDRDGKPITASYVKKILEERLGEDTRVTILGHVQRGGAPSAFDRWMSSLLGATAVEELLEADPNAEPKLIGLRENRVVRLPLMTCVRDTHQVAEAIAQRDYERALAMRGNSLVEAYRTLGTLIQSQHSDPRPITARASLRKSCNSGGPAPENEYAVRAAGGSAXTGHTSPVAHGSRTTRGLSTRMVEQGWAHVPKWPSR

SEQ ID NO: 8877 - protein, 264 aa, Chloroflexus aurantiacus
  unsure (1)..(264): unsure at all Xaa locations
VPGFIHIESPYPYRFVQSXPAPERWGGRANLLEEAIVREGPDTDAAFIAEPVQGAGGVIPPQDDYFKRIREICDYYDVLLISDEVITEFGRTGRWFGLEHYGIEPDIAQFAKGITSGYIPLGGIGVSDRIYQAIQSVPPEQRWMHAFTYSGHPTACAVALANIAIIEREGLVQRAAEVGDYMLRRLQELYALPHVGNVRGKGMMAGIELVADTATKAPFPASANVGVRVQKEMTARGLFTRVVGDTICLAPPLVTTYEQIDQIV

SEQ ID NO: 8878 - protein, 401 aa, Chloroflexus aurantiacus
MAKQKFERTKPHINVGTIGHVDHGKTTLTAAITKVLSLKGAAQFMAYDQIDNAPEERARGITIAIRHVEYQTDKRHYAHVDCPGHADYIKNMITGAAQMDGAILVVSAPDGPMPQTREHILLARQVQVPAIVVFLNKVDMMDDPELLELVELELRELLSKYGFPGDEIPIVRGSARNALESPSKDINAPEYKCILELMNAVDEYIPTPQRAVDQPFLMPIEDVFGIKGRGTVVTGRIERGKVKVGDTVEIVGMTNDAPRRTVVTGVEMFQKTLDEGIAGDNVGCLLRGIERTDVERGQVLCAPGSIKPHKKFEAQVYVLKKEEGGRHTPFFSGYRPQFYIRTTDVTGAIGLPAGMEMVMPGDNVVMTIELIVPVAIEEGLRFAIREGGRTVGAGVVTKILD

SEQ ID NO: 8879 - protein, 390 aa, Chloroflexus aurantiacus
FTGPSTAAVHAGEPRQRAFDAITPPVVHSATYTFRDSAELIAFQSGDLEREEYGRYGNPTVRAVEARLAALESPTAPAAALLCASGMNALTTVMLALLPSGSHVILTDDGYRRTRQFVRTMLARLGVTHSVVAAADPAAIAAAIEPGRTRLIVTEAPTNPYLRVIDLAAVASIAREHRIKTLIDATFATPYNMRPLEYGIDLVVHSCSKYLAGHNDLLAGVIIGRPPIISALRETQGILGGICDPHTAYLLGRGLKTFALRMERHNHNGQAVAEFLARHPRVSRVHYPGLPEHPDHAVARAQMRGFGGVVSFEVVGDLQSAMAVVDRLRLPYIAPSFGGVESLVEQPALMSYYELSSEERLAVGIRDNLIRLSCGIEDVSDLIADLQQAL

SEQ ID NO: 8880 - protein, 410 aa, Chloroflexus aurantiacus
LLNIVQQHFDQAAELLDLPARLRGILRVPQRELTVNFPVKRDSGRIEVFQGFRVQHNLARGPTKGGIRYHPNVTLDETRALAMLMTWKCALAGLPYGGAKGAVIVDPKQLSVGEIERLTRRFATEISVVIGPERDIPAPDVGTNPQVMAWIMDTISMHQGHTVPAVVTGKPINIGGSEGRREATGRGLTYVLTAAAHHLGLNISDIRLAIQGCGNVGSTVAREAVALGMKVIALSDSRGGVYNPHGLDIEAILAHKAHTGSVVGAVNADSLTNEELLEVECDVLVPAALSGVITAQNAGRIRAQIVAEAANGPTTKAADAILYDRGCLVIPDILANAGGVTVSYFEWVQGLQEFFWSEREVNTQLRRVMTNALQQVLRVSAERQVDLRTASYMLAVQRVADAVTTRGIYP

SEQ ID NO: 8881 - protein, 215 aa, Chloroflexus aurantiacus
VSFDVQQGEVVGIIGRNGAGKSTLLKVLSRITEPTRGRAELYGRMASLLEVGTGFHPELTGRENIYLNGAILGMRKREIDRNFDAIVQFAEVEKFIDTPVKFYSSGMYVRLAFAVAAHLEPEILIVDEVLAVGDARFQKKCLNKMQDVGQQGRTVLFVSHSMQSILRMCQRAILLNQGQVVADGPAQQVVGVYLGKGTHSIAERVWPDRASAPGK

SEQ ID NO: 8882 - protein, 400 aa, Chloroflexus aurantiacus
IILRMHVLQISWEYPPHIVGGLGRHVADLAPALTEHDVIVTVLTPQLRGGDTFERHENLTICRVTVPQFDTDDFPTFVSHTGRHLEQAAHALFPGGRPDLIHVHDWLTAEAGIALKHHWRIPLIATIHATERGRGRGALNGHRAQQINDLEWRLTYEAWRVIVCSHFMAHQIREYFTTPADKIDVISNGVHLPPPPFATPAEWVAFRRRFAADTEALVIFVGRLVYEKGVHILLEAWPQVVAEMPARLVIAGTGSALDELKARAATLGTTVEFLGVISDEDRQMRLLRCRGDIAVFPSLYEPFGIVALEAFAAGCPVIVSNTGGLAEVVQHELNGLVVPAGDVGALAHALLNSLRSPAESRLRAARGAALARAYYTWSRIAGEVKAVYDRVWTEWKAGSW

SEQ ID NO: 8883 - protein, 148 aa, Chloroflexus aurantiacus
LDRPVALVGLSGCGKSTLARLLARALSWPWYDTDAAIAAAAGMSVADLFQTYGEAEFRVRETAALTEALREAQVIATGGGIVLQPENRRMLREYATVIWLDAADATILTRLAADAEQRPLLHGDAAARLAELRARRTPLYAEVADVII

SEQ ID NO: 8884 - protein, 384 aa, Chloroflexus aurantiacus
RGQCESTPHQETGVYWRAQTFRQEQAVYADFLDVNQKSRRINLRTRYTFSSIFPLLNLLAAVGTALLVYLGGQAVYAGELTTGSWFLFIQGLQSFWFPLTSIASFWSQFQLGLAAGERVFALIDAEPRVVQVDRLDPGRLRGEIRFSEVDFAYKPGEPVLRQFNLHIKPGERVALVGHTGSGKSSIAKLIARFYEFQGGQIQIDGYDIRRLDLNAYRSQLGMVTQIPFLFDGTVRENIRYGRPDADDEAVMAAAQRVGNGDWLSSLPAGLDTPVGERGSGLSMGQRQLVALARVLLQDPAILILDEATASIDPLTEALIQEGLDEAMRGRTAIIIAHRLSTVREVDRIIVLRHGTILEQGTHDQLLAAGGHYAELYNTYFRHQS

SEQ ID NO: 8885 - protein, 335 aa, Chloroflexus aurantiacus
MAVRVGINGFGRIGRLALRAAWAWPELDIVHINEVGGDAATAAHLLSFDSTQGRWSVEVHGEGNQLLIDDKTVGYSQIRDPGAVPWADAGVDIVLEATGKFRTAEQLAAYFSAGVKKVIVAAPVKGEALNVVMGVNDHWYEPDRHHLLTAASCTTNCLAPIVKVIHEGIGIRHGMITTIHSSTNTQTVHDRPHKDLRRARAASLSLIPTTTGSATAIGLIFPELQGKLDGQAVRVPLLNASLTDCVFEVRRPTTVAEVNGLLQAAAEGALKGILAYETRPLVSIDFLGNPHSAIVDSLCTMVTNETQVKIYAWYDNEWGYANRYVELARKVALLL

SEQ ID NO: 8886 - protein, 218 aa, Chloroflexus aurantiacus
FKPQPDFYYLASFPKSGNTWVRFLLANLLAGQELGLQGFGRYVPDSHIKGDLVYMADPTTPFNQMRPRFVKTHLHYRPVFRRAIYIVRDGRDAMTSYYHWRNRRSDKPVSLHEIIVGDIYWGRWSDHVLGWLNSGAELLVVKYEDLYADTPSQVRRILNFCHIQATDDQIAAAVAASSFERMRAKEQAANGAATPFFVRKGGSGDWRNLFSPADEELF

SEQ ID NO: 8887 - protein, 557 aa, Chloroflexus aurantiacus
  unsure (1)..(557): unsure at all Xaa locations
LPFTAIVGLDTARQALLLLAVDPSLAGVAIGAGAGTGKSALVRAFARMLAGGREFDPTIPWQLVEMPVGVSEDRLLGGIDIEATLATGERVHRSGLLARANGGMLYVDSVNLLDDSTINHILSALDSGVVRVEREGISVVEPARFVLLVTYDPAEGPPRRHLLDRLGLIVAPIGKAPVTTRAEVVRRNLQPGTDYEDDEALVLAGILAARELLPSVTISDEQVQQLSLTAMALGIEGHRADLFAVRAARAAAALAGREEVNNDDLELAVRLVMLPRATRLPEMTPEEAGPPPPPEPAPPPPSPENSDDEQRDDEEEKPPQPPEDELTIEELILAAMETDVPPDILETPFTVRRRGRSGSRGTISGQRGRHIRSVPGKPAQGRLDVIATLRAAAPWQRIRAAEYHPHRRGRIHLRADDLHIKKYRSKAGTLFCFLVDASGSMALHRMRQAKGAVNALLQQAYVHRDQVALLAFRGERADLLIPPSQSVELAKRRLDVLPTGGGTPLAAASWXVQIETRRSQGTSGKIGXNADDKDDRATLCTTGKTAPKEHGEEXPEE

SEQ ID NO: 8888 - protein, 475 aa, Chloroflexus aurantiacus
LGEPVTQAVITVPAYFNDSQRQATKDAGKIAGLEVLRIVNEPTASALAYGLDKKGQDELVVVYDMGGGTFDVSILELSEGVIEVKATSGDTHLGGDDFDQRIIDWLADEFQKEHGIDLRSDRVALQRLKEAAEKAKMELSSLMQTEISLPFITADSSGPKHLSATLTRSRLEQLCADLIERSMGPVRQALRDAGLQPSQIDEIILVGGQTRMPAIQAAVRNFFGKEPNRSVNPDEVVAIGAAIQAGVLGGEVKDILLLDVTPLTLGIETYGGVMTPLIERNTTIPTRKSQVFSTASDNQTSVEIHVLQGERAEARYNKSLGRFELSGIPPAPRGVPQIEVTFDIDANGIVSVSARDKATGKEQRITITASSGLSKEEIEQMVRDAELHAEEDRRRRELIAARNQADSILYTAEKSLREAGDTLDPALRSTVEEKMMALRSVVADDNEQMIRNRIAELAVALQQITTTTTSNNAAG

SEQ ID NO: 8889 - protein, 753 aa, Chloroflexus aurantiacus
HYRPARGCQCADGFNRCRQEYQASSTVVQSTRQAVEQLRQARAALDEERAGCRHTLAEREARLEALTRLARSHAGTFAGVRTALEWAERHGRRFTLVQQLIRVPPELETAIEVALGARLQHIVVEQWRDAEDAIAELRRTGVGRATFLPLDTLRRPDHSRRPAFSSQVIGVASELVTCDPDYAIVVDQLLGRTLVVTDLATARAEVRNLPPGWTIVTLAGDQVQSGGAVTGGAPTKESGALRRERELRELPEQVAAARSALAAIDERRQALDQELQATITRLRNAEQAEREAQRRRDAARNALDQAQHAARQSEQEQQWLVNQQERLQQELTSLTAQLTSLREQQTALRHERSVAEAELAALREKQEQQAQADRAGQERLANLRATLTAGESRQRMLAELLAGHERTLADLTRQAHDLEATLNALRSERIEREAGYATMITRQQQLLSDLQTLRSHIEPLEAEIGAAEAELSQLEAAEVQATNDLLAAEAEHSRLVREAQRASDRLETLFERAAADGVDLTAPPPAEEGPPLSELPAAIEALRARILRLGVVNPLALEEYEEAANRHAFLTSQAADLRAASATLHQLIAELDEAMHSRFEHTFNAVAGEFSAVFQELFGGGSARLELVESTDSDEHNGKRTAPGVEIIARPPGKRPQNIALLSGGERTLTAVALLFAILKVNPSPFCILDETDAALDESNIGRFRTMLQRLTDRTQFIVITHNRGTIEVADTLYGVSMGDDGASRVVSLRVAE

SEQ ID NO: 8890 - protein, 241 aa, Chloroflexus aurantiacus
VMPGEGAMKLKGRVAIITGASSGVGYAAARLFAREGATVVAAARRRDRLEHLVSMITSEGHHAFAIPTDITVSAQVQQLVDTTAQMFGRIDIVLNCAGNIEKIAPLEQFSDAEWQDVMNTNLNGVFYLMRAVVPYMKRQRSGTIVNLGSRVGKVGMANIAPFCAAKFALSGLSQALAQELRPYNVFVTTVYSGMINADIAPLNPAEELRKRLMTVDDVAQALLWVCTLPPSLRVDELPIMP

SEQ ID NO: 8891 - protein, 307 aa, Chloroflexus aurantiacus
  unsure (1)..(307): unsure at all Xaa locations
AIETIYLTLRYSKVVALDHFDCQVSQVSIVGFIGPYGAGCTTFLRLLAGLITPTSGESRLLVDRLTMRSAQRLVGYMPDFFGVYDDLRVWVFLDFFARCYGLRGARLRQVVDELLDLVDLSAXRDAFVQTLSRGMQQRLCLAHALVHDPPILLLDEPASGLDPRARVELRELLRTLRDMGKTIMLSSHILSELAEVCDAIGIIDHGRMIISGSLAEVQQQLVTGSRIRLRIVHERDLTSAVSFLQQQPLVQAISTVPADPRSLTIELTQTVNEEQCAGLLAGLVQAGVAISEFSARSESLEEFFLRL

SEQ ID NO: 8892 - protein, 533 aa, Chloroflexus aurantiacus
SAPDADLSRCGKPHEEVCPMHMYELGLDKNAANYTPLTPLSFLKRTAMVYPNLPAVIHGERWYTWAQVYERSRRLASALRALGVGFRDTVAVVLSNTPEMYECHFGVPGAGAVLNTINVRLDAATIAFILDHGEAKVLITDREFSPVVKAALEQCNRTLTVIDVDDPLYTGPGERLGSLEYEQFLASGDPEFDLIYPADEWEAITLNYTSGTTANPKGVVYHHRGAYLNALSNIVSWGMPHHAVYLWTLPMFHCNGWCFPWTIAANAGTNICLRKVDAGLIWQAIETYRVTHYCGAPIVHSLIANNAPPHWREGRGTHKVSGLIAAAPPPAAVLQAMAEIGFDITHVYGLTETYGPAAVCAKQPDWHTLPIAEQAHLNGRQGVTYHAQEAISVLDPATMQPVPWDGQTMGEVMFRGNIVMKGYLKNPAATEAAFRDGWFHSGDLAVVHPDGYIKITDRAKDIIISGGENISSIEVEDALYKHPAVMLAAVVAAPDPKWGEVPHAFIELREGVTVTEEELQQHCRRFLAGYKIP

SEQ ID NO: 8893 - protein, 546 aa, Chloroflexus aurantiacus
  unsure (1)..(546): unsure at all Xaa locations
GVAHAIKLKGEPRVAMCFFGDGSASQGLAHEAMNWASVFKLPMVIICENNQYAYSTPLSRQMAITDIAQRAAGYAMPGVIVDGNDFAAVYRATKEAVERARAGGGPTFIECKTMRMRGHAIHDNMAYVPKELLAEWEARDPIARIEEVLRSRGLLDDAKLAALLARIEAELDEAQAFAEASPYPDPATLTDGVYAXTTSRRQAMTWDQGLHKSTTVLSDDQGTRELTYLEAIRAALRYEMQRDPRVLVMGEDIGVYGGAFKVTQGLIDEFGEDRVIDTPMTELAMLYAAIGMSFEGFLPVVEMQFADFISTGFDALVQFAATNHFRWRQPVPITVRAPGGGGLRAGPFHSQSNEAWFIHTPGLKVVAPATPADAYGLLLSAIRDPNPVIYYETKYLYRSLKGMVPEGDAPVPIGQAALRRTGEEVSIITYGAMVQEALSAAQTLEQEGHSVEVLDLRTLKPLDEDAILTTARKTGKVLIVHEANRTCGVGGEVAAIIAERAFEYLDGPIIRLAAPDTPVPYSPPLEDAYRPNATKILAAARDLLAY

SEQ ID NO: 8894 - protein, 506 aa, Chloroflexus aurantiacus
  unsure (1)..(506): unsure at all Xaa locations
MLINGQWQAAAQGEVFPVHNPATEEVIDYVPRATAADAEQAMIAAEKAFREWASLYGPRQGSHLLHEVAHKNXRTXTXXRXXGXXLLXTXSKXXVXXRWXXRKSXXXNXGWXXAXXVLXXIXXRXXATXNXHGXXAXXPXSVXXPSXNWRNGXXKEXHTVXGSGXLVPXWNYPLLLKCRGKWAPALAAGNTVVLKPSENTPLATLRFAELCCDHLPPGVLNIITGFGDVGRELVVSPRTQMIAFTGSFATGREIARLAAERVKKTHLELGGKDAFIVAEDADLDVAVPGVAWAALLNAGQVCTSTERVYVHESIARPFTERLVEFVRSLRLGPGMDPDTDIGPLIGEKYRAKVEDHVEEARARGATILTGGRRPPQFSRGFFYEPTVLTNVDHSFRIMREETFGPTIPIMTYRTFDEAIELVNDCDYGLGANLYTNDPRKVKQYYEEVKAGTCWVNDPLTDNDAGPFGGMKFSGGARELGEEGLEEFLETKHVHWDFTMVRKPWWY

SEQ ID NO: 8895 - protein, 306 aa, Chloroflexus aurantiacus
RCLKYGVTADYVLGLTTVLADGSIARYGDGLAGQGESDGLVQLLVGSEGTLAVITEATLRLIPLPRARRTTMAIFADLAAACATVERIMASGIIPASLELMDDTTIAAVEAYLRIGLPADAGAMLLMLADGEPEAVERDAAALAELAKAGGAQRVAVARNATDEANLWQARRVIAPALARIRPNRLGEDISVPVTRIAECVGQIKQVSATYGLPIVVFGHAGDGNLHPNILFDARNPTEVARLWPCAEAVFKVALAVGGTLSGEHGIGTLKRPFMTQALGEAQLAVQRQIKAHFDPTGRLNPGKVL

SEQ ID NO: 8896 - protein, 560 aa, Chloroflexus aurantiacus
MTKKWVYLFREGNASMRDLLGGKGAGVAEMTRTGVPVPPGFTITTEACNAYYENGQQFPEGMWEQVLEGLKDIEAQTGKRFGDPSNPLLVSVRSGAKFSMPGMMDTVLNLGLNQQTREGLARLTNNPRFAADAYRRFVQLFGKIVLGVDGDRFEHEMDEAKGHGQRQDTDLTTEELLALAEKFKAIIKEDVGVDFPEDPFEQLRAAIAAVFRSWNGRRAVDYRRVNKIPDNLGTAVNVQAMVFGNMGNDSATGVAFTRNPSTGEPEIFGEYLVNAQGEDVVAGIRTPQPISKLAQEMPEVYEQFHQIAKQLERHYKDMQDVEFTIERGKLWMLQTRTGKRTGAAAVKIAVDMVNEGLIDRATAVQRVDPHALDQLLHPMIDPAARKDAHPLTVGLPASPGAASGKVVFDPDEAEELAKTGEKVILVRVETAPEDFHGMVAAQAILTARGGMTSHAAVVARGMGKPCVAGAGDLRISYADQLMTVNGTTIRKGDWITLDGGSGEVFAGKMPTVEPELSGDFATLMSWADEFRKLGVRANADIPRDARVARQFGAEGIRLCR

SEQ ID NO: 8897 - protein, 487 aa, Chloroflexus aurantiacus
FFMARTRIYWVKPGETGVSFKDYRGNPEVLEAARRVVTLLKGAKEFKQMGGEVTRGILLIGPPGTGKSYLAQAISTEAGVPFGYLSAPSLLSAWMGMGNIKVMNLYRKARRLAREYGACILFIDEIDAIGMARSSNLMGTGAAGAGMNNRENVVMGVGGMMGGGSSLLNELLLQMDPPPQEQTWWGKLLRLVGLRRGKAEMPPVLTMAATNLAETLDAALLRPGRFDRKIAVEPPDADGRREVIEYYLSKVKHEPMPIDRMVADTIGYTPVAIKYVINEATIHAHFDGRAAINYWDFTQAREIHEWGLKQPIRSMSYEERRRIAYHEAGHALAAVKLLKKERLTKVTIVRHGNALGFAAWKPEEEIHTRTREELLDRIKISLASRAAEELFLGTQMSGVTGDLQSATGIAAMMVGAYGMDNSFFSYLLFGMQGLSAPDVKPRVEAILQEQYRIVKQMLEQNRMAVIAIAEALILRNELTDIDVKEIL

SEQ ID NO: 8898 - protein, 181 aa, Chloroflexus aurantiacus
EFVDGLRVTSPAVMDIMQMVVCGTINKRIVTALVNAGVKAIGLSGLDLGLLRCEPYRPAGRDLGRVGEVTAVDGAALLHLLALGWMPVIAPVALGATDGLSYNVNADMVAEAVAGALAGAELVFVSNVPGVLVDGRVVPALTPAAVEELIANGVISGGMIPKVRAALAALQRGASSVRIVN

SEQ ID NO: 8899 - protein, 424 aa, Chloroflexus aurantiacus
KYTIIVVGSGLAGASAAATLGEAGYNVLCFCYQDSPRRAHSIAAQGGINAAKNYRNDGDSIYRLFYDTVKGGDFRARESNVYRLAQVSVNIIDQCVAQGVPFAREYGGLLDNRSFGGAQVARTFYARGQTGQQLLLGAYQALSRQIAAGTVKMFPRTEMLDLVVVDGRARGIITRDMVTGKITRYAADAVVLATGGYGNVFYLSTNAKGCNATAIWRAHRRGAFFGNPCFTQIHPTCIPVSGEYQSKLTLMSESLRNDGRIWVPKKKGDTRRPQDIPESERDYYLEERYPSFGNLVPRDIASRAAKQVCDEGRGVGPGGLGVYLDFADAIKRLGRQKIAERYGNLFDMYKQITGEDPYETPMRIYPAVHYTMGGLWVDYNLQSTIPGLFVIGEANFSDHGANRLGASALMQGLADGYFILPYTI

SEQ ID NO: 8900 - protein, 350 aa, Chloroflexus aurantiacus
MKGLVLSGGKGTRLRPITYTSAKQLVPVANKPVLFRVIEAIRDAGITDIGIVIGDTGDEIRSAVGNGRRWGVKISYIPQEAPLGLAHAVKISRDFLGDDRFVMFLGDNCIQGGISPLIEQFGRSDYNAQIVLKKVSDPRSFGVAELDDEGRVVRLVEKPREPKSDLALVGIYMFDHHIFEAVEAIRPSARGELEITDAIQWLVSNGYNVYPYVHEGWWIDTGKKDDMLEANRLVLEELEPSVQGYVDRDSQLIGKVIIEPGAEIINSTIRGPAIIGEHTRIVNAYVGPFTSIYHHCHIEECEIEHSIVLEYCTIRGLPHRLEDSLIGRNVEIGRSPLRPKAYRFMLGDNS

SEQ ID NO: 8901 - protein, 316 aa, Chloroflexus aurantiacus
IRVFITGITGPVVSFLSDYLLTIPGVDIHAFKRWRSDPRPIEHLIGRITIHEGDIVDAFAIDRAIATARPDRIFHLAAQSYPSASWDAPILTMRANVEGTINLLEAARRHVPKARIHIAGTSAEYGPVRPDEVPISEDHPLRPASPYGVSKVAAELSGLQYHASYGLHVVVTRSFNHVGPRQGDRCSIQTFCRQMALIEAGQQEPVMYVGNLSPKRDFTHTRDVARALWLLLEHGTPGEVYNLCSGQAVRIGDIVDMVIAMGRVPVTVQVDPARLRPVDEPILQGDNRKLRAATGWQPEIGIEQIVAEVLDYWRQQ

SEQ ID NO: 8902 - protein, 718 aa, Chloroflexus aurantiacus
EVLREVRGAQRVTSPTPEGTYAALEQYGRDLTELAARNKLDPVIGRDEEIRRVIQILSRRTKNNPVLIGEPGVGKTAIVEGLAQRIVRGDVPEALKNKRVIALDLGALIAGAKYRGEFEERLKAVLKEIQERDDIILFVDELHTVVGAGAAEGAMDAGNMLKPMLARGELHMVGATTLDEYRKHIEKDAALERRFQPVMVDPPSVEDTISILRGLKERYETHHGVRITDGALIAAAMLSDRYISDRFLPDKAIDLIDEAAARLRMEITSDPQELDDLKRRIMQLEIEREALRKEKDQASKERLEKLEQELANLREQRSALEAQIQRERQELERIQQLKEKIEQTRAAIEQAQRQYDYNKAAELQYGTLVSLERELQAAEAQLGSQSRLLRQEVTETDIAEIISKWTGIPVTKLLEGELEKLVHMEERLHQRVVGQDEAVIAVSNAVRRARAGLQDPNRPLGSFLFLGPTGVGKTELARALAEFLFDDEQAMIRIDMSEYMEKHSVARLIGAPPGYVGYDEGGQLTEAVRRKPYSVVLFDEIEKAHPDVFNVLLQVLDDGRLTDGQGRIVNFKNTVIIMTSNIASTTIQELTRAGAGQSEIRAAVMEELRGVLRPEFLNRIDEVIVFSPLSREHIDRIVEIQLNRLRKLLADRKLNLVLTDAARAQLAAEGYDPVYGARPLKRVIQQRIQNPLALQLLQGAFPEGSTIVVDVENGTFVF

SEQ ID NO: 8903 - protein, 372 aa, Chloroflexus aurantiacus
GMRIALYNLTTTTKIGGVESYVWDLARELAQRGHAVDILGGVGNQTRNGTGSTCAYLPIYFASLLAGVPAAAPAYAEAKLLERLTMAVAALPTLVREKYQIIHLQKPYDLAPALLARRLSGARVILGCHGEDFYRGDTWLARRVDAAVSCSRFNAQTIAGRYGFMPEVVFNGIDTSLFRPQPPDPTLRERLGVSSTVPLLLFVGRLQPWKGVETAIRALCHIDQAILVIAGDGEDRPRLAAIARELGVSERVRFLGSVPRQHLPALYATVDLLLATSYASETFGIGPVEAQACGLPVVATRFGGFPEVVAEGQTGLLVPPRDPAALAAAVNSLLSDPARRAALAAAAPAWAAQFAWPAVVDRIEAVYRAVLQ

SEQ ID NO: 8904 - protein, 290 aa, Chloroflexus aurantiacus
FPLLAMVGQTELKTALILGLINPQVGGILLSGPYGVGKTTAVRALIDLMPFVTREPPDADGKTIVERMRLIELPLNARLEDVVGGINERVALEQRIVRLEEGILARAHGNVLYVDEINLLDQAVVDAILDAAAQGRTFVRRGAMVRLFPSQFVLIGSMNPEEGALRPQILDRFGLRVWVAPVNDQRARLEIYRRARDFRNDPAGFRQAYAAQTAALAEEIMIAREILPHVTIPPELEEQALALVQQLRIPSHRAEIALLEGARARAAADFRNVVNAEDIRRIAPLALTWR

SEQ ID NO: 8905 - protein, 157 aa, Chloroflexus aurantiacus
AYADSPLGRVLVAATDSGLCAVYLGDDDAALLATLHASFPVAGTAAGVLAETAASAIAAYLRNEAPLPAFPLDPIGTPFQQLVWQALCTIPRGSTRTYGQLAQELGLPTGAARAVGRACASNSLAIVVPCHRALGSDGRLHGFRWGIERKRALLALE

SEQ ID NO: 8906 - protein, 358 aa, Chloroflexus aurantiacus
HNFNPGPAALPPDVIARAQAELADYHGCGMSVLEISHRSKEYEAINAAAEANLKALLGLGDDYRVLFMQGGASMQFALIPLNLLPAGATAEYIVTGTWGEKAYEEAQRVGAVRLLASTAADGYRSLPSIDAITPDPQAAYLHLTTNETIQGVQWPAELPDLGSVPLVADMSSDFLSRPFPAQRFALIYAGAQKNLGPAGVTVVVIRQDMIERGRKDLPVIMRYATFAKNNSLYNTPPVFAVYMVNLVLEWIKDQGGLAAMAERNARKAALVYAAIDGSDGFYSGHAVPAARSLMNVTFRLPTPELEKQFLNEAQAAGMVGLAGHRSVGGIRASLYNAVAPESAAALADFMQDFAKRHG

SEQ ID NO: 8907 - protein, 613 aa, Chloroflexus aurantiacus
SMNDNRWLKNSFVYLIILVAALALFFQYFGQGASQTEEKGIADVIADAQVGLVSEIQAQAGDEQIIVTYKDGKKYRSRVETSDSVMQLLADYNVPLYDENGRRTINVTVQPAPAWGGLLSIFTILLPTLLLIGFFVFFMRQAQGSNNQAMSFGKSRARMFAGDKPTITFADVAGQEEAKQDLAEIVEFLKFPDKFAALGARIPRGVLMVGPPGTGKTLLSRAVAGEAGVPFFSISGSEFVEMFVGVGASRVRDLFDQAKRNAPCIVFIDEIDAVGRQRGAGLGGSHDEREQTLNQILVEMDGFDTNTNVIVIAATNRPDVLDPALVRPGRFDRQVVLDAPDVRGRIEILKVHVKGKPLAEDVNLEVIARQTPGFSGADLMNVVNEAAILAARRSKRKISMAEFQDAVERVAIGGPERRSRVMTDRQKLVVAYHEAGHAIVGAALPKADKVQKVTIIPRGQAGGYTLFLPDEDSLSLRTVSQFKARLAVSLGGRVAEEIVFGNDEVTTGASGDLMQVTRIARAMVTRYGMSQRLGPMVFGEKEELIFLGREISEQRNYGDEVARQIDEEVHAIVTEAYETAQQILLQNRAVLDDMANALLEYETLDGEQLEEMI

SEQ ID NO: 8908 - protein, 235 aa, Chloroflexus aurantiacus
MIEAIQLGKQFGDFVAVRDLNLVVQPGELVALLGPNGAGKTTTVRMLAAILPPGSGQARICGYDVVSHAQRVRGMVGLLTEYPGLYGRMAALEYLAFFGALLGVEATLCRQRSEALLRQFGLWEVRDRQLESFSKGMRQKMALIRALIHDPPVLFLDEPTTAMDPQSARTVRDAIGELRSAQRSILLTTHNLSEAEELADRIAIIRGGQIIACGSFAELSRQLLGEPAFELKLTN

SEQ ID NO: 8909 - protein, 849 aa, Chloroflexus aurantiacus
  unsure (1)..(849): unsure at all Xaa locations
SKRMSGRTTANEHDLLSANIRALGDALGRVIIGQHGSEALALVEQVRRMAKDLRNAPTNTDPQALPQLIADLDLPQLRSLVKAFTLYFGLVNLAEGVERLRVLRARDLRHAPAPRAESIADAIELLKRHGVPAPAIQEWLDHALIMPVLTAHPTESRRRTILIKLRRIFDTLVDLTFGERLVLPADRQAALTRIEREIVGLWQSDDVRNRRPSVLDEVENGLFFFQTVLWELLPHIYREMSDALQAAYPDHPWRLPPFLRFGSWMGGDRDGNPFVTPEVTVETVRLMRSAMLRYLIDCLDRLITDLSQSVQQVKVDTAIIDRIAEYRELMPDAAATLNPHYRCEPYRQLCHFIQARLHNTLQYTLDYTPRWGIDPPLARRPDIYYHSRELLADLDLIDASLRNNGSTLIAEGLLRDVRTLVAVCHLHTATLDVRQHASRTHTERSAAAVWSTIYEALDGRRIAVLSVEIRRPRPLTPTDQSFQSATRKTIHTFRSYASATADPEIFQTYIIRPPVSSDLLAVLLLCRDAGLYQPGQASQLHIVPLFETGDDLQRAPALLDELLRLPVYREHLALRDNLQEVMLGYSDSNXEGGFVAANWALYRAQVELTAVTDRHGVRLRLFHGRGGAVGRGGAVGRGGGPAGQAILAQPPGTLHGQIKVTDQGEMISDRYLDPRTAHRHLEQVVNAVLRAGFPGMARQPEPTWLAAMEEMATTARTVYRQLVYEDPDFLIYFRSATPVAEFNRLLVGSRPVSRRKSDRIEDLRAIPWVFSWMQSRHTIPGWFGLGSALEAFVEADPHHLHLLRTMYQHWTFFSTLLDNAQMIMLKGDLTFPGFASLVRIVIWRTDFHG

SEQ ID NO: 8910 - protein, 202 aa, Chloroflexus aurantiacus
MRLILVRHGETPWNQTLQYQGHAPIPLNERGREQARRAGIRLVRSGAVALYSSDLPRAWETAEIIGSHVNLQPVAMPDLREIDVGLWEGLTPDELYQRFPDHMREYDRDPARTVRLGGESYAQLQARVLRAFARIEAAHRNGETIIVVSHGGSIRALFCHIIGLDLANFSKLWLDNGSLSEIVRGRSGWRLLRMNDVAHLEE

SEQ ID NO: 8911 - protein, 222 aa, Chloroflexus aurantiacus
TYGDHADTIILMAMTDPSKGTKGITAFLVDTHAPGCRVVKVENKLGIRSAHSCQMAYDDYRIPAWRRLGEEGQGFKIAMTILNAGRIGIAAQAVGIAQGAFEAALEYSKVREQFGKPIHEFQAVGFTLADMATRIKAARLLTYEAAWRKDQGLDFIKDASMAKLFASETAMWVATKAVQLHGSNGYSKEYPVERFFRDAKITEIYEGTSEIQRLVISRELVR

SEQ ID NO: 8912 - protein, 518 aa, Chloroflexus aurantiacus
MTTITEELIARLKQGITSGVDLQPRQVNVGTVIAVGDGVARLSGLDQVVASEIVEFPPKAGRNESIYGIALNLEQDSVAAIILGDDETIEEGDMVTSTGRVISVPVGQGLLGRVVNPLGQPIDGKGPIVYEKTRPIERIAPGVITRKSVDTPVQTGIIAIDALIPIGRGQRELIIGDRQTGKTAVAIDTILNQKGQGMVCIYVAIGQRRAQVAQVVGTLERFGAMEYTIVVSATASESAALQYIAPYAGCAMGEEIMENGVMLNGQLVKDALIVYDDLSKHAVAYRQVSLLLRRPPGREAYPGDVFYLHSRLLERAARLNEEYGGGSLTALPVIETQANDVSAYIPTNVISITDGQIYLESDLFNAGQRPALNVGISVSRVGGAAQTRAMRAVAGKLKGELAQFRDLAAFAQFASDLDATTKAQIERGQRLQELLKQPQYQPLPVEDQVAVLYAATNNYLDDVPVPLITKWRDDFLAFLRTAHPEVRKLIYDNRLDRKFPTPEVKEALEAAIKEFKAT

SEQ ID NO: 8913 - protein, 293 aa, Chloroflexus aurantiacus
  unsure (1)..(293): unsure at all Xaa locations
MPSSREIKRRIRSVKNVAQITRAMEMVSASKMRRAQRNVLATRPYADRMREVMANLTARVVGAARRGTLLEKRETVKSVALLVVTPDRGLCGSLVANVLRRAGRFITEQRAMGRTVDVYTFGRKGRDFFLRTGFAPAGEATRLGDAPKLEAILGVAISAINGFQSGKYDELYIIYSEFINTLVQRPAIKQLLPVESPDISTTTNVDYTYEPGEEEVLNSILPRYVETQIYQAVLESIASEHSARMVAMRNATNNAKDLVRDLTLSFNKARQAAITKEVSEIASGAAALTSXXQ

SEQ ID NO: 8914 - protein, 316 aa, Chloroflexus aurantiacus
AKGVIQEIIGVVIRAKFPEDEVPEIYNAIEIPLGNGDRLVCEVQQQLGNGVVKAVAMGSTDGLRRGLEVIDTGRPIAVPVGPATLGRVFNVLGDPIDGMGPIGPEVERRPIHRDPPSFEEQNTQAQIFETGIKVIDLIAPFTRGGKTAIFGGAGVGKTVVIQELIANIAKEQSGFSVFAGVGERSREGNDLIHEMKEARIDENTTVFDKTVMVFGQMNEPPGARLRVGLTALTMAEYFRDEGRDILLFIDNIFRFVQAGSEVSSLLGRMPSQVGYQPTLGTEMGELQERITSTKRGSITSMQAVYVPADDYTDPAP

SEQ ID NO: 8915 - protein, 786 aa, Chloroflexus aurantiacus
PNPMQRPPMPEIPDVLPVLPINNAILFPGMFLPLVVSGEAWVRLVDEAALSTKIIGVFRRIQSGAEFEPEMLAQTGTAALIVRMMRLPQGGVQLLLQGQARIKVQRWVTVKPYPQAHVTVALDPVDVSMETTGLARAVLAGFQQIVEQSPNLPDELAIAAANAPHPGMLADLIAANLNLNLDDQQKVLDTFDVHERLQLVLRLLEREREILLIGRKAQEEVSKNQREYVLRQQLEAIKRELGETDDHAAEIAELRRRIEEANLPAEARQEAERELLRLERMPPGAAEYTVARTYLDWLLDLPWHTSTEDNLDITQARQVLDEDHYDLERIKERIIEYLAVRKLRREEGADNEARGPILCFVGPPGVGKTSLGASIARALGRKFVRVALGGVRDEAEIRGHRRTYIGALPGRIIQGLSRAKSNNPVLLLDEVDKLSIGFQGDPAAALLEVLDPEQNVAFVDRYLDVPFDLSKVLFVCTANRADTIPPALLDRMELLELAGYTEQEKLEIARRYLIPRQRREQGMTNRGPELTTAALQRLIREYTHEAGVRDLERRIGAIYRKMATRLASEQTLPDQVDAADLDDLLGPPRFRSETILGDNEVGVVTGLAWTPTGGDVLFVEVSVIPGNGQLILTGQLGDVMKESARAALTYARSRASALGIDPEVFQKSDIHIHVPAGAVPKDGPSAGITIASALISALTRREVDKRIAMTGEVTLRGKVLPIGGVKEKLLAAQRAGVRKVLLPTENEIDLRDVPAETKEQLEIVLVKHMDEVLHELGLEIAPQPVS

SEQ ID NO: 8916 - protein, 414 aa, Chloroflexus aurantiacus
VAMIMAGGEGTRLSVLSEKRAKPSVPFAGKFRIIDFTLSNCVNSGIFDVAVLTQYRPHSLNEHIGIGKPWDLDRARGGVRLLQPYQGRRDESWYRGTADAIYQNLNYIQERRADLVLILSGDHIYKMNYNDIIKTHLQKRADLTVAVMEVPIEETDRFGIMTTDEHDRIIEFTEKPKARDKGNLASMGIYVFNADILIRRLSEGGPEKPRIDFGKDVIPAMVAEDRVFAHRFKGYWVDVGTIQSYWETSMQLLDPSLDFDLFDPNWLIRTRSEERPPAKIGPQAKVTQSIICNGCTIRGTVIHSVLSPGVYVSPGAIVRDSVVMNDTWIGPGAVLDRVIVDKKVVVGAGARLGFGDDLTVPNRKQPDKLNSGVTVVGKSAHIPAGITIGRNVVINADRDAEDFPAGDVPSGETI

SEQ ID NO: 8917 - protein, 401 aa, Chloroflexus aurantiacus
MIRTLVMILAGGDSPALSVLTAERTEAAVPFGGKYRIIDFALSNCVNSGLYNVAVLTQYRPRSLHAHLGVGRPWDLDRAQGGLRLLHPSPTPDGGGWQRGTADAVRYNLDFVEDQQVDAVLLLAGDHIYKMDYGPLLKLHAEQEADVTMAVRSVSPHDAHRYGIVSVGSDGRVDRFVEKPRRADSNLASMGIYVFRKQFLIDLLRSTDAVDFGRHLLPQIVSSARAFAYNFQGYWADVGTVQAYYEANLALLAETPALDLYDPEWVIHTVSSDRPGAEIGVQARVENSLLSDGCRVYGTVIGSVLSPGVVVAAGAVVRDSVVLGDAVIEAGAVLDRCIIDEGVRIGEGAHVGFGDDNTPNAEAPERLNTGLTLVGLKAQIPAGVRIGRNVAIKPRTQPAAF

SEQ ID NO: 8918 - protein, 365 aa, Chloroflexus aurantiacus
IRVAMLARAVFPLHGYGGIERHVYHLTKYLTRLGVEVTLYVQSPPDNAEQGDLQPHAIETLRYDYTSPLLAPNGVIGRQINFPIYSWRIGHRAARRVQHGDFDVVHSQGLCAFGYAVARNRITLLRSVPFVANPHGMEEFRTPDRRKWLAYAPFRWLYAYGHRQADRVIATDACTKDDIPHYLRVDPDRVVVIPSAIDVEECLAQVRSELRTALRFRFGLGSSDPILLSVGRLEPNKGFDILIAALARLRNELPPRWRWIVVGNGSARAALEQQAQAAGIAEHTLFVGRLNDEELHSLYEEIDLFVHPTRYEGSSLVTLEAMIHRRPVVASAIGGIPDKVFPGRNGLLVQPGDVDDLTGPVQGGL

SEQ ID NO: 8919 - protein, 313 aa, Chloroflexus aurantiacus
LGNERLREWVLRMQIIRAFEEKAEELFARGLVHGTMHLSIGQEAVAIGASAAMKPGDYLLNHHRGHGHCLAWGSDVRLMMAEFLGKETGYCRGRGGSMHIANVEMNNLGANGIVGGGIPISVGVGLSIKKRRSSQVCLTIFGDGAVNTGAFHESLNMASIWNLPVVYLCENNQYAMSMPIQKACRLNHLSQRAAAYAIAGITVDGNDALAVYEAVRQAVARARSGYGPTLVEAITYRWKGHSKSDRQAYRSRDEVKDWQSRDPIMRLARLIQMSDAEFKAIVDQARTMIEEAVEFAQASPEPDPDTIFEGLYA

SEQ ID NO: 8920 - protein, 730 aa, Chloroflexus aurantiacus
AAERLRRDHKVDLSLAIYDAATLSNAAGWAKLDRDLARADLVFGARLFSEDLVRPLVERLAHFERPTLIITSNPALIRCTRIGGFSLRRESENEPGPLRRWVQKLRPQGGAGEARRQLAILRNLSKVLKVIPGTSRDLYTYITSHQYWLNASPENLYRLLCVLIGRYGPSPRPKLPQLDPLTYPDTAIYHPDAPDLFTSLNDYYRWRGKRIPSAGKVGILTLRTVVLSGNTPHIDALARAIEARGLEARVAYAAGLDLRPLLDKELADVDLLVNATGFALVGGPAESQPQQAAEALTRFDRPYLSLVPLAFQRIDDWRADDNGLVPVQQALSVAIPELEGAAEPLIFGGPAADGQRFAPAQAEIEQIADRIARRVALRRMPNAQKRLAVVIYNFPPALGTVGTAAYLDVFASLFRLLQALAADGYQVEVPESVDALRQLLLADGPAHGADAHIADWLSADEYRRLFPAYTDIEPYWGPAPGDLLRDNRGIRILGRQFGNVFVGVQPSFGYERDPMRLLLAKDAAPNHAFAAFYTWLIHKFRADAVIHLGTHGAMEFMPGKQVGLSARCWPLRLIGPLPNFYVYSVNNPSEAAIAKRRGAATLVSYLVPPVQQAGLYKGLRTLRDAIDQFERHPDPALVSDVRERAAQLGIPMAASGDDYADVAGLAHELLRIEQRMIPLGLHVLGQPPAPAELADFLLLYASLQPDGGLPALIARGMGMITLIYARTYRR

SEQ ID NO: 8921 - protein, 256 aa, Chloroflexus aurantiacus
MGLMEGKKGLILGVANDRSIAWGIAQALHREGATIGFTYLGEALERRVRPLAESLNSPLIVPCDVSKDEDITALIEQARETFGQIDFLVHAIAFANKEELSGTILNTTREGFRIALEISAYSLIALVKAAEPIFAPDASVLTLTYHGARQVIGSYNVMGVAKAALEASVRYLAAGLGPRGIRVNAISAGPIRTLAASGIANFRSLHKHFAEYAPLRRNVTIEDVGNAALYLCSPLAAGVTGEIHYVDAGFNVVVPG

SEQ ID NO: 8922 - protein, 230 aa, Chloroflexus aurantiacus
SGLQYVEIQAGDGEQPQPGAIVAVHYRGMLADGSVFDSSYERGEPIRFPLGVGMVIPGWDEGIGLMRVGGKARLIIPPHLGYGAMGYPPVIPPNATLTFDVELVEVLPGPPEAPQDLPADRYTTSASGLQYADLTVGDGATAMAGRTVTVHYTGWLTDGSMFDSSLSRGEPFVFPLGAGRVIRGWDEGVAGMRVGGRRQLIIPAALAYGNRGAGGVIPPGATLIFEVELL

SEQ ID NO: 8923 - protein, 185 aa, Chloroflexus aurantiacus
HIPGLKVVMPATPYDAKGLLIASIEDNNPVIFIEHKLLYKTKGVVPEDIYRVPLGKSHVVRQGRDVTIVATSVMVQRALEAAEQLAREGIEAEIIDPRTLRPLDDEPILESVVKTGKVLIVHEAVKMAGFGGEIAARIAESTAFDYLEAPICRLGGLDIPIPYNRTLEYHAVPQIENIIAAARDL

SEQ ID NO: 8924 - protein, 461 aa, Chloroflexus aurantiacus
  unsure (1)..(461): unsure at all Xaa locations
MVREVIMPKFGFTQETAEIVRWIKREGDLVDIGEPIVEVTTDKVNMEVEAPARGVLGNVRYREGDVVPVTEVIAYIMPLEEVGVQSASQSGTDHHMVVNSAPSQRSEPKATPLAERVARTVGLSLDRIQWXWSKRTNPSSXRRKHSTAVINEKVRAVPAARRLAREAGIDISKVKGTGPHHRVQSSDVQNYLATRSSLDATFTTSGPIKQPEDVVTSSTITGDTQTQSGYRKLPLTGMRRTIARRLQRSAQEAPHIQLEVRVDVTEVEALRAKANRHHLDEQPKVSLTAIFVKSAAWALKRHPYLNAWLQSIGHEEQIVLVDEINIGIAVALEQGLIVPVIRKANEKGILQIAREIDDLSQRARTDKLRPDEVVDGTFSISNLGMFGIERFSAIINPPQVAILAVGAVCREVVADENNGISVRPLVKLTLCVDHRVVDGAVAAAFLHDLKVVLEDPQVMLL

SEQ ID NO: 8925 - protein, 405 aa, Chloroflexus aurantiacus
TVQQFAFPTGFLWGAATSAHQVEGNNINSDSWVLEHLPDTIYAEPSGDACDYYHRYPEDIALLAQLGFNAYRFSIEWARIEPEEGEFSFASLEHYRRMLATCHEHGLKPVVTLHHFTSPRWLIRAGGWLDPKTPDRFVRYCERVVHYLGDLIAGACTFNEPNLPVLLSKIMPASPLASPFWRAAAAEFAVTPDRLGIFQFVSQPRMREIIFAAHRRAFEVLHDGPGSFPVGMTLALVDIHAGPDGERMAAEFRRELAEVYLEQLREDDFVGVQTYSRLVVGPAGIIPPGDDVEKTQTGEEYYPEAIGGTIRHAAAVAGIPVVVTENGLATTDDTRRVEYFRRALRSVAECLIDGIDVRGYFAWSALDNFEWISGYKPKLGIIAVDRTTQARTPKPSAYWLGNVAR

SEQ ID NO: 8926 - protein, 423 aa, Chloroflexus aurantiacus
MSRTRNSGRDPYACSFCGRGQDEVQRLIAGPGNVFICDECVALCSAIIAEESDQKAPNARRSTPPGPTRLPTPRKLRERLDQYVIGQDRAKIALAVAVYNHYKRVRAGARIDDVEISKSNILLIGPTGSGKTLLAQTMARLLDVPFAIADATALTEAGYVGEDVENILLRLIQAADGDLERAQTGIIYIDEIDKINARKADNPSITRDVSGEGVQQALLKILEGGVAHVPPLPGRKHPQQEYIPFDTTNVLFICGGAFEGITKIIAKRLRGKQLIGFGSNPVNPVEEEGALLAQITPDDLMHFGFIPEFVGRLPVIVALEPLSREAMLRILTEPRNAIIKQYQKLFALDHCELEFTPDSLEAIVDRAMAARTGARALRSIVEEVLLDVMFELPSQEHIGRCIVTAEVIQGRGRPILVPRADYR

SEQ ID NO: 8927 - protein, 591 aa, Chloroflexus aurantiacus
QNAERFGDKVALREKDYGIWQTVTWRQFADHVRAFAMGLHALGVRRGDVIAILGDNRPEWLYAEFAAQTIGAMSIGVYQDSVAEEVYYIVSAAGARVIVVEDQEQVDKIIEIWPRLEGVLKVIYYEPKGMRNYRQPYLADFPSIEELGRTYDREHPGLFEAELAAGKPDDVAILSTTSGTTGKPKLAMLTHRNMISQGAGLLSVDPLGPDDEFVSFLPLAWVGEQMVTVAAGMQCGFTINFPESASTVQENIREIGPRVMFSPPRIWENMLSQVQVKIQDSTPLKRAIFEWAMRQGYEMADTRFSGKQPDLWLRLRYGLARLLVFEMLKDHLGLRFLKRAYTGGAALGPDVFRFYHAIGVNLKQVYGQTESAGLSVIHRDGQIKFQTVGTPLPNTQIRIAENGEILVKSPSVFVGYYQNPEATAEALEDGWLHSGDAGYFDEDGHLIVIDRAKDVMTLHDGTKFSPQFIENKLKFSPYIKEAVVFGGDWPFVTAMINIDFANVGKWAENAQISYTTYTDLAQKPQVYALIRKDVERANADLPPAARIRRFLLLHKELDADDGELTRTRKVRRRLVAQRYQEIVDALYSDQD

SEQ ID NO: 8928 - protein, 316 aa, Chloroflexus aurantiacus
KRALITGITGQDGSYLAEFLLARGYEVIGMVRRSSTVNFERIRHIQDKITLVSGDLLDEVSLIHILREHRPHEVYNLAAQSFVQTSWPQPVFTGETTALGVTRLLDAVRIVDPEIRFYQASSSEMFGKVVEVPQKETTPFYPRSPYGVAKVYGHWITVNYRESYGMHATSGILFNHESPRRGLEFVTRKISHGVARIKLGLDEELRLGNLEARRDWGFAGDYVEAMWLMLQQDQPEDYVIATGETHSVREFCELAFGYVGLDYRDYVVIDQRFMRPAEVDLLIGDASKARQKLGWQPRTTFPELVQMMVEADLQLV

SEQ ID NO: 8929 - protein, 444 aa, Chloroflexus aurantiacus
NPTIFKAYDIRGIYPTELNEEVAYLIGRAFVTFLGAETVIVGRDMRTSGPALFDAVTRGIMDQGADVADIGMVSTDQYYFACTQLGFPGMMVTASHNPKQYNGFKMVRRMPYLLSGDEGIQDLRRLVESEAFPTPTRRGQRREYDFKEQFVQKVLSLIDVDAIKPLKVIVDTGNGMVGPILQEVYARLPIQLTGMYLDPDGTLPNHGLDPLMPENRAELQQRVKDEGADIGFAFDGDGDRFFAIDDRGEFISGDFLTAILGRYLLEKEPGAKILYDVRASWAVPDEVRAAGGVPLVERVGHAFIKRRMANEDAIFAGEVSGHYYFKAFAFADSGIIPSLYLLEMLSKRGVKMSELLGRLESRYFISGEINSRVSDVAAKLNEIAERYSDGKIERIDGVSVSYDTWHFNVRGSNTEPLIRLNLESIASREEMEAKRDEVLAVIRS

SEQ ID NO: 8930 - protein, 551 aa, Chloroflexus aurantiacus
YVQRTMLRRWVSIARRFRMMAVELGGMQIKLGQFLSSRADIIPDVVRRELTGLQDEVPPAPAGHVLEVILEELGAPPSEIFRSFETDCVAAASLGQVHYAVLHDGREVAVKVQRPWIDKIVEVDLSAVTWVVRLIKNYPPIRRRADLEALLAEFARVLVQELDYVQEARSAATFRQNFANHPGIYIPEPIFELTTRRVLVMERINGIKITDLHTLDQLGVSRVELAARLNNCYLKQFFIDGFFHADPHPGNLFVRVETALAPVQPSPPVTSVSRNGHLSMDAVEAGLPIDTPPDEVPAGTPFTLIFVDFGMVGRLPPQTMEIMRQGVLGLATNDADRILNCLEQLNMILPGADRRAIKTAIETMLRYSFNRTVRELTNLDVEAIMAETKDLIYDLPFQIPQDLLYLGRALSMVAGLATEICPDINLFHELRPFARAMLAQEQRNGNWVEKLQQELTELGQILIGLPRQMDAYYRAANRGELQTRSDLSRLERSMKRVERATDRLMGGMLATGLFLGGVQLRTRGLEREANRAWWAAAAAIVWALWPRNERW

SEQ ID NO: 8931 - protein, 440 aa, Chloroflexus aurantiacus
GEAIQISNGRLQVPDHPIIPFVEGDGTGRDIWRASVRVFDAAVALAYGGKRKIEWLEVLAGEKAFHETGNWLPDETIETFQKYLVGIKGPLTTPVGGGIRSLNVALRKHLDLYVCQRPVRHFAGVPSPVKHPEKVDMVIFRENTEDVYTGIEYRGGSEEAAKIIAFLQREFPKDFDKIRFGTPEKTDEFRQLIGEEPEGKIEVGIGIKPISRIGTERIMAAAIQYAITYKRKSITLMHKGNIQKFTEGAFRDWAYEYAERAFGDYVYTWAQWERTKAARGEAAANAEQKEALAAGKILVKDAIADIIFQQVLTRPDEFDVIVAPNLNGDYLSDALAAQVGGIGIAPGGNINYVTGHAIFEATHGTAPKYADLDKVNPGSVILSGEMMLRYMGWTEAADLIIAGLERTIADKTVTYDFARLMEGAREVKTSEFASLIIANM

SEQ ID NO: 8932 - protein, 825 aa, Chloroflexus aurantiacus
  unsure (1)..(825): unsure at all Xaa locations
RFTEKAQNAFHIAQEIMQEHQHSQLDVEHLFLAMLRQRDGLAARALARLNVDPHEVERRVERELEKLPKILSPYGMGSQVYITPRTQRLVKRAEEEANRLGDQYVGLDHLLIGLANERDGPSARILQSYQIDQERIYQVLMEIRGSQRSDDPSAESRYEILSKYSVDLTELAREDKLDPVIGREAEITRVIRILSRRTKNNPVLVGETGVGKTAIVEGLAQRIARGDVPPTLRDRKLLALDLAGMVAGSKFRGEFEERLKAVMDEVRNAKGRIILFIDELHTVVGAGAATGSIDASNMLKPALSRGEIQVIGATTIDEYRKHVEKDAALERRFSPVFVEEPDPETTVEMLRGLRKRYEEHHQLTISDEALRAAVQLSSRYINDRFLPDKAIDLIDEASAKLRIDIFSMPPELKAKEEELTRLQAEEEEAGARRDYERAALLRSRYLALQAQFEAERNEWLARNNLDEVVDDEDVAQIVSSWTGVPVSRMLETEREKLIHMEERLHERVIGQHEAIVALSDAIRRARSGLRDPRRPIGSFLFVGPTGVGKTELARALAEFMFDSEEAMTRVDMSEYQERHTVSRLIGAPPGYVGYDEGGQLTESIRRRPYQVVLFDEIEKAHRDVFNALLQVLDDGRLTDGQGRTVDFRNTIIIMTSNAGTEHLQGGGIGFNVGGKNAKTIDMREARKKVDEALRQTFRPEFLNRIDEIILFHPLSMDDLTRIVELQIADLVERLREQQIGLSLTQAAKEYLVQEGYNPVFGARPLRRTIQRLLETPISRELLRGMFRAGDQIEVDVENGQLVFHRGGILTMEEHRPAEPLDAXTV

SEQ ID NO: 8933 - protein, 473 aa, Chloroflexus aurantiacus
MRRTKIVATLGPATSTPERIAGLIRAGMNVARLNFSHGTHAEHAARIAMVRRAAAEAGRHVAILQDLQGPKIRTGPLENGQPVELVAGQRFVITTEPIVGDAHRVSTTYRALPLDVRPRDRILLSDGLIELVVTGHTDTEVETEVVHGGRLREHQGINLPGVRVSAPAATEKDLADLAFGLEQGVDYVALSFVRRASDVREVKEFIRRAGKQTPVIAKIERPEALDVLPEILAEADGIMVARGDLGVEMPPERVPIVQKQIIAAANQALLPVITATQMLESMIHNPRPTRAEASDVANAIIDGTDAVMLSGETAAGAYPIEAVQMMALIADAVEASYTGGQHSTTPRWSIAPAQSTPRAIAAAACTIANSLPVRFIVVLTQSGASARLVSHYRPEVPILAFCPSEETARRTSLYWGVTPIVIEARDRLDELEQQIVRMMRETGMVRKGDLIVLSGGHPVYRYGPTNFLKVITI

SEQ ID NO: 8934 - protein, 248 aa, Chloroflexus aurantiacus
GKIAIVTGGAQGIGRATALALAREGAAVVIADRDEAATTALVSGINAWGGRALAVIADVSDEADAARIANETVLTFGGIDLLVNNAGIQQPGTIESTTVQLWQEIIAVNLTGVFLVSRFVMPELRRRGGGAIVNVASVYGLRAEAGWAAYSASKGGVIALTRAMALDGAADGIRVNCVCPGMIDTSLLRANAALLNAQRPDEALRSFARRVPLGRLGTPEEVASVILCLLSPTAGYLTGAVITADGGW

SEQ ID NO: 8935 - protein, 872 aa, Chloroflexus aurantiacus
RWHALELTDVFTHLNSSPTGLTPDEAAKRLSIYGPNELQAAARVSPWTLLLNQFKNVLIIILLIATGLSLLLGHGIESVAIIVIVLFAVLLGFIQEYRAERAIEALRRMAAPNATVLRDGIEQSVPAHTLVPGDVVLLRAGDRVPADLRLIEALNLQVEEAALTGESVPVEKTAAITLPAEAPVAERRNMVYAGTSISYGRGRGVVVATGMQTEFGVIATMLQTIETGRTPLQDNLDRVGHILARSALVIVAVITLLGFWRGQPPVEMIIFGIALAVAVVPEALPAVVTISLAIGVQRMVKRNALMRRLPAVETLGSTSVICTDKTGTLTKDEMTARRLFVAGRWWDITGSGYDPVGEFRCDDRTTPADEAVRRLLEGAVLASDARIVYREQRWHAQGDPTEAALVVAAIKAGLVVEEVVSRAPRIAEIPFSSETKRMITLHEVEGERVAYAKGAPEVIVSACSHWLTPNGVAPLQPEDRDTILQAAQTMASRALRVLAVATKATADVADAEHDLTLLGLVGMIDPPRPEAKAAIQTCQQAGIRVVMITGDHPLTAAAIARELGLLTHGRVITGVELDTLSDEEFARTVETIDVYARVAPVHKLRVVTTLQQKGYVFAMTGDGVNDAPALKKADIGIAMGITGTDVTKEASAMTITDDNFASIVAAVEEGRRIFGNIKKYLMYLLSSNIGEITLMAGATFAGLPLPLTAVQILYVNLATDGLPALALAVDPPEDDLMRQPPRDPRRGIFTRPVVGLMLAGGLWSALVNISLFVWALQSGRGLAEAMTMTFVSLVLIQFFKAYNFRSDHLSVFHRPFANRWLNLAILWELILLLGVVYLPFLHEPFGTFPLSLIDWVIIGGVALTIVPVLELV

SEQ ID NO: 8936 - protein, 362 aa, Chloroflexus aurantiacus
ADPLELLGIDYVEFYVSNARQAAHFYRTTLGLRPVAYAGLETGVRDRASYVLERRNVRFVLTAPLLPDHPIAQHIAHHGDGVKDIALRVRDAVTAYETAVARGGIPVQAPTEYVDEHGRIIKATIATYGDTVHSFIERENYQGTFMPGFQPITTPLPVPETGIAAIDHIVGNVELGAMNRWVNYYRDVLGFSQLVHFDDHDISTEYSALMSKVMQNGTGRIKFPINEPAEGRRKSQIEEFLEYYGGPGVQHIALATGDICATVDALRAAGIPFIHVPDAYYDDLEERVGKIDESRQALQERGILVDRDEEGYLLQIFSQPLQDRPTLFIEIIQRKGSRGFGKGNFKALFEAIEREQARRGNL

SEQ ID NO: 8937 - protein, 620 aa, Chloroflexus aurantiacus
MCGIVGYIGGREATEVVLNGLQRLEYRGYDSAGIAIYHPDAGLQLRRSVGKLINLQQRVQADPPRGRVGIGHTRWATHGGVTEQNAHPHRDASGTIVVIQNGIVENYLSLKGRLIELGYQFESQTDTEVIAKLIGHYYQEQRDLVAATRQALQELRGGNAVVAFCIHEPDTLVAARLGNAGGIAIGLGDNEQFIASDIPAILDYTRNLIFLEDHDIAVVRRDEVTITRLDGTPVTRAVHSIAWDPVAAAKGDYRHFMHKEIDEQPRALMDVLRGRIDQERGLITLEDLRLDDQDLRRVRRIYAIACGTAWHAALVAKFMIENLARVRVEVDYASEFRYRQPILQSNGERDALILTFTQSGETVDTLAGMEEARRQGVPSVAIVNAIGSQAARLADGGPIYLHAGPEIGVASTKAFTSMLVAGYLFALRLAQAHGTLTPAQIREHIQALVELPGKAAQVIEQVTPVCVELAERYYRVGNALFLGRQINYPIALEGALKLKEISYIHAEGYPAGEMKHGPIALIDEGMPVVCIATRDHIYEKMISNVEQVRARHGQVIAIGHEGDELLAAKANHFIGVPATLPLLQPVLNVIPLQIFAYHVAVLRGCDVDQPRNLAKSVTVE

SEQ ID NO: 8938 - protein, 657 aa, Chloroflexus aurantiacus
RRSGFAQITPMFNRILIANRGEIAVRIIRACRELGISPVVVYSAADAGALHVRMADAAALIGPPPAAQSYLRAEAIVEAALQLGAQAIHPGYGFLSESVKLAEQCAAAGITFIGPPPSAIAAMGGKAEARALAQAAGVPVVPGYDGEDQSDERLLAEAHRIGPPLLIKASAGGGGKGMRSVGDLAAVPAAIEGARREARAAFGDDRLIIERLVLRPRHVEIQVLADQHGNVVHLGERDCSIQRRHQKVVEEAPSPALTPALRNAMGQAAVAVARAAGYVNAGTVEFILTPDGEFYFLEMNTRLQVEHPVTELICGYDLVHLQIAIAAGQPLPFRQEDVTVRGHAIEVRLYAEDPRTYLPAVGKVALFVPPQGPGVRVDAGLTSGDEVTVHYDPLLAKIIVAGADRQQAVARLRRVLREMVVLGPTTNLPLLQAIAEHPAFAAGATHTGFLSEHEGLVPPPAPPPCEVLVAAAVLTVTAEPPARDPLARVWRLGGDTIPLTFSSHGDHRLRVAPSTSGWHIHGDGWGVQTTLVYRGDHELALDIDGQRQQFFFAQADDGWLIAWRGEAYHLTRPAPLTADSVTRSGDQNAASFTAPMPGTIVRIHVAVGEQVREGQPLLVLEAMKMEHTVVAPYAGIVRRLPYQAGASVAAGAHLVDL

SEQ ID NO: 8939 - protein, 315 aa, Chloroflexus aurantiacus
TMLGVRNGFQGLIDGDIHEMDWMSVSGWATMGGAELGTNRKVPQGSELYQIARNIERFGIDGILMIGGWTGYQAIYKLYSERHIFPAFNIPMICLPATIDNNLPGSELSLGADTALNSIVSAIDRIKQSAVASRRCFIVEVMGRDCGYLALMSGLATGAERVYLPEEGISLRKLQADLDEMMRWFRAGKRLSLIIRNEKANPIYTTSFICSLFEEEGGKLFEVRQAILGHLQQGGDPSPFDRIQATRLAVRCIEFLVEHADRREPIGAFIGYRGGKVQIHQLDDMPRLMDPVHARPREQWWMSLRQMTDLLTTPP

SEQ ID NO: 8940 - protein, 477 aa, Chloroflexus aurantiacus
ISSDNLHGEGDPMAGAQQRPRYHFLPPANWMNDPNGLIQWEDTFHLFYQYNPAGAYHRHIHWGHATSHDLIHWQHQPIALSPTPGGADADGCWSGCAVNDHGTPTLIYTGFRLPEVQQPCLAVSHDGLQTWQKWPEPIIAAPPPELDLLGFRDHTVWQEQGVWHMLIGSGIRGQGGTVLLYRSPDLRHWEYAGPLLIGDAGQFDPVWTGLLWECPDFFALGDQQVLVCSAWDRRPYYTIAMIGAYRDGRFVPHTTHKLDYGDAHFYAPQTMPIRDGRRIMFAWSMEGRSEESIVAAGWAGVMTLPREVKIADDGQIVTLPVNEVQQLRQDEIVIPSTRVMPHDIHWLPVHGAQLEVELILRPPRHGTCTVMLRASPDGSEATVLRYNSRTATLTLDRRRSSLAGDVWRDAHHAPLTLHNDEPLVLRIFLDASLIEVFANERRSITSRIYPTRPDSTGIAICADEAAVDLLAGRVWEM

SEQ ID NO: 8941 - protein, 370 aa, Chloroflexus aurantiacus
TMDAVLVLEDGRVFPGRSFGAPGERVGEVVFHTGMTGYQEILTDPSYCGQLVTMTAPHIGNTGVNDFDPESIQPQVAGFIVRSYSEHYSSWRARGSLSQLLRDYGIVAISDVDTRALTRHIRTAGAMRGIISTTGESIESLLAKCRAAPPMEGLDLTQVVTCPEPYHWATNSVPFTPPYPNGPAQELRFHVVAYDFGLKRTILRRLVDHGCRVTVVPATTPPEDALALQPDGIFFSNGPGDPAAATYAVATLRSLLGKLPIFGICLGHQLMGLALGGRTYKLPFGHHGANHPVRYLPTGRVEITSQNHGFAVDPDSLPAGVVLTHINLNDQTLEGFDYPELQCFSVQYHPEAGPGPHDATYLFARFAEAM

SEQ ID NO: 8942 - protein, 334 aa, Chloroflexus aurantiacus
VVARLSANENPLGPSPRAMAAVQEALSTIHRYPDASGVALKEALAARVDLHPDQVMLGNGSDELIMLICHAMLGEGDEAVLAQGSFISYARRIQAQGAIARQVPLREMTHDLPAMAAAITPQTRLIFVCNPNNPTGTTVGAAELMAFLEQVPPDVLVVVDEAYLEFVTRPDFPDLLPLLRDGRDNLLIVRTFAKIHGLAGLRLGYAFGNADLIAYLERARPVFNVNVLAQIAGLAALDDVDHLERSLAHAAASRAFLTDHLRAMGMTVIPGETNFVVAAIADDTAVAAELARRGVLVTPLSGWGLPGWMRISFGTAEENRVFIEVLRNLMSKGT

SEQ ID NO: 8943 - protein, 361 aa, Chloroflexus aurantiacus
IAVLPGDGIGPEVVAEGVKVLQAIARRFGHQFTFHEALIGGCAIDATGEPLPAATITLCQSADAVLLGAVGGPKWDDPQARVRPEQGLLGIRKALGLFANLRPVRIYPQLINASPIRPERLQGVDLIVVRELTGGIYFGEKRRERTADGEWASDLCIYTEEEIVRVVRVAARLARQRRGKVTLVDKANVLETSRLWRSITTRLMQTEFPDLQFETMLVDACAMHLIRRPADFDVIVTENMFGDILTDEASMLAGSMGMLPSASLADGRLGLYEPIHGSAPDIAGQGKANPLATILSVAMLLRYSLDLNREAIVSKRQWLGIDRECDRICFPDRWVGRTAYPNSGCAYGRCNEALAPSYGGP

SEQ ID NO: 8944 - protein, 222 aa, Chloroflexus aurantiacus
DVIVVEGLTKSYGHVSVLRGVHLRVAAGEVYGLLGPNGAGKSTLIHLLLGFLYPDSGRIRVLGSADLEAQRRQIGYIPERQRYHNYYTPREYLTFLGRFDGMPETILRKRIDELLELTGLTAVANRYLRTLSKGMIQRLGIAQALLTDPDLLLIDEPTSGLDLDGQQELLVLLNDVRQRGHTVLLCTHRLAEVEYLCDRVGILTNGKVALEVNVADVRHMTG

SEQ ID NO: 8945 - protein, 335 aa, Chloroflexus aurantiacus
  unsure (1)..(335): unsure at all Xaa locations
MIVVMQTDSTPGQIEAVLNRLREHNLRGHLTVGEERTVIAVVGAAIPPTLREELEHFAGVKETLRITQPYKLVSREVKPSDTVVTVGDVKVGGGHLAIIAGPCSVESEEQIMATARAVREAGANMLRGGAFKPRSSPYSFRGLGEVGLQLLAQARAETGLPIVTEVMTPADVDLVARYADVLQIGARNMQNYQLLEEVGRTGMPVLLKRGLSATIEEWLLSAEYIIAQGXSKVILCERGIRTFETATRNTLDLNAVAVARKRSHLPVIVDPSHGTGKWYLVPPLTLAAIAAGADGVIIEVHPDPDRAKSDGGQSLNPENFMGLVPQMRAIAKVVG

SEQ ID NO: 8946 - protein, 307 aa, Chloroflexus aurantiacus
DLGAIEQRLLECTQSRVAVISAAGMHTVRSGGKRLRAALAVLAARLGHYQLERVIHPAAAAELIHAASLVHDDLVDQANRRRGQITVHARWDNDVALMVGDYFFALAAAEMARSPDPRIITFYAEAVQTICEGELSPVTVAEPFDKALRQYLYKTGAKTAVLFEAACKAGMVAGGGSDEEIAALGSYGYDLGMAFQIIDDVLDFIGDERTLGKPAGNDLRQGTITLPLIYATAASPSQVLRDVLLHTPPSDTLVAEVIREVINAGGVAAAQTEAARYIDQAVSHLERFPSSPARQALIDIAHFVLER

SEQ ID NO: 8947 - protein, 453 aa, Chloroflexus aurantiacus
RDDLITALLSVVDPAIVLRRPEELMLYEYDGSALDQGMPEVVVVPRTTAEVAACVQVAAQLGVPIVARGAGTGLAGGSVPEQGGLVISLTRLNRILAIDPVARTARVQPGVVNTDLSLAAAPYGLHFAPDPSSQRASTIGGNIATNAGGPHCLKYGVTTNHVLAVALVLGDGRVIEVSRAALDAPGYDLLGVVVGSEGTLGIVTEAVVKLTPNPESIYTFLAIYDDLDAASETVSAIIAHGIIPAALEMLVGQGIAAVEAAVQAGYPSDARAVLLIELDGLREEVIAQAQAIEQICHHYGVRELRAAQDAHQREKLWAGRKGALAACARIAPHYHIQDGVVPRSRLPELLRLTEEVAARHQITIVNIFHAGDGNLHPLLLFDLRHAGALERAVAASEEILQACVAAGGTISGEHGIGIEKRNYLGWIFGPSDLAAFADLRAIFDANGVMNPCK

SEQ ID NO: 8948 - protein, 901 aa, Chloroflexus aurantiacus
EMDGAVAPVVLGGMRGSTITTVPDRLERLARMARGFVRLRKKANRDKKVAIIVYNYPPGQGKVATAALLDVPASLIAILDRLAAEGYDVGRYPRDPAVFARCLEGLVSDQPLPPGHPPVVIGTSADRQDFYRWLRPIDQERINARWGEFPGDIAPLGRDKVRLAGTQIGNIFIGVQPVIGMPGDPMRLLFDKENTPHHQYALFYRYLSEQFGADAIIHLGMHGTAEWMPGVQLGVTDRCWPDVLLGEVPNFYVYPINNPAEANIAKRRGYSTIIGHAIPPYGRAGLYRELQALQDLLTEYRERPAALADDDQSPEAVAIMQKIALLNLDQDLVRQPDEPFSRFASRAYAYLRDLATTMITDRLHVLGSAPPPEEQLTLIVETLKVPRGELPGLADLLLSARQPGLRYNELLAQARQGDATALALREEIETRCTELVQQTVFGQMTPERAAQTFGLPVAEVTGLVQHGRALLAALRDNTQELDFLMHGLAGRYIPAAPGGDIIRDGVTVLPTGRNIHSLDPFRVPTDSAYERGVRIAEALIAAHRAETGQYPETIAQVLWGLDAIKTKGESIGIVLGLIGARPVKDGQGKVGRYALIPLAELGRPRIDVLMTASGIFRDIFAGTMDMLDRLVREAASADEPPTMNYIRKHVQEMMATGKTFDQATARIFTQAAGTYGTDVDEAIEGSAWEKREELEELFIKRNAYAFGGRQNGEARPEVLRTLLGTVSRVAQEIDSVEYGLTDMQHYYGYSGALKAAAERATGQRVPLNFVESFTAETKLQTLEQTLRVEYRTKFLNPKWYEGMLRHGHNGAAEIASRFTYMLGWSATTDAVDQWVYDEAAQTFVLDDAMRTRIEALNPAAARNMVGRLLEANARGMWQTDEATLERLRELHADLEDRLEGV

SEQ ID NO: 8949 - protein, 399 aa, Chloroflexus aurantiacus
LARLRALLDIAGNPHQQLAAVVVAGTKGKGSTCALIEAMARAAGLRVGLWTSPHLSSYRERIQIDREPISQATLIQLVRDVQPIVDAFDTATYGRPSTFDIGFVMAMRHFVAAHVDLAVVEVGLGGRFDAAATITPLIAVISSISYDHMAILGPTLHDIAYNKAGIMRPGRPAITVPQHPEAAAVFAAEAQTVGAPLWLAAEHTVEPWLASGQPLTYPAPPQPGRLRGGFQRENARLAMGTALLLRDQGVPIDDQAIRRGLAEAWWPGRFELIAGPPRILIDGAHNGDSAQKLWQAISDELPHRQFILVLGTSRDKDIAAIAAALAPQAAHVIITRSNHPKAMDLDRIAAEVAPFTNAPMQIVPVVAEALATAQALAEQDDLICVTGSLFVVGAAREAL

SEQ ID NO: 8950 - protein, 226 aa, Chloroflexus aurantiacus
MINVQNLSFTYPGTSTPALHDITFTIEAGEIFGFLGPSGAGKSTTQKILIRLLRGFRGHVTILGRDLRDWDDNLYEQVGVCFELPNHYGKLTAIENLRYFARLYSRPTLAPETVLDMVGLSEDGHLLASQYSKGMKIRLNLARALLHQPQLLFLDEPTAGLDPVNARRIKDLIKAQKEAGRTIFLTTHDMNIAEELCDRVAFIIDGQIRLIDSPRELKLQYGKKLV

SEQ ID NO: 8951 - protein, 494 aa, Chloroflexus aurantiacus
VSPRIVIVGAGPGGMATAIRLAGQGYQVEIFEAVDRPGGRMRGFSLGDYHFDTGPTILQVPRVYDELFSSAGLRFSDYVTLIRLDPNTRIRFWDGEYLDLTSNIAAFKAQLARFDPALPAEFERWYIEHIRKNVVGYEPYLGTPVRSPLVYLKPREIAAALAFRPWESLYDHFKRFFRDERVVYALSYQAKYLGMHPTACSSVFSLVTFLEFADGIWHPRGGFRALAAGLAKAATDLGVVIHYNSPVKQVLVEEGRACGVELVGGERIKADAVVVNADFGHALTHIIPPHARGTYTDQKLNSMEFSCSTFMLYLGVNRRWDHLPHHQLYLSANIRRNDPLWAKSAVLDEDDPSFYVCNPTIVDPTNAPPGHSTLFVLVPVPNLRYPVDWAAVEQRYRDLIIRQMAKLGFEDVERHIVVERRYTAETWRDEHHTYLGAVFNLIHSWSQLGPFRPHIRHNGARNLYWIGGAVHPGSGLMTILEAAKSAVHFIGEDL

SEQ ID NO: 8952 - protein, 676 aa, Chloroflexus aurantiacus
QHNVFRGCCPHDCPDTCATITEVRDGRAVAFYADPEHPITQGWLCAKVRPYLERVYSPDRLLYPLRRVGPKGSGRWERISWDEAITTIAERWQAIIAEYGAAAILPYSYSGTLGLLQTAIVDARLWNRMGASGLDRTICCAAAHAAVYATLGARRSPDYDDLRHSRLIILWGHNPASAGPHAMPFIRQAQRAGAYVVVIDPRRTATARSADLHLAIRPATDGALALGMMNVIFAENLHDEAWLEAHTVGWRELRARAAEYDPERVATITGLPVSTIIELARRYATTKPAIIKTADGIQRHQNGGQTFRALLCLPAVVGQYGVRGGGLAYSTGGYATWDAEAVGHASECPPVPRTVNMNRLGAALTGEVTDPPIMSLFVYCANPLASSPNAGLIEQGLRREDLFTVVHELFMTDTARYADIVLPATSQLEHLDLHRAYGHRYLTLNQPAIAPLGEAKSNWDVTRLLAQAMGYSEPWLHESAEEAIRGVLDASRARNPFLAGITFERLQQEGTIRLTLSPENEVPFADGHFPTPSGKVELWSATMAAQGLDPLPHYEPPAEYVAHPPEEGWLTLISAAAHHFVSSSMANQPSLRAKEGEPTIEINPVDAAARNIRDGDVVVVSNQRGQCHLRAVVSTNVPPGVVSAVKGHWPFTLARWAKCQLDNSRCTGRSGWTEHI

SEQ ID NO: 8953 - protein, 271 aa, Chloroflexus aurantiacus
FSIDGAKIHAIDTGPRNAQLAILIHGWSSSSFAMSPLIPLLSRRFRCIAVDLPGYGESPPLRERATIGRYAQIIGRLITGLSEHPAVLVGHSMGGMISATLALQIPQLVDRMVLLCPTISGRLSFWINTFVSPITMLERFPLFSRLLALLEPSMLYVTDSLMKPASFAERSAISEADYLRLRADARRPGQGRVRAECFVAMRNQDLSGRLRELETPALVIWGAEDNTVPLRDAGVIADEWRSADLRIVPKAGHWPHFETPDVTLRYIASYL

SEQ ID NO: 8954 - protein, 1144 aa, Chloroflexus aurantiacus
  unsure (1)..(1144): unsure at all Xaa locations
FAQRMLIAVTSYRIENDLRADLFDRLLSFEQMFYQQHYTGDLMARLTNDLSAVRQFLGPGLNGAATAILTFLAAAVLMFLVQPVLALIVVLLLPLATIVFVAIGGRMRQIFHRVQDQFGVLSTRAQENFAGIRTVKAFAQEEAEIAVFTADNERYRDLNLRYVLLSGALWPAMTLCLGLISALILLVGGQMVAAGTLTIGELVQFNAYLALLAFPMIILGWMVNLFQQATASLERLSDILRRQPLITSPATPRLPAGEGEIEFRGVGVRAGHSDQQWLLRDLSFRVPAGTVLAIVGATGAGKTTLINLLGRVRDPDVGQVLVDGIDIRDLDLAALRRMIGYVPQESFLFSIPLRENIGFGVETVDPDRLNYVVEVSRLVNDLDQLPGGMETMVGERGVTLSGGQKQRVAIARALMRDPRILVLDDALSSVDTHTAAQILAGLRTEMTGRTTIIIAQRIATVRDADQIIVLDEGQIVERGSHQELLARNGRYAAMYRRELIAAELERDDXQVRNVSAEPYGIGXRHCLHNHNHQTHRGISEXALSRSGVFSVIRSSEWHISLMMTQFSVKPTMAVWCGVWQPMSFPIGGGLVLQLCCXSERSSLIWCRRCXSNRPSMVRLVAGVIDGVWPYFVAFLGALLANFLFRYSHSYFINSVGQQVMKDLRVAIFRHIQYMSLSNFNRNPVGRFITRITNDVDALNEFLTQGVVMIVDDLMNLIGIIVVMLVLNWRLALISLATLPVLMLIVSIYQRFMRAAYRLVRQRLARINAFLSEQISGVLVTQLFNGEARSRAAFARLSDDYMQANIRSVLIFAIFIPSVNLLAAIGTAALLWGGGNGVLAGWASLGMLVAFIQYLERAFQPIRNLAERYTVLQSAMASAERIFAVLDTQAEVRDPVQPRTLPTPVRGEIELRNVVFGYNPQEPVLRGISLHIPAGQSVAIVGATGAGKSSLVGLLARFYDVQQGSITLDGIDIRDLPQAELRRHVAAVPQDPVCFSGTIASNIRLHNNAISDDQVRAAAELVGAHRFIERLPGGYNHEVRERGANLSIGQRQLLAFARAIAFNPEVLLILDEATSSVDTETEALIQEALARLMRGRTSIIIAHRLSTIRHVDRIIVLHKGRVVEDGTHDELLARHGYYYRLYQLQ

SEQ ID NO: 8955 - protein, 415 aa, Chloroflexus aurantiacus
  unsure (1)..(415): unsure at all Xaa locations
LTFASMVGLTIENVQLYNDLEQQVARRTEELRVALERAQLADRRKSDFLASISHELRTPLNAIIGFSTVLLXMIPIQPLTPTQARRHXRVSNRNGRFLLHLINELLDLARIEAGHLNLEISNVNLLXYYERGLXYRPDAXDRPVTLRNAVPVTLPDIAADGDRLRQILFNLLSNAIKFTERGTITVSARVHDEVNEDGKVGRYVAVSVSDTGIGIPLERQHEIFNEFVQIHGRRSRLSGTGLGLAITRKLVLAQGGRIWVDSTPGIGSTFTFTIPVAQPALLAAPVNIDTTTPMNQLPQILYIEDNPDNQRLVQRVLSARGYQVVIAEDGPGGLALARTTHPALVLVDLGIPGLDGYETTTRLRSLAHMHNVPIIALTADASPGSRERALVAGCDGYLSKPIDARALPAQIAEFI

SEQ ID NO: 8956 - protein, 159 aa, Chloroflexus aurantiacus
KICLLGEFSVGKTSLIRRFVEGVFDERYLSTLGVKINRHTLHIDQTEINLIIWDTAGGEKFDQVVQNYYRGAAGAILVCDVTRPETLSALHEYATAFHSASPHTPFVIAANKIDLTTQRRIADEEIATVATALQADWIFTSARTGEGVSDIFHALGRRI

SEQ ID NO: 8957 - protein, 394 aa, Chloroflexus aurantiacus
LQRQNVELARINASLLKTTKIKDEFLASMSHEIRTPLTAILGMVDLLRAQLVGPLSDEQMGAIDGIKKGSQHLLSLINDYLDIAKVEAGRMELDLTPVSVQDVCMSLRPLVADLIRRANLSLIFDIDSAVQVILADARRLRQILINLLSNAIKFTPAGGKVGLEVRGEPERGAVRFTVWDTGIGISAEDAVRLFEPFQQIESERQKEVTGSGLGLALVAKLVRLHGGSVRVESEVGVGSRFHVTLPWEPDEQYRFLEQLDQQEREEDTHPTELPAASPRAGDRPLLMVEDDVASATLIADYLRRCGYRVVHVESGEEALAYIQGELPCLILLDVRLRTMSGFEVMQHLRSQVATRDLPVLVLTALAMPGDRERCLEAGADEYLAKPIRLRLLAE

SEQ ID NO: 8958 - protein, 487 aa, Chloroflexus aurantiacus
TSSPRTVFVHLFEWKWTDIAQECENFLGPRGFAAVQVSPPQEHAIVAGYPWWQRYQPVSYQLTSRSGTRAEFANMVARCKAVGVDIYVDAVINHMTGVGSGVGSAGSTYSPYNYPGIYQYQDFHHCGRNGNDDIQNYGDRYEVQNCELVNLADLDTGSSYVRDRLAAYLNDLISLGVAGFRIDAAKHIAAGDIAAILSRVNGSPYIYQEVIGAAGEPITPWEYTNNGDVTEFKYSNEIGRVFLNGKLAWLSQFGEAWGMLPSDKAIVFVDNHDNQRGHGGGGTVVTYKNGVLYDLANVFMLAWPYGYPQVMSSYEFSNDFQGPPSDANGNTRSVYVNGQPNCFGEWKCEHRWRPIANMVAFRNATASTFSVSDWWSNGNNQIAFGRGDKGFVVINREDTTLNRTFQTSMAPGVYCNVIVADFTNGTCSGQTVTVDSNRRITVSIPPFSALAIHVGAKLSTQPATVAVTFNVNATTYWGQNVFVVGNI

SEQ ID NO: 8959 - protein, 476 aa, Chloroflexus aurantiacus
NTMTELAHFIAIDIGASSGRVILGRWDGTRFTLEEIHRFPNGMIERDGHLFWDVNRLWHEVQHGLRTYARHEQSSRLASIGIDTWAVDYGLIDEAGNLIGDPFAYRDARNEGMAERVDAIIPPTELYERTGLQRLPFNTLYQLYAERQGDRLPRAATMLLIPDLFHYWLTGKRVAEYTNASTTMFLDARRRVWATDLLERLGIPTHLLPPLVMPGTPLGPLVPELREALGLPGNVTVVAVGTHDTASAVAAVPHLDAQSAYISSGTWSLVGVERSEPLINEAARRLNVTNEGGVYGTIRLLKNVSGLWLLQECQRCWQADGLNLSWDAIIAQAAAAPAGRSYIDPDAPEFLAVGDMPARIREYCRRNGQPVPETVGEIARCCLDSLALRYREVIDALADLTGQPITTVRIVGGGSQNTLLCQLTADLCRRPVVAGPTEGTALGNILVQAIAMGYLPDLATARQVAAASVSQTTYRP

SEQ ID NO: 8960 - protein, 240 aa, Chloroflexus aurantiacus
KVALVTGAGTGIGEAIAERLLAGGALVVLVSRRLEPLELVCRRIDPKGARTLALEADVRNPMAMEAAVKRTIERFGKLDMAVNNAGVTGPAGVPVQDVEAEIWREVIDTDLTGIFYSMKYEIPAMLANGSGAIVNMSSANGLVGLAGMAAYTAAKHGVIGLTRSAALELAESNIRVCAVAPGYVATPRIMDSGKEVTDWMASLHPMKRLATREEVADFVAYLLSERAAFMTGSVHSIDGG

SEQ ID NO: 8961 - protein, 309 aa, Chloroflexus aurantiacus
EDSIVMRAIFFNGDLQYTTDYPDPVRQPGEALIRPHLVGICNTDLEITRGYMNFRGVLGHEFVGTVVASDDPSWQGKRVVGEINAACRRCPTCLRGDVSHCPQRTTLGIYRRDGAMADLFTLPEACLHEVPASVSDEAAVFTEPLAAALEIVEQSHIRPTERVAVVGDGKLGAMIVQVLRLTGCELTLIGRHPERWDVYRQQGITCVRSTDLPGTLFDVVVDCTGNPSGLNIARQIIRPRGRLILKSTFAAETQLNLSMVVVDEIQLIGSRCGPFAPALRLLERGLIATTPLISARYPLAEGLQAFAAA

SEQ ID NO: 8962 - protein, 292 aa, Chloroflexus aurantiacus
  unsure (1)..(292): unsure at all Xaa locations
YRRLCIFXEVGPRDGLQNEPTILTTAQKITLIELLAATGLRAIEVGAFVRPQQVPQMADTEAVFAGIKRQPGVVYSAIAPNVIGARRAIAAGADVVQVFLSASESHNRSNVNMSIEQSLVQVAEMATLVHAAGKPFDAVLSVAFGCPFEGDVPIERVLDLCQRLLDLGAEQLTLGDTTGMAHPLLVQEVVRAFRARFPRQPLRLHLHSARGAGLANLLAALQLGVDLFDSSIGGIGGCPFAPGAPGNLCTEDVTHLLHEMGIATGLNLPALMATARELERMLGHEVPGQTIK

SEQ ID NO: 8963 - protein, 422 aa, Chloroflexus aurantiacus
PRFTGFETLALHAGQTPDPTTGSRAVPIYATTSYQFKDTDHAARLFNLQEFGNIYTRIMNPTTDVFEQRMAALEGGVGALALASGQAAETLAILNLAGSGDNIVASSDLYGGTYNLFRHTLPKLGITTRFVDARDYDGFAAAIDGRTKAFFLELVGNPRLDVLDLERIAAIAHAQGVPVIVDATTVTPYLWQPIQHGADIVIHSATKYIGGHGTAIGGIIVDSGKFDWAASGRFPEFTNPDPSYHGLIYTQAFGNLAYIIKARVQGLRDIGAALSPFNSFLFLQGLETLPLRMERHSKNALAVARYLSEHPKVAWVNYPGLPSHPSYALAQKYLPRGQSGIVGFGLKGGRAAGRTFIERLRLFSHLANIGDAKSLAIHPATTTHSQLTPEEQLLTGVTDDYVRLSIGLETIDDILADLDHAL

SEQ ID NO: 8964 - protein, 298 aa, Chloroflexus aurantiacus
MEVGLIGLGRMGANMAIRLRRGGHRVIVYNRTVAKARELAAEHDLIAAEELSDLVAMLTPPRVVWLMLPAGSATDEHLAALTPLLTPGDIVIDGANNNYKASIAHAEQLTAQGLRFLDIGVSGGIWGLQIGYCLMVGGDEETFHYVEPLLQTLAPPEGYLLCGPHGAGHFVKMIHNGIEYGMMQAYAEGFEILRQSRYDFDLAKISHLWNQGSVVRSWLLELAERAFTADADLSSIRGYVEDSGEGRWTVQESIDLDVPAPIITLSLQMRFRSRQEDSFSMKVLAALRQQFGGHAVKK

SEQ ID NO: 8965 - protein, 502 aa, Chloroflexus aurantiacus
VLDNPLRAGLRIGRTPEPCTMVIFGASGDLTSRKLVPALYNLARERRLPGGFSVVGFARRDWTDETFRELLREAVNANSRSGAVDPDLWASFAQGIQYHRGSFDDADAYTRLAERLATIDAERGTGGNRVFYLATPPEAYPTIIAQLGAHGLAHSHGWTRIIIEKPFGHDLNSAQALNAEVLSVFSEDQVYRIDHYLGKETVQNILIFRFANGIFEPIWNRSHIDHVQITVAETIGVEDRGGYYDTSGALRDMIQNHLMQLLCLVAMEPPAVYDADAVRDEKVKVLRAIRPLSVNDTVRGQYGPGSANGRPVRGYREEKGVSPTSQTETYVALKLFIDNWRWAGVPFYLRSGKRLPRRVSEIAIQFKAAPTMIFADTPLNDLEPNVLAMKIQPDEGISLKFSSKVPGQPQIRPVTMDFRYGASFGVTSPEAYERLLLDCMLGDGTLFTRRDEVETSWALLTPILRDWAEGPPQPFPNYEAGSWGPAAADEFIARDGRFWRRL

SEQ ID NO: 8966 - protein, 455 aa, Chloroflexus aurantiacus
FAVINPANGTVLGYVPNAGVEETRTAIAAAVAAQPGWAATPAGERAALLRRVAQMMLDRQQELATIMTLEQGKPLAEARGEIAYAASFLSWFAGEAERIYGMTIPASTNAKRILVLRQPVGVVAMITPWNFPSAMITRKLGPALAAGCTVICKPAEQTPLSALALGQLFSEAGAPPGVINILTCQDPRPFADTIFADTRVRKISFTGSTEVGKELMRRSADTLKRVSLELGGNAPFIVFADADLDAAVRGAVASKFRNAGQTCVCANRIFVQRPIYAAFAERFAAEVNRLTVGDGLQPGVNIGPLIDDQARQKVERHVHDAIAAGARVLVGGGPAPLGGNFWLPTVLLDARSDMLVAREETFGPVAPLIPFDDEAEVIRMANDTPYGLAAYAFTRDVGRVWRLAEGLEYGIIGINDPIPSTAQAPFGGVKQSGIGREGGPTGIDEYLDIKYVSIG

SEQ ID NO: 8967 - protein, 414 aa, Chloroflexus aurantiacus
VVVVGAGAAGLAAARTLHNAGARVTIVEARPRIGGRVWTERSCGPYPIELGAELIHGEHTSTVALAHMAGLTLAEVDRYNGLRWGTPARLVQDLPATDPAWQTITAARDVWHKLATQYADDAADRSLAAELIQRGVDPARLPIADVVLAQTCCAELETLSCVDLAREIRGDRAGPREFRLREGYDTLLNWLARDLDIRLGSPVHAIIHQADEVQIKTPASILRARHCIITVPVAVLAAGMIRFDPPLSASKQAAITAFRTLSATKHFFWFDEPLWDAGFAYAAHGGLFARWWTPAHPDLSAPLICCYVTASRAEILDRLPDDTVRTLGLAELSRILGRDDVARRCTGFRRYRWAHDPFARGGYAHLLPGMAWARPALAAAEGSLHFAGEATAFDSNPQTVHGAIDSGRRAAQEC

SEQ ID NO: 8968 - protein, 341 aa, Chloroflexus aurantiacus
RLWGGRFSEPTAAEMRRFNDSFHFDVRLAEVDIAGSIAWAGALLQAGLINETEHADLVRGLELVRAEFANGSFVAAAGDEDIHTAVERRLRELIGDAALKLHTGRSRNDQVATDMRLYTIGIARQLDRRLRDLQLALLAQAEQHTATVMPGYTHLQRAQPITFGHWCLAYVEMFARDRSRLNDAIRRMRVLPLGAGALAGNSLGVERERLTELLDEFDELSANSLDAVSDRDFVAEVLFACALIGVHLSRLAEDVILYASAEFGFLELADAYSTGSSLMPQKKNPDSMELLRGKSGRLLGNLVALLTVLKGLPLTYNKDLQEDQGTVFDSFDTLELGLQVA

SEQ ID NO: 8969 - protein, 407 aa, Chloroflexus aurantiacus
SGMVTFLADGHVTSPRGWRAGVAACGIKYANRDDLALLVSDYPATAAAVFTTNAVKAAPVRYDMALMAQGHDLRAVVINAGNANACTGSDGDAAAAAMAQAVEQALDLPPQSVFVMSTGTIGVPMPVEKIVRGIAVAASHLSQDHGPAAARAIMTTDTRPKYCAVAVTLPDGQVITIGGMAKGAGMIHPNMATMLAVVTTDATVPRAVLDQALRRALEVSFNSISIDGDTSTNDTLLVMANGASPAPPITDLDSPAGSAFYAGLVAVCQHLAHAIVRDGEGATRFVTITVRGAVNDAEAKVAAMTIARSPLVKTALFGADPNWGRVLCAIGYSGATVDPDRVVLSFGGMRVLENGLPLPFDEKAAHQLLDVPEITIDADLGLGDGQATVWTCDFSYDYVRINAEYRT

SEQ ID NO: 8970 - protein, 424 aa, Chloroflexus aurantiacus
KRLRGVIEVPGDKSISHRSVLFNAIATGSAHITHFLPGADCLSTVACIRALGVTVEQPAERELIVHGVGLGGLREPADVLDCGNSGTTLRLLAGLLAGHPFFSVLTGDASLRSRPQRRIVVPLRAMGAQIDGRDDGDRAPLAIRGNRLRGGHYELSIASAQVKSALLLAALNAEQPLTLTGRIDSRDHTERMLAAMGLEITVTADQITIQPPSEATAPTALSLRVPGDPSSAAFWWVAAAIHPDAELVTPGVCLNPTRIGAIEVLQAMGADLTVMNERLEGSEPVGDVVVRSSSLRGTTIAGTLIPRLIDEIPVLAVAAACASGETVIRDAQELRAKETDRIATVAAGLSAMGAVVEPTADGMVIVGQPGQLQGTTLNSFHDHRLAMAWAIAAMVARGETTILEPAAAAVSYPEFWQTLAMVQE

SEQ ID NO: 8971 - protein, 255 aa, Chloroflexus aurantiacus
RRIGRYELIEELGRGGMARVYRARDTQLQRIVALKVLAAQLSMDAEFIKRFEREARTAANLRHPHIVTVYDIGEDQGLHYIAMEYIDGRPLHAILEQYGSLGLKYAIAILEPIALALDYAHQAGAVHRDVKPHNILIDRNGRVVLTDFGIAQTPEADEQRLTRTGVFMGTPEYISPEQAEARRVDGRSDLYSLAVVAYEIIAGRVPFSGATPQLIVAHAQLPPPPITSFAPDLPTDLDLVLTRALAKRPERRFQT

SEQ ID NO: 8972 - protein, 465 aa, Chloroflexus aurantiacus
MRLVMKFGGTSVGSADAIRRVTEIVGTYARDHEVVVVVSAMNAPDLRTTDTLIAAAKAAAAGNGDATAQIAPRLLDLHMRTAAEVASPAECAALEPQIRSMLDYMSNLSRSIAVLGELTPRALDLFSGLGERLNARLIAAALRSAGIDAEAIDATELIVTDDRYGNASPIEPDTRERSRARLLPMLADRKVPVVTGFIGATRAGVPTTLGRGGSDYTCAILGADLDADEVWFWKEVDGVLSANPKVVPEARTLPRLSYAEMGEMAYYGANVLHPKTVQPLVHRRIPIRIRNTFNPSHPGTLIDAEGDGESVRAITAIRGLSLITVGGPGMLGLTGVAARIFGAVARVGANILLISQASSEQSVCFAVPGDESERVVEELRRELAREFAAHDVDHIGTIAPVVIVAVVGSGMRGTPGIAGRVFGALGAARVNVIAIAQGSTENNISLVVAEADADAAVRAVHAAFV

SEQ ID NO: 8973 - protein, 641 aa, Chloroflexus aurantiacus
PFVSRKQIPCYSQRRIAVGYEAVYRRSIEEPEAYWAEFAAELHWYKPWEKVLDNSNPPFTRWFVGGETNLCYNAVDRHALGGRRGQAALIWESAETGQSRTLTYFELYREVNRLAGLFHNLGVRKGDRIIIYMPMVPEAIFAMLACVRIGAIHSVVFGGFSVTSLASRIDDAEPVLIVTADAGMRKGQPVPLKEIVDKALAEANTDSVRDVLVLNRGLVPVELKKGRDLDWYEQLAKRGERYVEPVPVASTDPSYILYTSGTTGKPKGVVRDTGGYMVALYASMSTIYNCGDGDVFWSTSDIGWVVGHSYIVYAPLLKGVPTVVYEGRPDHPDPGVWWRVIEKYGVTHVFTAPTALRALRKFPEHWMRDADISSLKLLYAAGEPLDAPTYEWASAALGVPVIDHYWQTESGWPMVTNPVGVELLPIKPGSPTKPAFGHRLEVVDADGNPVPPGEKGFLVEHGPLPPGTLLTLWNDDERFVKGYWGHFKDKLLYMTGDYAIKDADGYLFMLGRADEVLNVSGHRLGTREIEEVVSAHPAVAEASVIGVRDELKGEDVLVVAVLKQHITPQMQDDIANEIRQLVRERIGPIATPKAVHFVSMLPKTRSGKIMRRVIRAVYQGDNLGDLSTIEDDATVDMVREA

SEQ ID NO: 8974 - protein, 638 aa, Chloroflexus aurantiacus
RDVALPDTSELYYPDPALVEQSNVMAYARSKGFNSYDELYQWTISHREEFWADMASQLEWFKPWDKVLDDSNKPFYQWFVGGKTNIVYNAIDRHLKTWRKNKLALIWEGEDGSQRTYSYYQLNYEVSRIANVLKSMGVKKGDIVTIYMPRIPELMFSMLACAKIGAAHSVVYGGFSEAALADRLADAKSKVLITADGGYMRGKVVELKKIVNEALSRTPTVQTCLVFRHTNHGAPMEQGRDFWMHDLLGLPIANGHCPTEEMDAEDMLFILYTSGTTGKPKGVVHTHGGYMVGTYTTLKFVFDIKDEDRYWCAADPGWITGHSFIVYAPLINGATSFMYEGAPNYPYPDRWWSMVAKHGITILYTAPTAIRGLMRFGDLWPSRHDLSTLRLLGSVGEPINPEAWKWFYEKIGHGRCPIMDTWWQTETGHFMITPTPAVPLKPGSATRPFLGIEADVVHEDGSPCAPDEDGLLVIKNPWPGMMRTILNDPQRYVEGYWQKVPPYYAAGDSARKDKDGYIWVIGRLDDVIKVSGYRLGTAEVESALVSHPAVAEAAAIGLPHEVKGNAIHAFVILRAGYEPSHDLEEKLRAHVGHELGPIARPDSITFVTSLPKTRSGKIMRRVLRARALGLPEGDVSTL

SEQ ID NO: 8975 - protein, 295 aa, Chloroflexus aurantiacus
DTRTIVHDLMRSGQQRLCAAFEEIDQHAQFVAESWERPGGGGGTARVMTEGAVFERAGVNVSAVYGVEVPPSIWQHRPSTRGQPYFATGISMVLHPRNPYVPAFHANFRYFEAGDDWWFGGGMDLTPSYGFAEDARHFHVTLRDYCARHPIADYREMKATCDNYFFLKHRNEMRGIGGIFFDDLHPAGDDGFERAFAFVSDGITTILDAYLPIVRRRMHTPYGERERMWQLYRRGRYVEFNLIYDRGTLFGLQTGGNIEAILMSLPPLARWQFKYQPEPGSPEAAMAEFLKPRDW

SEQ ID NO: 8976 - protein, 427 aa, Chloroflexus aurantiacus
RSQADYAAAREVIPGGVNSPVRAFRGVGGIPIFFERGQGAYVWDVDGNRYIDYVLSWGPLLLGHAHPAVVEAITLQAQRGTSFGAPTELETELARLVIELVPSIEQIRFVNSGTEATMSALRLARAATGRRLIVKFNGCYHGHADMLLVQAGSGVATLGLPDSPGVPPSVAAETITIEYNDLDAAAALFANRGAEIAAVIVEPIAANMGFVLPKPGFLSGLRELTQTHGAIFILDEVMTGFRVAAGGAQALWGLDPDLTCLGKVIGGGLPVGAYAGKRQLMQLVAPAGPMYQAGTLSGNPLAMTAGLTTLRTAFGGDAGAFQQAVTRTARLADGLRMLGERYRIPVQVGNVGTMFGCYFLRQEGSQITSYAEAKAYADSQRYARFFWAMADQGIYLAPSQFEAGFLSTAHSDADIDETLAAAEVAFA

SEQ ID NO: 8977 - protein, 380 aa, Chloroflexus aurantiacus
QPDRNAPPRHSRHRDNKKTSVPSVSFVVTQPAIVKIERSAMRDRFLRACRRQPVDRTPIWLMRQAGRYMPEYRAIRERYGFLQMVKTPEVAAEVTLQPVQAFGVDAAIIFADILPPLEGLGLQLTYEKGEGPVIHNPIRSPHDVSVLRSCDPRETVAYTLAALQLVKRELNGLPLIGFSGAPFTLASYAIEGGGSREYRLTKRFMYEQPAAWHDLMERLSRLVADYLIAQIEAGADAVQIFDSWAGALSPADYRAYVLRHTQALVQTIRARLGDVTPPIIYFGTDMAGLAGEVRQIGADVLGVDWRIDLDVAWAQYGFNHAVQGNLDPMTLFAPPSIIAARARDILERAGGRPGHIFNLGHGILTETPVDHVRYLVEFVQ

SEQ ID NO: 8978 - protein, 187 aa, Chloroflexus aurantiacus
GYLLNDPTLALLAEASIVHARAGADIIAPSGMIDGMVAAIRSALDAAGLSHTAIMSYAAKYASGFYGPFRDAAESPPQFGDRSQYQMDPANAREALREVDLDVAEGADILMVKPALAYLDIIRQVRDRHTLPLAAYQVSGEYSMVKAAALQGWLDEQRIALEMLTAIRRAGADMIITYWAREAAEWL

SEQ ID NO: 8979 - protein, 227 aa, Chloroflexus aurantiacus
LNSVHLDLYAGEGVAIVGANGAGKTSLIKHFNGLHRPQQGQVRVIGKDTRTTPVSVLARHVGMVFQNPDDQLFTTRVRDEVAVGARVMGVYDPDQVAAVLRTFQLEHLVERSPFTLSAGEKRRLTLAAALVTNPAILVLDEPTTGLDWPARQALARHLREQVQHGRTVVVVTHDLEFAGALTSHWFVLADGCLLAEGVPHAICMQPAVVQAADLLLPDRYRLALALQ

SEQ ID NO: 8980 - protein, 604 aa, Chloroflexus aurantiacus
ASHSVEATRAALRSAAMFRTILVANRGEIALRVMRACRELGLRCVAVYSEADRDAPHVAYADDAFLIGPPSPAESYLNIDAIIRAAKATGAEAIHPGYGFLAENASFVRAVTAAGLIFIGPPAEAMERMGGKTAARREATAAGVPVVPGVLEPVTDAAEVRRLGKEFGYPIAIKAVGGGGGRGLRVVRSPEEVDEAFAAARREAEVAFKNGELYVEKYLDDPRHIEIQVLADRYGNAVALGERDCSIQRRHQKLIEECPSPALTPELRAEMGAAAVRLAKAVGYVSAGTLEFLFQDGRYYFLEMNTRIQVEHTVTEMVYGIDLVAAQIRIAQGEKLWFKQEDVVPRGHAIECRINAEDPLHNFRPALGTIGEYHEPVGFGVRVDSGVRAYYTVPSHYDSLLAKLITWGSDRQEAIARMRRALAEYRIEGVTTIIPFHQAALEHPVFTAGAATVNFIPRHPELFSRAAELTPPTAASAGAEPAPEPRRFTIEVNGRRFGVAVFGDGMNATPVASPSRSAPARRAAPKKTTLAAPVDAVISPIQGRVVAVRVAHGQQVEAGQVLFIVEAMKMENEITAPHSGTIAEVRVEVGTTVEAGAMLATYQN

SEQ ID NO: 8981 - protein, 286 aa, Chloroflexus aurantiacus
LGDINVDLGFLLPHFPREGDDNPAMAVHWGGGGAGLNMAVAVGRLGAIPYLIGRVGNDLAGSFALQTARTHGVQVSTVQVDPGAATGLCGIVVTPGGQRSFLSFRGANVFCDASTITPSLIRSSRLLLIGSHALLDDPQRSAALQAMELAIEQRCPIVLDLCLPAIRVARRLIVRLLPQLWLLTMNEDELRALLPGQSIAQALDSLLSAGVQHVAIKRGAQGCSVANNQGRRLDVLPPAVSVVDTTACGDAFSAAYAWALIHGLDLSQSATLANLVGALTATRHGA

SEQ ID NO: 8982 - protein, 171 aa, Chloroflexus aurantiacus
MRQDIDYILIGEDQIKQRVAELAAEISADYRDLGDLLLVGVLKGCAMFMVDLARAIDLPLAIDFIAVASYGASTESSGVVRLIKDLDTDISQRHVLIVEDIIDSGLSLAYLRSQLLRRNPASLRICTLLNKPERRTADVPVDYIGFDIPNAFVVGTGLDYAERYRNLNFSG

SEQ ID NO: 8983 - protein, 800 aa, Chloroflexus aurantiacus
LRGQLVVAAYDGSGNRIDATRVQIQGVLDDLYAANATTQTLGVSYSGAVPTVRLWAPTAKTVTLRRFASSTTTTYTDHPMTLDPTSGVWSVTGDASWDRQFYLFAVEVYVPALDAVVTNLVTDPYAVSLSQDGAAANDVRSQFVNLDDADLKPTGWDTLSKPALTNPEDIVIYEVHIRDFSANDSTVAAADRGTYRAFTYDGAGPHPNTTLSDGMNHLLQLRQAGLTHIHLLPTFDIASVIENPAERSEPTISFNPATDRASSNPQAAVGATRQTDSFNWGYDPYHYGVPEGAYSSDPDGVTRIREFRELVQTLNQNGLRVVMDVVYNHTAASGQDDKSVLDKIVPGYYYRYDTNGTLYQSSCCADTATEYAMMEKLMIDTVVRFATAYKIDGFRFDLMNLHTRQNMLNVRSAVQALNLSTHGVDGSTIYLYGEGWDFGSARDKGLTVCPHCYAHKHNMTGSGIGVFNDVIRDAAHGGYSTDPVGIRRQGFINGLSYDWNGYNYPNRFQSDLHATMDTLRSALRGSGTDWNGQGNPFTDDPQEAINYVEKHDNETLFDQNVFKLPNGDGSGNPGWIGSSIPTTTMSDRVRSQNMGVSLIGLAQGIPFFHMGQDILRSKSLDRNSYDSGDWFNRVYWDRSANNFGRGLPPAWDNSSRWGIMTPLLNNTALDPTTADMNAAAAHLRETLRLRMSSPLFRLTSEADVNARVSHYNTDNSRDALLVMRLSDQVAPDLDPNWENILVFFNANKVAQSITIPNANGFVLHPLHTNGIDDDPVIATATFNDATDTFTIPARTTVVFV

SEQ ID NO: 8984 - protein, 517 aa, Chloroflexus aurantiacus
VHLFEWRWSDVAKECTFLGQKGYTGVQVSPPNEHIVPTADLGGNPANDFPWWARYQPVTHDTTRFTSRSGTWAEFQQMVNTCNAAGVAVIVDAVINHMADIQVGTPPTGTAGTTYQSQPAGSRFYGTQYLPDDFHADCLISDYSDRYQVQYCQLAGLPDLDTGKSTVQTKLRAYLQALLNAGVKGFRIDAAKHMAAHEVGAILDGLTLPGGGRPYIFSEVIDMDPNERIRDWEYTPYGDVTEFAYSISVIGNTFNCGGSLSNLQNFTTNLLPSHFAQIFVDNHDNQRGHGPGGGCVVDHRDGRAHVLANIFTLAYPYGHPSIMSSYYWTTNPNSNAGDSLGPPSSNDGGTTWGPGLGADTRPVYGAGQSAGDYPANCAGTYPNPVTGGDLGKWVCEHRYPAIANMVQFRQTTHGEPVTNWQNIGGTPTNHIAFGRGNKGFVAINNGSVAAPTTYQTGLPAGFYCDVTKYDFQGGKCVLPGTNTPAPASALIEVNASGQIVNYTLAAQDAFAIHIDAR

SEQ ID NO: 8985 - protein, 345 aa, Chloroflexus aurantiacus
  unsure (1)..(345): unsure at all Xaa locations
PHRRLNRLTGEWVLVSPHRTQRPWLGQVETLPPAELPSYDPACYLCPGNTRANGVQNPPYTETFVFENDFAALLPDIPLDRVSVRLPLADQHDAGPVLLHAEAERGICRVVCFSPRHDLTLAQMSQAEVRRVVDVWVDQYNELGAIDWVQSVLIFENRGAMMGASNPHPHGQIWANEQLPNEMRKELATQTAYWHEHQRCLLCDYLALELQLGERIVCANDAWVALVPFWAVWPFETLVLPRVHAGAIGDLDESGRDGLAAILRELTGRYDRLFNVSFPYSMGFHQRPTDGLAHEGWHLHAHFYPPLLRSATVRKFMVGYEMLGQPQRDLTPEQAAARLRDLXSV

SEQ ID NO: 8986 - protein, 742 aa, Chloroflexus aurantiacus
MTGDLLANLNEPQQRAVTTVTGPVLVLAGPGSGKTRVLTHRIAYLIAETGIDPLQILAVTFTNKAAREIRERLNLLVGETVAHEITIGTFHAICTRWLRRDIVHLGRERDFVIYDSDDQERLMKRVLRELNLNEKQYPPRAILGVISRAKNELVDPEAFARTARSYFDEIVARCYTRYQQLLIESNALDFDDLLVETVRLFQEHPAILHHYHQRYRFLLVDEYQDTNRAQYLIVRALAERDRNLFVVGDEAQSIYAWRGADIRNILQFEHDYPDARVILLEQNYRSTQAILDAAQALMHASPQRKYAKNLWTVNGKGEAVTLYEASDEEDEVQFVVDEILRLIAEGKARPGDCAIMYRTNAQSRLVEEALIHAGVPYYVVGGVRFYERKEIKDVLAYLRLIANPYDSVSLQRIINWPGRGIGERTVAELIAWARTLGLPLYQALREIADNDAISHPFGGRARTALTEFYRLLSELHQLHGMMALSDLIDYLLNRIDVRATLYSEYDGDEADDRWRNVQELRNAALKYVNLPVETQLTAFLEEIALVADVDAIDRNSDTVTCITLHQAKGLEFPCVFLLGIEEGLLPHSRSLDNRDSIEEERRLLYVGMTRAQRRLYLCHATKRTMFGRVNIGARSRFLNDIPPTLVQQVHRRGYRAIPAVAGTTWQFRTSGQSEQNRRTSRNQAPLPTPQKAVFFPGQRVRHATFGEGIVVDSRLIEGDEEVTVRFADRERRLLASFARLEQ

SEQ ID NO: 8987 - protein, 278 aa, Chloroflexus aurantiacus
GRYCDIDAVRQAVRSYNIDTIVNFAAETHVDRSIMAPDAVVRTNVNGTWALLEVAREFQLERFHQISTDEVYGAIPAPRRSREGDPLEPRSPYSASKAGAEHLVYAYYITYGVPMTITRGSNNIGPYHYPEKAVPLFTTNAIDNLPLPIYGDGLQVRDYQYVLDHCEAIDLVLHKGQIGEVYNVGTEVETPNIEMARKILDILGKPYSLIQHVTDRAGHDRRYALDCSKLRALGWRSRHTFDEALEKTVRWFVENEAWWRPIKSGEYLEYYRRQYVER

SEQ ID NO: 8988 - protein, 280 aa, Chloroflexus aurantiacus
SMSGYAHPEALVETQWVADHLNDPNVRIVESDEDLLLYDTGHIPGAVKIDWVQDLNDPVVRDYLDSDRFAALMRVKGISNDTTVVLYGDKHNWWATYAFWVFKLFGHRDVRIMNGGRAKWIAEGRPLTREVPSYPPGNYVAPPRNDAEIRAFRDQVLEFVRQRKGVLVDVRSPQEYTGERTHMPDYPQEGTLRGGHIPTAVNIPWARAVNEDSTFKSVEELRELYAAQGVTPDKEVIAYCRIGERSSHTWFVLTYLLGFPNVRNYDGSWTEWGNSVGLPI

SEQ ID NO: 8989 - protein, 432 aa, Chloroflexus aurantiacus
RLVTEIPGPRSRALLARRDAAVVAGLGRATPIAIASGQGALVTDVDGNTLIDFVSGIGTLAVGHCPPEVVQAIQAQAEQLIHLSALVGTYEPYVALCERLNALAPISEPCKTLLSNSGAEGVENAIKFARAATGRPAIIVFDGAYHGRTLLTLSLTSRTYFKKKFGPFAPEIYRAPFPYAYRMGMSEAEAVEQCWAAFERMQIAGVDPETVAAVLIEPVQGEGGFIPVPVEFMRRLREFCTRNGSLLIVDEVQSGFGRTGTLFAIEQFGVEPDIIVAAKSIAAGMPLAATIGRARIMDCAHYGGVGGTYGGNPLACVAALATIDLIERERLLERAKVIGQQIRARFEPLLTDDSLDPLVGDVRGLGAMIGIELVKDRRKRTPAAAEEVLAILGRALERGVLAMRAGLYVNCIRLLVPLVITDDQLDEGLEVL

SEQ ID NO: 8990 - protein, 341 aa, Chloroflexus aurantiacus
ATVILRDVFGFSTFRPHQEQIIGRVLRGESTLAVLPTGAGKSLTYQLPAQLLPQATVVISPLIALMKDQVDRLPPAVQERATIINSTLTAGEVRDRLRAIAAGKYKLVYVAPERLRQRSFLFALRHCGVSRLVIDEAHCISLWGQNFRPDYLFINRAMNELGQPPVLAVTATAASDTIHTLQTMIGPLTVVQAPVFRPNLFFQVIQVRPGMSKARSLIELCRKINGSIIVYARARQTCEDLALELRSAGVAADHYHALHPDRAGVQERFMNGKTRVLVATVAFGMGVDKADIRAVIHYNLPASLEAYYQEAGRAGRDGLPARCILFFSENDARVLRTWLQS

SEQ ID NO: 8991 - protein, 1089 aa, Chloroflexus aurantiacus
MPKRTDLHTILIIGSGPIVIGQACEFDYSGTQACKALREEGYRVVLVNSNPATIMTDPGLADATYIEPLTVPSLERIIARERPDAILPTVGGQTALNLAVALHEAGILEKYGVELIGASVEAVRIAEDRQRFKDKMIEIGLQVPRSGTATTLEEALAIVAQTGFPAIIRPSFTLGGEGGGIAYNMEEFRTIVERGLDASPVSQVLVEESVLGWKEFELEVMRDRNDNGVIICSIENIDPMGVHTGDSITVAPAMTLTDREYQRMRDMGLAVLRAVGVETGGSNVQFAVSPTDGRIYVIEMNPRVSRSSALASKATGFPIAKIAAKLAVGYTLDELPNDITRETPASFEPTLDYVVVKIPRFTFEKFPQADQTLTTSMKSVGEVMAIGRTFAEAFQKAWRSLEQGRAGWGADGRDAIEPERLRERLITPHPDRMFYIRYALQSGMSVEQISNLTKIDPWFIRQLEQIVNLEGRLRAFDLATIPPDLLRQAKRMGFSDAQLAHLLRVPAGPQRWSAELAVRQRRLELGIRPTYHRVDTCAAEFPAFTPYLYSSYESEDEAEPTDRKKVIILGSGPNRIGQGIEFDYCCSHAVFGLRALGYETIMVNCNPETVSTDYDTADRLYFEPLTLEDVLNVVDVERPDGVIIQFGGQTPLKLARALEAVGVPIWGTAPEAIDLAEDRDRFGALLKELNIPAPEHGSATSWEEALTVARRIGYPVVVRPSYVLGGRAMAIVYDDAALERYMREAVAASPEHPVLIDRFLEDAFEMDVDAVCDGHTVVIAGIMEQIELAGVHSGDSACVIPTYMVAEEHVVTMRHYTERLAQALGVVGLMNIQYAMKDGVVYVLEVNPRASRTVPFVAKATGVPWVQLAVQCAAGARLKVDQDQVYVTHPVLPDSPRYRLDVSSEQRFHVKEVVLPWSRFSGVDTLLGPEMKSTGEGMGSGATFGEAFAKAQMACGSHLPTSGNAFLSVNDRDKATLLPIARELAALGFNLLATSGTAAYLQQHGLKVTPIYKVNEGRPNAVDYIKNGEIALIVNTPLGKVSFFDEAAIRRAAITYGVPTLTTLSGAAAAVQAIQALRAGQWTLQSLQE

SEQ ID NO: 8992 - protein, 839 aa, Chloroflexus aurantiacus
GFTPNDAQREAILHVDGPLYLTAGPGSGKTRVLLWRTLNLMVYYGVKAEEIFLATFTEKAARQLSDGLRSYLGLVTNLTGQPYDLAGMYIGTVHSLCQRILTDRRRFFLDRQRPRSPALLDDLGQYFHLYERANWEIVTRAAGLDPSSAAEVVTGHLNTQPSASRHRAIEALRPFFNRFSEELLDPAELRPRLSSLVRGEFSPQDVDLLLALYEGYLQSLREAGRTDFALLQREAFQVLQEFQGAGGVFRHVIVDEYQDTNTIQERIFFRLAEGTGNLCVVGDDDQALYRFRGATVENFVQFPARCQKYLNQTPRTISLEINYRSRSHIVETYGRFINHTNWQDRDGMVYRIPKNIRAYRNDLAPAVVASTPAEPEQACQEIARFVRRLIETGKVQNPNQIAFLYPSLKSEQAKRMIAALKAEGLDVYAPRAGRFLEVDEARDVLGIFLAIFGRPTIEGRGHDLRTFEVYLTALQTRADELQQTDPLLKQFIQNRRDEIQRALSDYAALQAVLTRNRWLPDQLYDPASMKRALADAPGLSETGHRLVSSAYLDRLVLLRASEGRPLSLEYVIRRATSLDWNLLDLFYQLMGFEHFKAMFDRAERQGDEGAVANLGLLTQYLARFVQERVNILTAAILSEHKFSGMFFGSFIFALYRLEEGEREDEENPFPRGRIPFLTIHQAKGLEFPVVVLGNLDKRDHGAPLIERLVRPLLSRPAGEPLDRMTAFDIARMFYVALSRAQNLLILAHFSGRGQRQDEAFKPILNGNLPRLADFDLNSLPNAVATDETLPKVYSFTADYLLYQTCPRQYMIFRKFGFVPSRSQTMFFGSLVHRTIEDLH

SEQ ID NO: 8993 - protein, 1074 aa, Chloroflexus aurantiacus
  unsure (1)..(1074): unsure at all Xaa locations
PVVGLLFYRAHLLSGNTGFVDALINGLQSRGLRVALSIPNLXKRSMRKVSRLGWLXSNRRGRWDVIISTLSFALGDDDPHPFTRLDVPVIQALLSSSSREAWQRDGRGLGPLDTAMNVALPELDGRIISVPIAFKAQEGEAAARSLPDPERIERLAGLVWRLSQLRHKPNAQKRIAIILTNSSAKAQRIGNAVGLDAPASLMRLFAALQDAGYSVAGLPEHGDRLIADLIARCSYDETWLTTEQLAQAYRIPSTTYQRWFAELPLSLQEAMTRQWGPPPGRAYVHRGELALAGLEFGNCFVALQPPRGYDMDPNAIYHRPDLPPPHNYYALYRWLRDVWQADAIIHLGKHGTLEWLPGKGVGLSATCFPDPFLGDMPLIYPFIINDPGEGTQAKRRAHAVIIDHLTPPMTSAGAYGDLAELAHLVDEYYRMERLDPTKLPLLQRQIWDVLQRSQLADDLRYILQADHGDHRHEWDGSVLEDGTPTVLAELEGREVAHLLEDIEGYLCELTGAQIRDGLHILGTLPEGDQLVDLVYHLLRLPNLHAPALPASVATALGVDWYALQNTPGQRRNGDDHFLTNADVIAHIETLCRDLLRRLQAEHWQAAMITSVIEQVLPACRDTTAVATALQYACDWIIPRLRQSAIDEIDHLLAALAGRFVPPGPSGAPTRGMAHVLPTGRNFYSLDPRSVPAMAAWETGLGLANDLLRRYQREYGTLPESVGISIWGTSLIRTAGDDVAQVMALLGVRPRWQRENRRVIGFEVIPLTELGRPRIDVVCRISGFFRDAFPHLIELLDQAIQTVIDLDEPLELNFPRKHAYLTAQALVNGGTDQETAQREARYRIFGSPPGSYGAGMLPLIDGQNWTNDADLARVYLRWGGYAYTATEQGVPAETAFAAALSTVQVATKNQDTREHDIFDSDDYFQFHGGMIAAIRALSGRNPARYFGDSSDPARPRTRDLREEARRVFRARVINPKWLASMRRHGYKGGLELAATVDYLFGYDATAQVLADWMYEQVTTHYIRDPEIQQWLHEVNPWALQAIAERLNEAIGRGMWRHPSPEAQAAIAEVLAQGEE

SEQ ID NO: 8994 - protein, 369 aa, Chloroflexus aurantiacus
ITTTLTVTTSTTSYPVIVGAGILSNLADYLAECALRGTAWIVADEHLTAIADQTAAHLTAAGYRVHTTTVPSGEQSKSFGELNRLYDWMIEHGIERRDVVLALGGGVVGDLAGFAAATILRGVALVQIPSTLLAMVDAAVGGKTGINHPLGKNLIGAFHQPRLVLADTNLLATLPARELRAGWAEVIKHGVIRDAELFDALETLAATQRWHADNPATWDATDPALTGELTNIIARAVAVKVDVVSRDEFERGERITLNYGHTIGHAIEQLLGYRLLHGECVAIGMDAAARIAVALGICPPALVERQRNLLAAYGLSTALPADLDRSAILTLIGRDKKVQAGNVRWVLPTAIGQVVVRADVPLAVVEAVL

SEQ ID NO: 8995 - protein, 437 aa, Chloroflexus aurantiacus
MAKILQHLPVGEKIGIAFSGGLDTSAAIHWMRAKGAIPYAYTANLGQPDEPDYEDIPRRALMYGAEAARLIDCRQQLVAEGLAALQCGAFHISTAGLPYFNTTPLGRAVTGTMLVAAMREDGVHIWGDGSTYKGNDIERFYRYGLLVNPDLRIYKPWLDQAFIDELGGRAEMSAYLSRAGFEYRMPAEKAYSTDSNMLGATHEAKDLEFLDRNITIVKPIMGVAFWQPDVHIEYEEVRITFEEGFPVAINGMTFPDHVALMAEANRIGGRHGLGMSDQIENRIIEAKSRGIYEAPGMALLYIAYERLVTGIHNEDTIDQYREYGRKLGRLLYAGRWFDPQAMMIRESLQRWVARLITGEVTIGLRRGNDYSILDTTSPNLTYDPARLTMEKGEASFTPQDRIGQLHMRNNDIADTRKKLMVYLRTGLLGESGVLPQL

SEQ ID NO: 8996 - protein, 311 aa, Chloroflexus aurantiacus
DGRLLIFTGNANPALAQEIARNLRINLGRALVGTFKNGETRVKIHDNVRGCDVFVIQPTCTPVDHHLMELLIMIDAFRRASAARVTAVIPYYGYAKQEKKTSGREPISAKLVANLIRTAGADRVLTMDLHAPAIEGFFDIPVDHLQASPLLADYIRELNLPNPVVVSPDTGGVGRANRFRERIGAGLAIIAKQRPEPDTAEVIEMVGEVEGKTAIIVDDMISTGGTLIEAAQTLLARGARAVYACATHGIFAENALQLIAESDLVETVVTNTIPQPPTAAAARVRTISVAPLFAEAIMRIHKDLSLSALFS

SEQ ID NO: 8997 - protein, 287 aa, Chloroflexus aurantiacus
ELPSGPLVETDWLAAHLGHPKLRIVDMRGTVLPPSAPKPHYFARHDDYAAGHIPGAVYIDWTRDIVDLDDPTPVQVAPPAKIAEELGKRGIGDDCVVVAYDDWYSMFAGRLMWVLRYYGFEQVRVLNGGMVKWVAEGRPLTTEVPDYPPAIFTPRPQPHLRKTADQVLQALGSDLLLIDARHEREYQGFESRAARGGHIPGARNVFYQSLVSGPHQTYLSPDQLRERFLAAGIDPDATTDREVVAYCNGGVSATPTAIAFELVSGRRVAIYDGSWNEWGNDPTKPLE

SEQ ID NO: 8998 - protein, 445 aa, Chloroflexus aurantiacus
EVTMPRLSDTMSEGTVGRWLKKVGDQIAVGDIIAEIETDKATMELEAFEAGVLQQILIPEGQTVPIGQPIAIIGDSAAPVAAAPAPTPAPAAAPAPEPAAAPTPAPAPALVTTAAAPGGGDENGRIKASPVARRLAEELGIDLRQVVGTGPGGRIIKENVEEFAARRGTAAPAAAPAPAPAPAAVPAPAPAPAAASAPAPTPAPAPAPTRAPAPTPAPALAGAEPLSRMRKAIARAMTDSKPGVPHIYLTIEVDADALMALREQITAGGTRVSVNDLVVKAAAKALAKVPAVNVSFSQTADGQPGIVRHNQINIGVAVALDDGLVAPVVRDADKKSISVISAEIRDMALRAREGKIKQNELEGATFQVTNLGMFGIVEFGSIISVPQAASLAVGAVRKVPVVRDDQIVIGQVMNLTLSADHRVIDGAVGAQYLQELRKLLEAPMN

SEQ ID NO: 8999 - protein, 321 aa, Chloroflexus aurantiacus
ITYRQALNDTLGEELARDPNVFLMGEEIGVFQGSYRVTEGLLAEFGPKRVVDTPIAEEGFVGVAIGAAMLGLRPVVEIMTINFILVAIDQVVNHASKIHYMFGGQVSVPLVIRTPSGGTGQLAATHSQSFENWFAYCPGLKVVAPATPYDAKGLLRAAIRDDDPVIFIESLALYDTKGEVPEDDDYVVPIGVAEVKRQGTDVTVVSYSRMTAVALQVAQRMEQEGISVEVVDLRSLRPLDRPTIIESVKKTNRAVVIAEDWYSYGVTAEIAATIQEEAFDYLDAPVYRVAGLEVPLPYAKELSAASKPNANSLIYAIRQVM

SEQ ID NO: 9000 - protein, 318 aa, Chloroflexus aurantiacus
PLLERATADELKHYYYQMLLLRRFEERAGEMYVKAKIGGYCHLNLGEEATIVGLMAALTPDDYIFTNYREHGYIIARGVPPGPVMAELFGKETGVSGGRGGSMHLFDRKTNFMGGYAIVGGQVPLAVGAAYALRYQNKPGVVVAQMGDGTTNIGAFYESLNLAKLWKCPVLFFIVNNGYGMGTSVEAGSSEPDLWKKGASFRIHGERVDGTDVLAVRDVVRRLRARAEAEGEPAIIDAVSFRFRGHSVIDSDRYRDPEAVRRGRELYDPIRKFATLLLDHGVVDDAWLKGIAEQVEREVQEAIDFANNSPDPKFEDLY

SEQ ID NO: 9001 - protein, 465 aa, Chloroflexus aurantiacus
YDLVVLGSGPGGYVAAIRAAQLGMKTAIVEVNALGGVCLNIGCIPTKALLHSADLLEEVKEAKRFGITVENVAFELAGAMKHKDTVVKQSTDGVAFLMKKNKIEVVAGRGRLIGRGQVHVQLNEGGERVLAAKHIIVATGGRPRPFPGIPFDGERVLSSTDMLTLKTVPSSLLAIGAGAIGVEFASMFRSFGSDVTIVEALPRIVPNEDEEVSAELTKAFQRRGIKTLAGAKVEGVDVGGEKVVVTVVDSSGKPQQIAVEKLLVSIGIAPNTENIGLEEVGVKVNNRGFIETDGFLRTSAEGVYAIGDCTANTPWLAHKASAEGILAAEHIAGHHVTPIDYGKIAACTYCNPEIASVGLTEAKARERGYQVKVGKFPFSANGKARVLGQTRFGFIKLVADAQYDEILGVHMIGPRVTEMIAEGGIALSHEATGESMMQTIHAHPTLYEAIGEAAHALVHGAPIHL

SEQ ID NO: 9002 - protein, 203 aa, Chloroflexus aurantiacus
MRLIIVRHGESEWNRINRYQGQQDAPLSELGRKQAAALGERLRHEKIDVVYSSRLQRAAHTAQAIVAHHPGLEIIYDDALLEINHGEWEGKYLHEILERYADGLREWRQHPTRSQMPGGESFSNVLKRVLDFRERICVQHAGQTVLISTHDVIVKILVADALGMNMDRINRIWVTNASISVIEYGDDLPYLVSLSEACHLGHL

SEQ ID NO: 9003 - protein, 514 aa, Chloroflexus aurantiacus
LGRYREIAQVLVHHGFGYLVDQLGLSGLLSLPRRVILRAPAPPPLGSAARLREALIELGPTFVKLGQALSTRPDLLPADVVAELSKLQDTVPPFPGDQAVALIEATFNRPLDQLFIAFDRQPFAAASLGQVHAAVLPDGTQVVVKVQRPDIASRIQTDLAILADLATLAQERLAFAAQYNLSEIVWEFSAMLRAELDYVREGRNAERFRQMFCTNPHIYIPRVYWEYTGSRILTTERIVGVKLNDMAGLRAAGVDMSRLARASLDITLEEIFTHGFFHSDPHPGNFFVLDGDVLGVVDFGQVGTLDHATMQGLLWLMGALVNHDSQGLLRSLERLEVIPRRAANLALRRDLERFVEGFVDRPLGLISARETFDGLTTLLRRHRLTIPGPLATLLKTIVMMEGLGMQLDPNLNVFAAARPYIQRALREQMNPTALGAQALAGGRELGELAFDLPIQISQTLQHLNDGELRIQTRELELRRLAAALIGAANRLALALVVAAFIVGVAALVIAMRAL

SEQ ID NO: 9004 - protein, 216 aa, Chloroflexus aurantiacus
RQPRAPLRYVVRELLETAIFILLVFLIVRGVVQNFKIEGSSMEPTLHTGQYILVNKLIYFHFDLNAPLRLLPGQSDLPPRIVYPFRPPQRGDIVVFEYPRDVRKDYIKRVIGLPGDIIEIREGKVFVNNEPLDEPYLRGASTYCLGGYPCAQGPVLVPAGSIFVMGDNRGNSSDSREWDALPLDRVVGQAWLIYFPFSDWGLVPHHRYETSTAVAP

SEQ ID NO: 9005 - protein, 416 aa, Chloroflexus aurantiacus
YDIKDINLAEQGRKRIEWAEKEMPVLRLIRERFARERPLAGLRISACLHVTTETANLMRTLAAGGADVVLVASNPLSTQDDVAAALVAYEEIPVFAIKGESNEVYYSHIRAALDHNPQLTMDDGADLVTGVLRDRPDLIPHMVGSTEETTTGVIRLKAMAKEGVLPFPVIAVNDSDTKHMFDNRYGTGQSTLDGIIRATNILLAGKTFVVAGYGWCSRGIAERARGLGANVIVTEVDPIKALEAVMDGFRVMPMEEAASQADFIVTATGNKHVIDSNAFAVMKDGCVIANSGHFNVEINIPALEALSVEKRQPRAFVDQYILRDGRAINLLGEGRLINLASAEGHPSAVMDMSFANQALASEFLLRNQGKLPVGVHALPKELDREIAALKLAAMGIKIDTLTAEQEAYLNSWQEGT

SEQ ID NO: 9006 - protein, 391 aa, Chloroflexus aurantiacus
RFYFTSESVSEGHPDKMCDQISDAILDAFLSHDPKARVAVETATTTGLIVVLGEVTYERGYIPIEEIVRRTVKEIGYTSAEYGFDADTCGVMVAIHGQSPDIAMGVDKALEAKIGAMADDVEAVGAGDQGMMFGFACDETPELMPASIALAHRLIRRLERVRKDGTLPYLRPDAKSQVTVEYSFGKPVRVDTVLISSQHAPDITQDQIRADLIEHVIKTEIPEAWLDSQTKIFINPTGRFVIGGPMGDSGLTGRKIIVDTYGGVARHGGGAFSGKDPSKVDRSAAYACRWVAKNIVAAGLARRVELQVSYAIGVARPLSLSVETFGTAAVPDEVILKAVNEVFDLRPGAIIRDLDLRRPIYRKTAAGGHFGRTDIDLPWERTNRVEELRRA

SEQ ID NO: 9007 - protein, 501 aa, Chloroflexus aurantiacus
  unsure (1)..(501): unsure at all Xaa locations
RPPVXPIMVHLDHGKTKLLDAIRSTRVAEGEAGGITQHIGAYQIEVNHRKITFLDTPGHEAFTAMRARGAQVTDIVVLVVAADDGVKPQTEEAIAHVKAAGVPMIVAINKIDLPTANPDRIKQQLANVGVIVEEYGGNVPCVHVSARQKINIDGLLEMILLVADLEDLRANPNAPAVGTIIEAKLDKSRGPVATVLIQNGTLHLEDNVLVGCVAGKIKSMFSDSGKRLRHAEPSTPVEIVGLEGVPQAGDILQVMDDLVVAREIALQRQRQQRAEVMAAAARGTSLEELFGKVKQGQVKELNLILKADVQGSLDAIAHLIEQLNQSQQAVQTRIIHRGVGAITEGDVNLSLASHAIIIGFNARPDPAARRHAEQHGIDIRFYNIIYQLQDDLKKAMAGMLAPTVKEVVEGYAEVRNTFRLPTREVVAGVYVSDGKITRTGQNVRVLRRGVVIHDGKISSLKRFKDDVREVTAGYECGLIVEGFNDIEVGDALEFYRQETVA

SEQ ID NO: 9008 - protein, 266 aa, Chloroflexus aurantiacus
LPIAVIGAGAMGEAIIGGLLRNELVAADQILASHPREDRRRELSHHYGIQTTHDNLAAAQWGRVVIFAVKPQQLRRVLPPLRGALRDDDLAISVIAGATIASFAEALDHQAVVRSMPNTPAQIGCGMTVWTAAPAVNERQRGWAATVLGALGRELFVDNETYLDMATAINGTGPAYVFLMMEAMIDAGVHLGLSRRIAEELVQQTMLGSVQYAIQSGLHPAQLRNAVTSPGGTSAAALSELERGGLRTVLADAIWAAYRRSVELGR

SEQ ID NO: 9009 - protein, 216 aa, Chloroflexus aurantiacus
MKQGFFITFEGPEGAGKSTQARRLYERLQSIGYPTILTREPGGTRISELIRRILVDLRHTEMAPTTEILLFSAARAQLVSELIRPYLATGGIVVCDRYADSTFAYQGYGLGRDLEELRTITDIATGGLKPDLTLYLRIDVEVGLQRKRASRERIEPGSVQPPEWNRLDARDLAYHQRVAQGFNELMAQEPERWYALDADQPVDELAEQIWQVVMAR

SEQ ID NO: 9010 - protein, 386 aa, Chloroflexus aurantiacus
DGHIASPTGFRATGVSAGLKEGSKARDLALVYSQYPCRAAALFTTSVFKAAPVFLSQAILLRNHDAIRAVLINAGQANAGTGQSGLNDAIECAKITADELEVPRDSVLLMSTGLIGVPLPMQRMRNGIRRAVSELDSNGGRRAALAILTTDTRPKERVLRVTLRNGPRFTLAGMAKGTRMIHPRLATVLALITTDLAISQPLLQRALHQSVERSFNRLNIDGDCSPNDSVIMLANGAIDHPPITDSSTWEFGVFQEALDFLCADLAGQIVRDAAGSGKVIKVVVQGAADEAAASAIAHTVARSGSVRAACRRHSSDWGALLAAIGASNVELRPDLLDLRIGTVPVMLRGAPVPFDPTMLVQTMSGPEIELLIDLNLGPAETTVWTC

SEQ ID NO: 9011 - protein, 305 aa, Chloroflexus aurantiacus
MISTEQRVSLSRKIRAHIELADPVTWISPVLVCFCGALASGYERGFDWTRPDHWWLMLLGALMTGPLGTGFSQSINDYFDRDLDAINDPQRPIPAGIISLNEARWNWIVLGAATLLVSLVFGNPLIVLFAVVGIVLSVIYSMPPIKLKKHFWLGPPAVGLGYVSMSWMAGHLIFAPLTWQSVVVALINGGLAAGLLFLNDIKSVEGDRKLGLQSLTVAIGVKRTLIVAYVTINSFEAMLMILALIWGQYWVAAFMFLALVAPIYNQIKLYQEPTQQNYVRYLLASNPFVALIQIISGFLVGGYFG

SEQ ID NO: 9012 - protein, 320 aa, Chloroflexus aurantiacus
ISREKLLWAYERMRLIREFEDRLHTDFAAGKIPGFVHLYAGEEAVAVGLCAHLRDDDFITSTHRGHGHCIAKGVDLRAMMAEIYGKATGACKGKGGSMHIADVDKGMLGANGIVGGGPPLACGAGLTAKIKGTDQVTVCFFGDGASNQGTTFEGLNLAGIWKLPVVFVCENNGYAETTSPRYSVSGQDIAARARGFGMPSIAIDGLDFFAVYEAAGEAVARARRGEGPTFIEAQTYRYYGHFEGDSIRYRTRDEEAHYRSLDCLHRFRQTVTAQGLLTAAELDEIDARARAAVEDAVRFAAESPLPDPAELLTDVYVDYP

SEQ ID NO: 9013 - protein, 335 aa, Chloroflexus aurantiacus
RTLSYREAINEALRLEMRRDPTVILMGEDVTGASHSEDESHLDAWGGVLGVTKGLVHEFGRQRVRDTPITESGFVGAGVGAAATGLRPVVELMFIGFMGVCLDQIVNQAAKMRYMFGGKARIPLVIRTMIGAGFRAAAQHSDSIYSTFVHFPGLKVVAPATPADAKGLLAAAIRDDDPVIFCEHKLLYDMKGPVPEGEYVIPLGQADVKREGGDVTIVAISRMVLHALEAAERLAQQGISAEVIDLRTLSPLDETTVLESVRKTGRLVVVDEDNPRCSVAGDIATLAATQALEFLNAPVKLVTPPHTPVPFSPTLEDAYVPSPERIVAAARATFG

SEQ ID NO: 9014 - protein, 221 aa, Chloroflexus aurantiacus
MYKTVGEATTLVRDLLAGLGELSDREAIVCPPFTALAAVAALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGAL

SEQ ID NO: 9015 - protein, 749 aa, Chloroflexus aurantiacus
QPWQQAFDDSEAPFYRWFSGGLTNACFNEVDRHVMMGYGDEVAYYFEGDRWDNSLNNGRGGPVVQETITRRRLLVEVVKAAQVLRDLGLKKGDRIALNMPNIMPQIYYTEAAKRLGILYTPVFGGFSDKTLSDRIHNAGARVVITSDGAYRNAQVVPYKEAYTDQALDKYIPVETAQAIVAQTLATLPLTESQRQTIITEVEAALAGEITVERSDVMRGVGSALAKLRDLDASVQAKVRTVLAQALVESPPRVEAVVVVRHTGQEILWNEGRDRWSHDLLDAALAKILANARAAGFDVHSENDLLNLPDDQLIRALYASIPCEPVDAEYPMFIIYTSGSTGKPKGVIHVHGGYVAGVVHTLRVSFDAEPGDTIYVIADPGWITGQSYMLTATMAGRLTGVIAEGSPLFPSAGRYASIIERYGVQIFKAGVTFLKTVMSNPQNVEDVRLYDMHSLRVATFCAEPVSPAVQQFGMQIMTPQYINSYWATEHGGIVWTHFYGNQDFPLRPDAHTYPLPWVMGDVWVAETDESGTTRYRVADFDEKGEIVITAPYPYLTRTLWGDVPGFEAYLRGEIPLRAWKGDAERFVKTYWRRGPNGEWGYIQGDFAIKYPDGSFTLHGRSDDVINVSGHRMGTEEIEGAILRDRQITPDSPVGNCIVVGAPHREKGLTPVAFIQPAPGRHLTGADRRRLDELVRTEKGAVSVPEDYIEVSAFPETRSGKYMRRFLRNMMLDEPLGDTTTLRNPEVLEEI

SEQ ID NO: 9016 - protein, 336 aa, Chloroflexus aurantiacus
GVPCMKQRRLGNSDLNVSAIGLGCMTMTGGYSVSPNRQEMIALLRKAVELGVTFFDTAEVYGPFINEELVGEALEPFKGQVVIATKFGFKHDHNNRPTPAAGLDSRPEQIKRVAEASLKRLRVEAIDLFYQHRVDPNVPIEEVAGAVKDLIQAGKVRYFGMSEAGAHTLRRAHAVCTVTAVQYEYSLWWRRPEQDILPLCEELGIGFVPYSPLGKGFLTGKIDATTHFDSTDLRSRIPRFTSEARKANQALVDLLDEIARQHHATPAQIALAWLLAQKPWIVPIPGTTKLHRLEENIGAVKVELTSSDLQRINDAVALIPIQGARYPEELERMTYL

SEQ ID NO: 9017 - protein, 585 aa, Chloroflexus aurantiacus
PAYIKHHRLREWISDIVALCEPAQVHFCDGTPAEYDTLCNQMVENGTFIRLNPKLRPNSFLARSDPSDVARVEDRTFICSISKDDAGPTNNWMPPKEMKEILLKLFKGSMRGRVLYVIPFSMGPIGSPIAHIGIQLTDSPYVVVNMHIMTRVSTKIYDVLGEDGEYIPCLHSVGMPLEPGQPDVPWPCNPTKYIVHFPEERSIWSFGSGYGGNALLGKKCFALRIASVMARQEGWLAEHMLILGVKEPSGRKTYVAAAFPSACGKTNFAMLIPPDTFKREGWEITTVGDDIAWIKPGANGKLYAINPEAGYFGVAPGTSYKTNPNAMESCRANTIFTNVALTDDGDVWWEGMTDEPPAHLIDWQGRDWTPGCGRLAAHPNARFTAPARQNPAIDPEWENPNGVPIEAFIFGGRRSRVVPLVYQAFNWTYGVYLAATMGSETTAAAMGQQGVVRRDPFAMLPFAGYHMGDYFNHWLSFGRRLRNPPRIFSVNWFRKDENGKFIWPGFGENMRVLKWIIERAHGQAVSVETPIGWVPRYEDIDWRGLSFSAEQFEQVMECNVGEWQQEILLHEELFIKLYDRLPKEL

SEQ ID NO: 9018 - protein, 527 aa, Chloroflexus aurantiacus
STDVLVIGGGATGTGCALDLAMRGIRCVLVEKGDLTHGTTGRYHGLLHSGGRYVTKDPQSASECAHENAILRRIMPHCIEQTSGFFVITPWDDESYGDVFVANCHRTGVPVQEISVAEMLRREPLLNPRISRVFEVPDGSADSFLATHSVALAAREYGADIRTYHHVVELIRVGDRVVGAIAEDLRSGERVRIDCAYVLNAAGAWAGKIAALAGLTVNVVPGKGTMVAMNHRMVNTVVNRCKLPSDGDIIVPIHTVAVIGTTDVHVPDPDVFGIEPEEIQFMLDEGEKLIPGFRQYRALRAWAGVRPLYKDKDVASDRDIPRTFKLLDHEERDGVSGIFSIVGGKWTTYRLMAEQTVNEIARRLGNTQPCRTASEVLPVPRFEHSSRATVTVSPNPAAQTPHYWLGKPLALVESHHAAGDLICECELVTRDRIQAAIDAGAHNLDDIRRDVRMGMGPCQGGWCIYRTANLLYEQRCAAGLSHVHTNEAIMHFLQERWKGLTPVLWGDQLRQARLDELIYVGVLGIDR

SEQ ID NO: 9019 - protein, 498 aa, Chloroflexus aurantiacus
MAKYAAAIDQGTTSTRCMIFDHSGNVICYDQKEHEQIYPRPGWVEHSPDEIWERTQSVIRGALSKGGLSASDIVAVGITNQRETTVVWNRKTGRPVYNAIVWQDTRTDQICNELAADGGQDRFRPKVGLPLATYFSGPKIRWILDNVPGAREAAEAGDVVFGNIDTFLTWWLTGGPNGGVHVTDVTNASRTMLMNLETLDWDDEILGIMGIPRQMLPKIVPSSMVYGTATGELAGVPVAGILGDQQAAMVGQTCFDVGEAKNTYGTGSFMLLNTGTKLVPSKSGLLTTVCYKFGDQPAVYALEGSIAITGALVQWLRDNLGLITSSAEVEALANLVEDNGGIYFVPAFSGLFAPYWRSDARGVIVGLTRYVNKDHLARAVLEATAYQTREVLDAMEQDSGVKLTALKVDGGMVYNNTLMQFQADILGVPVIRPKVAETTSLGAAYAAGLAVGFWSNTDEMRANWGVDHTWTPQMDEATRERLYRGWKKAVTRTFDWVE

SEQ ID NO: 9020 - protein, 333 aa, Chloroflexus aurantiacus
KPVKKLINAPENVVKEALAGMAIAHADLIQVHYDPDYIVRVGAPHNKVGVISGGGSGHEPMHGGFVGYGMLDAACPGAVFTSPVPDQMLAATKAVNGGKGVLHIVKNYTGDVMNFEMAAELAAAEGIEVASVVTNDDVAVENSTWTAGRRGVGVTVLLEKIVGAAAEAGADLATCKAIAERVNASGRSMGMALTPCTVPQAGKPGFELADDEMEVGIGIHGEPGRRREKLAPARDIAEMLAGPILEDLPFKSGDAVLAFVNGMGGTPLIELYVMYNELARILKDRNITIARSLVGSYITSLEMAGVSFTLLRLDDEMIKLWDAPVHTPALRWG

SEQ ID NO: 9021 - protein, 534 aa, Chloroflexus aurantiacus
RPVVLIIMDGWGIAPPGPGNAADLADTPHVDAWMANCPFTTLGASGLDVGLPEGQIGNSEVGHLNIGAGFVVYQELTRISKAIADGDFFTNPVLLQAIEHVKQRNSALHLMGLFGPGGVHAHEDHLHALLELAHRHHLQRVYLHLFLDGRDVLPRSALGFLDTLEGVIARLGVGTIATVSGRYYAMDRDKRWERTGRAYAALVDGVGEKAPSARAAIEASYARDVSDEFVLPTVIVTASGEPTATVRDGDAVIFTNFRPDRGRQLTRAFVDPDLNERIRQHYERQKAEGQPLPATIWQRERQLRDLCFVTMTQYEEGLPVLVAFPPRYVTNPLAAVISQAGLRQFHIAETEKYPHVTFFLNGGREEPFPGEDRQLIPSPKVATYDLKPEMSAPEVTEALLAAIDSDQYDFIVVNYANPDMVGHTGSIPAVIKACEAVDAGLARVVPAILERGGVALVIADHGNAEQMIDPETGGPHTAHTTNPAPCFLIGGAGYGKDAIELRHGGRLADVAPTLLELLELEPSPDMTGQSLIVR

SEQ ID NO: 9022 - protein, 318 aa, Chloroflexus aurantiacus
  unsure (1)..(318): unsure at all Xaa locations
RTGKVGVVGTGMVGTSFAYALMQRSLASELVLIDIDHARAEGEAMDLNHGLPFVRPMRIYAGTYDDLAGADLIVIAAGANQRPGETRLDLLNRNVAIFREIIPPILAANDDGIIVVATNPVDILTTIGAQIAGPAANRVIGSGTILDTARFRYLLGQHYGVDPRSVHAYIVGEHGDSELALWSLANIAGVRLVDFVGANGQGYNQAALDAILEQTRNAAYEIIKRKRATYYAIGLGLLSIAEAVLRDQHTVMTISSLMNGQYGVSGIAISLPTIVGRDGAEEVLNLPLSEQEIALFQRSAGILKEHLSHVQXRDRCIV

SEQ ID NO: 9023 - protein, 343 aa, Chloroflexus aurantiacus
IRPILFRLGRGDAETAHERTLHILALISRSRLLCKTIGYLTTIRDQRLQRTVCGIPFPNPVGLAAGMDKDGVAIPAWAALGFGFVEVGTVTHHPQPGNPRPRLFRLPEQEALINRMGFNNQGAASLARRLARLQPAPIPVGVSIGKSKITPLEQAIDDYRASFRQLFPYAAYIAINVSSPNTPGLRQLQDADQLRALLAALQHDNAELGRTDQRGPRPLLVKIAPDLSDTAIEEVLTVCADHGVAGIIATNTTISREGLTGVDPRLAAEAGGLSGRPLIARALHVVRLIARLTGNRLPIIGVGGIHTPDDGLRMLEAGASLIQIYTGLVYYGPLLPRRINRAI

SEQ ID NO: 9024 - protein, 334 aa, Chloroflexus aurantiacus
LITGGAGFLGINLTRYLLARGYLVRSLDIAPFDYPERNQIEEHTGDIRDRAAVDRAMKDVRFVVHTAAALPLYSPADIFSTDIDGTRNVLESARDHGVERVVHISSTAVYGIPDHHPLLETDPLSGVGPYGEAKVKAEELCLEFRRAGMCVPILRPKSFVGPERLGIFAMLYDWAMDGRNFPLPGNGKNRYQLLDVEDLCEAIVRCLELDRDRVNDTFNIGAKEFGTIKEDFQAVLDAAGHGKKIITFPAAPMVWALAILEKLKLSPVYKWAYGTVTEDSFVSVEKAERVLGFTPKYSNKEALVRNFQWYVEHANQFGQQTGVSHRVPWSQGIL

SEQ ID NO: 9025 - protein, 636 aa, Chloroflexus aurantiacus
MEQLNLLNPAQRAAVTAPIGPILVKAGAGSGKTRVLTLRIAYLITHYGVAPQQILAVTFTNKAAREMRERLSNLPGLRIRGLTSGTFHAICTRILRESIEGRLKGYTSSFSIYAGEEQLQLAAEALAGVGETPPRLIEADEVLRLISRAKSRMLTPRLMARFATDPLDRFIAACYRRYQRALEQANALDFDDLILTAYRLLSDDPDLLATYQQRWQHVLVDEYQDTDPSQHALIELLTRPTAQRPRSLFVVGDAMQSIYGFRNADHSIINRFATDFPDARVIELTTNYRSRQPILDAAYAIIRHSRSVAPMELRAAARNVDERCVLISEARDSRDEADQVARSIADLQRQGRRLRDIAVLYRTRHMSRPFEQALRHARIPYQVRGGVSFFDRAVVRDALAYLRCIANPADNLSLTRIANVPARGLGGQALATIAAYAAAQSLPISTALGHARNIPGLSPRAVEGAHRLFALLQRWWRLAESTMPPDHVLADVLEQSGYMAALAERFDAEELAEARAHLQELLRAAEEHTDLRSFLQEVALMTNTDDEDDERDRVQLLTIHAAKGLEWPFVFVVGLEEGTLPHERSIGDPAAIEEERRLCYVALTRAAERLYLSWTASRQRGQRLKPSRFLDEICID

SEQ ID NO: 9026 - protein, 259 aa, Chloroflexus aurantiacus
MLTRRIIPCLDVKAGRVVKGVKFLNHRDAGDPVELAAAYNAAGADELVFYDITASSDERAIMVEVVERTAAEVFIPLTVGGGLRSVDDMYRMLRAGADKVSLNTAAVYNPQLIAEGARRFGSQCIVLSVDAKRVNAPGEPPRWEVFTHTGANPRPTGLDAIEWIKRGIDLGAGEICINSMDADGARTGYDLELLQAITAISPVPVIASGGVGSPHDMYRGIVEGGADAVLAASIFHFGDYSVADVKRYLAERGVAVRMI

SEQ ID NO: 9027 - protein, 441 aa, Chloroflexus aurantiacus
LNQTIFRAYDIRGIVEVDLDEAIYERLGRATGTLFRNEGRQRIVVARDARLSSPRFQAALIHGLRATGMDVIDIGMVATPVMYFAVEALGADAGAIVSASHNPPEFNGLKLRRAEPRFGSEPLPSAAIQEVGRIAASGEFAQGSGGYEQVDIGPAYVESARRWIDFGGRRPRVVLDGGNGVAGPLAVAMYEALGIEVIPLFIEPDGTFPNHHPDPLKVENLRHLQAAVREYRADLGIGLDGDGDRLGVVDGHGEVVFADRYLIVLAKALLAKRKGPVVFDVKCSAVLPQAIRELGGEPVMWKTGYTSLSAKMREIDAVLGGELSGHTIFPFPGRYFDDGAFAGAVLLHALSELGQTLSEALAPYPVLPSIDEGRIPFPEERKFAVIDFLRERFTGKYPIIDIDGVRIDFGDGWGLVRASNTEPAITTRFEAQTWERVQAIR

SEQ ID NO: 9028 - protein, 628 aa, Chloroflexus aurantiacus
SILSEDDIYLFNQGTHYRLYDKFGAQPVVLEGVPGTYFAVWAPNAEYVAVIGDWNNWDAGANPLRQRGFSGVWEGFIPHVGKGMRYKFHIASRYYGYREDKTDPFGTYFEVAPQTAAIIWDRDYTWSDQQWMSERGQRQRLDAPISIYEVHLGSWRRKPEEDNRPLNYRELAHELVEHVKDCGFTHVELLPVTEHPFYGSWGYQSTGMFAPTSRYGTPQDFMYFVDYLHQNGIGVILDWVPSHFPTDGHGLAYFDGTHLYEHADPRKGYHPDWGSYIYNYGRNEVRSFLISSALCWLDKFHIDGIRVDAVASMLYLDYSRRAGEWIPNEYGGNENLEAISFLRELNTQIYKYYPDVQTIAEESTAWPMVSRPVYVGGLGFGFKWDMGWMHDTLQYFRRDPIYRRFHHNELTFRGLYMFSENYVLPLSHDEVVHGKGSLLDKMAGDVWQKFANLRLLYSYMFAQPGKKLLFMGGEFGQWREWSHDTSLDWHLLMFPSHQGVQRLIGDLNRLYRTEPALHELDCDPRGFEWIDANDADASVYSFLRKSRYGEQILIVINATPVVREDYRIGVPVGGWWRELFNSDSEYYWGSGQGNAGGVMAEAIPTHGRDFSLRLRLPPLGALFLKPAG

SEQ ID NO: 9029 - protein, 539 aa, Chloroflexus aurantiacus
PLWYKDAVIYELHVRAFCDSNGDGIGDFPGLTSKLDYLQDLGVTAIWLLPFYPSPLRDDGYDIADYTNIHPNYGTLADFKVFIREAHRRGLRVITELVCNHTSDQHPWFQRARRAKPGTSARNFYVWSDTPDRYKDARIIFKDFETSNWTWDPVAQAYYWHRFYSHQPDLNFENPAVQRAVFKAMEFWLDLGVDGMRLDAIPYLYEAEGTNCENLPETHAFLKRLRKHMDEKYQGRMFLAEANQWPEDAVAYFGDGDECHMAFHFPVMPRLFMSVHLENRYPIIDIMRQTPPIPDNCQWAIFLRNHDELTLEMVTDEERDYMYRVYARDPQARINLGIRRRLAPLLGNHRRKIELMNGLLFSLPGTPVIYYGDEIGMGDNIYLGDRNGVRTPMQWSGDRNAGFSRANPQQLYLPVITDPEYHYETVNVETQSANQHSLLWWTKRLIALRKRYAAFGRGTLEFLYPENRKVLCFLRKTEDQILLAVFNLSRFVQGVELDLSPYRGLMPVELFGQVEFPPIGDQPYFLTLGPHSFYWFTLT

SEQ ID NO: 9030 - protein, 342 aa, Chloroflexus aurantiacus
LGLGGVGRALVRQMLAVAPTIRRRYGIDLRYTALVDSRGALAGDPALTDDQIQTVLTAKAAGHHIDSLAHAITDRHWLELLPATMAIVVDVTAAGSHAAPLAAAISAGHRVVLANKRPLCESYELFAALTERGATRYEATVGAGLPVIGVLQSLIDSGDEVRAIEAALSGTLGFLMSELERGVGFADAVRTAHQLGYTEPDPRDDLSGADVARKALILARTCGMHLPPDAVIAEPLFPATLKEISVTEFLQRLEEAEHEVMNRLQVASANGKVLRYITRISPDNGVEVGLRELPTDHPLASLRGPDNMISFTTNRYADRPLVVRGPGAGVEVTAAGVLSDII

SEQ ID NO: 9031 - protein, 480 aa, Chloroflexus aurantiacus
LYIDGAWQPAENGQTFTVYDPATSQPIATCVQATHSDVDRAVRAARAAFDHGPWPHTSPAQRAEILHAIADALEARNFELAEIESRDAGVPIRKTTYNDITLGLEILRGCAEMARKHPYEPLPWNDLPSVSWNFVWREPIGVCAQIIPWNYAFCMAAWKLGPALATGNTVVFKPSSLAPLSTLAIFQTIHDLNLLPKGVINLVLGPGGDVGEYLVTHPAVDKVAFTGSTEVGRKIMALAAPHIKRVTLELGGKNAMLILPDADLDLVVDGVLWGAFYHSGQLCEAGSRLLVPHALHDTLVERLVERVRGMRIGDPMDLETDIGPLISERQREKVEYYIAVGREEGATVVIGGGRPIGEAFANGHYVEPTIFTGVRPEMRIAREEIFGPVLSVIAYDEIGEAIRIANDSIYGLAASVWSRDLQHALSVVRRIRAGTVWINEHHVLNPRAPFGGYRQSGFGREMGRYGLDEYTEVKHIHVDL

SEQ ID NO: 9032 - protein, 419 aa, Chloroflexus aurantiacus
LEAIGRRAKTAARALAKLSTEQKNAALCAIADGLLARQDKILAANAADVADAEKGGTPPAIVDRMLLTPARLAAIAGDCRQVASLPDPVGEIFDRRELPSGLRLYKRRVPIGVIGAIYEARPNVTVDIASLCLKAGNAVILRGGSDIARSVAATTEVIALALEQAGLPAFAVQSIIDPDRELVRQLLRLDRYVDMIIPRGGAGLHRFCVENATVPVIVGGMGVSHIYVEPSADFARAVPVIVNAKVQRPGACNALDTLLVHRAAASTFLPLVAAALAQHGVELRCDLEALAILADAPGHEAWNLKPASPTDFGCEFLALIVAIKIVGSIDEALDHIALYGGHSEAILTGDPISAERFTREVDATAVFVNASTRFNDGGQFGLGAEVAISTNRLHARGPMGLQELTTYTWIGEGDYLVRA

SEQ ID NO: 9033 - protein, 168 aa, Chloroflexus aurantiacus
QILSADEIRRALVRIAHEIDERNGGLRDVVLVGIRSRGVPLAERIAAAIADFEGTRIPVGQLDITLYRDDLKLRGPAPRVRKTDLPIDITGKTVVLVDDVLFTGRTVRAALDAIADLGRPARIQLAVLIDRGHRELPIRADFVGKNVPTSLSERVMVRLRETDGVDEV

SEQ ID NO: 9034 - protein, 301 aa, Chloroflexus aurantiacus
RHAIDLDNFSATEIEEILETAESMREVLSREIKQVPALRGKTVVNMFFEESTRTRISFELAARALSANVVAFTARGSSVEKGESLVDTVRTLQALGADIIVMRHSQSGAPYLVARHFRGSLINAGDGRHAHPTQALLDLYTMQSRLGQIRDLHVVIVGDILHSRVVRSNLWGLTRLGARVTLCGPPTLIGPAAFWTATWPQVRIAYELDPLLPEADVVMALRLQKERMQSGLLPALREYTRIYGLTSERLARLPSHAIVMHPGPMNEGIEIFPEVATASPAVIEEQVTNGVAVRMALLYRM

SEQ ID NO: 9035 - protein, 544 aa, Chloroflexus aurantiacus
LGLGEKTGRLNRKGRDFILWNNDVLSPHGEAEFAVGRDPADPRTKNTSTEFDPYYISIPFFYHLDQTGNAAGFFLDNPYRVHVDFSPAETYGICALGGQYTEYVLAGPRIADILEGFTWLTGRLAPPPIWALGYHQCRWHRYSQADILTLAARHRERRIPCDTLWLDIEHMDGYRVFTWNHELFPDPTALARQLYEQGFRLITIVDPGVKVDPDFALFREGVAHDLFCRAASGELYIGQVWPGRTAFPDFVKPEARTWWGEQNARHAQLGIAGIWNDMNEPATGDIPPYAMRFNGGREPHERYHNQYALLMAMATVEGLHTAFPNQRTFVLSRAGFAGIQRYAANWMGDNCARWDHLWMSMPMAMGTALSGQAFIGADIGGFAGDTQPELFARWMQCAALTPFCRNHSAYGHIDQYVWSFGPAIEQIARNAIELRYRLMPYLVTAFMRTVETGEPVQQPLVFAYQYDRLTLEIDDQFLVGRDLLAAPVYTPGTTSRQLYLPAGEWYDWHTDTRYAGEQFVVIPAPLERLTLFARGGAVIPLWPD

SEQ ID NO: 9036 - protein, 382 aa, Chloroflexus aurantiacus
EFIMPAQMIIGSGAVDQVGAQCAKRGWKKALIVTDQIMQKLGIVGQVEQNLAHHGINSVVYAGVNTEPVVEYVQEGLTTFREGGCDFVLAVGGGSPIDTAKAVAVLVTNPGSIEQYKGIGKIGAPGVPLVAIPTTAGTGSEATIYTVITDQKTDVKMLIGSPYLMPTIAIVDPMLTISSPPSVTAATGVDALVHAIEAYVSVKRQPMTDVLCLSAIELIAGNIRQAWANGNNIEAREKMMLGATQAGIAFSNSSVALVHGMSRPIGAYFHIAHGVSNAALLAVVTEFSLVGDPQRYADIARAMGEPTEGLSLMEAADRAVVAIRRLVRDIKIPSLRQLGVERERLMELAPAMADAAIDSGSPANNPRKPTKQEIIELYARAY

SEQ ID NO: 9037 - protein, 380 aa, Chloroflexus aurantiacus
DMFLGPEHEMLRQTVRNFAEREVAPHIREWDRSGAAAEGPEDRPHLRPVLKRMGELGLLGICIPQRYGGAGMDYLALAVVCEELERVDSFLRVVMSVHTGLNSLSIFQWGTEEQKQRFLVPQARGEKLAAFCLTEPNSGTDAAAMQATARRDGEDYILNGEKIWISLADLADNFLVFAKTDPGAGPRGITAFIVERSMPGVSSYPIHGKLGVRAGNTGGVVFNDVRVPRSHRLGEEGEGFKIAMAALDNGRYTVAAGATGLIQASLEASIRYARERQTFGVPIAEHQLVKRMISHMVRKLDTSRLLVYRAGWMKNKGIRNTRETTLAKWHATVSSFEAADDAIQIHGAYGYADEYPVERYLRNARGAIIYEGTRELQELL

SEQ ID NO: 9038 - protein, 75 aa, Chloroflexus aurantiacus
LIDVRQPEEFAYDGHVSGARLLPLPVLASRLNELPKDQPIVCICRSGNRSQVACEMLQRHGFTNVTNVVGGMVAW

SEQ ID NO: 9039 - protein, 269 aa, Chloroflexus aurantiacus
MDITAYLNRINYAGPLAPTAETLRRLHLAHLLSVPFENLSIHWHEPIVLTDEALFQKIVLRQRGGFCYELNGLFASLLRTLGFQVEMLSAGVMNKRGEFGPEFDHMTLMVTLAERWLVDVGFGDSFREPLLLDARTEQVQGRRAYRIEEVGDGRLILMERREGDEWQAQYRFSLEPHVYADYAGMCRYHQTSPESHFTQRRICSLATADGRVTLSERRLIITRGGERQERELGSAEEYGEVLRTHFGIEAAPNQGMQPTAMRRSVILET

SEQ ID NO: 9040 - protein, 307 aa, Chloroflexus aurantiacus
AIVETKNLTRYYGAMLALDHLNLHIPAGAVYGFIGPNGAGKTTTMRILTTLLTPSGGEAWVAGFSVTHQRTEVRRAVGFMPDSFGFYNNMTAAEYLKFFADAYHVPPARQLGLIEDLLTLVDLAHKRDSDVMSLSRGMKQRLSLARTLIHDPQLLILDEPASGLDPRARVELRELLKELRRLGKTIMISSHILTELAEMCTHIGIIERGKLLASGDVTTIMRSLQPHRTFEVHVISDLEQAAAAAATADHVLAVRTITDDEPPRLEIDVDGDNHAVSALLAHLINHGVEVVHFTAQTSNLEEVFLKV

SEQ ID NO: 9041 - protein, 207 aa, Chloroflexus aurantiacus
LRDLKAVVTGGSRGIGRAIAEALARAGAQVIISSTNPTNLTEAERALQAAGLNVTGIRCDVANRNEVEALASAAVERMGRIDLWVNNAGISGPFGYALDIPPDAWEQVIRVNLLGTYYGCRAALPYMIKQRNGQIINLSGGGAKRAQRFLSAYSTSKAAIVRLTEAFARDYQDHPYLRFNVLTPGMVPTDMINHFETVGPGGEAIKQ

SEQ ID NO: 9042 - protein, 284 aa, Chloroflexus aurantiacus
SARILDGKALAQELRAEAAAQIAELRTQIDRPPTIAVVQVGDDPAATRYVRSIDRLCQSLGAACRAIALPAETAQADLEATVATLSADDRIDGILLQLPLPAGLTLDGVLSRLAPEKDLDGIHPINAGLLAQGRPTLTPNTPAGGIELMRRYGIDIRGRRAAVVGRSAIVGRPMALLLLQADATVTICHSRTPDLGAVLRECDIIAAAAGRPGLITADMVKPGATVIDFGTNVLADGSMVGDVDFAAVAEVAGAITPVPGGTGPVTNIMLMRNLITATRTRLGI

SEQ ID NO: 9043 - protein, 230 aa, Chloroflexus aurantiacus
VRYSARTDVGQRREVNQDAYGSAEIDQGTLLVVCDGMGGHLAGEVASRLAVETIITSFRADNDPAEGLRQALISANQRVYQEGRGTMGTTAVAAFFWHNMLYVANVGDSRAYLVREGLIRQLTNDHSLIGDQVAAGLLTPEQARTSTIRNIITRAIGHQSHVEVDIFREPLLPGDTVVLSTDGMHGLLTDEEIAAIASMHPLDVASRRLVDEANARGGPDNITVVVAQVD

SEQ ID NO: 9044 - protein, 630 aa, Chloroflexus aurantiacus
  unsure (1)..(630): unsure at all Xaa locations
LDETIAAQIAAGEVVERPASVVKELLENAIDAGAQRIVIEVRGGGLREIRVQDDGCGIPADEIELAFARHATSKLQSADDLWAIRTLGFRGEALPSIASVAQVICISRVADAELGVELRIAGGEVQSRLPCGCPVGTTITVRNLFYNTPVRREYLRSEATETGAISAIVQQYALAYPEVSFSLLIDGRMALQTSGDGDLRTVVVELYGLEVGRALLPVQAEAGVDETWVAVNGLISPPELTRSSRNYLSLFANRRALQPRGALAAVVENAYHTMLMKGRFPIAILDVRVHPAAIDVNVHPTKSEVKFRYAAHVHSVLGRAIRDALLRGADIPTWDAPDPATAQRRFELRRLGQVATTPSSGWSVGASAWDRERSRWDVGSPATALNTPLPIVPEAPQSPPSPTLVPEPARQTPGEPITPAVPAAAPSALPPLRVVGQVGLTYIVAEAPEGMYLIDQHAAHERITYEKLMNQYAQHAVESQQLLIPQAVEVSPEASALLLGNAERLAEWGFVLEPWGTGVLVRAIPATLPTDELTQAIHEIAEKLAGRGGSDPLEWREAMLITLACHTSVRAGQPLSHEEMRQLLRQLEQCVSPRTCPHGRPTMILMTPAQLERQFGRRVXPGLKAQRRNG

SEQ ID NO: 9045 - protein, 309 aa, Chloroflexus aurantiacus
MRKKISIIGAGFVGSTTAHWLAAKELGDIVLLDFVEGVPQGKALDLYEASPIEGFDVRVTGTNNYADTANSDVIVVTSGAPRKPGMSREDLIKVNADITRACISQAAPLSPNAVIIMVNNPLDAMTYLAAEVSGFPKERVIGQAGVLDAARYRTFIAMEAGVSVEDVQAMLMGGHGDEMVPLPRFSTISGIPVSEFIAPDRLAQIVERTRKGGGEIVNLLKTGSAYYAPAAATAQMVEAVLKDKKRVMPVAAYLTGQYGLNDIYFGVPVILGAGGVEKILELPLNEEEMALLNASAKAVRATLDTLKSL

SEQ ID NO: 9046 - protein, 340 aa, Chloroflexus aurantiacus
MVRVAINGFGRIGRQSFKAMLEYYPEEFEIVAINDLTDAQTLAHLLRYDSTYGAFDGEVTVTEKAIVVEQDDIRYELLTLAERDPAALPWKELGVDIVIESTGRFTDAEKAKAHLAAGAKKVIITAPAKGEDITICLGVNDAKYDHEKHHIISNASCTTNCLAPVAKVLNDRFGIERGLMTTIHSYTMDQNLQDNVHKDLRRARAAAINMVPTTTGAAKAVALVIPELKGKFHGYAVRVPTPTVSMVDFSVLLSTKTSVEEINQAFIEASESEELEGILGVSHDPLVSTDFIGTTYSSVVDLPLTMSMGDDFFKIVAWYDNEWGYSVRVADLTALVADRF

SEQ ID NO: 9047 - protein, 921 aa, Chloroflexus aurantiacus
SGRSMNEWNGFYGPNAGYLIELYERYCADPNSVDEATRAFFAQWAPPSDSAAPAGEAGQPPLDVTRIVGAARLIRYIRELGHLAARIDPLGSDPPGDPGLELATHGVTQADLAALPAHIVRGPIATQVRNAAEGVERLRQAYSGSIGYETDQIQDYLERAWIREAAEDRRFFGGLDADRQRELLDRLTEVECFERFLHKTFPGQKRFSIEGCDMLIPMIDAIIRNAAVNGTKEVVIGMAHRGRLNVLAHILGKPYSMILTEFHSPDYTKDTYEGWTGDVKYHLGARKAYRESGIAEMPITLAPNPSHLEFINPVVEGRARAAQEHRNRPGFPEEDEKESLAILIHGDAAFPGQGIVAETLNLSRLKGYHTGGTIHIIINNQIGFTTDSNDSRSTLYASDLARGLEIPVVHVNADDVEACIAAARMASAYREKFQKDFLIDLVGYRRWGHNEGDEPEFTQPKMYERIRNHPTVREIWARELERRGIITREEAQARVDAVMNRLQQAFEKVRERQRLAASLPPAPPPPVQPLRRPPIFTRPVSAKTLIELNEALLDRPEGFTVHPKLERTLQRRRQAIFEESGIDWGHAEALAFASILADGTPIRLTGQDSERGTFSHRHAVLHDVVTGERFIPLHHIPQARASFAVYNSPLSEASVLGFEYGYSCHAPDTLVLWEAQFGDFANGAQVIIDQFIVSGHAKWGQNPSLVMLLPHGYEGQGPEHSSARLERFLQLAANDNIRVANCTTAAQYFHLLRYQAASLYADPKPLIILTPKSLLRHPRSSSSLRDLTDHRFQPVLGLGAEAPAPEGVTRLILCSGKVAIDLLSSAEWEKTAGRVDVLRLELLYPFPAEELRMAMQRYPNLQEVVWLQEEPQNMGAWSFVWPRLQQLLPEGVTLRYVGRAESASPAEGLHSIHVREQARIL

SEQ ID NO: 9048 - protein, 445 aa, Chloroflexus aurantiacus
EIRVPSLGESIVEATVARWLKREGEPVAVGEPVVELETDKVNLEVAADQSGILTSIACPEGTTVGIGDLLGTIEAGALPKEAPVAAASTTTVAAPVAEPVAATAVNEVLATPVAQRMAAEHAIDLRTVPGTGPGGRITKEDVMRLVSGTGPSEATAKADEARVHVSHPTPAVVERPQPAQPSPAPAPVAPPPPAPAPRPTPPAAPAVVSTNGDRREERQRLSRRRLTIARRLVEAQHTAAMLTTFNEVDMSAVMALRARHKDSFKERHGVGLGFMSFFTKAVVGALKAFPMVNAEIQGEEVVIKYYYDIGIAVGVDEGLVVPVVRDADRKTFAQIEREIAQLAKKAREGTLSLAELQGGTFTITNGGVYGSLMSTPILNAPQVGILGMHKIEERPVVVGGQIVIRPMMYVALSYDHRLIDGSTAVRFLVKVKELIEDPEALLLEG

SEQ ID NO: 9049 - protein, 496 aa, Chloroflexus aurantiacus
  unsure (1)..(496): unsure at all Xaa locations
WRYAEAVALARRAAGVLYDLGVRPGDRVGLMIGNNPDYLWAWFGCACLGAVTVPINLHLKGDVLHYILDHAGATVLLIEAHLYERIAALRAQLPTLRHLVVRGSDTAPPDAVHWHTALSGARPVDPSPGSATDLHSILYTSGTTGPPKGVMLSHHAYLHSAALFADVMIGATADDVFGTSLPLFHINAQAHTVLPAIYRGTTIALIEQFSASRYWRQLADLGATICNLLAAMIPILMKQAPSADDRAHRVRIAACAATPPDLWRAFEERFGLTIIEGYGLTETTGFCVANPRDAVRVGTFGKAMPGFELAVVDASDQPLPAGVPGEIVIRPQRDHLMMMGYYRQPEQTATAMRGGWFHTGDLGQLDEAGYAIFIDRLKQSIRRRGENISSWEVERAVNAHPAVLESAAVGVPSELGEEEVKVVVVLRPGATLDPIDLIRWCEERLAYFAVPRYVEFRQSLPKTATERVEKYKLKAEGVGNAWDREAAGYRVKRSXV

SEQ ID NO: 9050 - protein, 1139 aa, Chloroflexus aurantiacus
GVFSFLQSFMAEQTSHGLAFDLRNAIFSKIQRMSFSFYDRNQTGQLMVRATDDVERVRTFVAQGLVLAAQSFLLLIGALIVLAFTNWQLTLVILPLLPIALAVFFVFGRISQPLFLEVQNRLSRLNTILQENIAGIKVVKAFAREPYEEQRFDQAATALMEQQIRVNRIFAFLFPVIFLIAQLGQAAILYFGGQQILNGTLELGEYQKFSLYLVYVFFPLGQLGFIIALLAQAGASAGRIFEVLDAQSEIVERPDAIVLPPLQGRVEFRHVTFRYFNSSAPVLQDVSFVVEPGQTVALLGATGSGKTSIINLIPRFYDVSEGAVLIDGYDVRDVTIDSLRSQIGIVLQESNLFSGTIRENIAFGRPDASDDEIIAAAKAAAAHDFIMSFPDGYNTRVGERGMTLSGGQKQRIAIARALLLDPRLLILDDSTSNVDVATEALIQRALDRLMRGRTSFVIAQRISTVRNADLILVLDKGRLVASGTHAELLEQSPIYAEIYASQLIEDAPLPSTNGQGERRSDRTMMGGLGGQGRMLNTDVQKPKNVLATIARFWPYFRPYWPVVVLTFVLITASAQLQVTAPELIGQAVDCYLFPRADACWYTTVDAAATNADRLSGLTGLVGWLLVVFVGGAFLQGLAFFSMNWVGQRALRQIREDVFAHIHRLSLGYFARNEAGNVMSRITSDTDTIQQALSFALLSVVSGFLQIGLTINAMVLSNLPYALISLSVVPFMVLATFYFSTQARRAFRASRQQMGNVNAGLQESIAGAREVQAFNREAESIAQFERTNAANRDANIRAASFTSALNPVLEALGYVAIAIVVVVGALSALRNVPLFGTGIISLGTIFAFIQYVQRFNQPIQQIASLWTNVQNAIAGGERIFGLLDVQPDLVDAPNAYPLPPIQGRVVFDHVWAEYKPGEPVLRDVSFIAEPGQTIAIVGPTGAGKTTLVNLIPRFYDVSAGQVTIDGHDVRAVTAASLRSQIGIVLQDTFLFADTVMNNIRYGRLSATDDEVIAAAQLVGAQEFIERLPDGYQTILGERGTGLSQGQRQLIAIARAALANPRILILDEATSSVDTRTERIIQRAFDQMLAERTSFVIAHRLSTIRNADLVLMVKNGQIVERGSHQELLALRGAYYDLYQQQ

SEQ ID NO: 9051 - protein, 438 aa, Chloroflexus aurantiacus
IKMPQLGESVTEGTVGRWLKRPGDPVAKYEPLLEVVTDKVDTEVPAPEAGVLHEILVPEGETVRVGTVIARLAPAGATVPATPASAPAATTVAATASATTTVTATVAPPVADGRNTYLSPVVARLLSEHNLDPGQIRGTGQGGRITKQDVLRFLAERQQQPSAPVAAPVAPTPVAPSPAPAPAPAPVSPTPAPTPAPTPAPAPAPATFDIPADAELVPLTPMRRSIAEHMVRSVRTSPHVTTVMEVDLSRVIAHRAAHQEAFSRQGVRLTMTPYFVMAAVAGLQAVPVFNGSFTDQGIILHRRINIGVAVALQEGLLVPVIPDADEKNLLGLARAVSDLAERARTKRLRPEETQGGTFTITNHGVTGSLFATPIINQPQAGILGVGAIVKRPVVITQNGLDAIAIRPLCYLSFTFDHRIADGATADQFLATVKKRLEE

SEQ ID NO: 9052 - protein, 328 aa, Chloroflexus aurantiacus
IDFSSNINPFGPPESVLQALRTLNPAPYPDRSCLHLRRHLAAIHHCQPEAVLVGNGANELIHLVARALGEPGATALVVAPTYGEYAYASHLAGMRVIEIRSTVGNGFQPDLAELLLTIERLRPRLIWLCSPNNPTGVNLSVTTITELAHTCALHQGWLILDRAYLALGRDETGHDPLDHNSPSRLIRIYSLTKSYAVAGLRIGYMIADPDVIAATARFQPAWSVSSAAQAAAAAMLHDTGFLATTLPALWDASSELAQNLRQIGLTVWRAHLPFMLVHCDNAALTRQQLLVRGCVVRDCTSFGLPEWVRVAPRRPSENARLLAAWRDV

SEQ ID NO: 9053 - protein, 402 aa, Chloroflexus aurantiacus
EDGIYHSFCGLVSVGWLYQKIKDSFFLILGTHTCAHLLQNTLGVMIFARPRFAVSLLEESDLSSSQPDISAQIEEIKREHHPSVIFLLSSCTPEVMKVEFEGLAASVSTPEVPVLFVPASGLDYTFSQSEDSVLQALIPFCPPAPPDDKRVVFLGSVNDAIADDFSLEAARLGIPVAGFLPASHFTELPPIGPGTVIAPLQPYLHKTATQLRNERGCTVLSSLFPFGPDGTRRFWEDLAAQFGMQVDLSEREAAAWERIKHHTDLLRGKKIFFASDTLMELPLARFLKACGAEVVECSTPYINRRFHAAELAALDGVRLVEQANFHRQLRTITETKPDLIISNIITTNPLVGQGTVAKWGTEYCFLPIHGWAGVNNLVTSFTRALQRHARLDPLGSDPIWLT

SEQ ID NO: 9054 - protein, 541 aa, Chloroflexus aurantiacus
MRLAYWMYEGTAHHGVGRIANSMRNVHAVFHAPQGDDYVNAIFAMLDRTPNFPAMTTSVVSGTDLARGTIRLPDTLRQVEERVHPDLIVVVASCSTILLQENLEIAAQHAGLQCEVMVYDANPYRMQEIVAAESLFTDLVKRFAKPQPRTERPTVNILGPASLGFHARHDLISLRRMLKTLGLEVNVVAPWGASIADLRRLPAAWLTIAPYRELGLRAAIYLEEQFGVPALLDAPIGVQPTLRWIERLRELLAQAGADVPMPPLTAFSLDGMSAPSAVPWFARTADMDSFSGKPAFVFGDATHVVGVTRFLRDELGMPIAGAGTYVKHQADWVREQLTGYVDEVLVTDEFQVVADRIAALRPELVCGTQMERHTSRRYDLNCMVISPPTHIENHLLAYRPFLGFDGADVIADEVYTTCTLGMEKHLIDLFGDAGLDLPEKTERTPVAEPAPVAATVESPQPQNEPAIAVASAPSLTSAPATPTPAAVVDPVWAADAEAMLKKVPFFVRGRVRGNVEKYARQRGHAVITAEVLLAAKEELGA

SEQ ID NO: 9055 - protein, 314 aa, Chloroflexus aurantiacus
SRLQGFYQLNPFERLQMVKSFDGLVDEDLRALHGGHGGALTIERADKMIENVIGTYNLPLGIATNFRINGRDYLIPMVVEEPSIVAGASYAARMVRDGGGFETSSTEPLMIGQVQLVNVRDPDQARQTILSRKEEILALANAQSRSLVSLGGGARDVEVRFFPTSPMGPMLVVHLIIDCRDAMGANAVNTMAEAVAPLLAEMTGGKVYLRILSNLTDRRLARARCVVPAASLARDGLSGEEVVEGILWAYAFAAVDPYRAATHNKGIMNGIDPVLVATGNDWRAVEAGAHAYASRNGHYTSLSHWERDAQGDLV

SEQ ID NO: 9056 - protein, 555 aa, Chloroflexus aurantiacus
RPWLRHYDPGVPATLDLKPEPLPVLLQQAAERFADATAIAFYGRTLSYARLWAETNRFARGLLGTGFQPGERVVILLPNIPQSVIAYFGVLLAGGIVVLANPIFDAEGFAHEVRDSGATTVIALSMFHRLVEQVRAELHFPRLIYTNLKEYLPSSQRLLFTLLRQEQEGHRVPDAQASQALWFQHLVAAGQDGELPTLDAGDPAVILYTSGTTGAAKGVLHRHASLYINAYQTRMWYADAEEGNERVLCVIPFSHAYGMTACMNVGIALGATLILLPTFETHNVLHTIRRERPTIFPGVPPMYAALNEVREVRKYGLSSLKSCLSGAAPLPVEVQEGFERITRSRLVEGYGLTEAGPVTHANPLRGARRAGTIGLPIPDTEARIVDLETGQDLPPGAIGELLIRGPQLMAGYWNNPEATAEALTADGWLRTGDIARMLPDGYFQIIERKKEMIIAGNYNIYPRDLEEALYEHPTVIDAAVVGVPLPNGKTEVRVFVVTRPGERVSEAEVLAFLRERVNLPVVPDKIEFREALPRSFIGKLLRRRLVEELLSREQR

SEQ ID NO: 9057 - protein, 331 aa, Chloroflexus aurantiacus
MARVGIYGATGYTGIELIKLLSRHPEVEIGFATARSAAGQRLSEVFPILSDLRLTAVEEVDPATVDLVFTCLPHNTPDLIPIVQRALAAGARVVDFSDTFRISDPQVYAARRGKEHPAPELLAQAVYGLPELHRERIRQARLVANTGCYPLTAILPLVPLVRADLLADSTVIVDSKSGVSGAGRSLSLKTHFGETHETFSAYNVGRVHRHLAEMEQETGLHIIFAPHLLPVFRGILSTIYVNLKPGVDEATLAAVYADAYAAEPFVHVLPGGRLPELRHVQHTNHVVIGYQMVEPGRAILVAVIDNLVKGAAGQAVQNMNLLLGFAETVGL

SEQ ID NO: 9058 - protein, 443 aa, Chloroflexus aurantiacus
VMKQIVVIGGGAAGVEAAVAAAQGNTKVTLVSEGPIGGRTGWDSLLPSKVWLHAAEVAGIATAAAGEGVAVNGVQVDPTAVLQRIKHVATRWSDHEQQRLQAAGVTVMQGVAAFSSPHELTIQTQAGQQTITADVIIIATGSVPRFPPTMKPDGQRIIAPRFASHLHTLPDDIIVIGGGPTGSEFASLFSRLGVKVTWLVGSPGVLPMFATNARSTLAAAMQAHGVEIHQVDVERAERTEEGVSVLAADGTTYTAAMAFLAIGRTPDLSRLNLSAAGLTVEANGQLTVDNYGRTPVNHIFAVGDAAGGPMLANRALAQAWIAGRTAADLPAPGYCPHTIVHAVYTVPEVAQVGLVMDTELSRIRAEYGSSLKSYLGAETSGWIELTFDPITRQVRGGVAVGDHAADLLAPVALAIQTGATLADLAAVFAAYPTLSETVFAAAR

SEQ ID NO: 9059 - protein, 672 aa, Chloroflexus aurantiacus
PRTLFEKVWEAHLVRPETAETPAVLYIDLHLIHEVTSPQAFTELRQRGLRVRRPDKTLATMDHSTPTTPRNHLGIIPVVDPMAISQLEQLRKNCAEFGIPLFELGDENQGIVHVIGPEQGLTQPGMTIVCGDSHTSTHGAFGALAFGIGTSEVGHVLATQCLLQRKPKTCAVRIDGRLGPGVTAKDIILALIAKYGVGGGTGYVFEYMGEAIRALSMEERMTICNMSIEGGARAGMVAPDDTTFEYIAGRPFAPKGADFEAAVARWRTLPSDEGATFDHELTLSASELKPMITYGTNPGMGIPIDAPVPRPEDMPDARSRAALDKALAYMGLEPGKPLLGHPVDVVFIGSCTNSRLSDLRQAAQFFRGRKVAPGVRVMVVPGSQQVKRAAEAEGLDRIFKEAGAEWREAGCSACLGMNDDKVPPGKYAVSTSNRNFEGRQGPGARTMLASPLTAAAAAITGVVTDPAHVVELEEALVEPVSTITGKAVVLPVENIDTDQIIPARFLKVTDRSGLAAGLFEAWRYQADGTPNPDFPLNRPEAAGATILISGRNFGCGSSREHAPWALQDYGFKAVLAPSFADIFRSNSLKIGLLPVTIDQAVYDELVARYAADPQMHLTIDLATQTVTLPDGRQVHFPIDAFSKYCLLHGVDQLGFLLQQEEAIIAYEASHPQ

SEQ ID NO: 9060 - protein, 817 aa, Chloroflexus aurantiacus
MPVYRPADRMVLPPVDAEKYQTVCHYCIVGCGYHVYKWPEGRSGGLLPDQNALGVDFTKQVAPLSGDWIAPDHHTVITERDGRRFHIAIVPDKECVVNKGHHSGRGGTLGSSLYRPDGPTHVRLTHPLVYRATEQSPTTWDDAIDLAARVIYGSILRDGNNSIFMKIFDHGGGGGGFENNWAVGKFFFNAVQTINCSIHNRPAYNSEVHASRDMGVPELNFAYVDAELSDTIVLWGANSYETQTNFYLVHMLPNLQGTTVKAKQDARPGEQVGPGRIIVIDPRRTATVVVSERAAGKDRVLHLQLNPGTDIALANAIARVVYERGWHDKDFVANRVEAETVQPFLEQSLQIGKSLDEVLAEAEQITGLSRAQIEQAASWIAETKSDGSRPRSIFLYEKGVIWGMKNYQNIGSIVNLALLTGNFGKPGTGCGRLGGHQEGYVRPGYPGPRPAPYIDDLLSQGQGNVFYVVGCNPAVTTLNAQRMRETLQTRGKLVRDAIDASFGADNATKAQAILDAISQGGLFIIVQDIYPIETARYAHVVFPAAAWGESPITSINGERRLRLYEKFMDPPGIAEPDWKIFGMLAQRIKALAQADGNADIAQRFSGFEWQTAEEVFLEGGQSFADGVKASTERYKGVDYAFLKAAGNNGIQTPVTIVNGQPQGRVRYFENGEPFYTESGKAKMLPTPWPGFPAIVQEQINKYPYFLTNGRNNNWQTFYNDLNIPFHAERVPLSYIEINPQDAQREGIQPGDIVQLYNDYGETTAYAVVSNSVKPGLIFMLFAHPRSTANSLTTPYVDPEVIIPYYKGSAVGLRRLGR

SEQ ID NO: 9061 - protein, 249 aa, Chloroflexus aurantiacus
IYAMVMLWQQYVDWLDVTLMLVLYVISGLGITIGFHRMLTHKSFETSRPLKALFLIMGCMALEGDPTSWASTHIQHHAHSDDEDDPHSPLEGLWHSHVGWLFTHKNNIEMYGKWLTKDPTVVWVTKTWYVWAALGIIIPTLIAGWSGLIWGGLVRIFLTHHITWSVNSICHTFGRRDYNTRDASRNNFIVGLLAFGEGWHNNHHAFPRSAFHGLQWWQVDISAYIIRALEKVGLVWNVHRVKPEDLRKR

SEQ ID NO: 9062 - protein, 467 aa, Chloroflexus aurantiacus
ELIAELERILGPRGVVANPDALLTYDADGCVMDTHEPHVVTLPTSAEQVAAIVRLAARAGMPIVPRGAGTGLAGGATPMQGGIVISTARMDKILQVDTANGRVLCQPGVINWELSQYLKPFGYQFAPDPSSQKACTIGGNIANNSGGPHCLKYGITASHVLAVQVVLPDGSIVWTGDGSAHTPGYDLTGVITGSEGTIGFVTAAWLRLTRLPEAVRVVLALFPDIAGASNTVSQVIASGLLPAALEIMDRLAIKAVNDMYRLGLPEAAGAALLIEVDGVEDGLDELLNDVTAICWRNGAIDVRPARTLAEQNQVWAARKNAFGAMGRLAPTYYLVDTVVPRTKLPQTMDEVGRISREFRLPIANVFHAGDGNLHPIILFDRRDRSQNQRALEAATSVMQVSIDFGGVISGEHGIGVEKQDYMTLLFSTDDLAAMAGLHQSFDPHDLFNPGKVFPKGRGCGELAALRR

SEQ ID NO: 9063 - protein, 480 aa, Chloroflexus aurantiacus
TPVVVPDKLVAELRAILGADAVVTAPEALLTYDSDGSMIVSHPPQLVVLPKDAGQVATAVRLAVREGLAVVARGAGTGIAGGAVPLCGGLLISTARMTDITTVDVRSRLAVVQPGVVNADLNAHLAPLGYQFAPDPSSQRASTIGGNIATNAGGPHCLKYGVTSNHVLAVEVVDHTGQRYWTGDGVIDPVGYDLTGLLVGSEGTLGVVTAAIVRLTPLPEAVRVVLALFPTVVAAAAAVSAVIASGSLPTSLEVMDHNAIRAVNSAYSLGLPETTGTTALIIEVDGVQDGLDDQLDQIIAICRDHGAFDLRPARDPATQARVWMARKSVAGAIGRLAPAYYLVDTVVPRTRLPLMMEHVERLRAEYGMEVCNVFHAGDGNLHPLVLYDPRDPDQRQRAHAIAAGVLELSIEHGGVVSGEHGIGLEKCEYLPRFFSPAELQLHATIHQVFNPTGCFNPAKIFPSDTPPADLAAARAMRLQQ

SEQ ID NO: 9064 - protein, 337 aa, Chloroflexus aurantiacus
IPVAVLGATGAVGQRFIQLLEGHPLFQVVALTGSERSAGKKYHEVCRWVLDTPMPAAVANLTVLDADADLPAQLVFSALPSTVAGPIEQRLAAAGHIVCSNASNHRMEPDVPLIIPEVNPDHLALIPVQRRRRGWSGAIVTNPNCTSTPATMVLRPLLDTFGVRRMLLVSMQALSGAGYPGVPSYDVVDNVIPYIGGEEPKLEIEPQKMLGRLEGETIVPAGFTTSAHCNRVPVLEGHLVCLSIELERKADPAEIATVLSNFRALPQELRLPTAPEQPIIVRHEPDRPQPRRDRDAGRGMATVVGRIRPCSLFDIKLIALSHNTIRGAAGASILNAE

SEQ ID NO: 9065 - protein, 344 aa, Chloroflexus aurantiacus
  unsure (1)..(344): unsure at all Xaa locations
SAAPRALXTITPMTLRFAIPSKGSGYEATVALLESCGLRVTRANPRQYTAVLRGLPDTEVLLHRPADIVLKVAEGAIDLGVTGYDLLHELRGDDDDDVLTIIDDLGFWRVELVFAVPQSWIDVTSWADLADLAVEFQSRGRRLRIATKYPNTVRRFCYAQGINVFELVESQGATEAAPSLGYADIIADITETGTAIRENQLKIVGGPLIRSQAILIGSRRALRGNRHRLELVRQLCELIEARRRGRLFYSLTANLPGASVEEVGRKVTARHELAGLQGPTIAPVWSKFSGDSGWYAVNVVVPQEELLPAIDYLRAIGASSVTTVQVQHVFRAESEAFARLCARL

SEQ ID NO: 9066 - protein, 258 aa, Chloroflexus aurantiacus
SGATGWAGSALARAIAQTDDIVLSAALSRRAAGQSLADVLGEPRLTCPVYATAAEALTQPCDVFFEYTRPDVAKANVLTALQHGCHVVIGTSGLSDDDYREIDAVATAQQRGVLAAGNFALTAVLLQRFASIAARYIEQWEIIDYARDSKPDAPSGTARELAARLGQIRSSHLSVPLEQTQGVPATRGARLNGMQVHSVRLPGYTIGLEIIFGMPDQRLSIRHDAGASAEPYVAGALLAIRRVGKLVGLHRGLDSVLE

SEQ ID NO: 9067 - protein, 470 aa, Chloroflexus aurantiacus
PCIVFDQHLITYADLARAVAGWAGRFHSLGINRGDRIALALPNTPAFIAAYFGAQLAGAAVVLINPQYRHTELSHLLSDSEPAIVVATTENEAFITAAMPESRPHLLKPLAELCGAPPADPGLFTPPAADEMALIAYTSGTTGRAKGAVHTHASLAANCAAISTAWRWTEHDRLLLMLPLFHVHGLGVGVHGTIRNGASLELHSRFDADVALQRMHDPAITLFFGVPTMYIRLIEAARHQGVPEHRLRLFVSGSAPLSPQTFADFASLFGQPILERYGMTETGMNLTNPYAGERRPGSVGMPFPGQEARIVDRTTGQPLPTGQIGEIQVRGPHLFRGYWRNPAATAAAFTADGWFYTGDLGFVDDDGYFHITGRSRDLIISGGYNIYPREVEEVLAQHPAVAECAVYGEADPDLGEVPVAAVVTNGQAVTAADLIEFCRMHLAAYKRPRRIHFVTSLPRNALGKVQRHLL

SEQ ID NO: 9068 - protein, 368 aa, Chloroflexus aurantiacus
VVMAGGEGTRLRPLTINRPKPMVSLVDRPVMQHIIELLKLHGITDIIITVQYLANVIQDYYGDGSAYGVNITYSLEEVPLGTAGSVKNAEHLLTEPFLVISGDALTDFNLSQIIEYHMASGATATVTLTRVSNPLDYGVIITDEQGRIRQLLEKPSWGEVFSDTVNTGIYVFNPDIFSYIERGKVTDWSKDVFPRMLHRGDRLQGYIANGYWTDVGTIEEYMRACGDYLSGKVNLPRVGHNIGGDIWVDRDAEIAPDAQLHGPIYLGHGAKIKGGVIIHGPSVIRDYTIVDSRANIDRSIIWRNSYIGERAELRGAIVLRQCNIRSRAMIFEGAVIGDGVQIGAGTVVQPNVKIWPSKEVDEGATVTS

SEQ ID NO: 9069 - protein, 442 aa, Chloroflexus aurantiacus
SIIWGSQGRRVLFGRYGITGLVNIEITPEMCARLGAAYGATLPRGATVTINRDAHFTPRMLKRAIIAGLPSAGVNVCDLRNVPIPIARYYTHASGAAGGVHVRISPFDNRVAEIKFFNHLGLDINSATERKIESTFFREDYRRAYLDEIGRIFYGEDVEETYRAAFMRALGQNAAFGKGFPIVIDYANTSTSTVMAEILRRMQADAVELNVYLDERMVFQTSADFEAAMNRLTKITPVVGAQFGVRLDPGGEKIFLIDDQGRRLHPLRALAAITALAMRANGGGVVAVPVTAPRAFEQIAARYGGSIIRTRANLGALMNLAAERADLLLLGDGTGNYIFPHFYPVADGMFAIARLMELLSLNQTTLSEVLADLPPYYLWQTRVPCRWESKGKVMRILNQQYHERHGEQIDGIKIELGEEWVLILPDPDGPFFHVIAEGVSED

SEQ ID NO: 9070 - protein, 421 aa, Chloroflexus aurantiacus
SLVGQTIGRFEILSELGRGGMAVVYKARQTDLDRIVALKILPPGLTNDESYIARFRQEARSAARLEHPHIMPIYEVGEVAGYHYIAMKYIQGRTLKQLLQQEGALPVARAAQILAQVGEALDYAHRQGIIHRDIKPSNVMITDEGWIYLTDFGLARGTGANSSGLTMAGTVMGTPEYMSPEQAQGLPNVGPPTDIYALGVMLYELLTGAFPFKAETPMAMLAARLVHAPIPPRDVRGDLPPAVEDVIMRALARKPEARFASAAEMVAALRQAVGLSERELSRPLTPQRGMPAVSNAGSQTPPAYGPTTPASQPPAYGPTTPASQPPAYGPTTPASQPPAYAPTTPVTPPPVYVQTPAAPATHPYSASPSAPTPHPFNVPATPAPTAGKRTPVGLIVGLIVGVLLIGGGLTTFFLLRPTTPP

SEQ ID NO: 9071 - protein, 956 aa, Chloroflexus aurantiacus
  unsure (1)..(956): unsure at all Xaa locations
MATIELHAWYRQYRKLKEEAADAILLFRFGDFYETFDDDAKLIAELLDITLTRKEYAVDKRLPKDQQKLYAPMAGMPYHAVDRYVSELIARGYRVAIAEQLSETEAMRNDTRPRSVYAAGLTPVESSGKMVQRAIVRVITPGTVIDPAMLPDRTNNYLAAVIVEQGKVGLAYADLSTGEFAAAEFTDARALMQLQAELARLSPAEVLVPDDEALRLPNLEPVQARLSQDLAPLTKEEREALLPHERVARRLEGASAASWTQGYVTEWPLWRWELATTTEVLCEHLALPSLAVCGLDGRPLATRAAGALLQYAQVTQRQRVSQLRALRVYHTGAYMLLDPQTRRNLELLESGGRQGAKASLIAVLDRTCTAMGARLLRRWITQPLIVIEPLQVRQHAVARLVAETMARLEVRSALADLPDMERALNRIAQGITVATPRDMTQLRAALRKLPAVAQAVQALLPDLLAAEMPGEPPLVFDVCADVLDLLERALDDDPPALLGSSNYLRAAEEGGERPRRVIRPGFDQRLDALIRASRHAQEFIDRLESKERERTGIRSLKVGYNQVFGYYIEISRAVDAKLIPAHYERKQTLVNAERYVTEELKYYEGLLSDARLKLVDLERDIFQRLCDELQPHLDRLRATIAAVARIDALAALAEVAVRGRYVQPRLRTDRVLRIKQGRHPVVERTLSEPFIGNDIDLDGEQAQILIITGPNMAGKSTFLRQVALITLMAQXGSFVPADEAEIGLVDRIFTRIGAQDDIATGQSTFMVEMTETAALLMQSTPRSLIILDEVGRGTSTYDGMAIARAVVEYIHDHPRLGCRTLFATHYHELIALERELPRVRNYHMAAVERDGRVVFLHELRPGGADRSYGIHVAELAGIPPEVIRRASALLADLEGQRPPSSPAQPPAPPAPVVVPAQETGQGMQLSFFDLAPHPVVEYLRRLRIEELTPLEALNRL

SEQ ID NO: 9072 - protein, 474 aa, Chloroflexus aurantiacus
VSHYIDGQFVDGGSRFDILYPATNQVIGSAPEAGADEVDAAVAAASRAFRQWSRMPAAERRLILKRFAQLIRDHEAELAAIETWDVGRPITENRSGYIPRIAANIEFFADFAVTHGSESYPMDNGYINYVLRQPVGVAALIAPWNIPLLQATWKMGPALAFGNTVVLKPAELTPIGTWRLAQLAHAAGVPAGVINVIHGFGPNSAGALLTRHPDVKLISFTGETTTGKIIMATAAPTLKRVSFELGGKGANIIFADADLDRAVAISLRSSFFNQGEFCLAGPRLLVQRPIYEAFLTRFQRATSQLQVGDPFDPQTRVGALISREHYERVTGFIDLARADGAHILTGGTDPVLPEPFAQGNFLQPTIITDVKPHDQVCQDEIFGPVVTVVPFDDEEEAIAIANGVSYGLSAVVQTRDVGRAVRMGSALEAGTIWINDFFVRDLRVPFGGMKQSGIGREGGHYSLEFYTEAKTICL

SEQ ID NO: 9073 - protein, 410 aa, Chloroflexus aurantiacus
QRIVVTGLGVISPFGVGVEPFWAGLVAGRSAIGRITFFDPSDYPCQLAGQVNDFHPQEFMDAKEARRMSRASQMAVAAARMALDHARLPLERMARDEIGVLIASGTTSMPDVEQAVTTLIQRGGMKISPFFIPAALPNMPSSQVAIHFGLRGYTTAICTACAAGAQAIGEAAEIIRRGDAEVMLAGGAEAPITALSLGAFCVMRALSTRSNHEPTRASRPFDALRDGFVPGEGAAVLVLERLSSAQRRGAPILAELIGYGVSADAYHVTAPDPDGEGAALAIRRALQQARLAPQQVDYINAHATSTPAGDIAETRAIKQVFGEYAYSVPISSIKSMIGHLTGAAGAVEAAATILALHHGQIPPTINLEHPDPECDLDYVPNVARQAAIQVAISNSFGFGGVNAVLAFRKM

SEQ ID NO: 9074 - protein, 680 aa, Chloroflexus aurantiacus
CDGCALGTAGLRDFTMKGVHLCTVRLNLLRLNTMPPLDIHRLHDVADLQRLNGRELRALGRLPYPMLRRRGEAGFRRISWDDALNEIAARLRNTDPHRMAFYLTSRGITNETYYVAQKVARFLGTNNVDNAARLCHAPSTTAMKQALGVAASTCSYRDWIGTDLLIFIGSDAPNNQPVTTKYLYYAKQHGTRILVINPYREPGLERYWVPSVFESALFGTRLADRFFQIHTGGDIAFLNGTLKHLIERNWLDWDFISAHTRDFERVQVALAQQSWDDLERASGATRGEMLAFAEALAQAKSAVFVWSMGITQHEYGVENVKAILNLALARGFIGREYCGVMPIRGHSGVQGGGEMGCTATTFPGGKPITPDTAHWLGEQWGFAVPAWKGLSCGDMLDVAYNGELDVFYAVGGNFLDTMPDPAYIRTALARPALRVHQDIVLTTQMLVEPADTVILLPAATRYEQRDGGTETSTEREIIFSPYIAPPPAEARSEWEILLSVAERTKPEQAHLIHFADGQQIRNEIARIVPEYNGIQHLHQTGDHIQWGGRILCRDGRFGTPDGKAVFTPLKPPVTTLPPAMFVLKTRRGKQFNSLIHDERDPLNGALRDDVLINPVDAATLGVREGDWVILRSAVGEMRARIKFAPLKSGNIQVHWPEGNVLIDAHQRDPGAGVPSYKALV

SEQ ID NO: 9075 - protein, 579 aa, Chloroflexus aurantiacus
GATESRDQGYYQNVTVSARVFNETVTINNTFESGEAGIRLIPVSFNGPVSGTIQTDLSGIATFSGPPGTYTVSIVSDPSGFTRSPGNTGTASTGPVLSGQTAAVPFGYYRTAQISGTVWFDTDSDGLFDSGEPGMESISVRLIGSSSGPGTPVTTDVNGAFAITGIEPTGLTNTTYQICITLPTGFTPTTQGSTLTTDNNSDIDSSGCTATFTVASAANITYIDAGLRGTLAIGDLVWEDTNANGIQDSGEQALDGVTVTVLVTTTGNVINTTNPSFTLSTVSTTASGLNPNYTIGNIPPGSTVTIQTVERFGYLLSAANQGGNPATDSNAVGSSVTLNANNTTIDFGLYRTTAVGDTVWLDVNGNGLFDSGEPGLPGITITLRDGGGTAVATTQTLANGSYTFSNLTPGSYSLQLSLPAGYATTNNGSGSITVDNDNDFRNDGTTATFTLTSGQALAGIDAGLRGTGNVNGIAWFDTNENNIRDPSETNRASSVRVTVIYTPTLTPTLPQTVEVATDTNGTYSVAGLPPGQVTVIFVNRLGYLSAQPNVGDDATDSDGPEVTFTLNAGQSVTIDMGYY

SEQ ID NO: 9076 - protein, 640 aa, Chloroflexus aurantiacus
LLWEPPEDLRANCTMRAFMRWLEQRSGLHFADYHQLYRWSVDRLEDFWAALWEYYQIKAHTPYTTVLSSREMPGARWFTGAHLNYAEHVFRHATDQRPAVIFASERQEPTPLSWASLRAQTAALAQTLREAGVGPGDRVVAYVPNTPHALIGCLATASLGAIWSSCSPDFGSPSVIDRFSQIAPKVLIAVDGYQYGGKAFDRRAEVAAIQAALPDLELTIFIPYLDPTDEASGLRGRVIRWEDALRQEAELHFTPVEFNDPLMVLYSSGTTGLPKPIVHSQGGILLEHIKSLDLHFDMRAGDTFFWYTTTGWMMWNFLIGGLLIGAIPILYDGSPAYPDMGVLWRLAEQTRIRYFGTSAGYITALMKSGVEPGTQFDLSSIKAIGSTGSPLPPEGFDWVYEHIKHDVWLVSYSGGTDVCSGFVGGCPLLPVYSGEIQCRILGCRAEAYDTDGQSVTGVMGELVITAPMPSMPIYFWNDPDNARYKASYFEHYPGVWRHGDWIVINERGGVIIYGRSDSTINRQGVRMGTSEIYRAVETIPEVLDSLVIDLEGLGGRSYMPLFVVLREGVTLDDDLRQRIKQVIRQTLSPRHVPDDIFQIPAVPLTLSGKKLEVPVKKILMGVPVERAANPDSLRNPESLQ

SEQ ID NO: 9077 - protein, 296 aa, Chloroflexus aurantiacus
IAILGVPIDLGAGRRGVDMGPSAIRYAGLSRRLGELGYQVVDFGNLTVPMVETTPPPPPDSRLRYLEPIADMCGRLARQVADIVQQGMLPLILGGDHSLTIGSASGSARQRRLGLIWIDAHADFNDEHTTPSGNIHGMPLAVLTGRGHPTLTGFAGRIPAFDPAHVVLIAVRDLDPLEREALRASPITVFTMHEIDRCGMATVMERALAIATTGTEGFHLSFDLDVVDPREAPGVGTPVSSGISARESHLAMELIAESGALRSLDVVEVNPILDERNATAQLAVDLVLSALGKRIL

SEQ ID NO: 9078 - protein, 239 aa, Chloroflexus aurantiacus
NRTAMATGESMSGTGRLAGKIALITGGAGNIGSELTRRFLAEGATVIISGRNRAKLTALAERMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAH

SEQ ID NO: 9079 - protein, 433 aa, Chloroflexus aurantiacus
PVAIRNLQQLRREPLTLLEELAARGDVVPFRVGPQMMVLVNHPDLIREVLVTQHRSFVKGRVLERAKRLLGEGLLTSEGELHLRQRRLMQPAFHRQRIAAYGDAMVAVAEARSARWQDGLVLDVSREFMAITLQIVGITLFSADTEADADEVFAAMHDLVAMFDLAVLPFADWLFALPLPPVRRFQAVKARLDAIIYRLIAQRRANPVDRGDLLSMLLTAVDHEGDGYRMTDTQLRDELLTIFLAGHETTANALTWALYLLAQYPSLAAHLAAELDTVLGGRKPTVADLPKLTYTSWFFAEALRLYPPAWLIGRRAIAPVTLGDVRIAPDTIVLLSPWLMHHDPRFFHEPYHCDPLRHTPEAQAQRPKFAFFPFGGGPRTCIGEPFAWMEGILVLATLAQRWQFLPVADHPVVLQTGITLRPRYGMQLQLRER

SEQ ID NO: 9080 - protein, 355 aa, Chloroflexus aurantiacus
PIDVLFAISDTGGGHRSAAVAISAALEQMSGASITWAIEDLLQATNVPGVRSAPGLYDQLSTRWLKLYNFSFQLTNSQSTVSFLSRIVYLIARQNLNRLLTERRPRLVVVTHPLVHRLVCAARRRRQHSFRVLTVVTDLVTLHASWSYPGVDLALTPTDEAYRLMHKRGMKPSQLQRCGFPVHPKFAAEQRDAPTARRDLGLEPDRFTVLLTAGGVGSGRLGELVQTLEQQMPDKQFLVVTGKNRALYEELRSGPRLPHTHVFGFVNNMEELMAASDVVVTKAGPGTLMEALVMRKPVIVTEAVGLQEHGNIDFVLNYELGFFCPTNERIVAAISQLEDPVRYAETVERLKHAVP

SEQ ID NO: 9081 - protein, 372 aa, Chloroflexus aurantiacus
RVLILHASVGTGHKRAAEALAAAFSRRQPGEVRVEDVLDHTSRLFRLAYARSYLELTDRAPLVWGYFYTQTNADPNLAEITNNIRKLVEGIGTNGLKEVLRAFQPEVIICTHFLPMELLVSYKRSARLTEPIYCVITDYAAHTFWTYTEIDGYFVGDEQTRAQLIERGVSPQQIVVSGIPIDPAFAQPNDCREARQRRELPLDGTVITLFGGGVDDEHVRLIVSGLMQSSLKATLIVVAGRNTTLVESLSDFISTPNIDLRVLGFVDYVDDLITASDLVITKAGGLIVSEVLARGTPMVIIDPILGHEEWNADYVVSTGSGIQLRMCESTPRAVVNLLNHPTMLVEMRRCAQAAAHPRAALDIAEKVIADLE

SEQ ID NO: 9082 - protein, 337 aa, Chloroflexus aurantiacus
RAFIVADKGVVQAGLAPIELVGIFDDVPANSSVAKVAEGAELARVAGADLLIAVGGGSPIDTAKGIRIVLTLGGSIPDYEGYNVIETPLTPLIAIPTTAGTGSEVTPIAVILDEEGQRKISIVSRYVTPTLAILDPLMTRTLPPRLTAATGMDALSHAIETYVSTENNPLSDSLALAAIDMIATYLRDAVHDGENMEARSQLLIAATMAGIACGNSLFGVVHALSHALGGKFPVHHGTANAIFLPPGMRFNSEVVPERYVRIARAMGVNVGGRSNAEVIADGIAAVRTLTADCGLPTTLREVGVPREALPELAELAAVEPAIFNNPRPATPEELLAM

SEQ ID NO: 9083 - protein, 201 aa, Chloroflexus aurantiacus
  unsure (1)..(201): unsure at all Xaa locations
PKTRHPSPNCGRLQRGSDTXTRRFGMPLETATLAGGCFWCLEAVYDQVSGVKDVVSGYTGGYVPNPTYRRVCDGNTGHAEAVQIQFDPEQISYRELLEIFFSIHDPTTLNRQGADVGTQYRSAIFYHSEEQRQVAEQLVRELTEQQVFRDPIVTQIVPATTFYPAEEYHQEYFARNPYQPYCQFVVAPKVAKFQKLFAHRV

SEQ ID NO: 9084 - protein, 302 aa, Chloroflexus aurantiacus
IELHDLTVYYGRRRGIEGLDLAVEAGEVFGFLGPNGAGKSTTLRVLLDLIRPVRGRALIFGQDCRRHGPAIRRQVGYLPGELNLPPQQTARQYLAMLDAVRGRVVEPAYLKQLCDQLELDLDRPLRTYSRGNKQKVGLIAAFMFRPRLLILDEPTGGLDPLAQQAVIELVRAARSEGRTVFFSSHVLPEVQAVCDRVGIIREGRLVTVERIDTLLQRQQVHRMRLRFAHQLPPTVFSLPGVTILAHSGNDIMLEVRSGLADVLRIAAEQAVIELETIPLTLEEVFLAYYGGQGENHAQPVLA

SEQ ID NO: 9085 - protein, 469 aa, Chloroflexus aurantiacus
ARKQTEIELRLARQQAEAANRAKSAFLANVSHELRTPLHAVLGFAQLMSRDDNLTATQHEYLAIINRNSEHLLHLINEVLDLAKIESGRYTYTPNPLDVRRLLADLQALFGPQAEAKQLQLIVTCEEQVPPMIVSDEAKIRHILINLLGNAIKFTHGGSVRLRADTDKQQMYFIVEDTGVGISPLEQPYLFRPFFQGKQTANASSDTGVGLGLSISYEFARLIGGDLSVYSAGEGQGARFTLTLPLRTPVTSSFVLPAEPVKRAIQVRADQPVYRMLVADDQPTHALLLISLLRRLGFAVQSVTDGEQALAVWREWQPHMIWLDLRMPQMDGLTVARQIRAICATEPGLLQPVIIALSAHVLGDTAASVLAAGCDEFLAKPFPEHEVVRLIEQHLNVQFEYASVVIREVPETAIHDQGYHPAWCQALRQAVQVAHFQRLQELVGMIEDQRPDDARQLRNWIETFDYEAV

SEQ ID NO: 9086 - protein, 378 aa, Chloroflexus aurantiacus
MDVELTPEQQFIRQTVREFAEKEIAPKARYVDEHSAFPSETFAKMAQLGLMGLPFPEEYGGAGADSVSTAIAIEEVARCCGSTALAYAAHLGLGSAPIAMFGTEEQKRRFLVPAAKGEYLAAFGLTEPHAGSDAGATRTTARLVGDEWVINGQKMWITNAPIAGHIIVTAVTDPDLGKKGISAFIVPRGTPGLSFGKHEPKMGLRGSVSTAVMLDDVRVPRENLLGERGRGFIQFLQVLDGGRIGIGAMAIGLAQAAYEAAVAYARERTAFGKPIGAHQSVANMIANMAVDLAAARALVYGAARLKDAGRPYTREAAIAKLFASEASERICRDAIQVFGGYGYSQEYPVERLYRDTRLLTIGEGTSEILRGVIAHSVL

SEQ ID NO: 9087 - protein, 338 aa, Chloroflexus aurantiacus
EIYAQPTVISELLEHGLVQAYQLAAKIRKHDIRYVYAAGRGTSEHASIYGQYLFGTLNRLPVALAAPSLFTIYQQPPNLRHALVIGVSQSGQSPDILAVIDEAQRQGALTLAITNDPASPLAQHAALHFDIAAGPELAVAATKTYTAQLTAFALLAIALADDQARLTELRRLPVALTEALQLEEVVATAASHFRTMSYCVVLGRGFQLATALEWSLKLKEMAYVVAERYSTAEFQHGPIALIEPGFPVLAVATRDAGSMYIANLLDRLRAAGAELLVLSDDRTLFAHGVTGLLIPAGIPDWLTPIVTIVPAQLFCYHLALARGVDPLHPRGLRKITRT

SEQ ID NO: 9088 - protein, 311 aa, Chloroflexus aurantiacus
MRAVYYEAFGQMPWIATLPDPAPTPDGVVLAVRATGLCRSDWHGWMGHDPDIKLPHVPGHELAGEIVAVGSQVRRWRIGDRVTVPFVCACGFCPQCQAGQQQVCDNQFQPGFTHWGSFAEYVAIDRADLNLVRLPADMSFTTAASLGCRFATAFRAVVDLGQVRGGEWVAVYGCGGVGLSAIMLASALGGQVIGIDINLERLALARAVGATAVIDATTEPDVVSVVRDLSRGGVHLAIDALGSPMTCANAIASLRKRGRHVQVGLLLADQRMPPLPMDIVVARELTIMGSHGMQAYRYDAMLDLIQSGKVQ

SEQ ID NO: 9089 - protein, 410 aa, Chloroflexus aurantiacus
RRVVVTGMGAISPLGLSVAELWQGIVAARSGVGPITLFDSTGFDTRFAAEVKGFDPTNYMDRKEARRTDRFVQFAVAATREALRDAELEITPANRDEIGVFIASGIGGIGTLSEQLDVLRSRGPGRISPFLIPAMITNLAAGQVSIVTGARGPSYCVTSACASSAHAIGEAAETIRRGWAKAIIVGGSEASITPIGVAGFNAMRALSTRNEDYAHASRPFDAERDGFVMGEGAAVLILEDLEFALARGARILAEVVGYGATSDAYHISNLAEDGEGVARAIRLALQRGALAPEDVDYINAHATSTPAGDPVETTAIKQVFGGREKSPPVSASKSQFGHLLGAAGAIEAVVTILAMQNNLLPATINLQQPDPACDLDFVPGQPRPARIEVALSNSFGFGGHNVCLAFRKYH

SEQ ID NO: 9090 - protein, 306 aa, Chloroflexus aurantiacus
AIETIDLVKRYGNLTALDHVNLQAPSGKIYALLGPNGAGKTTLLSILTTLLPPTAGTARILGYDVSREAAEVRRRIGVTFQEMVLDPLLTGRETLDFHGRLYRLPAAVRRQRIRDLVELVQLTDAIDRPVKSYSGGMKRRLELARGLMTDPQVLVLDEPTQGLDPQNRVNIWQYVRDLNRQRGMTILLTTHAMDEAEALADLVGIIDHGRLIVEGQPTDLIASLGSDVIRVRGQGDSHHLTSAICGIDGVQRVETDPTEGLILIYTDNGSRRLPVVLSAVSGNGFAIEDVTLARPSLGDVFLHYTG

SEQ ID NO: 9091 - protein, 564 aa, Chloroflexus aurantiacus
  unsure (1)..(564): unsure at all Xaa locations
TDTPRLSKVEQIKLASRHLRGPVDHELHDGNDHFSDEGYQILKFHGIYQQDNRDVRKARKARGLGPEYSFMIRVAIPGGRLSPEQYLTLDRLADELGNTTLRFTTRQAIQYHGVRKGGLKPLIRTLNRHLLTTLSACGDVVRNIVACPAPFVDRQRIELMQYAKALSDRLKPKTRAYYEIWLDGEKAASLEEDEPLYGATYLPRKFKIAFAFPGDNCVDVYTQDIGIVPWIEESLQGFTILVGGGLGQSHGVKETHPALAKPLTTVAPAQLFEVVEAIVKVQRDHGRRDDRKLARMKYLVESWGIERFKAEVERYVGYALPEPRPLTWLSADDHLGWHEQGDGRLFFGLFVENGRVRDHLRAAIRDVVQRFGLEVRLTPQQNILFVNIQPADRAAIEAIFRQYDVALPGTIPLVVQNALACPALPTCGLAITESERVMPQVIRDMNALLDRLGLHDGPVPHVRMTGCPNGCARPYTAEIGLVGRSLNSYTIYLGGSPLGTRLGEVYLDNVKREEIVARLEPILLLYQRERNPGESFGDFCHRLGSATLQHLAGQNEXQTIGGNS

SEQ ID NO: 9092 - protein, 372 aa, Chloroflexus aurantiacus
SLPKPHGGVLVERIRVAHPREYDHLPALELDERAYADLELIATGVYSPLEGFMGQADYLSVLEEMRLTNGLPWSIPITLGVSAQDAASYRKTVRLTKDGRTVGLLDVEEQYRPDKEHEALAVYRTTDLAHPGVAALFARGDVYLAGKVQLLTLDRGPFPEHHYTPRETRQLFQERGWQTIVAFQTRNPIHRAHEYLHKVALESLDGLFLHPLVGSTKSDDVPAPVRMAAYKVLLERYYPQNRVLLGVYPAAMRYAGPREAILHAISRKNYGCTHFIVGRDHAGVGNYYGPYEAQAIFDHFRPEEIGIHILKFEQTFYCVTCAAVVSPRTCPHDTQHHLVLSGTRVRELLRAGSPLPPEFTRPEVAEVLRAAY

SEQ ID NO: 9093 - protein, 225 aa, Chloroflexus aurantiacus
GESPMTTQYWDANTDPRDVIRWALAGYPDLLMTSAFNLNGVVLIELAAQAGFAGEVVFVDTGYHFPETLATRDHLITRYPQMQFVTLSADLPPEPWGEEQFRSDPDGCCRVRKVAPLREYLARKNPSALLNARSRDQAATRRDLGFVEIGERVRINPLAYWRREQIEAFAQAHHLPVNPLYWAGFKSIGCWPCTRAVRPGEDVRAGRWSGKGKIECGLWIGEQSL

SEQ ID NO: 9094 - protein, 167 aa, Chloroflexus aurantiacus
RSGLVVWFTGLSGAGKTTLARALATLLQEAGYPVEQLDGDVVREHLSKGLGFSREDRDTNIRRIGFVANLLAKHGVIVLVSAISPYRETRAEVLAAAPRKLEVFVEAPLDVLIQRDVKGLYAKALRGEIAQFTGISDPYEPPLHPDVHLRTDLMSLPECLDHLLAAL

SEQ ID NO: 9095 - protein, 271 aa, Chloroflexus aurantiacus
GYDAAQVVILGCPQDIGVLRNRGRPGAAQGPTAIRRCLYRLGITGLQHLTICDLGDVDTTGDLETIHARQQALVARIIADGKLLISLGGGNDISFPDMAAMAVAAPPPPLAINVDAHYDVRADQPANSGTPYRQLIEAGLIAPQRYWVCGVQPFANSPAYTEYLRTRGATIIELNTARHYGVADTMRSLLATSDAGSIGWGFDLDVVQVAEAPGVSAPNPLGMRGDELVALATLAGAEPRTRLIEFSELNPQYDIDDRTARLAAVAIWHAL

SEQ ID NO: 9096 - protein, 463 aa, Chloroflexus aurantiacus
  unsure (1)..(463): unsure at all Xaa locations
HNRTTVVRPPXCRSQCGSTDVSMAMQSQXAXKSMAMTRNTLTVTDNRTGKTYEIPIENNTIRATDLRQIKVSEDDFGLMSYDPAYLNTASCKSSITYIDGDKGILEYRGYPIEQLAEQSSYLEVAYLLLYGELPSKERLAWWEYRISRHLFLHNSLVELIQAFRYDAHPMGILISSVAAMSTLYPEAKNIHDPAVREKQIWRIIGQIPTIAAFAYRHRIGRPFNLPDSSLSYTANLLYMMDYMNQREYEVNPVLAKALDVLFILHADHEQNCSTSVMRSVGSSHADPYNALAAAAAALYGPLHGGANEAVLRMLQQIGHPKNVPAFIERVKKGEMRLMGFGHRVYKNYDPRAKIIRKIAHEVFAATAANPLLDVAMELERTALEDEYFISRKLYPNVDFYSGLIYQALRFPIEYFPFLFAIPRASGWLAQWIEMLEDPEQKITRPRQVYVGPQRRDYVPIDQR

SEQ ID NO: 9097 - protein, 417 aa, Chloroflexus aurantiacus
IVAREVLDSRGNPTIEVDVRLESGDVGRAIVPSGASTGAHEALELRDGDKSRYNGKGVLKAVQAVNEDIAEALIGFDAADQIALDQELIALDGTPNKSKLGANAILGVSLAAAKAAAAAFGLPLYRYLGGVYAHVLPVPMMNIMNGGQHATNSTDFQEFMIMPVGAESFREGLRWGAEIYHMLKKVIHDRGFSTTVGDEGGFAPSLPTNDAPLQLIMEAIEKAGYRPGEQIVIALDPATTEIFEDGKYHLKREGRSLSSAEMVDYWVDLVNRYPIISLEDGLAEDDWEGWALLRAKLGDRVQLVGDDFLVTNVQRLQRAIEAKAANSILIKLNQIGSLTETLSAIQLAQRSGWTAVVSHRSGESEDVTIADLVVATNAGQIKTGAPARTDRIAKYNQLLRIEEELGSAARYAGRSAF

SEQ ID NO: 9098 - protein, 488 aa, Chloroflexus aurantiacus
LIRDISDTSSYWGASWVFGCFPDVHIVCDAPIGCYNLLGMAVTDYTDALPHMANLTPTSIREEDVINGTAKALIRTIDDLRTMGMLDGKRLLVISTAESEMISADHAQLVARIDPDARFFWSQSLEQDEWIGRERALRFAWEQYGKPFVDADVQPRPRTVNIIGPSLGCFNAPSDLYELKRLITGIGAEINLVYPYEGSIATTPKLAEAAVNVVMYREFGQGLAEDLGRPYLFAPFGVFGTTAFLRELGQLLGIDPAQVDAFIEREKRTTLQPVWDLWRGPQSDWFATVDCAIVAARSYADGLRSFLGDELGMKIAWVSGRPRREDEPDNIEIRKRLHAKAPAFVFGSINEKIYLAEANARGTHFIPATFPGPVVRRTTGTPFMGYAGAANIMQELVNRFYETVINFLPVETINPGPAGPPKPTSAETMPWTKEATERLNAALEAVPYLARISASRTLRAAAEQLAKARGLNEVGIEIVEAAIAQSGA

SEQ ID NO: 9099 - protein, 417 aa, Chloroflexus aurantiacus
SATLAEKARVRFPGGATHDGRYADPFPLFMERASGPYKWDVDDNRMIDYWCGHGALLLGHGHPTIVNAIQQQAPIATHLGANHRLELEWADLIADLIPAAERIRFTASGSEATTLALRIARAATGKTTIIRFAGHFHGWHDALAPGADPDDPHRGVLPATLSSLLILPTDLDQVAATLATHTDIAAVILEPTGASYGSIPLPDTFLIGLRELTQQYGVLLIADEVVTGFRVAPGGACARAGVRPDLVCLAKIVAGGLPGGALVGRADLLDLLAHDENGPRGRIRQQGTFNANPLSAAAGIAMLRAVATGEPGAIAAARGTMLIQMLNELFASYRLRGWTAFGDGSIFHLFVDPATDLIPGEIPRNLPLATLKRGGDPQILRRLRMALHLNGVDLMRGRSGFVSAVHSEEDIRATVAA

SEQ ID NO: 9100 - protein, 585 aa, Chloroflexus aurantiacus
LRNVPAAFRLVWQADRTHTIAMACITLLAAGLPLAQAYMAKQIVDTVVAAVQQGLTALSGLEQTLPWLLGEFGLITLGAVLMQMRTLSEHILNARLSNMVNVMIMQKALLLDLHYFEDAQYYDKLQNARRETNWRAMAMVNTAFSAIQQILTLGSFAASLLWFSPLIALILFGATIPAFLAQTHFSQLRFRLLTWRAPEFRRMQYLEHLLTVDTAAKEVKLFALGLPLLQRHQEQYQRFFTEDAALARRRSLISMVWGVVASAGYYVAYGWIIWQTVAGAITIGGMTFYLTLFRQSQSVVQTLFGNLAQLYEGGLFLGNLFDFLALEPQMRSGRNLPVPPIIRHGIEFRNVSFRYPDREDWALRSINLHIAPGEKIALVGANGAGKTTLIKLLTRLYDPTEGQILLDGVDLRDYDLEQLRQRIGVIFQDFVRYQATARENIGFGQIDDLANEPRIRSAAERGGADEVLRHLPDGYETMLGRWFENGAELSGGQWQKIALGRAFMRDSEILVLDEPTAALDAEREYEIFQRFRDLTAGRIAVLISHRFSTVRMADRIVVLEHGQITEMGTHQELLARDGTYARLFH

SEQ ID NO: 9101 - protein, 501 aa, Chloroflexus aurantiacus
WSHLLAQLRSVVPEAFNSEGHVLNLIEGTWGWPGHGKHYSTPIDGTELGRMPMIDLETAKRAVRFAAREHETWARTDLDERRRRVRETVDGLRQHRDLIAYLLMWEIGKPYHLACDDVDRCLDGVEWYIDQIEWMLSNRQPLGLISNIASWNYPYSVLVHAVLVQALAGNAVIAKTPSDGGLFALTLGFAIARRAGLPVSLVSGSGGALSDALVRNADVACLAFVGGKTNGRDIAASLYDRNKRYMLEMEGVNCYGIWDFSDWASLAQQIKKGFAYGKQRCTAYIRYVVQRRLFPKFLDVYLPVLKSLQIGNPVLVDRAGDPLPRLDFGPLINARKVEELRVLYSEALGAGAVCLYEGELNPELFLPDQDISAYMAPIALLNVPRNCRLHHNEPFGPIDTIVIVDSIEELISEMNISNGNLVSSIATDDLRLGQMIASELRAFKVGINRMRSRGDRDEVFGGMGASWKGCFVGGKYLVEAVTVGAPGERLYGNFPDYTLLP

SEQ ID NO: 9102 - protein, 846 aa, Chloroflexus aurantiacus
EREVILPITGMTCASCSARVEKALRKAPGVLAAEVNLAGEQALVRYDPGLVQPEALQAAVEQAGYGVVVDEITLAITGMTCASCSARVEKALRKLPGVLAAEVNLASEQALVRYVPGMVERTDLVAAVEQAGYGVILPSATDEAAEDVEARAREAEMTVRRRRLLVGVVFGLPLFVLSMARDFGLIAPWLIGEGAAMMATMRDAAMGEIMAMVAARDDLLNWLFLALATPVQFYSGRDFYRHAWRALRARTATMDTLIALGSSAAYFYSLAMLLSGAPGHVYFETAALIITLILVGKYLEARAKGQTSAAIKALIGLQPKTARVVRGGQEVDVPLTEVRVGEMIIVRPGEKIPVDGVIVSGESTIDESMLTGESLPVEKRSGDPVFGATINRSGSFQMRATRIGKDSALAQIIRLVQEAQGSKAPVQALVDRVSAVFVPIVIVIALITFLGWLWAGVGLTQALIFAVAVLVIACPCALGLATPTAIMVGTGTGASHGILIRNAEALERAASLHAVVFDKTGTITHGRPAVTDVVMVARPVLAQGTQSDGTGDQVLLQIAAAAESRSEHPLGVAIVKAAQERGLAVERPTRFQAVSGAGVEAEVGGQTVLVGTLRWLRERGVEIHALEAIVDQLQNEGKTAIAVAVDSEAWGVIALADTVKPTAAEAVAKLHQAGIEVALLTGDNQRTAAAIAAAVGIPATAVYAEVKPDEKAAIVARLQQSGPHGKPRRVAMVGDGINDAPALAQADVGIAMGSGTDVAMETADITLMRSDPRGVVQAIALSRATVRTIRWNLFWAFAYNVLLIPVAAGVFYPLTGWQLSPVLAAAAMAFSSVFVVTNSLRLRRVR

SEQ ID NO: 9103 - protein, 406 aa, Chloroflexus aurantiacus
DGRLWIGGCDTVALAEQFGTPLYLLDDLTLRGAMRAYRQAFATAYPGPSIVHYAGKALLNTALAQIVAQEGLGLDVVSATELLVAQRAGLPMDRVHLHGNAKSDQELERAIAWRVGAIVVDNLDELQRLCALTSHLTTPQGVLLRVAPAIEADTHAHIATGSATAKFGLPLEALDEAVAQTLAAPSLRWLGLHAHIGSQLFALEQVTATVEVLVALAARIRDRFGVAPVELSPGGGLGVPYTADQPATDIGRYAQVVSAALCAACERYRLPLPRLTVEPGRSIVARAGVALYRVVGRKGEHWVHIDGGMADNIRPALYGARYSAVLANKPASPPAMTVNVGGRYCESGDVLLRDIALPTVQPDDLLAVAKSGCLHAEYVPSTYYLVPRPALVLVADGQARLIQRRE

SEQ ID NO: 9104 - protein, 850 aa, Chloroflexus aurantiacus
FQLLNIAEENAAVQQRRVADRDPNIPPELGRWRDALQKLHQSGLTGEEIAAALPHVHVEPVLTAHPTEAKRATVLAHYRELYLLLVRRESQRWSPAEQAEITADIETLLERLWRTGDVFLSKPGVPAEVRNVLHYLVNVFPDVLPVLDNQLRYAWQEAGFDPALLSDTWPKLSFGSWVGGDRDGHPLVTAEITAQTLREMRLQALRLLRRRIRQAASHLSISDLLVPTPPGLIDQIRRLSSGLGSRGAQAVARNPNEPWRQALNLMLARLPIDDAPAEAARLVDDPDRYRCADELLNDLREFAGYLRAVGAGRLADAEIRPLMQLVDTFGFHLATLDVRQNSQFHDRALAQLLEAAGLSSDDLIGGDPERRRALLEREVASPRPFAHPNTPLDYEAAAVVDSYRVLANHIARYGTAGLGPLIISMTRDVTDVLVVYLLAREAGLAYATPEGLVCRLPVVPLFETIEDLEHSPRILADILDHPVTRRSLIAQAQGGELVQQVMIGYSDSNKDGGILASQWALYQAQRAMTEVGRARGIRIRFFHGRGGTISRGAGPTSRFISMLPPGSLNGDLRLTEQGEVISQKYANRLTAAYNLELLIAGTTKHTLLQQRQPEEPHPLEPVIGWLAEKSRIAYRELVERDGFITFFRQATPIDVIEQSRIGSRPSRRTGQATLADLRAIPWVFSWNQARFYLPGWYGVGSALTALQEQEPALWEQLRAEQWRWPLLRYLLANVGTSLQTAHRETMHAYAGLVEDDEIRRQFLNLIDAEFTRTEAALTAIFGMPIEQRRPRVTATLARRQIGLAPLHRRQIELLGRWRAQRAADDPAAETTLIDLLLLVNAIAAGLRTTG

SEQ ID NO: 9105 - protein, 290 aa, Chloroflexus aurantiacus
VSILIDANTRLLVQGITGKEGEFHTRQMIEYGTNVVAGVVPGRGGQKAIDGRVPVFNTVAEAVAATGANTAVIYVPAPFAPDAIRESAAARIPLIVCITEGIPALDMVSTYAFVQECGVRLIGPNCPGLLTPGAAKVGIIPGNIAMPGPVGIVSKSGTLTYEAVDALTRLGIGQSTIVGIGGDPIIGTNFIDVLSMFEADPQTEAIVLIGEIGGTAEQEAAAYIKAHVTKPVVGFIAGQTAPPGKRMGHAGAIISGGEGTAQEKIAALESVGVRVARMPTDIAGLVKEAL

SEQ ID NO: 9106 - protein, 294 aa, Chloroflexus aurantiacus
MTRFDAIGVGIASWDLVGVTATSPVLGQKQPLAGYTEMGGGPVATALATMARFGAQVALVSAVGDDHYGMAIKAELTRFGVDTSFVVTGRGSSHIAFVLAEPGSDRRTVWWYNEPTVFADLSFPAELAGQTRALLIDSHLPAALSAARQVRAAGGRIMIDAERVNPTVLELLPLCDDIVVSANFARAVTGLSDIVMATQALAERYRTLVVVTAGEAGSWACHNGELIHTPAFPTTPVDTTGCGDVFHGALLFALLRNDPLPAALRFASAAAALKTRGLGGRTALPSLAEVEALV

SEQ ID NO: 9107 - protein, 336 aa, Chloroflexus aurantiacus
MLVVMEAHATAEQIEAVCAEMRAMGFTPHPMPGPTRTAIGITGNQGPIEQAGRLQRLPGVSQLIRVTAPYKRVSREFKELDTVVDVGGIPIGGSGITIIAGPCTVESREQTFNVARAVQAAGAVILRGGAYKPRTSPYSFQGLGEAGLQILAEARALTGMPVVTEVMDTETLPLVVQYADMLQIGARNMQNYSLLRAVGRTRHPVLLKRGFAATVKDLLLAAEYILAEGNPNVVLCERGIRTFDDSLRFTLDLGAVPLIKQLSHLPVIVDPSHASGRADMVIPMARAAIAAGADGLIIEVHDNPAFAVCDGTQSLVPESFADLMKQLHRVAAAIER

SEQ ID NO: 9108 - protein, 151 aa, Chloroflexus aurantiacus
MERALLILKPDAVQRGLIGAIISRFEQRGLKFQGLKLMQVDEALARRHYAEHEGKSFFNGLVSYITSAPVVVAVVAGKPGTVELVRAMVGATNPAKAAPGTIRGDFGVDIGRNLIHASDSPESGERETAIFFQPHELIGEWNRALDNWIYE

SEQ ID NO: 9109 - protein, 245 aa, Chloroflexus aurantiacus
LSGRVAIVTGGSRGIGRATAERLAGSGAAVVVNYRGNAAAAEATVAAITAAGGTAIAVQGDVSQPADVEQMVKTTLERFGRIDILVNNAGITRDTLLLRMKESDFDEVIATNLRGVFLCTRAVLRPMTKQRFGRIINITSVVGLTGNVGQANYAAAKAGILGFTKSTAREMASRGITVNAIAPGFIETEMTEALNEEARKAILATIPLGRFGQPAEVAGLVCFLASDAGAYISGQTLTIDGGMVM

SEQ ID NO: 9110 - protein, 452 aa, Chloroflexus aurantiacus
MIRKVLVANRGEIAVRIIRACQELGIRTVVAYSTADRDSLAVRLADEAVCIGPPPAAKSYLNAPALISAALVSGCDAIHPGYGFLSENPYFAEMCADCKLTFIGPPPEPIRLMGDKAIGRETMRKAGVPTVPGSDGEVRSLEEAIDVARQIGYPVLLKPSGGGGGRGMRVAYDEADLQRAFPTARAEAEAAFGNGALLLEKYLTRVRHVEIQVLADQYGHAIHLGERDCSAQRRHQKIVEEAPSPAVTPELRERMGADAVRGIKSIGYVNAGTLEFLLDQDGNYYFIEMNTRIQVEHPVTEQVTGIDLVRWQLLIASGERLTLRQEDIKITRHAIECRINAEDPERDFLPASGEVEFYLPPGGPGVRVDSHLYSGYTPPGTYDSLLAKIITFGDTRDEALNRMRRALNECVITGIKTTIPFQLALIDDPEFRAGRIHTGYVAELLRQWKETL

SEQ ID NO: 9111 - protein, 71 aa, Chloroflexus aurantiacus
MEERLRKIIVDQLGVEPEQVVPSASFTKDLNADSLDLVELIMSIEEEFGVEISDEEAEKIQTVADALNYLE

SEQ ID NO: 9112 - protein, 808 aa, Chloroflexus aurantiacus
LYSKFTKRAKQVLQLAAEEARAFNHPYIGTEHILLGLIRESEGIAARVLDELGVKLPQARSAVEFIVGPGESTMVTDQELTARAQKVIKYAIEEANRLNHHYIGTEHLLLGLVRNGEGVATGVLDILGVSLEQVRNQVMRVLRHGTAGATAEGRTAPGTTPTQRQSKTPYLDALGTDLTEMAEQGRLDPIIGRQHEIERVIQILSRRTKNNPALIGEPGVGKTAIVEGLAQRIVQGDVPDSIKGKRVVTLDMGALVAGTKYRGQFEERLKRVIDEIKESRCILFIDEFHTIIGAGGAEGTLDAANILKPALSRGELQTIGATTLDEYRKYIERDAALERRFQPVMVDEPSIEDTIQILRGIKSRYEDFHQLQISDEAIRAAAVLSARYVPDRQLPDKAIDLIDEAASRVRMYRSATPPRLRDALRGLEALRKEREAALEDQQFELANDLREREERMLSRIQEIEAELGTRSDERYERPYVTEEDIAEVVGMWTGVPVTRLTGNETQRLMQMEEFLHSRIVGQHEAIVTISKAVRRARAGLKDPKRPIGSFIFLGPTGVGKTELAKALAEFMFGTEEALIKIDMSEFQERHTTSRLVGSPPGYIGYGEGGQLTDAVRRKPYSVVLFDEIEKAHPDAFNLLLQVLEDGHLTDGKGRRVDFRNTIIIMTSNVGTEHIRRASRIGFGSNAAEIDQNDMRRKVDEALRMLFRPEFLNRIDATIIFHPLTTEEIQSITRLMLKRVQTQLDEHQIKLEVQPDALEFLARRGYDPAFGARPLRRVITNLIEDPLAEGLLSGQFRDGDTVIVDTFED

SEQ ID NO: 9113 - protein, 236 aa, Chloroflexus aurantiacus
VECRDLTKQYGTFTAVDGLNLTVRKGEIFGLLGPNGAGKTTTILMLLGLTEPTSGSVRVLGLDPARQPLSVKARVGYLPDQVGFYDNLTARENLNYIAKLNGMREPEMSKRIATALEQVGLSNVADRRVKTFSRGMRQRLGVAEVLIKQPQLIIMDEPTLALDPEAVREFLDLIRKLKESGITMLLSSHLLQQVQAVCDRVGLFHKGRMVLEGTVSELAQRVLGGAYRIHLEVEGG

SEQ ID NO: 9114 - protein, 576 aa, Chloroflexus aurantiacus
NLEKIWLSYYEPGVPPTLTYPEITLSDMLSNSAKTYADHTATNFVLRYLLGGRFTVGGKLTYRQLNEKVDRMATALYQLGVRKGDRVAVMLPNSPHYIITFFACMRLGAIVVNTNPTYTGRELQHQLHDSGAETIVLLNIFWPRLREVRAETPVKRVIVAHVFDTLGFPSNLLVKSAQRKTPEWVDVMPEQDIFFFQHLLEKYGPTPPRVSVTPDDIALFQYTGGTTGLPKGAMLTHRNLIANTVQIAAWLTRGEPGGEKMMAAIPFFHVYGMTVAMIYSIHMGAEIVIVPNPRPIDNVMNVIQRERCTLFPGVPAMYIGIINHPKVNEYNLRSVKACISGSAPLPMEVQEKFGQLTGGRLVEGFGMTEASPVTHCNPVFGERRAGSIGIPVPDTEAKVINLDTGEEIEPGSDETGELCVRGPQVMKGYWQRPEETAQTIDADGWLHTGDIARVDKDGYFYIVDRKKDMINVGGLKVLPRDVEEVLFMHPKVMEAVVVGIPHPQRGDDTVKAFIVPKPGENPTAEEIKEFCKLHLAPYKVPREVEFRSELPKTLVGKVLRRVLVEEEKAKQKAAMA

SEQ ID NO: 9115 - protein, 335 aa, Chloroflexus aurantiacus
MKAAVVHDFHQPLRIEESPKPEPGFGEIVVKIEASGLCHTDIHAAHGDWPVKPKLPFIPGHEGIGIVESVGAGVTNVKEGDRVAIPWLGYACGECKYCASGWETLCERQLNTGYFLDGAHAQYAKAYAKYVGIVPAGVSALDAAPLTCAGVTTYKAVKVSGARPSELVAIFGVGGLGHLALQYARIAGATVAAIDLLDERLQTARELGADITINASTQDPIEELKKWGGADAAICLAVSPKAFEQAYRSLRRGGRLVFVGLPADNMIQLPIFETVLNGIHVMGSIVGTRADLAETFALHAAGKTRVLFETRKLDQVNEAFEEVEHGRNKAPRIVF

SEQ ID NO: 9116 - protein, 398 aa, Chloroflexus aurantiacus
MNKKTIRDVDWAGKRALVRVDFNVPLDDQGQITDDTRIRAALPTIRYLLEHGASVVLMSHLGRPKGKPNPKYSLRPVVERLFELLPEAKEVKKTEAITGPAAEAAVAMLKPGQVLVLENTRFDPREEPNDPAMAAELAKLGDVFVNDAFGTAHRANASTEGVAHYLPAVAGFLMEKELTYIGGALNNPQRPFVTVIGGAKISDKIGVIENLLGKVDALLIGGGMANTFLLAKGLNVGDSLVEPDSVPVAQQLMARAEERGARLLLPVDVVIADAFSADAQRQVVDVSDIPAGWRVLDIGPKTIERYSAEIRAARTVIWNGPMGVFELEPFAVGTRAIAQAMAEAAANGAITIVGGGDSVAAVEQAGLADKMSHVSTGGGASLELLEGRVLPGVAALQD

SEQ ID NO: 9117 - protein, 316 aa, Chloroflexus aurantiacus
PLEYRDLPVPTPQPEEVLIRVEACAVCRTDLHIIDGELPAPNLPLVPGHQIVGTIERLGERVTRWTVGQRVGVPWLGWTCGECRFCRDGRENLCDQAQFTGYTRPGGFAEYTVADQRFCFALPTDYDATAVAPLLCAGLIGYRALRLAGTGERLGIYGFGAAAHLMTQVARWQGREVFAFTRPGDTEGQRFARELGAVWAGSSTELPPVPLDAAIIFAPVGDLVPYALRAVEKGGVVVCGGIHMSQIPAFAYELLWGERVLRSVANLTREDGEAFLQIAPQIPVRTTVQTFPLTELNTALNALRQGKLQGAAVIQI

SEQ ID NO: 9118 - protein, 229 aa, Chloroflexus aurantiacus
EVVLITGSSRGIGRFLVEHFLARGALVEGCARNPVDWELPGYTHHQVDVANEGQVKAMISSIQRRHGRLDIAINNAGIAAMNHALLTPSETAGRILNINVLGSFLVCREAAKLMRRRNYGRIVNFSTIAVPLRLEGEALYAASKSAVETMTRILAREFAPFGITVNAIGPTPIETDLIRGVPQEKLQHIIDALAIRRFGTFRDVAHVIDFFVNPASDYVTGQVLYLGGG

SEQ ID NO: 9119 - protein, 472 aa, Chloroflexus aurantiacus
PDWLARRAALHPHRPALIYAGTTYTFAELDRWAGAVASHLRQLVTPGARVALLSRNRPGFVAIVHAAPRTAITLVPLNTRLTAAELAFQIQDSDPALLIIEHDLLPVAREAAGNRPLIVLEELTAATTAPTAPAPPIDLDAMHTIIYTSGTTGRPKGAILTAGNHWWNAIGSMLNLGLHEDDRWLAVLPLFHVGGLSILLRGAIYGIPVILHERFDPALVRHDLDAQRITIVSLVAVMLQRLLAIDPSPFPPHLRCVLLGGGPAPQTLLEQCATRGIPVTQTYGMSEAASQAATLSPAESLIRLGSAGKPLLPVELSIVTPSGQPAAPGEVGEICLRGPNISPGYLGLPPRSPTDWFHTGDLGYLDQEGYLYVVDRRSDLIIAGGENIYPAEIEAILLSHPAIAEAGVVGLPDPEWGQRPVAAIVAQQPTTAEELIAYCRSRLAGYKVPRTIVFLHELPRTAAGKLRRHELR

SEQ ID NO: 9120 - protein, 522 aa, Chloroflexus aurantiacus
  unsure (1)..(522): unsure at all Xaa locations
VILDGESLTIEQVLAVAYGQPGTPVVRLAPIARQRVERAAQAVQDLLARGVVAYGITTGFGAFKDRVIAPDQVERLQYNILVSHAVGVGPVFDIPTTRAIMLIRANTLARGHSGVRLQTVERLLDMLNQGIHPRIPCKGSLGASGDLAPLAHMALPLIGLGEVEWQGEVLPAATALERLGWQPLHLAAKEGLALTNGTAVMCALGVIETARAETLSATADIAGCLSLEALYGTPAAFDARLHALRPFPRQIECAAHLRRLLAGSTFVRNNDPRHVQDAYTLRCIPQVHGAVRDAIAYARWVFAIELNAVTDNPLLFVDDDGNVEVISGGNFHGEPLAIALDYLGLAVAELGNIAERRLMRLTDEASNTHVLPAFLTRAGGLNSGFMIVQYTAAALATENKVLAHPASVDSIPTSANVEDHVSMGVTAGLKLRSIIDNVSQILALELFAAAQGIDFRRQELGSQARLGRGTGPVYELIRQYVPFIAEDTLLHPYITIISELVAQGKIAAAAAVHDDADAXASL

SEQ ID NO: 9121 - protein, 308 aa, Chloroflexus aurantiacus
IVEQLLARGDHVRVIGRGAYPELQSLGAETYQADLTLPESAPVLARAMRGVTTVFHVAAKAGLWGSYDDFYRANVSATQRVVKAAIRAGVPKLVYTSTPSVVIGHEDIHGGDEHLPYPRRYLAPYPHTKAIAERYVLAQTDIATVSLRPHLIWGPRDPHILPRLLRRARRRMLFQIGDGTNLVDVCYVENAATAHIQAASALNERSPLRGRAYFIGQERPVNLWQFIGEILKAANCPPVRGRISASAATILATGLELLYTILRLPGEPPLTRLMVHELSHSHWFSHAAAERDFGYTPRISIEEGLERT

SEQ ID NO: 9122 - protein, 444 aa, Chloroflexus aurantiacus
RQSFAGLHAASDRLAWGLTAYGLRKGMRVLLMVPAGVPLISLTFALMKAGCVPILIDPAMGRRNLAQCIAEVEPEAFIGVPRAHLLRLIFPRSCATIRYAVSVGPALPGAAALRELDIPMKTAFPLADMRSDDPAAIVFTSGSTGTPKGVLYTHGMFEAQIHTLRDLFGIAAGEVEMPAFPLFALFNVALGVTSAIPPIDPTRPAQCDPAAVVEFIRDLGVTSTFGSPAIWEKVTAYCLTHGIQLPSLRRVLMAGAPVPIHLHERLHRILSPTADSFTPYGATEALPVTSISGREVLAAHTEYPSPLAGTCIGYPVPGVEVAIIPITDEPIHAWQDTHRLPPGVIGEICVSGATVTHTYVGRPQATALAKISDGNRIWHRMGDLGYFDERGRLWFYGRKSQRVITAHGTLFTEPVERLFNQHPAVARSALVGIGKPGTQLPVVV

SEQ ID NO: 9123 - protein, 95 aa, Chloroflexus aurantiacus
TRRFEFSAAHRYWRDDWSAEENERVFGPYTSPYGHGHNYTLDVSITGELDERTGMVMNMTELKAIVNEVLEEFDHKHLNYDTPYFRDQVPTTENL

SEQ ID NO: 9124 - protein, 404 aa, Chloroflexus aurantiacus
HTTPNGIRVLIEELPHTHSVAVGCFIDIGARYESAELAGAAHFIEHMLFKGAGAYPTAHAISLAIEGIGGYLNASTGYETTVFYAKVAAIHFQRALHVLSEMVQRPLFDATELEKERRVIIEEIRGIQDNPTELVHELLQRTMWGDHPFGRDIAGSIATVSAIARHELLQFFAQGYHAGNLVVSVAGKIAAEEAIPAIERAFADLPAAQRPAAIAAPPLPHQPKLSLLTRDIEQGNFCLGMPGVSYHDPDRRAVHALDALLGGGMSSRLFQTIREEHGLSYNIGSYHNEFSDTGMWVIYAGVEPDALRDAVAMTRAIVRDVAENGPTKQELATVKEQLKGSLLLSLEDTWSIASRNATSLLRYQMVPPVEQIIAEIDALSLADLQRAARRLLTANQQWLAVVGP

SEQ ID NO: 9125 - protein, 307 aa, Chloroflexus aurantiacus
LSRLSRGLGALPDSERPLVGQRVNDMREQLEAAFSAAKERLEAQAVAAELDAERIDVTMPGRRPAVGYVHLTNQILRQVQHIFAEMGFQVWESPEVEYDAFNFSLLNFPDDHPARDMQDTFYVEMPAGAPSVLLRTHTSPGQIHAMRRNAPNPLRVLIPGKVYRNEQVTVRSEMMFHQFEFLAVGRNVTMADLKGTLSFFAERMFGPGTRVRLRPSFFPFTEPSAEMDVTCFLCGGKGCRICKYAGWLEIGGCGMVHPNVLRNGGYDPAEFSGFAGGFGPERVAMLKYGIDDIRWFYSGDQRFVEQF

SEQ ID NO: 9126 - protein, 138 aa, Chloroflexus aurantiacus
LVLHGPNLNMLGRREPHIYGATTLAEINEALEQRGKAAGVEVICIQSNHEGVLVDAVQTHGWTASGIIINPGALTHYGLSLRDALAMVSAPIIEVHLSNVYQREAFRHTSVVAPIARGQITGLGWRGYLLALEWLLAE

SEQ ID NO: 9127 - protein, 234 aa, Chloroflexus aurantiacus
  unsure (1)..(234): unsure at all Xaa locations
PAMHLMCAXVPSWRPTSRNCDGVTRRDLAVSEVSSVVNRIRRATIERVTGETNITLTLTIDGSGQADVQTGIGFLDHMLTLWARHGLFDLQVRAQGDLHIDEHHTAEDVCICLGRAIDQALGERAGIVRTAHSFVPMDEALALVAVDLGGRPYCVVQADFVTMRVGQLGTDLVAHLFESVAFNGRFNLHAQVMYGRNDHHKIEALFKAFGRALDAATRIDARLGGTIPSTKGVL

SEQ ID NO: 9128 - protein, 383 aa, Chloroflexus aurantiacus
ELIQADHQYLLQSYVRADFVIERGEGVYLYDSEGRRYLDFVAGIAVNALGYGDRDVLKAINDQAERLIHVSNLYHTQPAIELAKLLVQSSPAFAKAFFCNSGAEAIEGAIKFSRRYARAHVGEGKTTIVAFDGSFHGRTMGAVAITAREKYREPFMPVMPGVRFARYNDLDSLAAVMGDDVCAVVVEPVQGEGGLRAAEPAFMQGVRELCQRYGALLVFDEIQCGVGRTGTLWAHEQLGVQPDMMTVAKPLAGGLPIGAVLMGQHVADTIHPGDHGTTFGGNPLATAVGTVVFRKISDPAFLAHVQQVSNYLDEALQDFANEHADQVIELRGRGLMRGVRIAGSASAVREAAHRHGLLVATAGEDVIRLLPPLIIEPQHVDEA

SEQ ID NO: 9129 - protein, 430 aa, Chloroflexus aurantiacus
MPVVALIGAQWGDEGKGHLVDLLAARARLVIRYGGGNNAGHTVVNHLGTFKLHLVPSGIFDPGIVNVIGPGVVVNPEVLIKEIEELEARGVSTAKLFVSDRAHVIMPYHIQLDQLQEEARGEGRIGTTGRGIGPAYADKMSRSGIRMGDLLHEETLLNRLRTVLEEKNRLLTKLYNARPLSLHDTYLTYLEYGRRLANHITDVHPIIHRALEKDLPVLLEGAQGALLDIDHGTYPFVTSSPPGAAGACQGSGIGPTHINSVIGVVKAYTTRVGEGPFPTEVDGSVADVLRQIGTPWAEVGTTTGRLRRVGWFDAVMARYAVQVNGVDTLAITKLDVLDGLETLKICTGYKLHDALLEYPPTTTALFDQIEPVYEELPGWSEPTRHVRRFADLPEAAQAYVARICQLVGARLGIISVGPGRDQTIMVADVF

SEQ ID NO: 9130 - protein, 266 aa, Chloroflexus aurantiacus
LLIGDPVAHSRSPAMHNAALAALGIAARYRAVQTTAAELPDRLAALRQPHFLGANVTLPHKQAVIPLLDEIEPAAARIGAVNTIVRQPDGRLLGVNTDAPGLLADLAAAGWTPVEQEVVILGASGAARAATFALADAGVNGITIVNRSLMRAIDLAAAAAANQPALRIRALSLSDPAVTDVIAHCTLLINATALGWHDDETPIADPPVGAHCLVYDMVYRETALLRAAVARGARVRDGRGMLVEQGALAFERWTGRPAPREIMWQA

SEQ ID NO: 9131 - protein, 508 aa, Chloroflexus aurantiacus
HLLTGWPPPPANQRQSGMPLNSPRALNPQVSVLAEQLTLRALEMKPANRYQRASEMRSALETVRLMAGRPMGATAPIEKPVAPSATVPAAPPPQPATIATAAPATTLPPAPPPTTTAAPAAGVAAPTAPPRPLISTSCLLAIVGGLAVVAVGVCVLLAVLVGLYMTNASLFGLPGNTVATQSTVAPAPTTNEAPAVDLLQQVNAITQTAQLREDSLGAAAYSPDGLLVAVAVGSAIQLRDASSFLVQATLSGHEGDVSSLAFSPDGAILASGAQDDPVVRLWDTGTGREIAQLRGHSDWIRSLAFSPDGRLLASASVDQTIRIWEVTSGQTTAILRGHTDLPGNVAFSPDGQWLASASRDGTARLWDVSSGQQIDAFSFSAPVDPTTNAPFWLTGIAFSGDGRQIAVGSVNGNVYLLDAATGNVQRELRGHDGWVVIRGVAYSPDGRLLASASLDGSVRLWSPTSGAERGVLQQRGLRLLGLSWSPDGTRILSSSDMGGNLVIWDVES

SEQ ID NO: 9132 - protein, 474 aa, Chloroflexus aurantiacus
LIGGEFVPAQSGKTFERRNPADTRDVVGIFADSDERDVHAAVEAAKAAFPQWSKVPAPKRGEILLRAAELLQARKEQYSRDLTREMGKPLFEAGGDIVEAIGMAQYAGSEGRRMHGVTTPSELPNKFQMSIRQPIGVVGLITPWNFPMAIASWKMLPAIVCGNTVVIKPGEDASVSTYNLVQCLMEAGLPPGVVNIVTGYGPRAGQPLVEHPDVPVISFTGSTETGRLVYELGARRIKRVSLEMGGKNPLIVMPDADLDLALDGVLWAAFGTTGQRCTATSRLIVHRAVAKELVERIVARAQSLRVGNGLDPATEMGPLVNEKQLQRVLNYIDIGKQEGATLLCGGYRLTGGDYDYGYFIAPTVFTNVTSQMRIAREEIFGPVLSVIEVDSLDEAVAIANDVAYGLSSAIYTRDINAAFRAMQALQAGIVYINAPTIGAEIHLPFGGVKATGNGHREAGPTMLDVFSEWKSVYI

SEQ ID NO: 9133 - protein, 308 aa, Chloroflexus aurantiacus
MRVMILTAGLGTRLRPHTFVRPKPLVSVAGKTVLAHIIDYLAPLQIDELICVVGYLGNQIEEFMRANYTYPMRFLEQKVMRGQADAIALARELTGPLLVVFGDGLLEFDIEQLNQHPNYGIIYCKEVDDPRRFGVVVVEQGRIVRLVEKPSEPISNLAVAGIYYVPEAARLMSAIDYIMQNNIQTKGEFYLADALQVMIDRGEELRAETVRTWYDCGTIEALLDTNRYLLDHGHNQAAEYPNAVIVPPVNIAPTAVIEHAVIGPYVSIADGAVVRHAIVRDSIINAGAQIQSVILNRSLIGDRASVNG

SEQ ID NO: 9134 - protein, 812 aa, Chloroflexus aurantiacus
LTDIARTVLKKRYLLKNEHGDVIETPETMFWRVAETIAAVDARYGASAEQVEERAERFYHLMTQGYFEPNSPTLMNAGRPLGQLSACFVLPIDDNLTSIYETLKHQALIHQSGGGTGFSFSRLRPRNDVVRSTMGVASGPVSFMDVYNHSTEAIKQGGTRRGANMGILRCDHPDILEFITCKLDTTKITNFNISVAITDAFMRAVERDEEYDLINPRTGLGQIASRDGLKHPLTGEVLVPAGQPMRLRARMVFDLIVQCAHATGEPGLFFIDRANEYNPVPHLGEYEATNPCGEQPLLAYDVCNLGSINLGKFVTDAGTIDWESLRDVVHESTRFLDNVIDANHYPLEQITQLSQRIRRIGLGVMGWADMLVRLGIPYNSAQAIDLARQVMRFIDEESKVASEQLARERGPFPEWEYSIWGPDATCARRPDGSRIRPQRLLRNCNVTTVAPTGTISIIAGCSSGIEPLFAIAFWRYQADTRMLDINQDFVAQAKREGWYSDELMERIADTGHIHHPEVPASVQRVWVTAHDIAPEWHVRMQAAFQEYTDSAISKTINFPHEATPDQVREAYELAFRLGCKGITVYRDGSRANQVLSTGSTGKSAEPAPASDQPVELKPRPVPAEGLPSHSFPVVTPLGKLRLFVTELDGKPFEVFAIIGRAGSDVTAFTEAIGRLISLALRCGVPVKLIAEQLRGIGGSRSAGFGPDRVRSVPDAIGKVLLDHYVKNGNGNGNGNGNGNGHDYEYGNGETDTSRTYTNGASEATATTPVSHPHSDHGHGTIEAAEICPECQNATMLNEEGCRKCHSCGYSEC

SEQ ID NO: 9135 - protein, 217 aa, Chloroflexus aurantiacus
  unsure (1)..(217): unsure at all Xaa locations
CCGATDPVAGRCSSRGITCXMGCLTRASCCVSRGVECGSHAAAPAALSIRRVAYCYPSWSRGCWMGSCRSSRPSGMHCDPCAXTGMLQEICACAPAATASPDGGLCITHNWCXPRAYQRVCIAIGAGLSDWPGGSALLQRGITCXMGCLTRASCVCRAVWSAQPCCRASRALIRRVAYCYPSWSRGCWMGSCRSSRPSGMHCDPCAXTGMLQKICAC

SEQ ID NO: 9136 - protein, 379 aa, Chloroflexus aurantiacus
LEELQERNMRAGRLRFTDDYAVGIPDAEFIFITVGTPMGEDGSADLTYVKAAARSIGQYLRSGSIIIDKSTVPVGTGDMVENIIAEYAGPDVKFDVVSNPEFLREGSALSDFFKPDRIVLGAKNREAAQRVAALHETLGAPIIITDLRTAEMIKYASNAFLATRISFINEIAQICERLGADVREVARGMGADKRIGPHFLEAGVGYGGSCFPKDVLALYHMAASAGCHPQLLQAVMDINSDARKRFVKKVETVLGDLEGRVIGVLGLSFKPNTDDMREAPSVDIINSLLKKGARVKAYDPVAMARAEELLPTVTFTATAYDVAKDADALLLVTEWNEFKQLDWQRIKRYMRQPVVIDGRNLYDPREMRNLGFIYWGVGR

SEQ ID NO: 9137 - protein, 363 aa, Chloroflexus aurantiacus
  unsure (1)..(363): unsure at all Xaa locations
PASDGLPVGWRLSRTELLAMFAIDSGVVXTVPRRLRRKEWEAASTRMRIFAGNGNLPLARAISERLGVPLGDVTIVKFSNENIFVRLNESVREKDVFVIQSLSMPDLSDRIMELLILLDACKRASAGRITAVIPYYAYGRTDKKDQPRVPITARLLADMIQVAGAHQVMTIDLHAGQIQGFFSIPMDELTAMNLLVRYFADKGWNDLIVVSPDVGFAKRARNFAEALNAPLAIAEKRRLQHFDRKDGSLTVPEILNLIGDVRGKRCLIVDDEIATGSSILEVVQLLEKEGASEIYACCVHPVFAGNAIERLRASPIRELVVTDTLPVAPERRWPGLTILSVSTLIAEVIQRIHSGVSVDTIFQ

SEQ ID NO: 9138 - protein, 256 aa, Chloroflexus aurantiacus
PLLQVAGAYSDVGRVRDHNEDSLFKLTLCLENNGQRQSWGLYIVADGMGGHAAGEVASGLAVRHAAQTIIDSYLQQMLAGPRLYHEADMQSLVRQAVLAANEAIYNEGRAQANDMGSTLTMALVVGDRAVVANVGDSRTYLFRDGKLQRISQDHSLVMRLVELGHLSEDEIYSHPQRNAVLRSLGDRAEPEIDLFQVHLRPGDALLLCSDGQWEMTRDPVMERIITEEADPQEACKALVAAANQAGGEDNIAVILV

SEQ ID NO: 9139 - protein, 226 aa, Chloroflexus aurantiacus
ILITGASRGIGAATALALAGPDTRLTLAARDRTALEAVARQATAAGAQCLVVPCDVTDPAQVAPTVAQAAGEGTLDVVVHSVGGALVAPLADIELPAWEEHMRTQLTSLFLVAKATTARMDRGSLFINIASVAARQAFPGWSAYVAAKHGALGFMAAIREELRPRGIRVCSILPAATDTAIWDAIPGDWSRTNMLQPGDVAAVIAALVALPPYATVEDLTIGHVAG

SEQ ID NO: 9140 - protein, 777 aa, Chloroflexus aurantiacus
PVLPLLDSVLFPQMLAPLFVSDERAINAVEQAVAEDRLVLAVAVRGPVDELTLGIDDLYPVGVEATVQRVRRLPDGTLSVVLEGRQRMQIVSVVTEHPALRVLATPLETPPLDEDAALMVEALSRTILTTFEKIVRLSRNLPDDAYLSALNSAEPGELADIIAALLPISVEDRQRILALADIQQRLRQLEILLAKELDLLELENRIHSQVQQEVDRSQRELFLREQLRAIQRELGQEDPSRREIMLLRERAAAAGLPAHAMARFEEELARLELISPMSPEHGMLRTYLDWLISLPWSNASPENRDLRAAAAVLERNHYGLRKVKDRILEYIAVRQLAGPSRRAPILCFVGPPGVGKTSLGQSIAEALGRRFVRLSLGGVHDEAEIRGHRRTYIGAMPGRILQRMKVAGTINPVFMLDEVDKLGSDFRGDPAAALLEVLDPEQNSTFSDHYLDLPYDLSQTLFITTANVADDIPDPLLDRMELVELPGYTEDEKLHIARRFLIPRQMTDSGLPPATIRFGDATIHTIIRNYTYEAGVRNLEREIGAICRKIARRIAEGRRYPRQITPRALPKLLGPPRFEIGKIDPRDQVGVAIGMVYTSAGGDIMPVEVVLMDGKGNLLLTGQLGEVMQESAQAALSFARANASRLGIEIRHFDKLDIHVHVPEGATPKDGPSAGVTIATALISALTGRTVRHDIAMTGEITLHGRVLPIGGVKEKVLGAYRAGIRQIILPRRNEHDLVEIPVALRRQLTIHLIERIEQALELVLGPPPPKEPRRAP

SEQ ID NO: 9141 - protein, 123 aa, Chloroflexus aurantiacus
NTPSDLRYSKTHEWVRQEGDEVVIGITDYAQHALGDVVYIELPAVGSTITVGESFGIVESVKASSDLYAPVSGEVVAVNTALESDQAPINSDPYGAGWMLRVRPSGESAELLDAEAYAAFVAE

SEQ ID NO: 9142 - protein, 399 aa, Chloroflexus aurantiacus
RVALFTNEYPPYIYGGAGVHVEYLSQALSRMVPVEVRCFGDQHVDTANLKVRGYPRWEEARQNTDPRFAGAVDAVARSLAMAKDTLDASVVHCHTWYTDLAGLFASKLWGIPYVLTIHSLEPLRPWKVEQLGNAYHLSSWIERTAIEQAHAVIAVSKETRADILRLFNINPERVHVIYNGIDLNEYRKTSATDALERYGVDPTRPFVLFVGRITRQKGIIHLVNAIPHIDPTAQIVLCAGAPDTKEIGIEMEERVAAVSAHRPGVIWIREMLPRQDVIQFYSHAAVFCCPSVYEPFGIINLEAMACETAVVASAVGGIKEVVIPEETGLLVDPNLKPGSFDPVDPAAFSADLAAAINRLLANPDLRYQFGQAGRRRVEQVFSWDAIARQTIELYQAVIE

SEQ ID NO: 9143 - protein, 567 aa, Chloroflexus aurantiacus
  unsure (1)..(567): unsure at all Xaa locations
YLAWHIFATKXSGYVKRNTMTTFAELGLSDALVSTLSGLGYDEPTPIQAQAIPLLLAGRDVIAQAQTGTGKTAAFALPMIERVTDALVVQALVLAPTRELAVQVAEAIHRYGRHRSLRVLPIYGGQPIERQLRGLAQGTQVVVGTPGRVLDHLKRGSLRFDHLRMVVLDEADEMLDMGFAEELEAILQLTPTERQTALFSATLPPAVQNLTLRYTRQPVRVSIAAEQLTTPRIRQTYYEVLARDKLDALCRVLDAEMPQLAIVFCRTRQEADDIGERLQGRGYAAESLHGDLSQAARDRVMRRFREGQLDVLVATDVAARGLDIAEVSHVINYDVPTDPESYVHRIGRTGRAGREGVAITFITPRERRMLQIIERVTRTRIERCQMPTLADVAARRRSALVDQLRTAMADPALAGYTTLVDELAGTGDLRTVAAAALKLLLNEDQTDQVDTITRLDPPPAERPQRERSERSARSPRTKADTRSERVERTMVRLQINLGRNDQIRPADIVGAIANESGLPGRSIGEIEIRARTSVVEVPRRAAQQVLQALNRTTLRGQRVRAVLLAEA

SEQ ID NO: 9144 - protein, 308 aa, Chloroflexus aurantiacus
NPITAALAQRPLLILDGALATELERRGCDLADPLWSAKVLIENPSLIQAVHADYFAAGADVAITASYQATIPGFMARGIAPDQAILLLQRSVALAQAARDQFWADPANREGRLRPLVAASVGPYGAFLHDGSEYRGNYGLSVAELIEFHRPRMAALAAARPDLFACETIPCLDEARALVALLPEFPHLTAWISFSARDGAHTAQGEPIAECAAEIAAHPQVAAIGVNCTAPRFLPDLIRAVQAVTDKPIVVYPNSGEVYDPVGQCWIGTTEIDDFVAQARQWYAMGARLIGGCCRTTPDHIRALAAWA

SEQ ID NO: 9145 - protein, 277 aa, Chloroflexus aurantiacus
MQGKTVIVTGANSGIGYVTARELAAMGARVIMVCRSQSKGEAARQRIMQEAKGAPEPELVLADFASLASVRRAAGDILERCPRIDVLVNNAGLFVSEPLASADGYEMTFAVNHLAPFLLTNLLLERIIASAPARIINVSSFAHVAGRIAIPQIASPQRPNIAQAYSDSKLCNILFTNELARRLQGSGVTANSLHPGAVATNFAADSRGLFAFFFRLARPFMLSPEHGAATSIYLASSPEVAEISGQYFVRKKPVKPSAAAQGAALAKRLWEFSEQLV

SEQ ID NO: 9146 - protein, 489 aa, Chloroflexus aurantiacus
VRVRFAPRPTGSLHIGGVRTDLFNWLCARHYGGQFILRIEDTDEKRFVPGAADDISASLRWVGIDWDEGPDVGGPYGPYVQSERFEQGIYQPFINQLLEAGLAYMSFTTEEELAQMRAAAEAAGIKAFRFRGPERDWPLERQREEAASGKPYTIRLKTPLEGETRFRDLIRGGDEIVVQNNQLQDIVLIKSTGMPVYHFAHLVDDHLMKITHVMRGEEWVPSTPYHVLLYDFFGWPRPVFAHLPAILRQDGRGKLSKRKDDVATQRFRERGYLPETIFNYLALQGWSYDGVTEIMTRDELIARFTLERIQPSPARWNPEKLRDMNGIYIRKLTTEQLAERVLPFMQRAGLIGDPASETERAYLISLIPLIHERLEELQEAPDLLAFFYQDVVPGETYNPADLIPKKHDAAQTVALLRAAHEALSQQTDWTPPALETTLRALCEQLQVKPGPLFGAIRVAITGRSVAPPLFDTLAGVGRERSLSRLAAAI

SEQ ID NO: 9147 - protein, 591 aa, Chloroflexus aurantiacus
  unsure (1)..(591): unsure at all Xaa locations
FSGRPGDTAVFRLRMAADAPVSGVFLRTCPDGEQHFTPLRDLGVRGVCRWWEGELPIRMLRTNYRFLIRADDCSRWYSAGGITRHYPTDANDFVVLANYHAPAWVRDAVFYQIFPDRFADGDPTNNVRDGAYLYHGRPVVARRWDERPNRATGSIEFYGGDLQGIAQRIDYLTDLGVSALYLNPIFRAPSNHKYDVEDYTSIDPHLGGEAGLLRLREVLDERAMKLVLDIVPNHCGVTHPWFVAAQANPRAPTAEFFMFRRHPDDYESWLGVKTLPKLNYRSVRLRDVMYAGQDAIMRYWLRPPYRIDGWRIDVANMLGRLGTDNLGHKIGRGIRRAVKAEQPEAYLLGEHFFDGTPHLQGEELDATMNYQGFTFPIWRWLGGFEFNPQRPEADPRPIATETVVAQWTAFRAAIPWQIASQQFNLLGSHDTPRLRTIVGDDLARVRVAMTLLFCYPGVPCIYYGDEIGLTGGGDPDCRRPMPWDEREWDHDLRAFVQRLARLRRQSPALRWGGFQQLYANGETIAFQREAPEERMIIVVRRSDDGQRLLPGASRRAGXWGSPAGTLQWCRDGCTQRDAGHGNLPATGAQIW

SEQ ID NO: 9148 - protein, 391 aa, Chloroflexus aurantiacus
MDDVVIVGAARTPIGRFNSAYSGLSAIDLGAAAVQAAVQRAGIEADSIDECIMGCVVTAGLGQSPARQAALRAGLPHTIGGLTINKVCGSGLKAVMIGTALIKAGEADVIVAGGMEHMSGAPYLLPQARHGYRLGHGQIIDAVVHDGLWCAFEHHHMGVAAEWIARTFNVTREQQDAYALQSHQRAVAAQDSGAFQAEIAPVTVPGPKGQVNLVTTDEGPRRDTSLAALAKLKPAFVTDGTVTAGNAPGITDGAAAVVLMRASRAAQLGVQPLARIGTAAQAAVKPLELFTAPAFAIERLMKRAGRTLDDYDLFEINEAFAAQVIANLRALALDADRVNVHGGAIALGHPIGASGARVLVTLISALRQRGGQRGIAALCLGGGEAVALEVE

SEQ ID NO: 9149 - protein, 451 aa, Chloroflexus aurantiacus
RFPSDFLWGAATAAYQIEGAWNEDGKGESIWDRFVRRPGVIANGDTGDIACDHYHRYEEDLDHMAALGLKAYRFSISWPRIFPTGSGQPNQRGLDFYRRLIDGLHRRHILPVATLYHWDLPQALEDRGGWTQRDTALRFAEYADYLFRTIGGEVALWATHNEPFIQAFYGYGNGENAPGKRVPWRVLAVVHHLLLSHGLAVSAFRAARPQAVRSDMPSPQIGIVLMIWPQYPASQRIADQKAAQRIDGIMNRLFLEPLFCRRYPADMIDHFARRLVFAPIQPGDFEIIGQPIDFLGINTYTRLLNAFTWREPFTMAKQVPGPLPKTAMGWEIYPDCIVEALQKARSYTSLPLYITENGAAFDDPAPGPSDQVVEDPQRVAYLQSHIEACRRAIAAGIDLRGYFVWTLLDNFEWAKGYSKRFGIIYTDYTTQRRVWKRSAFVYRDIIARNGL

SEQ ID NO: 9150 - protein, 246 aa, Chloroflexus aurantiacus
GKVALVTGAAAGIGRASALAFAREGAKVVVADVNVEGGEETIALCRALNTDAMFVRCDVSQRDEVERLIALAVDTFGRIDFAHNNAGIEGVQAMLADYPEEVWDRVIEINLKGVWLCMKYEIRHMLKQGGGAIVNTSSVAGLAGSRGVSAYVASKHGIVGITKAAALEYARNGIRVNAICPGTIHTAMIDRFTQGDPQLLAQFAEGEPIGRLGSPEEVANAVIWLCSDKASFVTGATLAVDGGRLA

SEQ ID NO: 9151 - protein, 293 aa, Chloroflexus aurantiacus
PTIVVVGSLNMDLVVRAPRHPQPGETVIGSDFQTFPGGKGANQAVAAARLGARVHLVGRVGVDAFGHTLLATAQEHGVDTTFVQRDPTAPTGVALITIDSHGQNTIVVAPGANMQVTEADVLRAESVLATADMLLMQLECPLEVVIAAARLAHHHGVPVVLNPAPARPLPVDLLALVDFLIPNQLELQALAEGEADLRTAIRYLQQRGARNVVVTLAEAGAVLAEADQIIHEPAFEVPVVDTVAAGDAFVAAFCVASASGKSPQEAVRWGNAAGALAVTREGAQPSLPAYREV

SEQ ID NO: 9152 - protein, 426 aa, Chloroflexus aurantiacus
VPGPRAQELVARDHTVIAPLGRVYPLVIDHAQGCEVWDVDGNRFLDMNAGIAVLAAGHCHPRLIQVAQEQLQRFTHMAGTDFYNEPMVRAAEKLVSLMPGGKDWQVFFTNSGTEAVEASIKLARYATGRQNIIAFYGAFHGRSYGSLSLTASKPRQRQGFFPLLPGVSHTYYPNCYRCPINLRFPECDIACLDLIERTLFKTTTPPEEVAAIIIEPIQGEGGYVVPPPGALARLRSICDRYGILLIVDEVQSGVGRTGKMWAFEHEGIVPDIVASAKGLGGGLPLGAMIARSELARKWQPGSHGNTYGGNGLTCAVAYELLTMVEEELMDNAATVGAYLLEQLQALQQRFPQIGAVRGRGLMIGVEFVDSQGNPAGALAEAVMVESFRKGLLVLTCGASTIRFCPPLTLTKAQADEAVARFALAIE

SEQ ID NO: 9153 - protein, 203 aa, Chloroflexus aurantiacus
IHALIFDFDGLMVDTETPALQSWQEIYAEYGVTLSVHDWAITLGANAGFDAHAHLVALLRQRDPQLAEQVIAARDTILARRQARKDELSAPQTLLPGVAELLAEAHSKGLPCAVASSSSRRWVEGWLERLGIRPFFATVVTADDVAATKPAPDLFLEAARRLGLPPATCLVLEDSPNGIRAARAAGCPVVAIPGAISGQVPLP

SEQ ID NO: 9154 - protein, 257 aa, Xylella fastidiosa
LATGGSRAALPSMPVDGQVVITSEQAIALTRVPEHLIVIGSGAVGLELASIWVRLGAQVSVIEAQPEILPGWDATVARTAKRSLRQQGITFLTDHRVETVVRSGSRAAVTCLNSKGETLMLDGDQVLVAVGRQAQLCVAGIQNLELQQDEQGRLWVDAHYATSLAGLYAVGDLIAGPQLAHRATAEGLRVADYLAGRPLSPMGPIPSVVYTDPELAMVGLTEQQAKVAGYAVKCGQFPFYGQCRARAQEQTEGLIKM

SEQ ID NO: 9155 - protein, 333 aa, Xylella fastidiosa
RMVINDIESLTAQALADAAAAQNLDHLEFLRVALLGKNGSITLQLKQLGKLPVEQRKAIGEKLNRVRDLISDALMDRKAALESAALSKRLIDERVDVTLPGRRGERAGLHPVTRTLERITEIFARLGYELVEGPEIEDDWHNFEALNFPLHHPARAMHDTFYFGDGRLLRTHTSGVQVRYMSDHRPPLRMIAAGKVYRSDSDQTHSPMFHQIEGLLIDKHATFVDLKGTLSEFLRAFFERDFEVRFRPSYFPFVEPGAEVDIAWQQSDSSVRWLEVLGCGMVHPNVLKNVGIDSECYTGFAFGLGVERFAMLRYGVDDLRAFFENDVRFLRQF

SEQ ID NO: 9156 - protein, 334 aa, Xylella fastidiosa
MIDSKQKIAVLGAGSWGTALAALVARHDYPTILWGRDVRVIQSINIQHQNFRYLPSIMLPQTLRATTDLAAAVSGADWVLVAVPSYAFTETLCRLAPLLSIGVGVAWATKGFEPGSGRFLHEVAREILGGDAPLAVVTGPSFAKEVTLGLPTAVTVHGEDACFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRQAEQNGVELPISEAVRAVLREEITPYAGMKVLLAREQKPE

SEQ ID NO: 9157 - protein, 654 aa, Xylella fastidiosa
LNSPQRAAVLYREGPLLVLAGAGSGKTRVIVEKIAYLITSDCYPAKRIAAITFTNKSAKEMRERVAKQIKSSRADGLTICTFHALGLKFLQIEHEAVGLKPGFSVFDADDADAQINDLLHGAKQDVIDDTKRRISRAKNAGLSPEQALVAARTTRDMEVATLYARYQARLIAFNAVDFDDLIRLPVQILETSDQVAMAWRERIGYLLVDECQDTNDAQYRLLKVLASPRGNFTCVGDDDQSIYAWRGANAENLMQLERDYPQLKVIKLEQNYRCPNRVLRAANALIAHNPHAHLKTLWSDQKDGERIRIWECRDSEHEAEKIAAEISYLGDAKQVPWSDFCILFRGNFQSRPLEKALQLLRIPYHLTGGTAFLERQEVKNLLSWLRLLVNPDDDAAFLRAVQSPKREVGSTSLAKLAELAATKQMPMSRAAESLGALQQLPARAANGLNKFTDILRELRQQVSRVSSAELVRRLAEVSGLLTELREQSNDEASYQRRKRNVEELAEWFEGGPFGASVGDLVSQLALLSRNDKDDGGNQVRMMTLHASKGSEFRYVFIAGCEDGVLPHEVSLEEGNVQEERRLLYVGITRAKEQLWMSYSKCARRFGERVRFKPSRFFDELPAEELQRDGADPAVDAERKQERAKAGLAAIQALL

SEQ ID NO: 9158 - protein, 243 aa, Xylella fastidiosa
VEFRMLRLHGERLADIVLTPPEEDYELPEMQLPKKEPDIEVEGLSFRYGEDEPWVLKDCSFKVAAGESVAIIGASGCGKTTLMKLLLGLLKPTAGTIRISGRDLHKFGTRNVRSIVGAVMQDDQLFAGSVADNISFFDPDFDLERIEAAAKLAAIHEDIAAMPMGYHALIGDMGSALSGGQKQRVILARALYRQPKLLFLDEATSHLDVMRERLVNDAVHQLKLTKVIVAHRPETIASTDRVV

SEQ ID NO: 9159 - protein, 302 aa, Xylella fastidiosa
TPALHVYNLHKTYSNGTQALKGISLDITPGDFFALLGPNGAGKSTLISIVSSLVNLSSGSVEVFGIDLVHERSAAIRLIGLVPQEINFNLFEKPLDILINYAGFYGIPYAKAEALAEVELKRAHLWGKAHVMSRTLSGGMKRRLMIARAMMTQPRLLILDEPTAGVDVEIRRDMWRVLQEINANGTTIMLTTHYLEEAESLCRNLAIINGGQIIEKGPMRTLLAKLDVEGFLLDIDGTLPAQLPSIEDTTLNALDDHTLDLSMPRAMNLNHVFAALSAANIQVRSMRTKSNRLEELFIRLTS

SEQ ID NO: 9160 - protein, 569 aa, Xylella fastidiosa
KHLALDLKLDFDKKTLAGTATYSLDWKDKDAKQIVLDTRELSIEKIEVDDGQGHLNQLKFVLFPADKILGSKLVIETPSQPTQIRVTYRTAPSASGLQWMEPAMTEGKRLPFMFSQSQAIHARSWVPLQDTPGVRFTYKAHIVSRPDVMVLMSADNDPNAVRDGDYRFKMAEPIPSYLLAIAAGDLVFKPISARSGVWAEPVMVDKAAKEFEDTEKMIGAAETLYGQYRWGRYDMLVLPSSFPFGGMENPRLTFVTPTVIVGDKSLVSLIAHELAHSWSGNLVTNASWKDIWLNEGFTTYVQARITEALYGQTMADMERQVDQMDIFAALKDIPKADQKLVLSTLTNRDPDDALSPIAYVKGAWFLQFLEQRVGREVFDPFLRGWFDSHAFQSATSEDFIVYLKQYLLSKVPNAITAEELDSWLNAPGIPTIAQKVRSLSFANVDGARIAWSGSGLLPNRQVTDGWGTQQWVYFLSRMGETLKLEQLKQLDEAYHFTGTPNGEIAMRWYPLAIRSGYTAAWPEAGAFIGRVGRLKLILPIYAELSKTPKGLLFAKQIFAKFKSLYHPIT

SEQ ID NO: 9161 - protein, 672 aa, Xylella fastidiosa
MSNPLLDFSDLPRFDAILPEHVGPAIEQLLAEAEAAVAHAEQVTPVTWENFVVPLDDATERLYRAWGQVAHLEAVVNTPALREVYNVTLPKVTRFSSTLGQNLALYAQYKALACAPEWDRDNAVRCKVVDNALRDFRLGGAELDAAGKVRLAEIKQELSALSATFSQNVLDATEAWSYTTEDAAVLSGLPTETVATARAAAEKKGVSGWTFTLQMPCYLSVQSDADNRALRERSYHASAIRASEFGDAALDNSPHIHQILTLRSELAALLGFSCYAAYSVATKMAEDPAEVLSFLHDLAGRAKPHAQRDRRELETFAREVLGLETLEAWDIAYASEKLKQARYNFSEQEVKQYFTEPKVLAGLFEVIRSLYGLRIEEDAAPVWHPDVRFYRLIDTNGQRVGQFYLDLYAREGKRGGAWMDDCRNRRDKGNGVQTPVVYLVCNFGRGNDGVLPTFRHQEVITLFHEMGHGLHQLLTRIGELGVAGINGVEWDAVELPSQFMENFCWEWERVQAMTAHVETGAPLPRSLFDRMVCARNFQSGMFTVRQLEFALFDMLLHSNFDPAQDSVLGLLERVRDEVAVNRLPDWNRFPHQFRHIFAGGYAAGYYSYKWAEVLSADAYAAFEEAPDQFAEIGARFLDEILSRGGSRSAAENFQAFRKRAPRIDALLKRNGI

SEQ ID NO: 9162 - protein, 265 aa, Xylella fastidiosa
IAFIGGGNMARSLIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPNTPALLGAGVTGLFTTSQTTGTQRTIAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQALVAKAIDAATRRARALGK

SEQ ID NO: 9163 - protein, 246 aa, Xylella fastidiosa
KLVLLRHGQSQWNSMNRFTGWVDIGLTEQGHQEATMAGHLMKKEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVRESLKNTLERVLPYWNDAIAPQLNDNKTVLISAHGNSLRALYKYLNKESDEKILNVNIPTGIPLLFELSDTLQVVSYRYLGDPDAAQRAAEMVANQGKAK

SEQ ID NO: 9164 - protein, 311 aa, Xylella fastidiosa
LMHSVVVVGSFSIDHVWRCDTLPTPGATIAGRYSRGPGGKGFNQAVAACRAGARTYFICALGNDTDGNMARDIATKDGFTLIGESSTEPTGTGGIYVDSHGHNTIVTGAGANAVLSTHFITEQRALITSAWIVLAQLESPIETLETALSMAREAGRLTILNAAPANATATINLLKLADVLTLNETEFVALLSRHVGERISPDNVATTDGNTLHALCNKLLSGSTVVITLGSAGVFVSHSEENLHGDTQPYYRVAAEQAHTVDTTGAGDAFNGALAASLAQQPNTAFIQHVRLANSYAARSTETEGGAVSMP

SEQ ID NO: 9165 - protein, 241 aa, Xylella fastidiosa
  unsure (1)..(241): unsure at all Xaa locations
MSSYLFTSESVSEGHPDKVADQISDAVLDAILVQDPRARVACETMVKTGVAIIAGEITTSAWVDLEALTRKVIVDIGYNSSDVGFDGATCGVLNLIGKQSPDINQGVDRKKAEEQGAGDQGLMFGYATNETDNYMPAAIHISHRLVEQQAKIRKKSNSLLPWLRPDAKAQITLRYEDGVASAIDAVVLSTQHDPGIKQKDLVEAVREEILKPVLPSKWLHKGTKLHINPTVNLXLCPVGDC

SEQ ID NO: 9166 - protein, 857 aa, Xylella fastidiosa
MRMDKLTSRFQNALADAQSLAVGRDHTIIEPVHVFSALLDQQGGSTRSLLVQAGVNVPLLRERLTEILEALPKVSGQTVNVSPSNELSRLFHRTDKLAQQHGDQFMASEWFVLAVVDDSGGLGQALRAAGAEKKKIEAAIDKLRGGETVQTENAEEQRQALEKYTIDLTARAESGKLDPVIGRDEEIRRTIQVLQRRTKNNPVLIGEPGVGKTAIVEGLAQRIVNGEVPEGLRSKRLLSLDLGALIAGAKFRGEFEERLKGVLNDLAKNEGRVILFIDELHTMVGAGKADGAMDAGNMLKPALARGELHCIGATTLDEYRKYIEKDAALERRFQKVFVGEPTVEDTIAILRGLKEKYALHHGVEITDPAIVAAATLSNRYITDRQLPDKAIDLMDEAASRIRMEIDSKPEELDRLERRLIQLKIQREMLKKEKDEASKQRLVDLERDIEVLDREFSDLEEVWRSEKAALQGATKIKESIEQAKLDLEAAQRRQDYAKMSEIQYGVLPALEKQLVAASQAEQHDFTLVQEKVTAEEIAEVVSRWTGIPVSKMLEGERDKLLRMEADLGRRVVGQDEAIKVVSDAVRRSRTGLSDPNRPSGSFLFLGPTGVGKTELCKALAEFLFDSQDAMVRIDMSEFMEKHSVARLIGAPPGYVGYEEGGYLTELARRRPYSLILLDEVEKAHSDVFNILLQVLDDGRLTDGQGRTVDFRNTVIVMTSNLGSHQIQELSGDDSPEVYTQMKAAVMGVVQVHFRPEFINRLDDIVVFHPLDKAQIKQIARIQLRGLEKRLAESELKLDLDDRALELLGNVGFDPVYGARPLKRAIQSQLENPLAQQILAGAFVSGDTVQVGVDGGKLV

SEQ ID NO: 9167 - protein, 435 aa, Xylella fastidiosa
VFLSGMVADKQGELTLARIAVVGLGYVGLPLAVAFGRQRPTLGFDIDICRVQQLCAGHDITCEIELEELQAARHLRYSSDPRELSDCQIFIITVPTPIDVVEQPDLGPLRSASMLVASVLKPGDLVIYESTVYPGTTEEVCVPLLEAGSGLRFNVDFHCGYSPERINPGDRKRRLQDICKIISGSTPDITAVVDALYSQIIVAGTWCAPSIRVAEAAKVVENIQRDVNIALVNELALIFDRLGIDTLDVLEAAETKWNFLPFRPGLVGGHCIGVDPYYLLHKSESVGYYPDLIHTARRVNSRVSRHVVDRVVALLGELSVPMTRAVVLVLGVTFKEDCPDLRNSRALDLVRMFRTLGAQVDVCDPCADPQQALEHEAVTLCTEPKAGAYDAIVLAVAHAQYRMYDVATIAALGKSQAVVYDVKSVWPRAAVTDRL

SEQ ID NO: 9168 - protein, 608 aa, Xylella fastidiosa
MISLRHFAMRRGGRLLLSNVDITLHAGDRVGVVGRNGVGKSSLFAAIRGELEADKGNVELPGKLRIASVAQETPSLSDLALDFVLSGDDVVAEVLRVEAEANAREDWEAVAAAHQRLAEIGGYDAEARAGKLLHGLGFLTQTQRRAVSTFSGGWRVRLNLARALMMPSDLLLLDEPTNHLDMDAVFWLEQWLQKYPGTLLLISHDREFLDNVATHILHLHDGNAKLYVGGYTDFERQRAEQLRQQQIAFEKEQAERVHLQSFIDRFKAKASKAKQAQSRIKRLEKLAGTEAVRMEREFRITFAPPTKQPHSLITLRQVNCGYSVLSPSTPSDPPPVDIHAAAPSQPAVILHRVDFGLEAGDRIGLLGPNGAGKSTLVKTLVSDLAPLTGERIAHPDVRIGYFAQHTVESLHEGQSPIDHFRTLAPQAPIQSIRDFLGKWNFPGDRAFEPVDGFSGGERARLALSLIAWRQPNVLLLDEPTNHLDLEMREALAEALSDFDGAIVMVSHDRHLIGLVCDTFWRVADGVVEPFAGDLDQYAAWLRTRPAARGVRAKTEEVNQPQASLTAKSLASQLPVKKSVNSQKLLVAEKHVSELETLLAELDRKLADP

SEQ ID NO: 9169 - protein, 161 aa, Xylella fastidiosa
TIVDGEPSPQDILRLLGIEPLAAYLVKEIQDVYRLQGVKINDKHIEVITRQMLRKVEIVDQGNSKFLNGEQVERQRVIDENAKLIARNELPAKYNPVLLGITKASLATESFISAASFQETTRVLTEAAVRGTRDNLRGLKENVIVGRLIPAGTGQTYHSQR

SEQ ID NO: 9170 - protein, 448 aa, Xylella fastidiosa
LMSLPAFKAYDIRGRVPDELNEDLARRIGVALAAQLDRAAPVVLGHDVRLTSPSLQEALSAGLRASGREVIDIGLCGTEEVYFQTQYRNAAGGVMVTASHNPMDYNGMKLVREQARPISSDTGLFTIRDAVAADIATITPPTAAEHQYLDKSAYIAHLLSYVDSNALKPLKLVVNAGNGSAGLIVDLLAPHLPFEFVRIFHEPDGHFPNGIPNPLLPENRDATAQAVKHHGADLGIAWDGDFDRCFFFDHTGRFIEGYYLVGLLASVILSKHPGGKIVHDPRLIWNTVEMVEAAGGIPVLSKSGHAFIKEKMRKENAVYGGEMSAHHYFREFSYADSGMIPWLLIAELISRSGRSLADLVESRMQQFPCSGEINFKITDTKTATARIMDHYTAQSPTIDHTDGISADFGDWRFNLRSSNTEPLLRLNVETRNNAALLKQRTDEISALL

SEQ ID NO: 9171 - protein, 339 aa, Xylella fastidiosa
LVTGGAGFIGGNFVLQAISLGHRVINLDALTYAGHLETLAALDGCAEHLFVHGDIGDRALVSRLLDTHRPDAVLNFAAESHVDRSIDAPAAFIQTNVVGTLLLLEAVCGYWKALPEAARAAFRFLHVSTDEVYGSLGETGAFTERTAYAPNSPYSASKAASDHLVRAFHHTYGLPVLTTHCSNNYGPYHFPEKLIPLVITKALAGEPLPVYGDGRHVRDWLFVGDHCTALCAVLAGGRVGETYNIGGQAERENLEVVRMICCLLDERRPRADGQSYQSQIVHVADRPGHDRRYAIDTSKLVSQLGWAPVYRFEQGLALTVDWYLQHQDWVRAVLQGRDR

SEQ ID NO: 9172 - protein, 565 aa, Xylella fastidiosa
NPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVTKFFGRISNALVVGAEIDFYRKLLQRFESEHNVPAIEIAAALARLLQGDSPFLLSVPTRPQRERSELASEHHVKRPSSFKQTERPNNTEHPKRPQRNAPARNVPEFGMESYRIEVGRMHGVKPANIVGAIANEAGLESRYIGRIDIRDDHSVLDLPAEMPHEILQHLKKVWVSGQQLQMR

SEQ ID NO: 9173 - protein, 597 aa, Xylella fastidiosa
MTVIEIKVPDIGDYSKVPVIEVLVTVGDHVVKNQGILTLESDKATLEVPSMNNGIVKELKVNVGDLLSQGDVILLLETEDTTAPPSPSNAATSDTTSPPPPSPQPAASKATAPDQQHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPTLKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGMTETEAKAKSLNIGVAKFPWAASGRAIGIGRTEGFTKLIFDEDTHRIIGGAIVGVHAGDLLAEIGLAIEMGTEAEDISHTIHAHPTLSESIAMSAEVYDGTITDLYLPKK

SEQ ID NO: 9174 - protein, 374 aa, Xylella fastidiosa
TSAVRAGIDSDTAHGAVTPPIVLSSNFSFERFGHKRKYDYTRSANPTRDLLGEALAELEGGAGGVVTATGIAAITLVLHALLRPGDRLVVPHDAYGGSWRLFNALAQKGHFELITVDLTDARSLVEALALPPKLVLIETPSNPLLRITDLGAVIEAAHRVGALTVVDNTFMSPVLQRPLEFGADLVLHSTTKYINGHSDVVGGVVVARDVAHYQQLVWWANALGLTGSPFDAFLTLRGVRTLDARLRVHQENAQMIAALLEGHGVVKHVHYPGLASHPGHVLAGRQQKGFGAMLSFELQGGEEAVRAFVSGLRYFTLAESLGGVESLIAHPASMTHAAMTPEARAKAGISDGLLRLSVGIEASEDLIVDLVAGL

SEQ ID NO: 9175 - protein, 209 aa, Xylella fastidiosa
MTSQRVRDRLVERLRECGIQDERVLSTIRIVPRHLFIDEALALRAYEDTALPIGHGQTISQPWVVARMTEAVMQVVPKKILEIGTGSGYQSAILASLGLEVYTIERIGKLLRQARKRFRQLGIKIRSKHDDGSTGWTEHAPYNAILVTAAAPTLIDTLIEQLAIGGRLVAPVGTASEQALVQLTRTIDGSITHEILEPVTFVSLLPGML

SEQ ID NO: 9176 - protein, 559 aa, Xylella fastidiosa
LIPAPVQIQRGHGQIHIGPHTLISIPPNDTDAQHSATYLATLLQHTRNLTLHIHTETTPKPDSIRLQRDPQSPVTQTEGYTLQALPNQGMHITARDGAGLFYGAITAWQLLTADSNQGPTEIPTVTIHDWPRFKWRGQLLDVARHFHDVDTVKHVIDAMAQHKLNVLHLHLTDDQGWRIEIKRYPKLTAIGAERIPPGAGRHGTPERYGGFYTQDQIRELVAYATERQITILPEIDMPGHAQAAVAAYPDIIGVTRTTPPVSIDWGINPYLFDTSTPSLDFIRNVLDEVLTLFPSQYIHIGGDEAVKDQWEASHTIRAQMRKLGVKDTHAMQGWFNTQLSQYLTTHDRRLIGWDEIIQSGLPDNAAVMSWRGVEGAITAAQQGHDVVLAPAGWMYLDNLQTERNDEPNGRLATLPLSRVYALDPVPKELTPDQAIHILGLQSALWSEYIPSRWHIDHALFPRLAAVAEVAWSPMTARNWDNFLKRLPPQLHRYRTLHIDYSDGAFAPDIMLQHRSAYVLAGAPPHITLSNQTNTGQIHYTTNGNEPTLHSPRYTAPFPI

SEQ ID NO: 9177 - protein, 315 aa, Xylella fastidiosa
TNILTYAGINLPGPEFSPSNKPGVLYKDYLYPSASDYAYVAKKGMNIVRLPVLWERVQPTLNDALDATQLNLILNAVEQAKAQKLHIILDIHNYAKYNDELIGSDNVPISAFADLWKRLSLQFANDKAVIFGLMNEPHEITSTTWAKAAQASINAIRSTGARNLVLVPGTAYSGAHSWLSSYYGIPNGEALLNINDPAKHMAFEVHQYLNENSTGTTGECISTTIGAEKLEAFTNWLRTYHKTGFLGEFATGNNDTCNQALEGMLSYIEENADVWLGLTWWGSNPWFSPDYPFNLHPNSDGNDKPQMSILESHTR

SEQ ID NO: 9178 - protein, 359 aa, Xylella fastidiosa
SDKPLTNLNFSSFDLHPALLTGLTRAAFTLCTPIQALTLPVALAGRDIAGQAQTGTGKTLAFLVVVVNRLLSSPGLVNRNPEDPRALILAPTRELAIQIYNDAVKFGGNLGLRFALIYGGVDYDKQREMLRKGADVVIATPGRLIDYLKQHEVVSLRVCEICVLDEADRMFDLGFIKDIRFILRRLPERCSRQTLLFSATLSHRVLELAYEYMNEPEKLVAETESVTTTRVRQRIYFPAEEEKIPLLLGLLSRSEGMRTMVFVNTKVFVEGVARALDEAGYRVGVLSGDVPQRKRETLLNRFQKGQLEILVATDVAARGLHIDGVNYVYNYDLPFDAEDYVHRIGRTARLGADGDAISF

SEQ ID NO: 9179 - protein, 216 aa, Xylella fastidiosa
SWKAHVGNWLLRPEMRDLSSFLRARKVAGVSVYPPGSQIFAAFEATPFQRVKAVILGQDPYHGQGQAHGLCFSVRPGMPLPPSLLNIYKELEEDLGLSAPDHGCLLPWAKRGVLLLNAVLTVEDGRAGAHQGKGWEGFTDHVVDTLNREREGLVFMLWGSYAQAKGKVIDTRRHLVLKAPHPSPLSAHRGFLGCRHFSLCNQYLSQHGLGMVDWSL

SEQ ID NO: 9180 - protein, 424 aa, Xylella fastidiosa
SRSHALFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCEMVRMVNSGTEATLSAIRLARSATGRNYIVKFEGCYHGHGDSFLVKGGSGMLTLGIPSSPGVPTELSKLTITLTYNDFDAATALFEEMGHHIATVIVEPVIGNANCIPPRPGYLQHLRTLCTQYGVLLIFDEVMTGFRVALGGAQALYGVTPDLTTFGKIIGGGMPVGAYGGRRDLMQHIAPTGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTI

SEQ ID NO: 9181 - protein, 330 aa, Xylella fastidiosa
AYPHYRPRRMRRHPFIRRLIREYTLTVDDLIWPVFVHGLPGRTPIASMPGVERLSMDALLHEAEHALTLGIPLISLFPVIDPALKSFDAAEAWNPDGLVQHAVRALKTRFPEIGVMTDVALDPYTTHGQDGIINSQGYVLNDITVEALVKQSLSHAQAGADIISPSDMMDGRIGAIRKALDTHPNFVDTSIMAYSAKYASAFYNPFRDAVGSAANLGKADKKTYQMDPANSDEALREIALDIEEGADMVIVKPGLLCLDVVRRVKETFRMPTYAYQVSGEYAMIKAAVSNGWLEERSGVLETLIAFKRAGADGILTYFAPQVASWLREGK

SEQ ID NO: 9182 - protein, 191 aa, Xylella fastidiosa
MKLTVPTWLTLLRIVMIPVLIVVFYLPYQWSNIVATGVFAIAAITDWLDGWIARRYAQHSLLGAFLDPVADKLMVAIALFLIVQGHPTPSMAFWAAVIVSREIAVSALREWMAEIGHRAKVRVAVLGKVKTTAQMIAVLCLLYSVTPEKKAIHQIWFGHLIFQVGYWTLLISALLTLWSGFQYLHAAWPSL

SEQ ID NO: 9183 - protein, 426 aa, Xylella fastidiosa
MTLWVLGLNHQTAPMELRERASFVGDALPHALDSLRNLPNVNEAALLSTCNRTELYAETTNAQMLLNWLEQHRPGLQNHLYQYRDAAAVRHLFRVATGLDSMVLGESQILGQVKDSWSMARTHGTLGNTLDRLFQHSFSVAKHARTNTRIGTNPVSIASTAVRLAQDAFSPLNESTVLLIGTGETIQLAAKHLSEGRVQRLLIANRTHAKAQMLASQHGGYALPLTELNLHLAEADIIFSATAAPTPIVTQSNVESALHIRKRKPMLLFDLAIPRDIETEVGTLTDAYLYTIDDLERAVEENRHSRREAAETAEAIIELQVKRYMDTLQAHAHQAPLRRLRTFGTTTRDELLTRARRQLANGRPAEEVLEQLAHGLTNRLLHPPTAALREAALANNTELVHAAEQLFPEKPGLPPPHPSDNDCENR

SEQ ID NO: 9184 - protein, 270 aa, Xylella fastidiosa
WPAPAKLNLFLQITGRRVDGYHELQTVFRLLDWGDTIHLRVREDGQIHRIGESVTGVVEADDLVVRAAYLLKHATNVYLGADIFVEKRIPVGGGFGGGSSDAATVLLVLNALWHTRLDVAVLAALGLRLGADVPVFVHGCNAWAEGVGECLTPMILPGAAYLLLDPGVCVPTRELFLDPDLTRDASPATIGDFIAGAAFGNAFEPVLRRRESAVAGALDVLSEVGFARVTGSGSGCFVEFSTRDEAECALERLPYGLCAWVADGASRSPL

SEQ ID NO: 9185 - protein, 312 aa, Xylella fastidiosa
NLMVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISAIGADRVLTIDLHADQIQGFFDVPVDNVYASPLLLADIWRAYGTDNIIVVSPDVGGVVRARAMAKRLGDTDLAIIDKRRPRANVATVMNIIGEVNGKTCVLVDDLVDTAGTLCAAAVALKQNGATKVVAYITHPVLSGPAVDNINNSELDELVVTDTIPLSDAARECRKIRQLSVAELLAETIRRIAFGESVSSLY

SEQ ID NO: 9186 - protein, 468 aa, Xylella fastidiosa
IIVGSGLAGLIAALTISPEPSVLVTRSALGAETSSAWAQGGMSVSLSPDDNPSLHLADTLAAGDGLCDAVAAESIILEALDAFHVLQHFGIHFDQDSNGHLALGLEAAHSRRRIVHVGGDRSGTAFVQALTACVLNDPSITVLEGLEARHILIADNVVCGLLLANPTSEIVLPSSRILLATGGIGGLYDATTNPVSNFGQGIAMAARAGAVLADMEFVQFHPTALHCHNRPLALVSEAVRGEGAVLINERGERFMADIPGAELAARNIVAQAISAEITRGGQVFLDARQALGARFSTRFPTITALCHKVGIDPVHMPIPVCPAAHYHMGGIATDRQGRSSIPGLWVAGEAASTGLHGANRLASNSLLEAVVMGTRAARDITSHNTPHPLGTIPITPKKPDTTLIRPIVSQCLGVLRHAADMHRAIAALLPFVEGEEESSDPAIVALLIAIFAHLRTESRGAHARTDFP

SEQ ID NO: 9187 - protein, 259 aa, Xylella fastidiosa
FFNMKMRIASWNVNSLNVRLSQLQQWLVEAAPDVLGLQETKLEDHQFPEAALAALGYVSVYAGQKTYNGVALLARVALEDVQVGIPEFEDVQRRVIAATVDGIRVVNLYVVNGQEVGTDKYAYKLSWLDAVYHWLAEELQRYPRLVVLGDFNIAPDARDVYDPQVWNEDHILTSTTERAALDKLLGLGLHDGFRLHHQDAGIFSWWDYRQASFRRNRGLRIDLTLVSEALRAQAVASGIDRVPRGWERPSDHAPAWIEL

SEQ ID NO: 9188 - protein, 662 aa, Xylella fastidiosa
TRRQLANAIRFLAADAVQAAHSGHPGMPMGMADIAEVLWNDFLRHNPNNPNWFNRDRFILSNGHGSMLQYALLHLSGYDLPLDELKQFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAVGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKAL

SEQ ID NO: 9189 - protein, 370 aa, Xylella fastidiosa
FSKLFLNLIFMLIVPLMFSALVVGVAEMGDISALGRIGWRTLGYTVVLSSVAVLIGLVLVNVLKPGVGVDPQLAQQLLSENAERSRQIVDSTDTQIHGMDMLLSIVPSNVVAAASSNDAILSLMFFTIMFGIGMVLVPQEKVETVKRAIEGVFEVSMVLIGLVIRLAPYAVACFMFNLTSLFGLELLIRLAAYVGVVVLGLSLHMFVTYGLAVWWAGRSPLRFFRETQEATLMAFSTASSNATLPTALRVADDMKLPKKISRFVLTIGATANQNGTALFEGLTVIFLAQFFGVDLSFSQQAMVMAVCILGGIGTAGVPSGSLPVVALICAMVGVDPVGIGLILGVNHFLDMCRTALNVTGDLALTTLVCR

SEQ ID NO: 9190 - protein, 197 aa, Xylella fastidiosa
GRTEPLPLDNRHYVNGHPLCDAFPGLALIQFGLGCFWGAERLFWQLPGVFSTAAGYAGGGVPYPTYREVCSGETGHAEVVLVVYDHTVISFEQLLQTFWESHDPTQGMRQGNDIGTQYRSVIHCTTSEQYAAASASREVYQQQLNTAGYTAITTEILHPAPPFYYAENEHQQYLAKHPNGYCGLGGTGVTCAIRLQV

SEQ ID NO: 9191 - protein, 684 aa, Xylella fastidiosa
VTTSNPLLTASSLPFQAPPFDKIKDSDYLPAFEEGMKQHLGEITKIAENPDAPTFENTIEMLEHSGTTLDRVSRIFFGLVHADTNDTRQKIQEEIAPKLAAHQDEIYLNPKLFTRIKSIYDQRDTLSLDPLQKRLVERDYEGFVHAGAQLPEADKTTLRKINVEESTLSTQFHAKLVAATAASAIVVDEKNKLDGLSEGDIAAAAEAANARKLNDKYVLALQNTTQQPISASLKDRDLRAQVLQASETRAEKGDANDTRQIVQRLTQLRAQKAKLLGFPNYAAYNLADQMAKTPEAALKLLNDTVPAATAKARKEAAEIQKLIDKQRVNTKANHFELVASDWDFYAEQVRKAKYNLDEEQIKPYFELDNVLQNGVFYAANQLYGITFKERKDIPTYHPDMKVYEVFDHDGSSLALFYTDYFKRDSKSGGAWMDVFVEQNAITGTKPVVYNVCNFTKPAPGQPALLSFKDVTTLFHEFGHALHGMFSKVKYPSLAGTSTSRDFVEFPSQFNEHWASDPKVFSHYAKHYQTGESMPQSLVDSIRKAKTFNQGYATTEYLSAALLDLAWHTLPADAPLEDVEKFEADALKKYKVNLKEVPPRYRTSYFDHIWSGGYSASYYAYFWSEVLSDDAFEWFKQHGGLDRKNGDIFRDKILSRGNSIELGDLYRQFRGQNPSVQPLLDNRGL

SEQ ID NO: 9192 - protein, 326 aa, Xylella fastidiosa
KALFRVAVTGAAGQIGYSLLFRIAAGEMFGKDRPVILQMLELPDEKAQAALKGVMMELEDCAFPLLADMVVTDNPDIAFKDADAALLVGARPRGPGMERKDLLMENAKIFTAQGAALNKVARRDVKVLVVGNPANTNAYIAMKSAPDLNPKHFTAMLRLDHNRALSQLSTKLGKPAANIEKLIVWGNHSPTMYPDYRFATADGTPIIEAINDQAWNANSFIPTVSKRGAAIIQARGLSSAASAANAAIEHMRDWLLGSNGKWITMGVPSDGSYGIPEGMIFGFPVTTTNGEYSIVKDLPIDTFSKTYIDKTLAELEEERASIAHLL

SEQ ID NO: 9193 - protein, 179 aa, Xylella fastidiosa
MPEAVIFDMDGLMLDSERVSIECRCRAAFDLEQQIEPDYWLQMVGVSDIACHAQLSARIGAVPATALLARSDALYEAVVTKGVPHRPGIVTLLEWLFARGIPCAVGTSTRRPLALRKLNTAGLLSRFDVVCTASEVAQAKPAPDIYLLAAHTLGIVPGRCLVVEDSPIGVRAALAAGMT

SEQ ID NO: 9194 - protein, 325 aa, Xylella fastidiosa
IINGKTSGILNWNDIPYPSFYRAYKELSTNFWIPDEVDMKIDKRQYGELSAREKNAYDAIIGLLATLDSPQTRFIYNVAEYITDPAAHANAAIIGQQEVIHNESYSYVLASITDLANQNRVFEIARTHPTILKRNAPIMQAYDDFMREKTAETLLYSLIQSSILEGINFYSGFAYFYNLVRQNRMTGTGKIISFINRDELAHTKFISEVIRAIVGENPELQTDALTDYVHQAFAHAIELETQWTGEVLDGIDGIDVEEMIRYVKYRANKMAGMLGIQTLYTETTDNVMPWIRAYADNFTETKTDFFEMRNASYKKTNVDNCFDDL

SEQ ID NO: 9195 - protein, 743 aa, Xylella fastidiosa
IHQEFPQLDVAEYKRAVFGFVERKDSVNADDLVDLLIREAESRVDLTAPEWEYFAARLYLRRLYKRASRNRFYDASQKYGSFVGLQESLADRNIYSNDILRSYSKEELIEAGQMIDPERDKLFTYNGLYLLATRYLATDASCGVFELPQERWLTIALYLMQDEYGPGKGGRERRMQLVGEAYWALSNLYMTVATPTLGNAGKINGQLSSCFIDTVDDSLQGIYDSNTDIARVSKHGGGVGAYLGYVRSSGSMIRGVANSSGGVVPWIKQLNNTAVSVDQLGQRKGAIAVYLDIWHRDIEAFLDLRLNNGDQRLRAHDVFTSVCIPDLFMEAVERRGDWYLFDPYEVKRVKGWYLQDFYDEKRGDPNGSFRRKYEDVVADERISRKTVKAIDIFKRIMVSQLETGNPFMFYRDEVNRKNPNKHVGMVYSSNLCTEILQNMTPTRLIQEMISGNQIVTTKHAGDFVVCNLSSINLGRAITVQADLLGADVLERLIPIQVRMLDNVIDLNLLPVPQATITNQKYRAIGLGTFGWHHLLAQKAIHWNSQEAEQYSDALYERINYLTIRASMELAKEKGTYAVFPGSDWQTGEYFRARDYNSPQWLELAAQVAVNGVRNAYMVAVAPNMSTAQIAGSTASIDPIYSAFYYEEKKDYRRPVVAPGLSLDTWPYYEKGAYKLDQFASIRQNARRQRHVDQSLSFNFYVPSTIRASTLLDLHMTAWREGLKTTYYVRSNDIDISECEWCSS

SEQ ID NO: 9196 - protein, 784 aa, Xylella fastidiosa
MTQSSQKALDLQVLPLRDVVVFPYMVIPLFVGREKSMRALEKAMDADKRILLVAQKTADIDDPGAVDLHAIGTYAQVLQLLKLPDGTIKVLVEGLTRVSVDQVVEHDGALRGCGIEIASTQEREEREIEAIVRSLLSLFEQYVKTNRKLPPELLQTLSGIDDPGRLADTIAAHLSVRLAHKQRLLETIEIGDRLEILIGLVDGEIDVQQMEKRIRGRVKSQMEKSQREYYLNEQMKAIQKELGDFDDLPSELEELARKIAEIGMPKSVQSKAKSELNKLKQMSPMSAEAAVVRNYLDWLLGVPWRKCTKVRKDLKVAQSTLDDDHYGLDKVKERILEYLAVQSRVKQMRGPILCLVGPPGVGKTSLAQSIAKATNRKFVRMSLGGVRDEAEVRGHRRTYVGSMPGRVVQNLNKVGSKNPLFVLDEIDKMAMDFRGDPSAALLEVLDPEQNNAFNDHYLDVDLDLSEVMFVATSNSLNIPGPLLDRMEVIRIPGYTEDEKLNIATRYLVPKQIRANGLAVEELAIGEDAIRDIVRYYTRESGVRNLEREISKICRKIVKEIALVGVKPFAKKSTKSKVLFAVTSKNLEKYLGVRCFDFGRAEEANEIGLVTGLAWTEVGGDLLQIESTLVPGKGNLILTGQLGSVMKESASAALTVVRSRADRFCIDVDFLHNQDVHLHVPDGATPKDGPSAGIAMVTSLVSMLTKVPVRADVAMTGEITLRGRVSVIGGLKEKLLAALRGGIRTVLIPEGNRRDLADIPANVTRALTIVPVKWIDEVLDLALES

SEQ ID NO: 9197 - protein, 339 aa, Xylella fastidiosa
MCNKSVVITGITGQDGAYLAQLLLEMGYVVYGTYRRSSSLNFWRINELGIAQHPNLHLVEYDLTDLSSSVRLLELAAPKEVYNLAAQSFVGVSFDQPLTTTDITGVGAVNLLEAIRIVNPKIRFYQASTSEMFGKVQQTPQIEETPFYPRSPYGIAKLYAHWMTVNYRESYGIFAASGILFNHESPLRARDFVTRKITHAIAMIKLGKLDVLELGNLDAKRDWGFAKEYVEGMWRMLQADEPDTFVLATNRTETVRDFVSLAASAVDIQLEWKGQAERECGVDVASGKTLVTINPKFYRPAEVDLLIGNPAKARTKLGWEPKTTLEELCHMMMEADVRR

SEQ ID NO: 9198 - protein, 643 aa, Xylella fastidiosa
  unsure (1)..(643): unsure at all Xaa locations
LTYRDAGVDIDAGNTLVERIKPLVKRSFRPEVMSGLGGFGALFNLAGKYKEPVLVSGTDGVGTKLKLAQQLNRHNTIGIDLVAMCVNDVLVQGAEPLFFLDYFATGKLDIDTATAVISGIALGCEQSGCALIGGETAEMPDMYPPGEYDLAGFCVAAVEKSQLLDGSQVREDDVLIGIASSGPHSNGYSLIRRIYERAGSPADLDIHGTRLIDTLMAPTALYVKPILKLLHTHSDAIHAMAHITGGGLTENIIRVIPPNLGLRIDANAWTQPPVFQWLQREGALADTEMWRTFNCGIGFVLVATPNQVAPLGQALDNQGLAHWQIGRVVTPVDNERVHIGXSDNNRDIHTTPHXGIPAASASTSSLPHNNTXSCLHXNNPIVTPTVLIHTCLRSPASTQLKLPQAIALLPWXLQQPAKPLLDTHWHTTNHTWLLLPFTLTQEIHCLTSPSSPLRLAILASGRGSNLQAILDAIATDRLHAEVVGVFSDRPDAPALTKVLPTHRWSADPHDSPDRITFDTTLSAAIAAVTPHWVVCAGYMRILSAAFIERFPKRILNIHPSLLPKHRGLHTHARALAAGDTEHGASVHLVIPELDAGTVLAQAVVPILTNDTAETLAKRVLVREHPLLVATLELLANGRLTVDG

SEQ ID NO: 9199 - protein, 153 aa, Xylella fastidiosa
YDIFDSPIGILTIVADTNALCRVMLPSNDHTTQEHECWHYAPSTTLLKQARTQLLDYLHGELHTFSLPLRPQGTPFQCAVWKALAHISFGQTWSYAQLAAHIGRPSASRAVGAANARNPLPIVLPCHRVIGSNGALTGFNGGLHIKRSLLYLE

SEQ ID NO: 9200 - protein, 359 aa, Xylella fastidiosa
  unsure (1)..(359): unsure at all Xaa locations
RKNPSIRTLDSXLALPLFSSGFNSHTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSRARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 9201 - protein, 428 aa, Xylella fastidiosa
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRDNGKYNLVGENKRLTSGQFVDFLDDLVAQYPIISIEDGLAEDDWLGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSL

SEQ ID NO: 9202 - protein, 270 aa, Xylella fastidiosa
VMKLCGFEVGLSQPLFLIAGPCVIESLQLQLDTAGVLKEITSKLGLNFIFKSSFDKANRTSGSSFRGPGLEEGLKVLEAVKTQIGVPVLTDVHEYTPIDEVATVVDVLQTPAFLVRQTDFIRNVCAVGKPVNIKKGQFLSPWDMKPVVEKAKSTGNSQILVCERGASFGYNNLVSDMRSLAVMRETGCPVVFDATHSVQLPGAQGARSGGQREFVPVLARAAVAVGISGLFAETHPDPPNALSDGPNAWPLRTMAMLLETLVELDAVTKK

SEQ ID NO: 9203 - protein, 450 aa, Xylella fastidiosa
TQIQQSIRIGNRTLSYKAIIGALPVQDDKGKTIGEVMFTAYIMKGNNRPVTFALNGGPGASSVYLNMGAIGPKVVHFGTQGTSPSDPAILHDNPGTWLDFTDLVFIDPIGTGFSRARIEGEEAKKQFFNPKADVDYLSRTIYDWLVANGRLLSRKYLVGESYGGFRAPRIAHTLQTQMGIALNGLVLVSPYLNPTLDDNSDVSPLAWIMTLPSIAAAHLERQHQLSEAKMREVIEYTRGDYASTLMKGRSDPAATETMLQQVIHLTGLDPTYVRRAGGRLETQAYLREVFRDTGELGSRYDINVTALDPFPYDSEQRTNDPLLDSIIAPTTTAMVDFVTRTVGWKVHERYQALNYDVNRQWDWNEELRKGSVTQLRQSVAIDPKLRVLIAHGWNDLSCPFMASVLTIDQIPKMGSDPTRIQVREYPGGHMFYNRPDSQSSFRQDVQAMYE

SEQ ID NO: 9204 - protein, 615 aa, Xylella fastidiosa
LTKNVLLWVVVAVVLMVVFQSFSPRIGGVIGNEPITYTQFLNEVDSGRIKSVNYTDESGLTVNAIRFKRTDGSEGLVYGPRDDKLVDVLYSKNIEMTRQKPSTGPGFWSLVLNFLPVILIIGFWVFIMRQMQGGGAKGAMSFGKSRAKLQGDDQIKITFADVAGCDEAKEEVGELVDFLRDPTKFTKLGGKIPRGVLMVGPPGTGKTLLAKAIAGEAKVPFFSISGSDFVEMFVGVGASRVRDMFEQAKKHAPCIIFIDEIDAVGRHRGAGLGGGHDEREQTLNQLLVEMDGFEGGEGVIVIAATNRPDVLDPALLRPGRFDRQVVVALPDVKGREQILGVHMRKLLLANDVEPLVIARGTPGFSGADLANLCNEAALFAARSNEKEVRMNHFDAARDKILMGTERRSMAMSEEEKTLTAYHEAGHAIVGRLVPEHDPVYKVTIIPRGRALGVTMYLPEGDKYSINKVAIQSQLCSLYGGRVAEELIFGEDKVTTGASNDIERVTKMARNMVTKWGLSDELGPVAYGEEEDEVFLGRSVTQHKNVSDETARKIDEVVRSILDKAYARTKRILADNLDKLHAMSQLLLQYETIDAPQIDAIMEGRAPPPPVGWGKP

SEQ ID NO: 9205 - protein, 634 aa, Xylella fastidiosa
  unsure (1)..(634): unsure at all Xaa locations
PCTDLHTYVNGNWLKANPVPSDRTSWGAFQMLDERSNAIQRQLIEHAAADPQSSGIKKILSDLWNTGMDEAKIETQGIDPLKTDLAAIDAITNQDTLVNYLRSTAAKGQGELFTLSAYPDFKDPTRNIAYISQGGLGLPDPEYYTKPANKDKLLAYKAHIAKVLELSGMAAADAAKHADKIIAFETRLAKVSKTTQQIARDVTLHYNPVTPTQANKLTPHWSWTEAFKAQGVPLPDMFSLAIPAFHKEVDRMLADTDVAIWRAYLRFHTVDNASPYLSRPFVDEHFAFWNNTMRGQKEIKPRWERVLDTINEKTGXXXXXXXVKAAFPTESKVKMEALVAQLRTALKARIEKLDWMSPATKSKALAKWESFTAKIGYPDQWRSWDNLHTSRDSYLGNVLTAKQFNYTWNLSKIGKPVDKTEWGMPPQMVNAYYDPQKNEIVFPAAILQPPFFDPDAPLESNYGGIVAIIGHEMTHGYDDQGSRFGPTGKFEQWWTKADAKAFSARTTKLVTQFNSYRTEDGKQVNGSLTLGENIADLGGLNTAYDAMKTATAGQTDPKTDGITREQRFFYNWATVWRAQYTPEEQAMLLKTDPHAPPHFRTIGPPSNMPSFAEAFNCKPGDAMVRHNDQQVVIW

SEQ ID NO: 9206 - protein, 300 aa, Xylella fastidiosa
SDTALLIVNLGTPEAPTAAAVRRYLGEFLSDRRVVSIPPLFWKPLLHTVILPIRGPRSARKYAKVWLQEGSPLSVYTRRIAEGLTQHLPDWRVAWAMRYGAPALTKALDALQAQQVRRIVILPLYPQYSTTTTASVQDVVEAWCKRTPQVQVECIQDYAEDPAWVAAVAASIRRHWQAHGRSEKLMFSFHGLPQRVANNGDPYPQRCQVSASLIAAALNLNESEWVLGYQSRFGAERWLQPYAEPTLWALAESGIRRFDLVCPGFSVDCLETLEEVALGFSETLAARGATMRYIPCLNDD

SEQ ID NO: 9207 - protein, 219 aa, Xylella fastidiosa
LRISSFNANGLRSALSKGFFDWFSTQDIDVLCVQETKAQRHQLVGPDFFPVGYHVCFRDATIKKGYSGVAIYSRCEPDELRTTLGWTEFDEEGRYVEARFGNLSVVSFYIPSGSSGEKRQNYKFEVMRWLRPILCEWLLSGRDYVLCGDWNIVRSALDIRNWKSNQKNSGCLPLERDWLNGLCADSLHDVNSAQGRGWVDTYRVLHPQGEDYTWWSNRG

SEQ ID NO: 9208 - protein, 452 aa, Xylella fastidiosa
SLFHEDDIHGVVPGELNAGVAKLIGQAIGSAMQAKGLSDIVIGRDGRVSSSELSAALSDGLRHAGCNVVDIGLVPIPVVYFAACHLGVGSCVAVTGWHHPHDYNGFKIVLGGESLSSEAMSDLYQCITNGRLYASVDSGSLSERDVVDDYIQRIADDVQLNRPLKIVVDPGHGAAEEILSRLFKAIGADLVSLYGDIDGVSLIVHPDSDEPGNLQKLIQRVEQADADLGLAFDGDAASLRVVTREGEVILSDSVLMLFATDVLQRNPGALVVYDAECTRNLSDYVLRNGGSPLMWKTGHSSIKAKMRETGAELAGEMSGYFFFKERWYGFEDALYAAARLLEILAQREDNPSQVFAALPHAYFTAQMEQSVEGDAQACVQSFIEEVQRSVEGGVFDGARLFAFDGLRADFTDGWGLVRVSDTASALVLRFEADTQAGLERIQSAFRTHLQAL

SEQ ID NO: 9209 - protein, 622 aa, Xylella fastidiosa
TWSQDLAHKTYSIRHWADGYFEVNDAGHMVVMPLGGDGVRISLPEVVDAARAAGAKLPLLLRFPDILGHRLGKLQAAFAQAQSEWEYAGGYTAVYPIKVNQHRGVAGVLASHQGDGFGLEAGSKPELMAVLALSRPGGLIVCNGYKDREYIRLALIGRKLGLKTFIVIEKPSELRMVLEEAKTLDVLPGLGVRVRLASLGAGKWQNSGGDKAKFGLSPRQVLDVWKVLRGTEYADCLNVMHFHMGSQISNVRDIAKGMREATRYFVELSRLGAKITHVDVGGGLGIDYEGTRSRSDCSINYGLQAYASHIVQPLASACEDYDLVPPRIVTECGRAMTAHHAVLIANVTEVEAVPEGRVPGVCDDEPAVVRHMREIYGELDARPAIELFYEAQHFHAEGLAAYTLGQIDLVHRARIDDLFYAISHGVRERLSHEEKSHRPVLDELNERLVDKYFVNFSVFESIPDVWAINQIFPIVPIERLNEAPTRRGVVCDLTCDSDGTVKQYVENESLDSALPLHVLRHGEAYRIGFFLVGAYQEILGDIHNLFGDTDAVEVAVDGRGYRIAQQRCGDTTDVMLDYVGYALDEVRRVYAQRIAAAGMSAAESKALSDMLEAGLTGYPYLS

SEQ ID NO: 9210 - protein, 609 aa, Xylella fastidiosa
MCGIVGAIAGRDVVPVLIEGLKRLEYRGYDSSGIAVLESGSIRRVRRTGRVAEMAVAATQEGFTASLGIGHTRWATHGGVTEANAHPHVSHGVVLVHNGIIENYEVQRERLSAFGYVFQSQTDTEVIAHLIHYYMQQGGDLLGALQCAVKALTGIYALAVMSQAEPERFVCARMGCPLLIGIGDGESFVASDISALIQATRQVIFLEDGDTAEIRRDGISIFNAEQCPVERSLHLSNVSLSSLELGEFRHFMQKEIHEQPRVLADTMEAAIDAAGFPPMLFGAQAESVFRGITGIQILACGTSYYAGLTARYWIEAIAGLPCQVEIASEYRYRKAYVNPQHLVVTISQSGETLDTLEALKYAKALGHRHTLSICNAPDSAIPRISELICYTRAGPEIGVASTKAFTTQLVVLFQLAVALGVLRGAVDAEDEAAYLEQLRQLPCSVQQALNLEPQIAGWAECFSSRHHALFLGRGLHYPIALEGALKLKEISYIHAEAYPAGELKHGPLALVDADMPVVVIAPNDSLLEKVKSNMQEVRARGGELFVFADQDSHFSESEGLHVIRTLRHTGVLSPLVHTIPVQLLAYHTALVRGTDVDKPRNLAKSVTVE

SEQ ID NO: 9211 - protein, 381 aa, Xylella fastidiosa
QHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVADTGPGLSEEQCQRLFRRFEQVNGASTVARYGGSGLGLAICRELATVMEGEIHVDSELGKGTCFRVLLPLPWVLAVQPEVAVMDMEPSPCSNPLHLLLIEDDPTVAEVIVELLRVRGHRVTHALHGLEALVEVTLTRFDVCLCDLDLPGLDGAGLIVQLRAQGQSFPIVVVTARTDADAQRQAFHVGCDAFLRKPVTGEMLEQVLTQVLSAP

SEQ ID NO: 9212 - protein, 353 aa, Xylella fastidiosa
LKNDRLLRALRRDTVDRTPIWLMRQAGRYLPEYRAARQHAGSFLKMAKTPELACEITLQPLRRFPLDAAILFSDILMIPDAMGLELHFIEGEGPRLGKPIRDAAAITQLAVPDMETELRYVMDAVRLIRKELDNSVPLIGFSGSPWTLACYMIEGGSSKEYARIKAMAFNAPDLLHQLLNTVTDAVISYLAAQRAAGAQALQVFDTWGGILSPRMYRTFSLPYLTRIARELERGTGTEHTPLVLFGKGNGPYIAELAMSGTEAVGVDWTIELEDAARRSNGQVALQGNLDPATLYGTPNNIAHEVQRTLDSYAAGNGGSREGHVFNLGHGMRPGMNPDHVSALVEAVQRLSRR

SEQ ID NO: 9213 - protein, 347 aa, Xylella fastidiosa
YTITIGPGLLHDPPRLAATIRGRHALILSDSEVAPRYAAQLHETLLRARPDLHLNVFTVPAGETSKSLENFGAAIGQLATLGATRDACLFALGGGVIGDLAGFTAACWMRGIDYVQVPTTLLAMVDSSVGGKTAVDIPQGKNMVGAFHPPRAVIADTNTLATLPLRELRAGLSEVIKYGAIRDPVFFHWLQTTREALLARDPAALAQAIARSCEHKADIVGRDPLEKGERVLLNLGHTFGHAIETTQGYSTPGSNNLNHGEAVAVGMVLAARLSNTLGLAPAEDTETLKNLLDAYGLPTVLPSGLTPEMLLERMRLDKKNIAGRLRLVLWHGIGHAEAVPDVDEAAV

SEQ ID NO: 9214 - protein, 166 aa, Xylella fastidiosa
MNPAPNLVMIGPMGAGKSSIGRRIAKHFNLHFADTDHAIVERAGTSISTIFKYSGEPEFRRLEREVLHDLLNHENRLIATGGGTILDPENRHRMQKRGFVVFLKINVNTQLERLAHDRYRPLLQQIDRKQVLSDLYATRQPLYQKIADMIVTTDHMSPNTATAQLI

SEQ ID NO: 9215 - protein, 573 aa, Xylella fastidiosa
TDAQAQPEKKDFIRQIIREDLAHGTHTHIHTRFPPEPNGYLHIGHAKAICLDFGVAAEFGGHCTLRMDDTNPSKEDPAFAAAIQEDVSWLGFHWNALRHTSDYFEVLYLAAEKLIADGKAYVCDLNSQQVREYRGTLTEAGRPSPWRERSPDENLELFRQMRAGTFPDGTRTLRAKIDMASGNINLRDPALYRIKHVEHQNTGNTWPIYPMYDFAHALSDAIEGITHSLCTLEFEDHRPLYDWCINHVDLPNNSHLLKPLLDKGFPQEPSQPRQIEFSRLNINYTVMSKRKLTALVDEKLVEGWDDPRMYTLQGLRRRGYTPAAMRLFVERIGISKQNSIIDFSVLENCLRENLDTIAPRRMATIAPLKLVLTNLPEDHEEQLIFPNHPKDDTQGTRTVPFSRELWIERDDFSEVPPKGWKRLVPGGEVRLRGAGIVRIDEVVKNAEGHVIALHGWLDPTSRPGMEGAHRKVKGTIHWVSAPHAVAAEIRLYDRLFSIEKPDDNTDGKTYRDFLNPDSKRVVHGYIEPAAAQTAPEHAFQFERLGYFVTDRHDHDATHPVFNRSVTLRDTWQR

SEQ ID NO: 9216 - protein, 320 aa, Xylella fastidiosa
IYARIAGTGGYLPEKVLTNDDLAHIVDTSDEWIRTRTGIRERHIAAEGETTSDLAYEAAIRALEAAEVRSADLDLIVVGTTTPDLIFPSTACLLQARLGAVGCGAFDVNAACSGFIYALSVAEKFVSSGCSKTVLVVGADTLTRIIDWSDRTTCVLFGDGAGAVVLKADEDTGILSTHLHADGSKKELLWDPVGVSVGFGEGKDCGALLMKGNEVFKYAVKALDRVVDETLEANHLDKHELDWLIPHQANLRIIEATARRLDMSMDQVVVTVDRHGNTSTASVPLALDEAIRSGRVQRGQLLLLEAFGGGFTWGSALLRY

SEQ ID NO: 9217 - protein, 338 aa, Xylella fastidiosa
  unsure (1)..(338): unsure at all Xaa locations
GXSSRLYTDNNADIFMKILVTGGSGFLGEALCRGLLKRGYQVVSFQRSHYQALQALGVVQICGDLSDFHAVRHAVRGVDAVFHNAAKVGAWGSYTSYHQINVIGTQHVLDACRAENINKLVYTSTPSVIHRSNYPVEGLDADQVPYSNAVKVPYVATKAMAEQAVLAANSVDLTTVALRPRMIWGPGDPHLMPRLVARARAGRLRLIGDGRNLVDSTYIDNAAQAHFDAFEHLMPGAACAGKAYFISNGEPLQMRELINKLLATTNAPPVTQSLSFKTGYCIGAFCEMLWSLLPLPGEPLLTRFLVEQMSTPHWYSIEPAKRDFGYVPRVSIEEGLVR

SEQ ID NO: 9218 - protein, 469 aa, Xylella fastidiosa
LPSFLKRKSIDLITVHEEGRRLVPTLSWPHLIAFGIGAIVGTGIYTLIGVGAEKAGPAVLLSFVIAGVICACAALAYAEMATMMPVAGSTYTYSYVALGEGIAWIVGWSLILEYSLVVSTVAVGWSGYMTGFLKSVGVDMPLALTAGPYAGGIINLPAAVITCVVAGLLIVGTKESTTVNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRVLSTVNERTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSK

SEQ ID NO: 9219 - protein, 728 aa, Xylella fastidiosa
VNVSHVLDHLNQNQREAVAAAPGHYLILAGAGSGKTRVLTHRIVWLNEVNGVPTHSMMAVTFTNKAAGEIQQRIDLQLRHGKRGMWIGTFHSLAHRLLRLHWNDATLPENFQVIDSDDQLRLVKRVIQSLGLNDTLFPPKQAMWWINTQKDEGRRPEHIQPESHDDWIETQRRIYTEYQERCNRAGLVDFSELLLRAHELLRDTPALLTHYRSRFREILIDEFQDTNAIQYAFVRVLANDTGHIFAVGDDDQAIYGWRGAKVEHVQHFLKDFPNVQTIRLEQNYRSSANILDAANAIIAHNPDRIGKRLWTESGVGESIDLYAAYNEIDEARYIVERARQWVRDGGSYGEIAVLYRSNAQSRAFEEVLQSEHMPYRVYGGMRFFERAEIKDALAYLRLLANRSDDAAFERVVNTPVRGIGERTLDEVRHLARTQGLALWDAAMACTQSTTLTARARNALASFLNLLQQLALETNQMDLAERIDHMLQRSELRQHWKKEARGSLDAESRQENLDELVSVASRFVLPQNDEDTPIMTELDAFLSYACLESGDGQVQAGEEGVQLMTLHSAKGLEFPLVFLVGLENGLFPSARCLDEHGRLEEERRLAYVGITRARHKLILSYAQARRIHGKDNYNVPSRFLREIPQDLLHEVRPTIQVSHQPPLGAAQRPAHDERDAAPIKLGVNVIHPTFGCGVVVDYEGSGAHTRVQIKFDDAGTKWLVMAYAKLSVV

SEQ ID NO: 9220 - protein, 444 aa, Xylella fastidiosa
MLDKVVIANRGEIALRILRACHTLGIRTVAVHSTVDRNLKHVAMADESVCIGPAPSAESYLNIPALIAAAEVTDAQAIHPGYGFLSENASFAERVEQSGFIFIGPRAETIRLMGDKVQAIHAMKAAGVPCVPGSDGPLGDDIVANVKIAREIGYPVIIKAAGGGGGRGMRVVHTEAGLEAAIETTQCEAKAAFGNGQVYMEKFLENPRHVEIQVLADGQGNAIHLGERDCSMQRRHQKVVEEAPAPGITEALRNEIGQVCVDACIRIGYRGAGTFEFLFENGRFYFIEMNTRIQVEHPVTERITGIDLVCEQLRIAAGQPLSIKQSDVVLRGHAIECRINAEDAETFLPNPGLITAFHPPGGPGVRMDTHIYSGYKVPPNYDSMIGKLIVHGPDRETAIARMHLALSEMVVDGIKTNIPLQQRIMCDKGFQSGGQNIHYLEKCL

SEQ ID NO: 9221 - protein, 144 aa, Xylella fastidiosa
MAHLLLLHGPNLNLLGTREPEIYGRITLPQIDAALAERAATAGHGLSSLQSNAEHVLIERIHATREDGTAFILINPGAFTHTSVALRDALLAVALPFVEIHLSNPHTREPFRHHSYLADKALGVVCGFGVDSYRIALEGVIARL

SEQ ID NO: 9222 - protein, 395 aa, Xylella fastidiosa
LFTDVELVPGDPILSLNDAYNADTRTNKVNLGIGIYCDESGCIPLLRAVQQVEEQLAKHPKPRGYLPIDGLPAYIKATQQLLFGVDSLLLTAGRVATSQTVGGSGALRVAAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPPAHGAYLVASVLNSHELRTLWEQELAQMRERIHGLRAGLVTRLKALGVPEFDFIQRQAGMFSYSGLSKIQVDRLRDEFGIYAVSSGRICLAALSQHKLEYVAQAVVKV

SEQ ID NO: 9223 - protein, 344 aa, Xylella fastidiosa
DDLRIRKIEPLTPPNKLLLQLPCDEQASLTVATSRNALHDILHGHNGRLAVVIGPCSIHDPIAAIDYSQRLRPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGKVPNYDAINVEAASQTLLKSKLPVRLMIDASHANSGKNPNNQPKVIENIVEQLKAGERRIIGVMIESHIVGGRQELVLGNTLTYGQSITDACIDWDTSVAMLEQLAQAVRVRQ

SEQ ID NO: 9224 - protein, 292 aa, Xylella fastidiosa
VRDYLTALQDRICNVVETIDGQSHFHEDHWQRTEGGGGRTRLLRDGAVFEQAGIGFSDVCGTHLPPSASVRRPELAGANWCACGVSLVFHPKNPFVPTTHLNVRYFRAERDGKQVAAWFGGGFDLTPFYPFDEDVVHWHTVARDLCAPFGDERYAAHKRWCDEYFVLRHRNETRGVGGLFFDDLDKDFERDFAYQRAVGDGFLDAYFPIVTRRHDTPYGDRERAFQLYRRGRYVEFNLLFDRGTLFGLQSGGRAESILISLPPLVRWEYGYHPLPGSAEARLADYLLPRDWL

SEQ ID NO: 9225 - protein, 839 aa, Xylella fastidiosa
  unsure (1)..(839): unsure at all Xaa locations
LCPGAYAALPYVARVYAENVLRRAAPDQWPAYLGQLIGRRCDTDIPWFPARIVCHDILGLTALVDLAGLRDAIAAQGGDAFQVNPTVPVQLIVDHSLAVEYGGSDPEAVAKNRAIEARRNADRFHFIEWTRHAFENVTVIPPGYGIMHQINLEALSPVVAVQDGVAFPDTCIGTDSHTPHVNALGVVAIGVGGLEAESVMLGRAVWLRCPESVGVELHGCPRPGITATDIVLALTAFLRQARVVGAYLEFRGEGVAALTVGDRATIANMAPEYGATAALFFIDAQTVEYLRLTGRDKAQVALVDTYAKQAGLWSDTLDGAQYARLLHFDLSSVARTMAGPSSPHHQLPTSALTERGIAGGLAQARAEEAAGHLPDGAVIIAAITSCTNTSNPRNLIAAGLLARNAHARGLRCKPWVKTSLAPGSQAVPLYLEAAGLLSALQQLGFGVVGFACTTCNGMSGALDPLIQHAIMARHVHTVAVLSGNRNFDGRIHPDATQAFLASPPLVIAYAIAGTIRFDIERDVLGHDADGTPVMLKDIWPSDADIDALVRRSVHPEXFRHVYMPLLQASRQRRECVPPLYAWHPGSTYIRRPPYWEGVLAGARTLRGLRPLAVLGDNITTDHLSPSNAILPNSAAGEYLARMGVPQEDFNSYATRRGDHLTAQRATFANPMLLNELVRDADGKVRQGSLTRLEPDGTVMRMWEAIEIYMQRSQPLIIIAGADYGQGSSRDWAAKGVRLAGVEAIVAEGFERIHRTNVIGMGVLPLTFHPGTTRITLRIDGTELFDVCGVPSVGAVLILRIQRRDGSVAEVPVTCRLDTAEELSIYAAGGVLQRVAQEML

SEQ ID NO: 9226 - protein, 824 aa, Xylella fastidiosa
LPIDALLPAITTSLSNHPRLILEAPPGAGKTTQVPLALLDTPWLNGRSIILLEPRRVAARNAALFMARQCGEEVGGLVGYHIRFESKVSARTRIHVVTEGILTRIIQDDPLLDGIGALLFDEFHERHLASDLGLALALDVQTQLREDLRIVVMSATLQGQRLAQFLDAPRLTSEGRAYPITITHFPARRDESLETQARRAIQHALDTHQGDVLTFLPGQREIARLQAILEKTLSPELHVMPLHGELPLQEQTRVLEPDQHGRRRIVLATNVAESSITLPGISVVIDSGLAREPAYDPNTGFTRLDVVNITQASADQRAGRAGRLAPGWAYRLWPQSQRLEAQRRPEIIQTELSGLALELTAWGSSTLRFIDPPPSGALSAARELLQRLGAISNTCTLTPLGKRMLALGIHPRLAAMLLAPHDPQEQALACDLAALLDARDPLRGSGDALISRWRALAELRSGCLPHDTKRSTLKAIDATTHQWRRRIRCDATPPDAIEAHTLGNLLTHAFPERIAARHSSDPLYYVLANGRRMRLLDNSALHGEPWIIASELHHGIKDIQLLCGAPLDERKLHADFPERFIQHDVIRWETDKRALVAQRESCFDRIVLDVRPAGRIDPVQAANVLTGAVRTLGLDTLSWTEHLRQWQARAVALRHWMPELELPDLSNTTLLATLDTWLRPAFAGKTRLDALDEAAFEQAVKSLLSWTQHALIDRHVPAHIIVPSGMGRHIDYGLADDGTPQPPVLSVKLQELFGLPDTPRIAKNRIPLTLHLLSPGGRPLQVTQDLKSFWTNTYPEVKKEMKGRYPKHPWPDDPWTATATHHTK

SEQ ID NO: 9227 - protein, 483 aa, Xylella fastidiosa
LRILAEALTYDDVSLVPSHSTVLPKDVKLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFERELDDPVRHIMTKKEALVTVKEGADSQEVLQLLHKHRIEKILVVNDAFELRGLITVKDIQKKSDYPNAAKDAVTRLLVGAAVGVGGETEKRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEQMRTKPQFVKITGAGQVESHVHDVQITKEPPNYRM

SEQ ID NO: 9228 - protein, 280 aa, Xylella fastidiosa
ARILDGRRIADDLLDALKTRVDARVSAGKLPPTLAVVLVGSDPASVVYVRNKRRAAEKVGIKAYDFDLPEATTEAELAALIDRLNADPKIHGILIQLPLPGIPDAHRLIQRIDPRKDVDGFHPQNVGHLALREFGLRPCTPRGIVTLLGHTDRPLRGRNATIVGVSNHVGRPMGLELLMAGCTVTSCHKFTPPQMLETAVRQADILIVAVGRPGVIPGEWVKPGAVVIDVGINRLDDGQLVGDVGFESAVKRASWITPVPGGVGPMTVATLMQNTLEAAE

SEQ ID NO: 9229 - protein, 314 aa, Xylella fastidiosa
  unsure (1)..(314): unsure at all Xaa locations
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGCKGRITQIVEKPKPDDAPSNLAVVGRYVLSGKIFEMLENTSIGTGGEIQLTDAIAELLKYERVDAYRFQGRRFDCGAHIGLIEATLHLALEHKKHGQAVREILRDTLLTVDKRXLSVFAXVCVKMLIVRRS

SEQ ID NO: 9230 - protein, 222 aa, Xylella fastidiosa
LEMLNVHLETLSAENRVRWALEHGPDHPALSSSFGAQSAVMLHLLTRFAPDIPVILVDTGYLFPETYRFADTLTERLKLNLKVYQPLRSGAWTEARHGRLWEQGIDGINQYNTLHKVEPMRRALEELQVGTWFTGLRRGQSSTRTQTSIVQRRDERYKISPIVDWTDRDIWEYMKHHDLPYHPLWEQGYVSIGDIHTTRPLEPDMREEDTRFFGFKRECGIH

SEQ ID NO: 9231 - protein, 559 aa, Xylella fastidiosa
SSSSIEDIKGQSHRLRGSLLESLANPTTGALGESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLISRAHADLYTDAAHLSEHLLPNTRAYYEIWLDEKKVAGAGEEEEPIYGPHYLPRKFKIGFAAPPINDVDVFANDLGFIAVIVDNTLLGYNVTIGGGMGTTHGDPDTWPRIGNIIGFITRADLIIISTAIVTTQRDFGNRTLRKRARFKYTIDDRGLDCIVGEIQQRAGIILQPARPFVFEHNGDRYGWIEGEDGHWHLTLSLPAGRIADTESSPLLSGFRAIAQLGIGQFRMTPNQNVVIAGISPGQRAAIDALVTQYGLDTGNRAPTALARHAMACVALPTCGLAMAEAERYLPDFNAKLQPILEKYGLAETPILLRISGCPNGCSRPYLAEIALVGKAPGRYNLMLGGDQRGQRLNTLYRENITETEILTALEPLLGRYQQERIPSEGFGDFLHRTGIIALPPYPTHRH

SEQ ID NO: 9232 - protein, 604 aa, Xylella fastidiosa
YLKQQEIKPLLRFITCGSVDDGKSTLIGHLLYGSQCLAEDQLADLTVDSQRYGTQGEHIDYALLLDGLAAEREQGITIDVAYRYFDTEKRKFIVADCPGHAQYTRNMATGASTADAAVVLVDARKGLLTQTRRHSYIVALLGIRHVVLAVNKMDLVGYDQQIFEAIASDYLALAAKLGINQVQCIPLSALEGDNLSKRSARMLWYVGPSLLEYLEALEPADVDLAAAMCLPVQWVNRPDSQFRGFTGTLAAGRVRSGDGVVVLPSGCVSRVVRVFNGDTEVHEAVAGQAVTLTLADEIDISRGDVIAALDDPPEVADQVTAYVLWMDDTALLPGRRYWLKLGARMVAASVSDIKHRVDVNTQEQRIAQRLQLNELGYCQLSLDAPVAFVPYARNRVLGSFILIDRQSNATVGAGTLDSGVHRASNVHWQPLDIDHVARARIKGQTPKVLWFTGLSGAGKSAIANIVDKRLHALGYHTFILDGDNVRHGLNRDLSFTAEDRVENIRRVAEVARLMVDAGLVVLVSFISPFRDERQLARERFAADEFVEVFVDVPLAVAEARDVKGLYAKARAGLITDFTGIDSPYEPPQHPELHLRADQGTPEQL

SEQ ID NO: 9233 - protein, 454 aa, Xylella fastidiosa
RIEHDSMGDLRVPIDALWGAQTQRAIENFPISGRSMPQGFIHALGFIKAAAAKVNAELGLLPKSMAKEIEAAALDVAAGRYDAEFPVDIYQTGSGTSSNMNANEVIATLAMRATKGPIHPNDHVNLGQSSNDVVPTAIRISATLAVQGRLLPALKHLRKMINKRARGLGSVVKTGRTHLMDAMPLTFAQEFGAWSAQIVSAEARLNDTLKRLHRLPLGGTAIGTGINTDPHFGRNTVKVLSALTGIHFESANNKFEGLAAQDDLVELSGQFNALAVALMKIANDLRWMNAGPLAGLGEIELPALQPGSSIMPGKVNPVIPEAVVMVASQVIGHHTAVTVAGQSGNFQLNVTLPLIAYNLLESATLLGNVVMLLADKVIVGLKVRQDRVQEVLERNPILVTALNPIIGYEKAAVIAKRAYKEHRPVLEVACEESNLNPVELARLLDPAALTEGGI

SEQ ID NO: 9234 - protein, 925 aa, Xylella fastidiosa
LIKQFTQSSPLAGGNAAYIEDLYEQYLVLPNSVDPKWKAYFDGFKGRDAGDIPHSAVIAHITDTAKQSIKQGASDERERNIGRLITAYRSRGHLGARIDPLALTPPSNPPDLDLPFHNLSQADLDNEFSTGGIGGQPRMKLRNLLAHLKATYTDTIGTEFMHISEFEQRQWIYRRLENVGGKIASNATNRKRILERLTAAEGLERYLHTKYVGQKRFSLEGGDALIPLMDTLVRQAGSNDVKDIVVGMAHRGRLNVLVNTLGKNPRKLFDEFEGKFEHAHHDRAHTGDVKYHMGFSADIAVGDGKQVHLALAFNPSHLEIVDPVVAGSVRSRQERFGDIERKTVLPILIHGDAAFAGQGVVMELLQMSQARGFAVGGTLHVIINNQIGFTTSARDDARSTPYCTDVAKMIGAPVFHVNGDDPDAVVFVAQLAYEFRQQFKKDVVIDLVCYRRWGHNEADEPAATQPVMYQTIRKHKTTRELYATKLEGEGVIAAGEAKAMVDDYRAKLDSGKFTTELASKHTDEFVIDWSKYLSGKLEDTVKTSVKRQTLNKLAALINTIPPTVELHPRVAKIYEDRIKMAAGEQPCDWGFAENLAYATLLAEGHKLRLVGQDAGRGTFFHRHAILHDQKTDSYYLPLRQLVSNPDDATVIDSLLSEEAVMGFEYGYSTTDPNTLCIWEAQFGDFANGAQVVIDQFIAAGEVKWGRISGLSLFLPHGYEGQGPEHSSARLERFLQLCALENMLVCVPTTPAQAFHMIRRQMRMSTRKPLVVMTPKSLLRHKLAVSTLDELANGKFQHIIPDDAADPKHVKRIVMCAGKVYYDIFENQQKRSQNDVAIIRIEQLYPFPRALLASELKRFNKATDVVWCQEEPQNQGAWYQIKHHLQAVLAHAQRLHYAGRSSSPSPAVGHMAEHMAEQESLVADAL

SEQ ID NO: 9235 - protein, 385 aa, Xylella fastidiosa
MSTEVKVPVLPESVSDATIASWHKKAGEIVKRDENIVDLETDKVVLEVPSPVDGVLKEIKFDTGSTVTSNQVLAIIEEGSIVAAPSQVIDQKPVAVSAPAAKSNVDSLPPGARFTATTEGIDPAHIEGSGRRGAVTKEDIINFAKQNGAARSSGTRLEERVPMTRIRQRIAERLMQSKNSTAMLTTFNEINLAKVSNIRKELQEEFQKAHGIKLGFMSFFVKAAANALQRFPLVNASIDGTDIIYHGYSDISIAVSTDKGLVTPVLRNVERMSFADIEHRIADYAKKARDGKLSLEELQGGTFTVTNGGTFGSLLSTPIVNPPQSAILGMHTIKERPIAENGHIVIAPMMYVALSYDHRIIDGKDSVQFLVDIKNQLEAPGRMLF

SEQ ID NO: 9236 - protein, 478 aa, Xylella fastidiosa
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGTNVILASGSDSVELPFATFDGETIVDNIGALDFTKVPKRLAVIGAGVIGLELGSVWKRLGAEVTILEAMPNFLAAVDADVSKTAAKEFKQQGLDIKLNAKVSRTEISSKNNKKEVIVTYTDASGKQTLTVDKLLVAVGRKAATKGLLADGTGVQLNERGQIMVDEHCHTGVDGVWAIGDCVRGPMLAHKGFEEGIAVAELIAGLPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 9237 - protein, 430 aa, Xylella fastidiosa
MGQSVVVLGAQWGDEGKGKIVDLLTEEIGAVVRFQGGHNAGHTLVINGKKTVLHLIPSGILRNGVLCLIGNGVVISPAALRKEIEELEDTGLEIRSRLKISPAAPLIMEYHIALDQAREKAAGGRAIGTTGRGIGPAYEDKVGRRGIRVADLHYPDQLAEKLRAALDYHNFVLTRYFGVDGMDFQRIYDEMLVFAEYVEPMKSDVAGILHDLRKQGKRVLFEGAQGTLLDIDHGTYPYVTSSSTTVGGALSGAGVGVQDIDYVLGIAKAYATRVGGGPFPTELDDKIGQGIRDRGVEYGASTGRPRRCGWMDIVALKRAVAINGITGLCITKLDVLDGMDKLKICIAYEYHDKRSEYAPLDAQGWEECTPVYLEFPGWNESTHGITSWEKLPPAARAYLCALEELAGCPIGIVSTGPDREHTIMLHDPFA

SEQ ID NO: 9238 - protein, 311 aa, Xylella fastidiosa
INGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNE

SEQ ID NO: 9239 - protein, 141 aa, Xylella fastidiosa
MVLERTLSIIKPDAVAKNVIGDIYSRFEKAGLKIVAAKYKQLSRREAEGFYAVHRDRPFFNALVEFMISGPVMIQVLESENAVARHRELLGATNPKDAAPGTIRADFAESIEANAAHGSDSVENAAIEVAYFFAATEIILR

SEQ ID NO: 9240 - protein, 754 aa, Xylella fastidiosa
PEHCVQYNDGRPIIYVLEDYGLCNTLILDKACRKTKLPSPLIPLSGNPLQRKRAYLALSRRSSSNSLIPNQRGGKTHSDSLANLLQAHRIRDTLDVHLVPVSIFIGRTPDRQSGWFAVLFSENWALVGRFRRILAILLNGRNTIVCFAPPISVRQTLNEGLPPERTLRKLQRVLRTHFRRIRETVIGPDLSTRRLLVDNVLATEAVREAIGAQAKRDGTDLSETWRKAQAYAWEIAADYSSPVIRSADFLFSHVWNRIYAGVLVHHVDSFKEISPGHEIVYVPSHRSHMDYLLLSYCLYKCSIGLPHIVAGINLNLPVVGTLLRKCGAFFIRRSIKGNMLYSVVLSEYVAQLVAGGYSLEYFIEGGRSRTGRLLQPKGGMIMMTLQAFLRQPRRPVLFQPIYIGYEKLMEGTSYLDELSGEPKKKESIWRVFWNIPKVLKQKYGQVVVNFGEPIALNDVLAELAPEWEGQALNENEKPAWLSSTVNHLARQIQTRINSAADVNPINLLALALLSTPKHAMGEADLIAQITLCKKILLELPYSNRVTITPHPPERIIAHAEQINILTRVHHPLGDVLRVDGDNAVLLSYFRNNVLHLFTASAWVACCFKNNRRMSRIALIRLGVGMYPFLQAELFLPWTEDQFAQHIQQVIELFVREGLLLSAGNEEEDPLTRNTSQTDEVFRLRAISHSLQQAFERYYITISILVKNGPGTLSASELESLCQLAAQRLSLLYASTAPEFFDKGLFRGFIQKLRE

SEQ ID NO: 9241 - protein, 468 aa, Xylella fastidiosa
YKIADISLADWGRKEIDIAEHEMPGLMSIRRKYASKQPLKGVRVTGSLHMTIQTAVLIETLKDIGADVRWASCNIFSTQDHAAAAIATSGTPVFAWKGETLEEYWDCTLQALTFTLADGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVTTVEDTLGQADIYVTTTGNKDVIRIEHMTAMKDQVIVCNIGHFDNEIQVDALNTLTGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 9242 - protein, 145 aa, Xylella fastidiosa
LELPIDIIKIQALLPHRYPFLLVDRILELDQKQKRIVAQKNVSINESFFQGHFPEHPVMPGVLIIEALAQAGGVMTQLNLSHNGHSSLLFYMVRVDNARFNKQVVPGDILILDMTMKRRIRNMGCYYGEARVNGEVVACADIMCA

SEQ ID NO: 9243 - protein, 459 aa, Xylella fastidiosa
NTLLLFGATGDLAQRYLFPSLLQLFTDGLLPQDFRIRALALSPHNTTQFRDILRPRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPASLEADRIRDEKVKVLRALRPLNAQNAAMHSVRGRYSAGTINSQPVPAYQPPEGSNVETFVGVTAYIDNWRWAGVPFHLCTGKRLAERSTQIVVTLKPVTHWLFERPNRNNAAPNRLCFKLQPQENIELNLMSSLAGPEWGTLELQPLELELSVPTGKHRHIAYERLFLDAFNGNPALFVRHDEVTAAWAWIDSISNAWELSDLPLQPYPAGGWGPPQA

SEQ ID NO: 9244 - protein, 596 aa, Xylella fastidiosa
MSAYTITEHKYDMVVVGAGGAGLRATFGLAQKGLQTVCLTKVFPTRSHTVAAQGGISAALGNMGEDDWRYHFYDTIKGSDWLGDQDAIEYMCREAIPAVIELEHYGVPFSRTAQGKIYQRPFGGMTTRYGEGPRAERTCAAADRTGHAMLHTLYQQALAHDARFMIEYFALDLIFDNEGLCRGVLALDMAEGSLHLFRAHGVVLATGGYGRTYFSATSAHTCTGDGGGLVMRAGLPMQDMEFVQFHPTGIYGAGCLITEGVRGEGGILRNSNGERFMERYAPHYKDLASRDVVSRSMIIEIREGRGVGEHKDHILLDLTHLGPSMIQEKLPGIAESARIFAGVDVTKQPIPVLPTVHYNMGGIPTNYHGEVVRKVGNDPDAVVPGLYAVGEAACVSVHGANRLGSNSLLDLVVFGRAVANRCAETIKPNQPHKVLPSDSCDKALGLLDKLRHADGSTPTAVIRDRMQRTMQSDASVFRTSKTLQEGCEKMNEIFALFDDVKVSDRSLVWNSDLIETYELHNLLLNALATINSAEQRKESRGAHAHEDYPDRDDENWLKHTLVSVDEKGTCSFDYRPVHMYTLSKDVDVIPPKPRVY

SEQ ID NO: 9245 - protein, 229 aa, Xylella fastidiosa
FKVYRWNPDDDANPRTDTYEIDLDTCGPMVLDALIKIKNEIDPTLTFRRSCREGICGSCAMNIDGTNTLACTKAISACTISEIPIYPLPHMNVIKDLIPDLTHFYAQYASIKPWIRTQTPPPPDRERLQSPVDRKKLDGLYECILCACCSTSCPSYWWNGDRYLGPAILLQAYRWIIDSRDEDTGARLDDLEDPFKLYRCHTIMNCTRTCPKGLNPAQAIAEIKKLMML

SEQ ID NO: 9246 - protein, 540 aa, Xylella fastidiosa
STFLALMKPITNETFIERNREVALWLPLGIVGLFLLRGIAGYITDMAMGRAARSIARDFRVCVLTKYFRLPGSRFDGEPVASMLVRLGSDSEQVAHAVIDAMKVMVQQTLQVIGALVVMLWYSWTVTLAILLVAPLLAWVMQRVAKRYRRISHHIQESNAQLMQAADQALSNYQDVKVYAAQESELERYARLANINLGLAVKVESTRSISSAAVQLLGAVGLAMLLLIAGHEALAGRLSPGDFVSLMTSMIAVIPALKQLTNVQNMLQSGIASAQRLFSVLDSPDELDTGRRPLGRARGLIEFRGITARYPGRSAPVLDSVSFVAAPGTVTAIVGRSGSGKSSLIKLIPRFYEPESGQILLDGHPLQDYLLADLRRQIALVGQQIMLFDGSIAENIAYGEMRQVVSEEIERVVVDANAQDFVNQLPEGLQFQVGVKGGRLSGGQRQRLAIARAMLKDAPILILDEATAALDNESERLVQDALQRLMPERTTLVIAHRLSTIKHADQVLVMDQGRIIESGTHVDLLARDGLYAYLYSMQFR

SEQ ID NO: 9247 - protein, 617 aa, Xylella fastidiosa
MPIRQLPEILINQIAAGEVVERPASVVKELVENAIDAGATRVDIELEAAGVRLIRIRDNGHGMAAQELPLAVLRHATSKIASLDDLEAVATLGFRGEALPSIASVSRFTLMSRRATDEHGAVLQIEGGTLGEVIPHAHAPGTTVEVRELFYNVPARRKFLRAERTELGHIEEWARSLALAHPDLELRLSHNGKLSRRYKPGDWYSDARLIEILGEDFAHQALPVDHSGAGLRLHGCIVQPHYSRLNADQQYLYVNGRPVRDRSVAHAVKQAYSDVLYQGRHPAYVLFLELDPARVDVNVHPAKHEVRFRDARLIHDFVYRTVQGTLAQTRAGTPPLAVGVGDVEGEGEGARPPGRHAVSFSGRRGGASHVLGSYSASTAPLMQGVPSVSVADAPAAYAALYAAPPTQVMDAVPQMQTGLPLAAGAGDVPPLGYAIAQLHGIYILAECADGLIVVDMHAAHERIGYERLKRAHDGIGLRTQPLLVPMTLMVAEREADVAECEAETLANLGFEVTRSGPGSLQVRSIPALLSQAEPEMLLRDVLSDLSEHGHTRRVAEARDTLLATMACHGAVRAHRRLSISEMNALLRDMEATERSGQCNHGRPTWARFSLAEIDRWF

SEQ ID NO: 9248 - protein, 272 aa, Xylella fastidiosa
LSGIITALVTPFDRDGAFDRDAWIRLLDMQLAGGVQGVVIAGSTGEAATLTDAEYDEMLCSAVVRVGGRVPVLAGTGLSGTAKTISQTKRAADNGAGYALVVTPPYIRPNQGGLKAHYLAVAEQGGLPVVLYNVPSRTGCDLLPETVADLAGHPSIVGIKEACASRERVQALLALRRPGFAVFSGDDSSAARSMLDGADGLVSVASNVLPSAYRHLCDLARAGERGAIDLWNARLSDFHAFCGLDSNPIPIKALLQRIGIGYGLRLPLLPLS

SEQ ID NO: 9249 - protein, 257 aa, Xylella fastidiosa
TQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 9250 - protein, 837 aa, Xylella fastidiosa
AARTGRVDRALQLLETGADPHALPFENARDQRSLMVLAAILPDLRLLRELIVRRVDVNQRHRGMTALLAATRDSWHGRSEAVQTLLANGADPRVVDADRNTPLHHAARSSDPGVAALLRDAAAELDALNCDGLSPLAAACQVGNWRLAKFLLERGAQTEPIGGTPVLLAAAGTDEDDPTGVLLLLKHKARVDARDRLRRTALHEAAEAGHSEIVKALLEAAANLEVRDMAGRTPLLEAARQARIVVLECLLSHKADRLAVDSEGRNAVFLACLSERVTLPLIRRLLEIGVPVVADKHGHRPVDIAAKVGCWSIVSLLDPDYPLPVVVSEPVSVGGVLDLPPLTLLRDGLQLGSFGSLSELIELCSAEELGTLLHDPHFALNPDVVDWLLIHGASPTVPNSSGNVPMFSLLARGIEAVPVLKVFLRHGVSPAGVGGLGLWLAACMQCDAASRSLEQFACELLEHGADPLMPSPDGDSPLVLTVRLGWLRLQQALLEAGVNCEVRDSYGMTALHQATVLGREAALKLLVMHGANPDARTPDGQTSLGMALSSGRRDLATWLDWRIWPLPRRPLRHADVPDAAMRGDTEAVRRLLDLGLPVDAVDTQGCTALLRAAGGGHLQVVRLLLMRGADLQRAANNGATPLSAAVSMRQNEIIPALLDAGAPLEYRFPEEMTVLMLAAALGFPDIVMRLIAAGADVHASNVQGFAALHCAALYGFSARDKTRLLALLDALLLAGANPGQLADGKITPLLLLLGARAERGAVCDEQVVLAGVERLLEEGETLDVVDTRGFGPLHLAALHGLPLLVKCLLRAGADSERRDALNRSPREIAIMRGFIDV

SEQ ID NO: 9251 - protein, 308 aa, Xylella fastidiosa
TRHGKTQMAVIMGTSTSSIGASEEAYTRLEYDAEGARFPNDLQRAVIHAPHSLGNFVQHATDLSGPCVTVATACSSSAKVFAQAARLITSGVVSAALVGGVDTLCGSVLFGFNALQLVSPEPCRPFDVHRAGLSLGEAGGFALLERLDLAPDADLLLCGYGESSDAHHMSAPHPEGLGARMAMQEALARANVDASEVGYLNLHGTASPANDSIEAVAIAALFPPTLHASSTKAWTGHTLGASGIVESTIALLALRGNILPGTMNSEQLDPVCGPQIRCENAHTPILYAMNNSFGFGGNNCALLFKRAD

SEQ ID NO: 9252 - protein, 300 aa, Xylella fastidiosa
LLRIATRKSLLAMWQSEYVAARLRMLCPDLDVVLVPMSTRGDEILDRSLAAIGGKGLFLKELELAMLRGDADCAVHSLKDVPMDLEPPFMLAAVLSRDDPADALISNVYLSLESLPIGARVATSSLRRQAQLRFYRPDLRLFDLRGNVNTRLAKLDNGDYDAIVLACAGLRRLGLEQRMTARLAPPEWLPAPGQGAIAVESLTEDARIATLLAGLDDLPTRQCVVAERTMNRALHGSCHVPVGAYASYEVGGMRLQGLVGCVADGRLVRAELCSAKDEGDMLGRAVAQCLLDAGAAELLA

SEQ ID NO: 9253 - protein, 220 aa, Xylella fastidiosa
MLETIEHETAPMPQWSVLWLHGLGADGHDFMPIIPELVRPHWPALRFVFPHAPVRPITINNGVPMRAWYDLVSFDFNQRADQTGIEAAVAQVQALMMREQQRGIASERLFLAGFSQGGAVVLSIGLRCKASLAGLIALSTYLPDPNVVTTTTGLLSGSNAQQFFIAHGHSDPVVPLVHGQCAAEVLRKLGFAVEWYTYTMAHQVCQEEIQALGDWLERRF

SEQ ID NO: 9254 - protein, 327 aa, Xylella fastidiosa
KKTILCFGEALIDMLAQPPVKKGMPRAFLQCAGGAPANVAVAVARLGGAVQFVGMLGSDMFGDFLFDSFAEAGVVTDGIVRTNTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIASTLRFAAAVGALAVTRQGAFTAMPMLSEVLSLIQEQS

SEQ ID NO: 9255 - protein, 262 aa, Xylella fastidiosa
RMRRLYAPFNRNHDRIVEMDVRSAELTKYAANAMLATKISFMNEVANIAVHVGADIEYVRKGIGSDPRIGWHFIYPGVGYGGSCFPKDVKALARTAQQYGVDPKLLNAVEDVNHAQKGHLFELMLRHYGCSGESTMLAGKTFAVWGLAFKPNTDDMREAPSCRLLVQLWKAGAQVRAYDPEAMQEARRIFGERDDLVFCETAYAALQCADALIVVTEWKQFRSPDFFVIRDALKDAVIFDGRNLYDPQEIEEAGLAYYGIGR

SEQ ID NO: 9256 - protein, 1440 aa, Xylella fastidiosa
MTRDRGRLLGLWSRWQSQPHDHEARANFQRVLSASRAQRQVRENNQPVVTVDTRLPIAQEAERIVALIRAHPVVIIAGETGSGKTTQLPKLCLSAGRGIAGTIGCTQPRRIAARAVATRVAEELQTPLGMVVGFQVRFTEKVSDASRIKFMTDGILLAEVASDRWLSAYDTIIIDEAHERSLNIDFLLGYLKQLLKKRADLKVIVTSATIDTARFSKHFDDAPVIHVAGRTYPVEVRYRPLDAMWASDNRLGEAYGGTESLAVNRWAGGSGGDGALSKPIVAVPQEDQRTVNDAIVAVIDEITREDPHGDVLVFLPGEREIRELYRVLERRKYRETELLPLYARLSARDQDLVFNPGSGRRLVLTTNVAETSLTVPRIRYVIDPGYARVKRYSARQKLDRLYIEPISQASANQRAGRCGRIADGVCYRLYSEADFLARPAFTDPEIRRSSLAGVILRMLQLGLGRIGGSAASLSEPVSGPEQQRTSWIIESFSFLEPPDERAVADGWQQLVELGAVDSQHALTAIGREMARLPVDVKLARMLVAARQHGCVYEMTVIAAFLGVQDPRERPPDAREAADNAHAKFADARSEFVGILRLWEAYRQIRGHMTQSKLRQWCQRHFLGFLHMREWCELQLQLSLLCAGEQAEQPRKGRVAAAFPKEGCLPSQRSKPGAEAGKVNELPSSATVLQALLAGQGTSTQSEHRGNTPSRGQLHRAARLARERSAVLKVTHNTQSVKAVAGQSVSNAGMQAQFAVAPNDVPHIGERERAAAYQALHRALLTGLPIQIGHRTEKGDFQAPRQRRFMLFPGSMLAKKPPPWVLAANLLDTQKVWGLTNAAIEPDWVIAELPHLLMRKHFNPHWSRTQGRVLVSEQISLFGLLLAPKKPMHYGRIDPVAAHDLFVRQGLVTGEINTRAGFVADNLKVLEQAHEEEAKLRRAGIVADEDWQARWYFDRVPSDIHTADALDSWWKGLSVEKRHGLYWSLIDLLPGEGGGEDRYPKYFALGDVRLPLHYSFDPGAVDDGVTLDVPLHLLNALDPVRLSWLVPGFVADKAAALIRSLPKALRRSYVPAPDFAHAFAQAFQQPSADEMRGELARFLSRITGVRVAAIDFDEQTLEPYLHLRVRLHDESGQVLAESRDFDALRARFGSHSGEAFVARAGRALIMEELREFPAVSIPLQLTGEAGVPMYPALVDDGEMAALRIFADPTEAAQVHPHGVRRLLEITLANKIKQARKQLPVSSKSGLLYAAIESKECLRDDLVKAALNAVLAHGLESIRDPVAFAQCRDVAAQQLFSEAMARLSLAEEILAAVAELKPLLEAPLMGWARGNLDDMERQLAQLVYPGFLRQTPADVLTQYPRYLKAMMMRSERAKRDPSRDQARMLELKPFLDALEVAMAQGVSDTPGWETLRWDVEELRVSLFAQELGVRSGISVKKLAQRL

SEQ ID NO: 9257 - protein, 201 aa, Xylella fastidiosa
RIKFCGMTRVGDVRLASELGVDAVGLIFASGSSRLLTVSAACAIRRTVAPMVDVVALFQNNSADEIHTVVRTVRPTLLQFHGKEEDAFCRTFNVPYLKAIPMAGAEAKRICTRTLYLKYPNAAGFIFDSHLKGGTGQTFDWSRLPIDLHHPFLLAGGITPENVFDAIAATVPWGVDVSSGIELQPGIKDGDKMRQFVEEVR

SEQ ID NO: 9258 - protein, 335 aa, Xylella fastidiosa
RCFNIAIVGATGAVGEAMLSILEERHFPVAKLIPLASARSAGSQITFKGESINVLELEHFDPHGVDIALFSAGSRVSEAYAPQFAAAGVVVIDNSSAFRYEEDVPLVVSEVNPHALKQRPRGIIANPNCSTMQLMPVLAPIHREYRIERINVATYQSVSGGGRSALEELGQQTAQLLAFQEINPKRFPVQIAFNLIPHIDDFQSNGYTKEEMKLVWETKKILEDSSIQVNPTAVRVPVFFGHSEAVNIETQKKVTSEQARVLLASAPGVEVVDEWQPGGYPTPVTHASGKDPVFVGRIRDDLSHPRGLNLWVVADNIRKGAALNAIQLAELVTGE

SEQ ID NO: 9259 - protein, 361 aa, Xylella fastidiosa
MGANTFGKLLAVTTFGESHGPAIGCVIDGCPPGLELAAEEFAHDLQRRATGRSRHTSARREADEVEILSGVYEGRTTGTPIALLIRNTDQRSKDYATIARQFRPGHADYTYWQKYGIRDPRGGGRSSARETTMRVAAAVVAKKWLQQRYGVTVRGFLSQLGEIRPEGFAWDAIEDNPFFWPHAAQVPELEAYMDALRKSGDSVGARVDVVAEGVPPGWGEPIYGKLDGELAAALMGINAVKGVEIGAGFGSAVQKGTEHRDLMTPLGFLSNHAGGIIGGIATGQPIIVSIALKPTSSLRLPGETVDVDGCAVQVITKGRHDPCVGIRAPPIAEAMVALVLMDQALRHRAQCGDVGEMSPCI

SEQ ID NO: 9260 - protein, 276 aa, Xylella fastidiosa
NFVTTLTYLLPHRMLSSLARHVAYCQHPLIKQWLIDTVIAKFDVNLSEAAEPDAHAYPSFNAFFTRSLKAGIRPPDPNPDTLLMPADGRISQLGPIREGRIFQAKGQSFTATELLGDTAAASAFTNGLFATVYLSPRDYHRVHMPCTGQLLKTVHVPGRLFSVGPDAVRQIPRLFARNERLVCHFDTTFGPMVLVMVGALLVSGVETVWGGVEIPAYGDRITRKDYQGRNIAIERFAEMARFNYGSTVIVLLPPNVFTLAPHLTAESPVTLGQALA

SEQ ID NO: 9261 - protein, 378 aa, Xylella fastidiosa
ERILSLRKLRLAQCRTRTRRTIERRNGVRLEINGSWLVEFCSNDYLGLAQHFEIIAALQDAAARNGIGATASHLICGHHAIHKALEYELAEWLGYPRALLFGSGFTANLAVQQALLTKENDICVQDRLNHASLIDATRLAGCRLRRYPHLDVDGAAHQLKNAPEGAAMLATDGIFSMDGDIAPLRALSLVARTQQALMYVDDAHGIGVTGPQGRGCIAAAWLSVEEVPLQLVTLSKALGGYGAAVLGSATLIQHLAETARPYIYTTALPPAQAAAALTAIRIARRDEWRRQRLQELVERFRENSRRHGLEIMDSETPIQPLQCGDETTTMAMSAALEREGFLVNAIRPPTVPEGKSRLRVTLSALHTTEQIDTLVQAL

SEQ ID NO: 9262 - protein, 421 aa, Xylella fastidiosa
MSFSKHFGKLMLATCLSLSAAPAFSYSISHGKVVDDKGNQIQLRGVNWFGFETGDHVVNGLWARNWKEFITQLQGMGFNAIRLPFCPANLNSNTSPSSIDYSRNPDLQGLSSLQILDKVVKELSDRRMYVLLDHHRPDCSAISELWHTDSYSEKQWIDDLRFVAHRYANVPGVIGLDVKNEPHGRATWGTGDFQTDWNTAVEHAAAAILEAAPKWVIGIEGIGENPICSSTIGHFWGENLEPMDCTPLKVPADHLLLMPHVYGPDVYVQPYFNSPDFPNNMAAIWDKHFGHFAKAGYAMAIGEFGGKYGEGDPRDIAWQNAFVDYLISIGVTDAFYWAANQNSGDTGGMVGNDWTTPRDDKVKLLNKLWNAGGGASGVPAVVLAEAPAAVLVLVPAAVLAAAPAAVLVLVPEVVLAAAPAA

SEQ ID NO: 9263 - protein, 461 aa, Xylella fastidiosa
MTCRTRFAPSPTGYLHIGGARTALYCWLEARRRNGQFLLRIEDTDRERSTQAAIDAILHAMDWLGLDYDEPPVYQTQRIERYNQVAARLLAEGKAYYAYDSKDTLNAMREAALRTGEKPRYNGAAREANLPYRDDPNRVIRFKNPHTGTVAFDDLIKGRIQIANSELDDMVILRPDGYPTYNFAVVVDDWDMNITEVIRGDDHINNTPRQINLYHALGAPLPTFAHLPMILDEQGAKLSKRTGAADVMQYRDSGYLPHALINYLVRLGWSHGDQELFNRQALIDLFQINDVNSKAARLDMAKLGWVNQHYLKTDDPATLAPPLVWHLEQRGIDVSAGPAPTDVILALRERVQTLKEMAEKAEIWYCPLQRYDEIAVAKHLKPGAETALLHARTLLAALPAWTVDNVDTALRTTATTLEIGMGKVAQPLRVAITGTQVSPDIAYTVYLTGRNEALKRIDAAL

SEQ ID NO: 9264 - protein, 390 aa, Xylella fastidiosa
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAQNDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIIIVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARS

SEQ ID NO: 9265 - protein, 476 aa, Xylella fastidiosa
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDATQVGVSYLGLPQDVAAGDVLLLDDGLMQLQVVQVQGARIVTTVLNDGVLSDRKGLNKQGGGLSLGALTDRDRELIRIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEV

SEQ ID NO: 9266 - protein, 344 aa, Xylella fastidiosa
  unsure (1)..(344): unsure at all Xaa locations
EQLAETAQAMVASGKGIIAIDESAGTIAKRFSSVGIENIEENRRAYRELLLTTPKLSDYISGAILFDETIRQSTKAGVPFPKYMAEHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQFDPLPWPLSFSYGRAMQQAALKLWSQDMKGNFAKAQQVVYERAKENGLAALGKWKGXASLLIVAKALAV

SEQ ID NO: 9267 - protein, 572 aa, Xylella fastidiosa
MLRHLLTLSLIFAIALPIGVSAAPWPAFSTRGTQFIRDGRPYQLISGAIHFQRIPRAYWKDRLQKARAMGLNTVETYVFWNLVELREGQFDFTGNNDIGAFVREAASQGLNVILRPGPYVCAEWEAGGFPAWLFADPTLRVRSQDPRFLDASQRYLEALGTQVRPLLNGNGGPIIAVQVENEYGSYGDDHGYLQAVHALFIKAGLGGALLFTADGAQMLGNGTLPDVLAAVNFAPGEAKQALDKLATFHPGQPQLVGEYWAGWFDQWGKPHAQTDAKQQADEIEWMLRQGHSINLYMFVGGTSFGFMNGANFQGGPGDHYSPQTTSYDYDAVLDEAGRPMPKFALFRDVITRVTGLQPPPLPGASRFIDLPDTPLRASASLWDNLPAAVATTADPQPMERYRQAYGYILYRTTLHGPRKGRLYLGEVRDDAHVYVDRLFVGRAERRRQQVWVEVDIPSGTHCLDVLVENSGRVNYGPHLADGRAGLIGPVMLNHERVNNWETFLLPLQTPEAIHGWTTAPMQGPAFHRGTLFIRTPGDTFLDMEAFSKGVTWANSHMLGRYWDIGPQRALYF

SEQ ID NO: 9268 - protein, 756 aa, Xylella fastidiosa
MTIVTNLGFPRIGARRELKRALESHWRGETDATQLQHTARELRARHWRLQRDAGVDLPPSNDFSLYDHVLDTAFLFDAIPQRYRGLVDADPLAGYFAMARGRQADNIDLHALEMTKWFDTNYHYLVPELHRDQHFALRGNKPIAEFEEALALGITTRPVLLGPVSFLLLSKTVDGSNRLDLLERLLPVYTQLLRQLQESGAEWVQIDEPTLVLDLDAQTQQAFRKTYATLNQGPRPKLLLTSYFGPLGDNIELALQLPADGLHIDLVRGTEQLDAVLNTLPAGRVLSAGLVNGRNIWRTALDNALTLARYAQGSVDKDHLWLAPSCSLLHVPVDLEQEKNLDADVRNWLAFAKQKLGELRVLADALDNKPEAETALTQTRQALEARRQSPKVHRPDVAQRLAALTPDTIRRNTAYPQRSQAQQHTLNLPAYPTTTIGSFPQTLAVREARAQFKSGKLSESDYEAFLKAETERCVRTQEEIGLDVLVHGEFERNDMVEYFGEQLDGFIFTKLGWVQSYGSRCVKPPIIYGDVVRPAPMTVTWSAYAQSLTDKPMKGMLTGPVTMLQWSFVRDDQERAQTCRQIALALRDEVQDLEKAGIKVIQIDEPAIREGLPLRRGEWADYLNWAVESFRIASSNVHDTTQIHTHMCYSEFNDIIEAVAALDADVISIETSRSRMELLDAFVKFRYPNAIGPGVYDIHSPRVPKEEEMVLLLKKARAVLPSEQLWVNPDCGLKTRGWKETRAALQTMVHAAQRLR

SEQ ID NO: 9269 - protein, 494 aa, Xylella fastidiosa
KYILAIDQGTTSSRAILFDHKGRITGMAQREFTQIFPQPGWVEHNPRDIMTSVYTTITELLNNTQIDVRAIAGIGITNQRETTVIWDRQTGQPIYNAIVWQSRQTKDICDQLTTAGYQDLVHAKTGLLIDAYFSGTKVKWILDHVENAHTQAARGELAFGTIDTWIIWNLTGGQVHVTDYSNASRTLLYDIHALRWDPDLLTMLDIPAAILPDVRSSSEIYGLTQTPYFHGEQIPIAGIAGDQQAALFGQACFEPGMAKNTYGTGCFMLMQTGKKAVESQNGLLTTIAWGLNGEIEYALEGSIFVAGSVVQWLRDGLRMFGKASDSQAYADRVSDNGGVYVVPAFVGLGAPYWRSDVRGAVFGLTRSTTKEHFVRAALESMAYQTRDVLSAMQADADIELKELRTDGAAITNDFMAQFQSDILAVPVLRSQIAETTALGAAYLAGLATGFWSSREEMTQHWAINRCFKPQMDKEQREHLYAGWKQAVAATLGFR

SEQ ID NO: 9270 - protein, 488 aa, Xylella fastidiosa
  unsure (1)..(488): unsure at all Xaa locations
FDLLVVGGGINGTGIARDAAGRHLSVCLCEQHDLASHTSSASTKLIHGGLRYLEYYEFALVSKALGEREILLRQAPHIVRPLHFILPHQPHLRPTWIIRAGLLLYDHLGFSRRTLPRSRRLNLAKHPTGQPLKQELHTGFMYCDAQVQDARLVVLNAMDAAQRGARILTAPAAXERAVTAHIGXLNWKTLRKTATNSYTAIVNAAGPWAVTFLDHIAQQPHQHTLRLVKGSHIVVPRLFEHEHAYIFQQPDRRIVFAIPYEQHFTLIGTTDVNYVADPANPHIDAAETMYLCNAVNAYFRQQITPEDVLWSYSGVRPLLNDGHNNASKVTRDYQLEILGNSAPLLNVFGGKLTTYRKLSEEAVNQLCVALDHPYRAWTANGPPLPGGEHHDIAALQNTLRQHRPWLPTATAQRLIHNYGTYAETLLGNATNLHTLGIHFGADLYQAEVDYLRTHEWACSAEDILWRRSKLGLHLDAHGTQRLEDYLRS

SEQ ID NO: 9271 - protein, 637 aa, Xylella fastidiosa
PMLAKDAHVDRAHYKTLYHESIEQPEAFWSKVAQRLEWFKAPTKIKNVSYQLEDVHIRWFEDGELNASVNCLDRHLTLRGDKTALLFEPDAPYAPSSRITYRELYERVCQLGNALRHLGIEKGDRVTIYLPMIPDAVVAILACARIGAIHSVVFGGFAANSIADRVNDCGSKLIITADEGLRGGRKIPLKANVDAALKIHGTQSVETVLVVRHTGSTINMHTPRDRWFHDLVDIQATECAPERMNAEAPLFILYTSGSTGKPKGVLHTTGGYLVYTSYTHETVFDLRENDIYWCTADIGWITGHSYIVYGPLANGATVLLFEGTPHYPTVSRFWEVIDKHHVTLFYTAPTAIRALMREGDIPVKKTSRKSLRLLGSVGEPINPEAWHWYYTIVGNGRCPIVDTWWQTETGGILITPLIGATDLKPGSVTLPFFGIRPALVDTNGQTLDGPAAGNLVLLDSWPGQMRTLYGDHQRFIDTYFRTYPNTYFTGDGCRRDADGYYWITGRVDDVINISGHRIGTAEIESTLVAHPKVAEAAVVGFPHPIKGQGIYAYVTLITGETPSEALHQELLTWVRKEIGAIAIPDHVQWAPNLPKTRSGKIMRRILRKIAENAPDQLGDTSTLADPSIVDLLLNERL

SEQ ID NO: 9272 - protein, 615 aa, Xylella fastidiosa
DSTCYPRLSRIQTPEDLRAFQESELPAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGVAELLNAEGIVLPIVHLGLPDAFQQHASREDLLAEAGIDAAGVYAAL

SEQ ID NO: 9273 - protein, 385 aa, Xylella fastidiosa
MNFHEYQAKQLFAEYGIPVPAGRIASSADEAVTAAKSLGNGPWMVKAQIHAGGRGKAGGVKFCKTTDEVKQAAATMLGTKMATYQSAGVALPVNLVLVTEAGEITKELYLSVLVDRGTRSITYIASSEGGVDIEHVAAETPEKIQTLNVDFVEGLQPYQGRDIGFHLGLEAKQVNQLSKIMISLYQLFNDKDLSLIELNPLAILSNGDLYALDGKINSDDNATFRHKELAAMRDKTQEDETEVLASENDLNYVTMDGNIGCMVNGAGLAMATMDVIKLNGGEPANFLDVGGGATKERVTTAFKLILSSNKVKAIFVNIFGGIVRCDMIAEGIIAAVKEVGVKVPVIVRLEGTNVDAGKQLLATSGLAIIPADDINDGAKKAVAAV

SEQ ID NO: 9274 - protein, 290 aa, Xylella fastidiosa
MSVLVNKNTKVIVQGFTGQQGTFHATQMVEYGTQVVGGVTPGKGGNTHIDLPVFNTVREAVQNTGADASVIYVPPPFAADAILEAAAAGIKVIVAITEGIPVLDMLRVKNVLKASPEITLIGPNCPGVITPGECKIGIMPGHIHKPGHIGIVSRSGTLTYEAVKQTTDVGLGQSTCIGIGGDPINGLNFVDALKLFNNDPQTKGIIMVGEIGGDAEEAGAEYIKHHVKKPVVGFIAGASAPKGKRMGHAGAIASGGSGTAEGKFAAMEKAGIKTVRSPGDLGAAIALLVR

SEQ ID NO: 9275 - protein, 1164 aa, Xylella fastidiosa
MRLSTIKLSGFKSFVDPATLHLPTNMTGIVGPNGCGKSNIIDAVRWVMGESSASRLRGDSLTDVIFSGSSARKPVAQATVELIFDNSDHTISGEFAAFNEISVKRTVSRDGSSVYSLNGTKCRRRDITDLFLGTGLGPRSYSIIEQGMISQIIEARPEDLRIYLEEAAGISKYKERRKETESRIRHTQENLDRLNDLREEIGKQLEHLKRQARQAEQYQTLQEERRVKDAECKALQFRELDTRLQGLRHALLQEETRLQQLLAEQREAEMRIETSRVRREESAEALATAQADVYQVGATLARIEQQIQHQREMSQRLHKARDEAQKQLIDLTRHMGDDAATLAVLREAVENNEPQLHVLREQSEFKQDALRDAEAALTDWQQRWDSHNRETSEASRAGEVERTRVDYLDRQTLDAERRRDLLLAERAGLDLDALAEAFEQIEVQYETQKAALDGLNDQLEQRKQTLADVQHQQRTAQTELADVRKHAQTARGRLSSLETLQQAALGQEQGAAMTWLQAHGLSSAARVGERIRVESGWENALESALGHMIEGVLVDDPQTLVEALNSLNEGHIALVADTQTQIQVAPTSLAAKVQGPVAIRRLLTHLHGAEDLVAARALQETLGEGDWVMTRNGECLGEGWLRVSRSGAAEQGALLRERDIQTLRAQIETLQEREAELEHRLTHFRDHLLMAEQHREDAQRQLYIAHRGVSELAGQRQAHHGKLEASRGRIQHIEAEIAQLLETLDTSRDQARTARATLDEAVTRMGDLESQRQALHAERQQLNLTRDQAREAARSVREAMHALALTLESQRTQMVSLSQTLQRMDNQRGQLDARLEELMNQLSEGDSPVEILEQQHQAALSERVRTEHLLVQARTHLDGIDAELRQFEHTRQQRDEQALSQRERISQCRLDQQALALGAEQRQAAVEKAGFVLQHLVDALPEAANPADWEAAIEQLDIRIRRLEPVNLAAIHEYNEAAQRVEYLQAQHEDLTVALQTLEDAISKIDRETRGRFKETFDRVNAGLQTLYPRLFGGGHAYLELTSEDLLDTGIAIMARPPGKRVSSISLLSGGEKAMTAVALVFAIFQLNPAPFCLLDEVDAPLDEANVGRLASMVKEMSEKVQFLFVSHNKSTMEAAQQLSGVTMREPGVSRLVSVDLAEATRLV

SEQ ID NO: 9276 - protein, 341 aa, Xylella fastidiosa
MYSLFRPLLFTCDAERAHDISLRTLDIAYHSGALPLLTRHTRPLPTTAFGLNFPNPVGLAAGLDKNGTHIDALFALGFGFIEIGTTTPRPQAGNPKPRLFRLTQQQAVINRMGFNNLGVDALVRNVAGARRRNGPLGINIGKNKDTPNEQASNDYRYCLERVYALADYVTINLSSPNTAGLRALQEEQTLRRLIGELRETQETLAAKHGRHVPMLIKMAPDLSDSDIDAAARVLNEMSVDGVIATNTTVTRPLLRQHPLASEAGGLSGAPLLGQSTLVLRRLRTHLPETIDLIGVGGICCGADAGAKMAAGASLVQCYTGLIFKGPQLIGECVEAIRRRLE

SEQ ID NO: 9277 - protein, 497 aa, Xylella fastidiosa
  unsure (1)..(497): unsure at all Xaa locations
EKIITDLRSQLYAHLIGLDASFHDRNRSNELVSRLATDSELLRSIIGSTMSVATRSTVTAIGSLIMLFITSPRLASLSLVVIPLVILPIVLGAQHLQKAARTSQDRIADTNSFAAETLRALRTVQAYAREHYERTRFDRTLETSLQAARQRIHIQTWVTAASIVLIFSAIVGVLWAGAHDVIAGRMSAGTLGEFVLYALIGGGSIGALAEVWNELQRAAGGMGRIFELLKEKNTLSVPATPTLPPHPLRGEIRFERVGFHYPQRPETPALDGIDLHIRPGETIAFVGPSGAGKSTLLSLLLRFYDPTHGRILIDGVDLRQTDPKVLRTHIALVQQQPTLFTASAMENIRYGRLDATTAEIEIAARSSEADGFIRALPQGYATELGEHGLSLSGGQQQRIAIARALLKEAPILLLDEATNALDAQNEQAVQQALERLMTGRTTLIIAHRLVTILKADRIVVMDQGRIVAQGTHSELIAAGGLYAKLARLQFIEXTSDR

SEQ ID NO: 9278 - protein, 511 aa, Xylella fastidiosa
LNPSEISELIKTRIEQVKLSAESRNEGTVTSVSDGIVRIFGLADAMQGEMIELPNKTYALALNLERDSVGAVVLGDYEHLREGDVAKTTGRILEVPVGKSLLGRVVNALGEPIDGKGALGPTQTAPVERVAPGVIWRKSVDQPVQTGYKSVDAMIPIGRGQRELIIGDRQTGKTAMAIDTVISQKHTGIKCVYVAIGQKASTIANIVRKLEENDALDHTIVVAATASESAALQYISAYAGCTMGEYFMDRGEDALIIYDDLSKQAVAYRQISLLLKRPPGREAYPGDVFYLHSRLLERAARVSEEYVEKFTQGEVKGKTGSLTALPIIETQAGDVSAFVPTNVISITDGQIFLETDLFNAGIRPAVNAGISVSRVGGSAQTKIIKKLSGGIRISLAQYRELAAFAQFASDLDETTRKQLERGQRVTELMKQKQYTSMSVANQALSIYAVNEGYLDDIPVHKVLTFEEGLHAHFSNTQGALIDKINNSGDWDNNIEAAFKQHIEEFKTTGSW

SEQ ID NO: 9279 - protein, 287 aa, Xylella fastidiosa
MASGREIKSKIKSVQNTRKVTRALEMVSASKIRKAQEQMKISRPYAQAMKQMIGHLAQANTDYLHPFLITHKQVKRIGYIVISSDRGLAGGLNNNLFRKMLGEMHQWQDNGAEVDIVTIGQKASVFFRRIKVNILGSVTHLGDTPRLEQLIGVIKVMLDAYTEEKLDRVYLVYNHFISTMVQKASFDQLLPLLAAKDKVAPHDWDYLYEPDAATVLEHVMTRYIESLVYQAMLENIASEHAARMVAMKAASDNANKLIGTLQLVYNKARQAAITQEISEIVGGAAAV

SEQ ID NO: 9280 - protein, 464 aa, Xylella fastidiosa
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLSVSRARKIERFFSQPFHVAEVFTGAPGKYVPLKDTIRGFKAIVDGEYDHLPEQAFYMVGNIEEVIEKANKM

SEQ ID NO: 9281 - protein, 343 aa, Xylella fastidiosa
GFAALSATGPLERFAFGRRAPRPDDVVIDILYCGVCHTDLHLARNHSGFTTYPIVPGHEIIGCVREIGKTVTRFKRGDLVGVGCMVDSCQHCQPCLKGWEQDCIEGSIFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTVPYDHDVNPYMPTLVLEGVLVLVGYLGPLSMPVNAGGVVRGRRAISGSFIGGAHETQQMLDFCGQHGIVSDVEIIPIQKINEAYERMLKSDVKYRFVIDMTSL

SEQ ID NO: 9282 - protein, 365 aa, Xylella fastidiosa
MRDEEGIGPCYVYHLPTVRERARQLNAVAAVDQCYYAIKANPHPAILRTLIEEGFGLECVSLGELRHAFEVVPHLVPSRVLFTPSFASRVEYEQAFLLGVNVTLDNVEALRLWPEVFRERTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRHLPAATASGDLMLIADAGAYGFSMASTYNLRGLPAEVVL

SEQ ID NO: 9283 - protein, 451 aa, Xylella fastidiosa
IVLKFGGTSVSRRHRWDTIAMVVRKRLEEHGTRVLIVVSALSGVTNELTAIAQGVVDSAKRVTALEQRHRDFLVELGLDVQAVLGTRFAMLSDLLQDARAVTRSLDWQAELLGQGELLSSTLGAAYLGASGIDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIE

SEQ ID NO: 9284 - protein, 1075 aa, Xylella fastidiosa
MPKRTDLRTILIIGAGPIVIGQACEFDYSGAQACKALRAEGFRVVLVNSNPATIMTDPDMADAVYIEPIHWRTVEKIITKEKPDALLPTMGGQTALNCALDLADHGVLEKYGVELIGAKREAIRMAEDRELFRVAMQEIGLECPKAEVAKSLERALEIQAKVGFPTIIRPSFTLGGTGGGIAYNRQEFEEIIKRGLELSPVHEVLVEESVLGWKEFEMEVVRDASDNCIIVCSIENLDPMGVHTGDSITVAPAQTLSDKEYQRLRDASIAVLRKIGVDTGGSNVQFGIDPQTGRVVVIEMNPRVSRSSALASKATGFPIAKIAAKLAVGYTLDELKNEITGGKTPASFEPSIDYVVTKIPRFAFEKFPQADARLTTQMKSVGEVMAMGRTFAESLQKAVRGLETGKVGLEPTGLDLSSEDDLVVLKRELKAPGAERLFYVADAFRAGFAVADVYALSYIDPWFLDQIEEIVAAEGRLVTDGLGSIDGARLRQLKRIGFSDARIAQLTGTNEVAVRTLRRVLKVKPVYKRVDSCAGEFATGTAYLYSTYEEECEAAPSDRRKIMILGGGPNRIGQGIEFDYCCVHAALALREDGFETIMVNCNPETVSTDYDTSDRLYFEPLTLEDVLEIVEVEHPVGVIVQYGGQTPLKLAKALEANGVPVIGTSPESIDLAEDRERFQRLVQQLGLRQPPNCTARTADEALVLAREIGYPLVVRPSYVLGGRAMEIVYSEADLARYVRDAVKVSNDSPVLLDRFLDNAVEVDVDIIADPEGQVLIGGVMEHIEEAGVHSGDSSCSLPPYSLSVATQDDLRRQVIRLAQALNVIGLMNTQFAIQSNDDGSDIVYLLEVNPRASRTVPFVSKATGVPLAKIAARCMTGKTLAEQSVTCEVVPAYYAVKEAIFPFAKLQGVDPILGPEMRSTGEVMGVGRSFAAAFARAQEAGDIRAPQPGRAFVSVRDPDKKRVLPVVLALVERGFGVVATAGTYAWLQQNGVACEVVNKVAEGRPHIVDLIKNGEIVYIINTTEGRAAIADSFSIRREALQHCVTYSTTIAGAKALVNSLEFRGTGPVWSLQELH

SEQ ID NO: 9285 - protein, 371 aa, Xylella fastidiosa
VTEPAILVLEDGTVFEGDAVGANGLSVGEVVFNTALTGYQEILTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVGKAQDAACQFAGIKGMDLAKVVSTKQGYSWYEGQLDLDRNECKRAAPQYKVVAYDYGVKLNILRMLAERGCDLTVVPAQTPADEVLALCPDGVFLSNGPGDPEPCDYAVAAIKTFIMRRIPIFGICLGHQLLAQAVGARVVKMSHGHHGANHPVQDLRSGRVMITSQNHGFAVDEATLPNNVRVTHRSLFDGTNQGIELLDVPAFSFQGHPEASPGPHDVDVLFDRFITMMA

SEQ ID NO: 9286 - protein, 231 aa, Xylella fastidiosa
RLLIHGASGRMGQSLLRLASEDPSFQVTAAVVGNAPHRHVSDGVPFFAAAELAAVPAFDVAIDFSLPQGFSSLLALCVARAVPLVSGTTGLDSRQHEALVMAGARIPLVWGSNFSVGMAVLVNLVERAGDALSGWDCDIVESHHVHKQDAPSGSALTLGEAVACKGIAPRYTSLRAGDIVGDHLVQFTGLGERIELVHRASNRDVFARGALCVARRVVGRVPGCYRVRDLI

SEQ ID NO: 9287 - protein, 541 aa, Xylella fastidiosa
MAAKEIIFSEKARSRMVYGVNLLANAVKATLGPKGRHVVLDKSFGSPIITKDGVSVAKEIELADKFENMGAQMLKEVASKTNDHAGDGTTTATVLAQALIREGCKAVAAGMNPMDLKRGIDKAVIAAVTELKKISKPTSDDKAIAQVATISANSDESIGNIIAEAMKKVGKEGVITIEEGTTLENELDVVEGMQFDRGYSSPYFINNQQSQIVELDNPYILLHDKKISSVRDLLTVLDAVAKESKPLLIVAEEVEGEALATLVVNNIRGIIKVCAVKAPGFGDRRKAMLEDMAVLTGGTVISEEVGLSLEKATTSHLGKAKKVRVSKENTTIIDGIGDNDAINGRVKQIKTQIEETTSDYDREKLQERVAKLAGGVAVIKVGAATEVEMKEKKARVDDALLATRAAVEEGVIPGGGVALIRAITAISNLKGANEDQTHGIQIALRAMEAPLREIVANAGEEPSVILNKVKEGKDNFGYNAATGEFGDMVKLGILDPTKVARTALQNAASIAGLMITTEAMVAEAPKKDEPTPPAAGGGMGG

SEQ ID NO: 9288 - protein, 270 aa, Xylella fastidiosa
FAVFGHPIAHSLSPRIHTEFGRQMGVVLDYLAFDVAPDAFRVSLEHFVAEGGCGANVTLPLKEAAFEVCTTLSTRARRAGAVNTLSRVDGVWHGENTDGTGLVRNLTERHGLDLRGRRALLLGAGGAARGVAPALLDAGITEMVIVNRSPERADMLCDALGEPGRVSARYWGDLGDLGNFELIVNATSIGNTSDMRTFSLPRSLLDSMTAAVDLNYGSAAVPFLAWAHAVETRYAIDGLGMLVEQAAESFSLWHGRRPDTDPVYTVLHSE

SEQ ID NO: 9289 - protein, 416 aa, Xylella fastidiosa
WLRIPFWQRVVAGFVLGALVGWVMGPAAKTWFGPLGTLYVTLIKMIAIPLVFFAVINAIAALHGQRSVAMLGGRTFLWFIVTAALAVCVGLGVGTLLKPGNGDFTVSVDAAWAPPDVPSPVHVLLDVVPSNPFYALTGIGTRSNNTGETTLAAGRGSILPVIFFAALLGLAIVKLGERVTEVRKLIGQMSEIMIQITRFVLEMTPLGTFGLIAALVGSYGFQKLLPFGHFVLALYLACALHIVVVYSGLLLAHGLSPLKFFRGVAPGMQVAFVSSSSFAAMPVALRAITHNLGVNKDYAAFAVPLGSSIKMDGCGAIFPALCAVFIAQYTGVPLTANQYFVIFIASVLGSFGTAGVPGTAVVMATVVLSAAHLPLEVIGYLYAIDRVLDMMRTMTNVTGQMLVPVLVAKETGLLNT

SEQ ID NO: 9290 - protein, 291 aa, Xylella fastidiosa
IPVSKALFTRWCQRTDSYLERTLSIPTQAPQRLHAAMRYTVLSGGKRIRPLLVYAAGHLFHVDEPLLDVPAAAVELIHAYSLVHDDLPAMDDDLLRRGRPTVHIAFDEATAILTGDALQTLAFECLADAPADTSLRIAWLQTLTHAAGVAGMCGGQALDIDATGQSQTLKALEVMHALKSGTLMRAAVRMGALAGDPSAEDLHSLDTFAATLGLAFQVRDDILDIESSSEQLGKTAGKDAIQQKSTFPALLSVEGAKCYLQELAERLYTQLHPYGERAAPLTALARLAVER

SEQ ID NO: 9291 - protein, 305 aa, Xylella fastidiosa
FAFVFPGQGSQSLGMLSEFAVLYPEIVDTFAEASEGAGVDLWTLSQRGPEEMLNRTEYTQPALLAASVALWRLWQARGGRAPDLLAGHSLGEYSALVVAGALSLKDGAYLVRLRGQLMQDAVAVGVGAMAAVLGAEDALVAEVCAQVAGSEIVVPANFNSPGQVVIGGHATAVDRVLVLLAERGVSKTVKLAVSVPSHTPLMRDVAHRLAEAMLGLVWKVPQIPVVQNVDGRVHDGVEAIREALVKQLYLPVQWTDCVRELATCGVVHIAECGPGKVLMGLIRRIDKTLDVRSLATPTGFSDVLD

SEQ ID NO: 9292 - protein, 242 aa, Xylella fastidiosa
LQGEVALVTGASRGIGAAVADILADHGATVIGTATSASGAQLIGDRLALLGGHGRALDVTDTAAVGALVEEIAEQFGSVSILVNNAGITRDNLLMRMKDEDWESIVDTNLSSIFRTSRAVVRDMMKARKGRIINIASVVGVTGNAGQANYAAAKAGVIGFTKSLAKEVGPRGITVNVVAPGFIDTDMTRVLSEGLRNDILNHVPLGHLGDPVDIAHAVAFLAAPAARYITGETLHVNGGMYM

SEQ ID NO: 9293 - protein, 73 aa, Xylella fastidiosa
MSDIEARVRKIVAEKLNVDEEKVTNTSTFVDELGADSLDTVELVMALEDEFQCEIGDEAAEKMTSVQHAIDYI

SEQ ID NO: 9294 - protein, 409 aa, Xylella fastidiosa
RRVVVTGMGMVSPLGNDLTTSWDGIVHGRSGVAPIVQIDASKFSTQIAGEIKGFDPMKFVSAKDAKKMDSFIYYGIGAAFMALDDAGLEINEINAERVGALIGSGIGGVFGIEEQTIKLYEGGARKISPFYVPATIINMLPGQLSILKGLKGPTFSAVSACATSNHSIGMAMRMIQYGDADVMLAGGSERASSPTAIGGFCAMRAMSTRNDDPTGASRPWDKGRDGFVLGDGAGILVLEEYEYAKARGARIYAELAGFGATSDAFHMTMPVEDGEGAARCMRIALQDAKVTPEQIDHLNAHGTSTPLGDLCETNAIKTVLGDHAYKVMVSSTKSMTGHLLGAAGGVEAIFSVMALHTGIVPPTINLEEPDEGCDLDYVPHVAREAKLDVVVSNGFGFGGTNGTLVFKRI

SEQ ID NO: 9295 - protein, 514 aa, Xylella fastidiosa
LSSSDLSEPVSVKTLWGEVQRPSLPTHVCTVLPARLTPKHGSIDALDANPKVSKPDTKRLQDAIDDCPAGSAVKLVIDSHRKSGFLSGPLHLKSGVTLWIDDGVTLFASRNPKDYDKGNGTCGTATSTHEFSCMPLISAINTTGSGIVGGGVIDGRGGSILTGGKYARQRTWWDLAYQNKRHALHQQVPRLIQIRGGNDFTLYRVAIENAPNFHVVADTVSGVTAWGIRILTPSLVYTTPGYHCPPGTTPDVVTPATCFTPDTVKNTDGFDPGQSNHVLLAYSYISTGDDHVAIKARGKMPSYALSFLHNHFGYGHGMSIGSDTESGVHDMEVSDLSIDGFDSPNSNGLHMKSDADHGGVVDHVTYSKICMRRLKRPLAFDTFYKPSNGNSYPLFKNIVLQDIHVLESPVFGAGQLLFMGILGSGNNLPMTLSMDNVVFDGFLPTLIAPPSSIVFANPQAAHFHFGPGPVSFAPLITPSVAYDVTVSGSPGVGNPYDCSAAFINFSSIFPDSPI

SEQ ID NO: 9296 - protein, 240 aa, Xylella fastidiosa
SPRFRALVTGGSGNLGTAICRQLIADGAHVIVHANHHRSRADTLVECLCAEGGSAEVIVFDVTAAQASKTALENLLQAGPIQIIINNAGIHDDAPMAGMSSTQWHRVIDVSLHGFFNVTQPLLLPMARTRWGRIVCISSVTAVLGNRGQSNYAAAKAGLHGAARSLAREMANRGITVNVVAPGVIESEMVGKTFTPEMIKQLIPTGRPGRPEEVAALIGFLCSEKAGYINGQVIGINGGM

SEQ ID NO: 9297 - protein, 129 aa, Xylella fastidiosa
MSDIPGDLKFLKSHEWVRIEDNNRAIVGVSDHAQNLLGDLVYVELPNIGDHLDAGATAAVIESVKAASDIYSPVTGKVIEVNTTLSDKPETINEDPYGEGWIMVIEMQAPEEISNLLSPDDYTEVLESD

SEQ ID NO: 9298 - protein, 455 aa, Xylella fastidiosa
RQRDLRVLWHPCTQMREHPDTLPLVPIVRGEGVWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACSAISTDTDDKQLGIMPDLLCLSKGLTGGVLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAI

SEQ ID NO: 9299 - protein, 422 aa, Xylella fastidiosa
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPALK

SEQ ID NO: 9300 - protein, 562 aa, Xylella fastidiosa
  unsure (1)..(562): unsure at all Xaa locations
ISVNGGAAALRAGWRFGDRCCVCTNEXGRGSSFQTEFGIRRCCQCDDSYQPQYSYTGRMTHAQGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAAHAFDIVSTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 9301 - protein, 887 aa, Xylella fastidiosa
TIRKLAELVNTPVEKLLEQLAGAGMKFSGPDQVVTSTEKMKLLGFLRRTHGKSDVSVGTVREAPKKITLNRRRLQEVTVNAGRNKTTVNVEVRQKRTYVKPPESEYHTPTKPSIELADAERVEILRKLEESRQRNLAEQQRLAEVDRQRVEEQERKRREEEQAELERQKTESRVVEEILVKTDSNSVKPVSKPISEERTRALPRTVRPTPAARPSVSRSDDRNSNGGVRHKARGSHVIVSDEDDSARRFAGQMHLTAAERARRGSNTRGKGGGSHRGATHRGNENSIRSSGAHGFERPTVAVVREVAVGDTITVADLAQKLALKSGDMVKALFKMGVMVTITQTIDHDTAVLVSEELGHKVTRASSSDFEDALLAHTEEVHGEPVPRPPVVTIMGHVDHGKTSLLDYIRRTKIAVGEAGGITQHIGAYHVETPRGVISFLDTPGHAAFTSMRARGAKITDIVVLVVAADDGVMPQTKEAVQHARAAGVPLIVAVSKIDKSTADPQRVKNELLTESVVAEEFGGDTQFVELSAKTGVGVDALLDAISIQAEVLELKAVIEGRATGTVIESSLDKGRGPVATVLVQQGRLKKGDYLVCGTHYGRVRALFDEVGHQPLAASPSIPVQVLGLSGVPDAGDDFVVVDDERLAKDVAQQREAKRRESRLVTSAGNRMEDILAQMGKGENQQVLNLLIKADVQGSLEALKQALVALSNDDIRINVIHVGVGGITESDANSAVTSKATVIGFNVRADASARKIIEANGVDLRYFSIIYDVIDQVKQVASGLLGVEIREEIIGVAEVRDVFRSSKFGAVAGCMIIEGVVKRSKPIRVLRDNTVVFEGELESLRRFKENVDEVRNSTECGIGVKAYNDVRVGDSIECFERIEVARTL

SEQ ID NO: 9302 - protein, 408 aa, Xylella fastidiosa
LHGVLSIPGDKSISHRAVMFAALADGTSRIDGFLEAEDTRSTAAILARLGVRIETPSSTQRIVHGVGVDGFQASDIALDCGNAGTGMRLLAGLLVAQPFDSVLVGDASLSKRPMRRVTDPLSQMGARIDTSDDGTPPLRIYGGQLLRGIDFISPVASAQIKSAVLLAGLYARNETVVREPHPTRDYTERMLTAFGVDIDVSTGCARLRGGQRLCATNITIPADFSSAAFYLVAASVIPGSDITLRAVGLNPRRIGLLTVLRLMGADIVESNCHEQGGEPVADLRVRYAPLQGTRVPEDLVPDMIDEFPVLFIAAAAAEGQTVVSGAAELRVKESDRLAAMVTGLRVLGVQVDETADGATIHGGPIGHGTINSHGDHRIAMAFSIAGQLSVSTVRIEDVANVATSFPNY

SEQ ID NO: 9303 - protein, 354 aa, Xylella fastidiosa
RIFNFSPGPATLPEPVLRQAQAEMLEWNAVGASVMEISHRSAEFIALAKGIESDLRCLLGVPDDYAVLFLSGGATTQQALLPLNFAAQGQTADYVVTGHWSKTALKQASPYVNINVVADGERDGFQDIPNRAGWRLSKDAAYVHMTANETIHGVEFRQTPDVGDVPLFADFSSSIAADLIDVSKYDLIYAGAQKNLGPVGICVVIVRRTLLERTGQPRADIFTYASHAERDSMLNTPPTFNWYLLGLTVKWMLAEGGVQEFARRNQAKAQLVYQTIDQSGGFYRNGVAAAVRSRMNIPFFLPNVEQDARFAAEAKAAGLLSLKGHKAVGGIRASLYNAMPLAGVQALVAFMHDF

SEQ ID NO: 9304 - protein, 164 aa, Xylella fastidiosa
MIVSLIAALDRYRAIGRDNGLPWHLPDDLKRFKALTLGRPVLMGRKTAHSLGRPLPGRTNLVLTRSGHVPFSEMRAVDSLDAAIVQAAAEGADTLSVIGGGELYALTLPHANAMYLTHVDVAVAGADTYFPIFDAVDWEIKKREPHQGDGRHAYPFTFIDYCRR

SEQ ID NO: 9305 - protein, 362 aa, Xylella fastidiosa
MSKRDYYQVLGVPRTASEDDLKKAYRRCAMKYHPDRNPGDAAAEAAFKECKEAYEVLADTKKRKLYDTHGHAAFEHGVGSGNAPDMNDIFGNIFGGARASRRGADVGYMVELDLEEAVAGVERQIQIPTLVECTHCHGSGSEDGHVETCGTCRGSGQVRIQRGIFAMQQTCPHCGGRGVIIRNPCKVCNGAGRVEDHKTLSVKIPAGVDNGDRIRLSGEGEQGPDGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRNLLEQFEMTFAGEDARKHSPKSATFLDGVKSFWDRM

SEQ ID NO: 9306 - protein, 637 aa, Xylella fastidiosa
MGKIIGIDLGTTNSCLAIIEGGKGRVIENSEGDRTTPSIVAYTKDGEILVGAAAKRQAVTNPKNTFYAVKRLIGRKFGDAEVQKDLDLVPYKITQHDNGDAWVATADGKKLAPQEISAKVLEKMKKTAEDFLGEKVTEAVITVPAYFNDSQRQATKDAGRIAGLDVKRIINEPTAAALAYGLDKKGGDRKIAVYDLGGGTFDVSIIEIAEVDGEKQFEVLATNGDTFLGGEDFDKRVIDYLVDEFNKDQGIDLRKDPLALQRLKDAAERAKIELSSSQQTEVNLPYITADASGPKHLNIKLTRAKLEALVDDLVRKSIEPCRIALNDAGLRTSDVQEVILVGGQTRMPKVQQAVADFFGKEPRKDVNPDEAVALGAAIQGGVLAGDVKDVLLLDVTPLSLGIETMGGVFTKIIEKNTTIPTKASQVFSTAEDGQSAVTVHVLQGEREQARFNKSLAKFDLAGIEPAPRGQPQIEVSFDIDANGILHVSAKDKKTNKEQKVEVKAGSGLSDSEIQQMVADAEAHREEDKKFQELVQARNHADGLIHSTRSAIKEHGSKVGGELIGRVEASLAELEAAVKGDDKNQIEAKSKTLEEVAQSLHMAATAEQQSGSTGAGAGASAKVDDVVDAEFTEVKADK

SEQ ID NO: 9307 - protein, 169 aa, Xylella fastidiosa
LLVDRPSIDVAIAHIADDIVRDYQGDVPLFVTIMHGGLPFAGQLALELGQRGQDIELDSLHATRYRGEQTGGALVWRHYPVSAMSGRRVILVDDILDEGHTLSEIRQWCLKRGATDVSLVVLMIKCHDRCIPNMRADYYGVEVPDRYVFGFGMDIAGQLRGIPAIYAMR

SEQ ID NO: 9308 - protein, 749 aa, Xylella fastidiosa
  unsure (1)..(749): unsure at all Xaa locations
MAGKTLYGKLWDIHEVARRDDGSSLIYIDRHILHEVTSPQAFEGLRLAGRPLWRVNANIATPDHNVPTTKAERQGSLLSIADTVSRLQVQTLDENCDDFGIFEFKMNDVRQGIVHVIGPEQGATLPGMTVVCGDSHTSTHGAFGALAHGIGTSEVEHVLATQCLVTQKMKNMQVRVEGTLPWGVTAKDIVLALIGKIGTAGGNGYAVEFSGSTIRALSMEGRMTICNMAIEAGARVGMVAVDEKTIQYVHGRPFAPKGSDWDAAVAFWRGLVSDPDAHFDRVVELSAEEIKPQVTWGTSPEMVSAVDQSVPDPERETDPVKKESLIRALKYMGLQPNDPIPSIKLDRVFIGSCTNSRIEDLRAAAEVVKGRKVASTVKQAMVVPGSGLVKAQAEVEGLDKIFIEAGFEWREPGCSMCLAMNPDKLGSGEHCASTSNRNFEGRQGIGGRTHLVSPAMAAAAAVAGHFVDVREMDAVMNLMLSLXMLGNNVLMKVYIQCRFLIVSILLAHAXSVSKRLFFSISAAXXNGSAIYDRSVHRIFKHWXSLMKPFTQHTGLVCPLDRVNVDTDQIIPKQFLKSIKRTGFGPNLFDEWRYLDAGQPGQDNSKRPINSDFVLNFPRYRGASVLLARDNFGCGSSREHAAWALDEYGFRTVIAPSFADIFFNNSFKNGLLPLVLNKVEVDALFAQCQVTEGYTLTVDLAAQQVITPDGTTYAFQIDTFRKHCLLNGLDDIGLTLQHAEAIRAFEATHR

SEQ ID NO: 9309 - protein, 347 aa, Xylella fastidiosa
MFINAYGAHAGDKPLESMQIARRAPGAHDVQIDIHYCGVRHSDIHQVRAEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDSFLTLLKRDGTLTLVGAPVTPHPSPEVFNLIFKRRSIAGSLIGGIAETQEMLDFCAEHGIVADIELIRADGINEAYERMMKGDVKYRFVIDNSTL

SEQ ID NO: 9310 - protein, 390 aa, Xylella fastidiosa
YVMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLP

SEQ ID NO: 9311 - protein, 702 aa, Xylella fastidiosa
ASNPQPDSALHGLVLLAQFHGIAADPVQIAHDFGRSGEPFDETTLLLAAKKLGLKAKVVTQPVTRIAMAALPALALIPGGTAFIVAKVTGNQILIHDLADQRPRTISHDEFTARYAGRLLQVASRASVLGNLAKFDFSWFIPAAVKYRKLLAEVFAVSLFIQIFALVTPLFYQVVMDKVLVHQALSTLEVIVVGLISLALFEVLLTALRTHVFAHTTSKIDVELGARLFRHLLALPLAYFESRRVGDTIARVRELENIRHFLTGQALTSVLDLLFTVVFLSVMFWYSSWLTLIVVISLPLYALISAFITPVLRKRLDEKFARGADNQAFLVETVSGIGTVKAMAVDPRVTRTWDNQLAGYVSASFSVTKIATLGQQSVQLVQKLTNVAVLFWGAKLVIDGQLSLGQLIAFNMLSGQVTAPIIRLAQLWQDFQQVGLSVERLGEILNTRTELPGSRMTLPPIQGRITFERLIFRYRPDTPDVLSGIDLDIQPGEVIGIVGRSGSGKSTLTKLVQRMYVPERGRVLVDSHDLSLADPAWLRRQIGVVLQENFLFNRSVRENIAMADPGIPLERVIHAATLAGAHTFISELPEGYDTKIGEHGTGLSGGQRQRIAIARALIGDPRILIFDEATSALDYESEHAVMQNMRAICKGRTVLIIAHRLSTVRNADRIVVIDKGKIVESGSHETLLNRNNGHYAHLYRLQ

SEQ ID NO: 9312 - protein, 443 aa, Xylella fastidiosa
GPEGWRLDAISRRQYSEDDSQCFACADAVALPRDLNEVVAIVRACRQHRVPVIPRGTGTGTVGGAVPLHGGIVLSLGRMNRIVALLPDDRCAVVQPGVINNDLQQALAPHGLFWPPDPSSTAMCSIGGNLATNAGGPRTVKYGATRDNVLGVVAVTGVGDVIRCGGAYTKNATGYDLAHLLIGSEGTLAIIVEATLKLAPQPQAIAGLRAFYQDTAAAAAAVSRLMSQPAIPATLEFMDHKAIELLYRNGSNIPMAGAMLLIEGDGNHDTLPYVLQALAQAASGEGLIDLDMAMDGAARDQLWAARKSLSPMLRTIKPGKLNEDVVVPVSRIPDLVAGIEVLATESGLPIVTFGHAGNGNLHVNIMYDDQDAEDIMRAQATLPKLFKLVLTLGGTLSGEHGIGVAKRDFMTQAFDTPTLAAMRAIKAAFDPEGILNPGKVLPR

SEQ ID NO: 9313 - protein, 288 aa, Xylella fastidiosa
MQFKDYYATLGVEPSAGEAEIKTAYRRLARKYHPDVSQEPGAEERFKAVNEAYEALRDPNKRAAYDQLRAQGYRPGDEFHAPPNFGGGHGFNFEEVFGNASGGHFSDFFESLFAGARAGGRHAGPGGGAKSQHGDTRSKLTVPLEAIYSGGSVRVTVNGRQLDVRVPKGIQPGKVIRLNGQGSYARHLLLEIEYAPHPQFEVDGHNILHTVQVTPWQAALGTSISVPTLGGSVELKVPPDSDAGRKLRLRGRGLPGPPPGDQIVELEITAPLATNDTQRKAYRALAKA

SEQ ID NO: 9314 - protein, 732 aa, Xylella fastidiosa
EGTHNKDWWPNQLRVDLLHQHSNKSNPLGETFDYAKEFQKLDYAALKRDLHALMTDSQDWWPADFGHYGGLFIRMAWHSAGTYRIGDGRGGAGRGQQRFAPLNSWPDNVSLDKARRLLWPIKKKYGQQISWADLIVLAGNVALESMGFKTFGFAGGRVDTWEPDQDVYWGRETTWLGGDVRYGAVSEGVHHPDEHRGAKEKAAKNSDLRVLENPLAAVQMGLIYVNPEGPDGCPDPLASARDIRETFARMAMNDEETVALIAGGHTFGKTHGAAPADNVGPEPEAGELEQQGLGWHNRFGSGRAGDTITSGLEVTWTKTPTQWSNDFFEHLFGYEWELTKSPAGAYQWVAKNAAATIPHAHDPSKKLLPMMLTSDLALRFDPVYEKISRHFHAHPDQFADAFARAWFKLTHRDMGPRVRYLGPEVPAEELIWQDPVPKVSHVLVDAQDLLALKQKISASGLGISQLVSTAWASASTFRGSDKRGGANGGRLCLAPQSQWEVNQPQQLSVVLETLRRVQAEFNAQAGDKRISLADLIVLAGGVGVEQAAKRAGIVVEVPFVPGRTDALQEQTDVSSFAPLEPFADGFRNYVKEGCVVPSEHLLIDRAQLLTLTAPEMTVLIGGLRVLGANVGGVKHGVFTDRLGTLSNDFFINLLDMGTEWAPVSKERHVFEGRDRRTGALKWTGTRVDLVFGSNALLRALAEVYAAVDAQEKFVRDFVAAWSKVMHLDRFDL

SEQ ID NO: 9315 - protein, 307 aa, Xylella fastidiosa
MQFDSNGRLRHLLTLEGLSRHTLLQLLDCAAQNCALGVDPMGKRNVLAGMAVCTLFFEPSTRTRHSFHLAAQRLGADVLNFDASMSSTSKGESACDTLKNLEAMGVRGFIVRHPEEIVIAQLAAVVGEGTVLINAGAGRSTHPTQGLLDMLTLCQAKGNDFSKLKLLFVGDIKHSRVARSNLHALRTLGAGQIRVCGPTTLLPHDGLLSGCVVSQDFDAMLEGVDVLMMLRLQRERMEEGLVPSLEHYHANYGLTAARLARAAPDAVVLHPGPINRGVEITDEVADGPQSWILRQASNGVMVRMAVL

SEQ ID NO: 9316 - protein, 832 aa, Xylella fastidiosa
SSSAVRLSTVETPVYVPRTVVHKFGGTSVADADCYRHVARLLLAREETVQVTIVSAMKGVTDTLIALAEQAANHSPDWQALWQQTRTRHCDAAQALLGEHAATLQDWLNTHFNELHEMLVALSVIGMLPSEVLDRLQGLGEVYSAQLLGEYLQFQGEDCVVLDARQVLVVSPGEFGAEVDWATSAQHLAHWRMQHPQRRVVVTGFVASDRTGRAITLGRNGSDYSGAIFAALFEADELHIWTDVDGVMSADPRVVPDAVQLDALSYDEACELAYFGAKVVHPQTMSPVMKRGVPIIIRNTFQPRHPGTRITADSVVSGSVKGLTLSPGLAVLNLEGTGLIGVPGTAERVFAALRNARLSVVMISQGSSEHSICCLVHQTEAERARDALLYAFAHELAIGHVQRVQLTNNISVLAAVGDGMAGHLGVAARLFESLRRAHVNILAIAQGSSERNISVAIDSQQATKALRAAHAAFWLSPQTFSIGVIGPGHVGEALLDQLCAAQQQLLSKANLDLRLRAIVSQRRMLLDERGLGSDWRHAFAAVPEAVDLDAFTAHLQAAHLPHAVIIDCSGSAEVADRYADWLAAGIHVVTPNKQAGSGPLHRYHAIRAAADASGARFRYEATVGAGLPVITTLRDLMDTGDSVTSIEGIFSGTLAWLFNKYDGSVPFSQLIAQARAMGYTEPDPRDDLSGVDVARKLVILARDAGRDISLEDVAVESLVPETLCQLSVADFMERLNEIDATFAERLAAAKQRGCVLRYVAQLSPGHVPSVSLIELPSDHAFVNLRLTDNVVQFTTRRYSENPLVVQGPGAGPEVTAAGVFADLLRVAAGEGA

SEQ ID NO: 9317 - protein, 292 aa, Xylella fastidiosa
RLRIAIQKSGRLTEPARRLLTACGLSWRQSRDKLFCYGESLPVDLLLVRDDDIPGLIAQGVCDLGIVGRNELDEQAASRRRNGLPVPYQTLRGLHFGQCRLMLAVPEEWEWQDISQLTGKRIATSYPAILADWLQTHHIAAQIVELSGSVEIAPRLGTADLICDLVSSGATLAAHQLKPVIQIMESQAVLAGMICQPADARAGLLAMLLRRIDGMVNLCDSNLLMFRAFQEHLDALTRLLPDADPLVQLPDDGSGTLRVQTMCHGAITWQRLEELERAGAQGLMVLTVERSL

SEQ ID NO: 9318 - protein, 425 aa, Xylella fastidiosa
IIDWNQLDTAAQAQTLTRPAQTIATQTREAVTALIEQVRRGGDTALRDITARFDGVDLATFEVTAAELAAAATAVAPELQHAMQTAAARIEAFHRAGMTNGYRVETAPGVVCERLVRPIARVGLYVPAGSAPLFSTALMLGVPARLAGCREVVLCTPPSKDGRANPAVLLAARLTGVTRVFTLGGAQAIAAMAYGTASVPTCDKVFGPGNSFVTEAKQQLAQAGVVAIDMPAGPSEVLVIADAAANPAFIAADLLSQAEHGPDSQVLLLSDSDALMTAVQTALALQLQQLSRAEIACQALAQSRFIKVATLETAFDISNRYAPEHLILALRQPRAWLHRVAAAGSVFLGDYTPEALGDYCSGTNHVLPTGGAARAYSGVSVSSFQNMISVQAASRSGIAEIGDCALTLARAEGLDAHANAVALRM

SEQ ID NO: 9319 - protein, 355 aa, Xylella fastidiosa
TVLDLVRQELRNFAGYSSARSVALTGDFWLNANESAWPNPADSHATMRRYPEPQPPKLRQMLAALYGCLPEQLLIGRGSDEGIDLLVRTVCEPRRDPVLVTPPVFGMYAVSAQLQNAPLIQVPLVDDAAGFHADVPAIITAAQTSRAKLVFLCSPSNPVGAAIPLQQIETILQTLAGTALVVVDEAYGEFSDVPSVVPLLARYPHLVVLRTLSKAHALAAVRIGSVIADAHLVAVLRRCQAPYPLPTPCVSLAEQGLSAAALQITAQRVAEIRAERERLRAALACLSGVRRVYPSQGNFLLVRFDDAEAAFQALYAAGVVVRDQRAAPQLHDALRLTVGTPEQNTRLLAVLRDIQ

SEQ ID NO: 9320 - protein, 371 aa, Xylella fastidiosa
VFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGVPQARITTGLPFFDHMLEQIAKHAGISLHISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 9321 - protein, 255 aa, Xylella fastidiosa
MLSRRIIPCLDVRDGRVVKGVKFRDHVDMGDIVELALRYRDHGADELVFYDIGASPQGRSVDYRWVERVARLIDIPFCVAGGIGEVETARAVLHAGADKISINSPALRQPALISALAEAFGVQCVVVGIDSIREADGQWRVRCNTGDPDKTQALPLRTLDWIVDAQRLGAGEIVLNCMDSDGVRCGYDIAQLSQARALCQVPLVASGGAGDMQHFADVFHKADVDGALAASVFHSGAISIPGLKQFLREQQIEVR

SEQ ID NO: 9322 - protein, 191 aa, Xylella fastidiosa
LDWAKGDGLLPVIVQDADTLRVLMLGYMNSQALEVTQRSRLVTFYSRSKQRLWTKGERSGHVLHVVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARH

SEQ ID NO: 9323 - protein, 457 aa, Xylella fastidiosa
SLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAALLAAVFPLDVLGELTSMGTLIAFTAVCAGVLILRCTRPDLPRPFRMPAAWLFCSAGVLSCITLLSAMTRHNWMLMSVWTVLGFSLYFSYGYHHSKLHQ

SEQ ID NO: 9324 - protein, 495 aa, Xylella fastidiosa
  unsure (1)..(495): unsure at all Xaa locations
LKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPMYWVIAPTGAAACLYLFWQPFTEHWPLMVGWTVLGLVMYGLYGYHHSKLRHGGXAISTQEAGATPA

SEQ ID NO: 9325 - protein, 439 aa, Xylella fastidiosa
TEPADLQHYGRDWTRRFTPAPLAIALPATVQEVQAIVRWANDAHIAIVPSGGRTGLSGGAMATNGELVLSLERMNKMLQFDPMDRTMTVQAGMPLEAVQAVARQHGLLYPVDFAARGSCSIGGTIATNAGGIRVVRYGNTREWIAGLNVVTGTGELLKLNHALIKNSSGYDFRHLMIGSEGTLGIVVEATLRLTDPPPPTKVMLLALPTFDVLMQVFAAFRAQLQIEAFEFFTQRALPHVIAHGAQAPFEHPYPYYVVTEFPCADAAQETTALTVFETCMEQGWVLDGVISQSDAQAAQLWRLRESITESIAPYTPYKNDIAVRIAAMPAFLEQAQTLLSQAYPEFEVLWFGHIGDGNLHINVLKPHTVPQTDFIHTCEHVTALLADLLQRFCGSISAEHGIGLIKKPYLHSTRSPAEIALMRQLKRAFDPKWILNPGK

SEQ ID NO: 9326 - protein, 252 aa, Xylella fastidiosa
MRLTPLPAFDNNYIWTLIAPDGRAIIVDPGQALPILEAHSKGLIPTAILLTHHHADHIGGVPELLERWPTLPVYAPHDTRIALNYHRIGEGDSLNILGMRFQVIHTPGHTHSHLTFIGNDLLFCGDTLFSLGCGQIFEGTPTQMLASLQRLAALPIQTRVCCGHEYTLSNAAFALHVDPTNTALQKRRQQANAMRLAGLPTLPISLESELNTNPFLRTAAPTIHAATSTHLQRTPIDEVEVFATLRHWKNNF

SEQ ID NO: 9327 - protein, 252 aa, Xylella fastidiosa
TTPVKIATRNLEFYYGTFQALKQINLEIPEKRVTALIGPSGCGKSTLLRIFNRIYALYPKLETRGEVFLDGENILSPKYSINRLRSKVGMVFQKPVPFPMTIYENVAYGIRHHEVMSKSQMNDRVEQALQQSALWEEVKDKLNQNALGLSGGQQQRLCIARAVALTPSVLLLDEPTSALDPISTSRIEQLIEELKTKYTIVIVTHNMQQAARVSDYTGFMYLGDLIEHDRTETIFSRPSKQQTEDYITGRFG

SEQ ID NO: 9328 - protein, 432 aa, Xylella fastidiosa
HTGIAPAEYGRRRRQLMKMVGPQGIVVLPAAPERVRSRDTHYPYRQDSDFWYLCGFPEPDAVLVLVPGRCHGQVLLFCRERDPEREAWDGPRSGYDGAIEQYGMDDAYPIDDLDEILPGLLEGRSHVYYHFGRDVEFDLRLIGWVNRVRDQVRYAADSPHEFIDLGHLLHEQRLFKSYDEIVLLQCAADISVEAHLAALRYAHPGVSEYVLQAELERVFRAADSCPAYTSIVAAGANACVLHYCANAECSRDGDLVLIDAGAEYRGYAADITRTFPVNGRFSPAQRALYDLVGAAYDVALAQARPGLPYEAGHLSAVQTLTEGLLRLGLLHGTLEDNLADQSYKRFYRHKTGHWLGLDVHDVGDYRIDGKSRLLEPGMVFTIEPGLYVLPDDTTVHPKWRGIGIRTEDDVLITEDGHCVLTGVLPRSADEIE

SEQ ID NO: 9329 - protein, 195 aa, Xylella fastidiosa
IMDHSKQQNASITQAQAEEAVRTLLRWAGEDPTREGLLDTPRRVVEAYGDWFSGYREDPHDYLQRTFEEISGYDEMIVLRNITYESHCEHHMAPIIGKVHVGYLPNGKVVGISKLARVVESYARRFQIQEKMTAQIAACIQDTLTPRGVGVVIEGAHACMTTRGIHKRGVSMVTSKMLGTFREDARTRAEFLQFI

SEQ ID NO: 9330 - protein, 306 aa, Xylella fastidiosa
  unsure (1)..(306): unsure at all Xaa locations
LERIGIKSDVFADIVGINARRLWNTNVQTSDVATMAARKALQDAGVAVDRIGLVVNTSVSRDYLEPSTASIVSGNLGVGEQCIAFDVANACLAFLNGMDIAGQMLERGDIDYALVVNAETANRVYEKTLERMSAPGVYRAGVPRGNGGLNPGVRCGGDGTGAYRFGAXCTSIQRGSDPLCDXMEQAMLRESGSHGYXHPLDAHXGDQTSKENLCCRKQVLGWAVEELDQFVIHQVSRPHTEAFIKSFGIDPAKVMTIFREYGNIGPASVPIVLSKLKELGRLKKGDRIALLGIGSGLNCSMAEVVW

SEQ ID NO: 9331 - protein, 560 aa, Xylella fastidiosa
MSQTRPWLQHYPSGISTEIDTDAFRTIADVFNTSVIKYRHCPAYTNFGKTLTYGEVDLLTKQFASYLLNVLKLKKGDRIALMMLNCLQYPVATFGALCAGLTVVNVNPLYTARELKHQLVDAGSTVLVVMDNFCTTVQQIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTSNSLKEGCETVLTALPLYHIFALTANSLVFMKIGGCNHLISNPRNMRAFVKELQRVRFTVITGVNTLFNKLLNTPGFDKLDFSSLKIALGGGMVIQRSVAEQWKQVTHVPLIEAYGLTEASPAACINPLNLQEHNGSIGMPIPSTDVCIKDDTNGVLPIGEMGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPA

SEQ ID NO: 9332 - protein, 901 aa, Xylella fastidiosa
MRDSFSTHRQLHVGNQSYHYYSLTKLGEHFDISHLPYSMKILLENLLRHEDGGVTVSTAHIEAVTKWNPKAEPDTEIAFMPARVVLQDFTGVPCVVDLAAMRDAAIRLGGTAEQINPHIPSELVIDHSVQVDVFGKPEALEHNGNIEFQRNKERYGFLRWGQKAFNNFKVVPPNTGIVHQVNLEHLARVVMTTEKEGATWAYPDTVFGTDSHTTMINGIGVLGWGVGGIEAEAAMLGQPSSMLIPQVVGFKLTGTLPEGATATDLVLTVTQMLRKHGVVGKFVEFYGDGLAHLPLADRATIGNMAPEYGATCGIFPIDTESLNYLRLSGRSESQIALVQAYAKAQGLWYAPNTPPPSYSTTLELNMDDIKPSLAGPKRPQDRVLLQDVQNNYREHVRALTAHRTTKANDHDTHPIKGQVDLDINGQTLQLKDGAVVIAAITSCTNTSNPAVMFGAGLLARNAVAKGLQRQPWVKTSLGPGSRVVTDYLEKAGLLNDLETLGFYVVGYGCTTCIGNSGPLPPEVSAGIAKGDLVAAAVLSGNRNFEGRIHPEVKMNYLASPALVVAYAIAGTVNSDLTSEPLGNGNDGQPVYLRDIWPSNKQIGDAIAATIGPEMFQQNYADVFKGDTRWNTIASPNGALYAWDAHSTYIKNPPYFDGMTMQTEPVKDVRGARVLGLFADSITTDHISPAGNIKQDSPAGRFLQEHGVQPTDFNSYGSRRGHDDVMVRGTFANIRLKNLMLNGEEGGNTWYRPQAGGPPEKMSIYDAAMKYNTDGVPLVVIAGKEYGTGSSRDWAAKGTKLLGIKAVIAESFERIHRSNLVGMGVLPLQFLDGQNAQTLGLDGSEMFDVTGLEGTISKHATVSAKQSDGSIKQFQVKVLLLTPKEVDYFTHGGLLQYVLRHL

SEQ ID NO: 9333 - protein, 247 aa, Xylella fastidiosa
MRPKIVAGNWKLHGSHAFAQALVAQVAAGLPLPGVSVIILPPLLYLSDLVQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLDLVGPQGVARGLIAYEPVWAIGTGRHADPSQVQAMHAFIRGEIARQDARIGDSLLILYGGGIKPCNAAELFSQQDVDGGLIGGASLVADDFLAIARA

SEQ ID NO: 9334 - protein, 606 aa, Xylella fastidiosa
VTIEIDGQNLVVPKGSMIIQAADNAGIPIPRFCYHEKLPIAANCRMCLVDVEKVPKPLPACATPVMEGMKVRTRSEKALQYQRSVMEFLLINHPLDCPICDQGGECELQDVSMGYGRSVSRFHERKRVVPDEDIGPLVATEMTRCIQCTRCVRFTADIAGTYELGGMYRGENLQIGTYDGKPLITELSGNVVDVCPVGALTNKVFQFRARPWELMAYQSLGYHDAMGSNLFLHVRQGEVLRTVPRDNEYVNECWLSDRDRYSHQGLYAADRAVKPLKKVGGQWLEVSWAEGVSAAVEILSAHRGDALGVLVHPATSNEEGVLLARLAAGLGTGHLDHRIFNRDFSDVAVAEPFALPLAEIGNADLVVLFGSNIRQELPLLHARLRKAVTCNGAKVYAVNPVDFDFTFSLTGKSIVPPSQLANALTDTALLNATKAAARVVIVVGALAENHPQGATLRAAARQFAEVTGAALCRIPQGANAIGLTQHGVLPTGRDAAAMLVEPCQAYVLYGIEPGLDFADTATARQALHGAKVVAFSHFACASTRDVADVILPIGLLPEIDGTLTNLDGRTQAAKPGGKLPLEAREGWRVLRALGGELGLSGFDFLD

SEQ ID NO: 9335 - protein, 245 aa, Xylella fastidiosa
MTLRIAYVTSGMGSIGTAICQKLARNGHTVVAGCGPNSPRKANWLREQRELGFDFIASEGNAADWDSTVSAFAKVKAEVGEIDVLVNNAGNNRDMLFRQMGREDWNSVISSNLNSLFNITKQVIDAMTARNWGRIVNIGSVSAHKGQIGQVNYATAKAAMHGFTRALAQEVATRNVTVNTISPGYIASAAISSFPPDVLDRLANSVPMRRLGKAEEVAGLCAWLVSDEAAYVTGADYAVNGGLRM

SEQ ID NO: 9336 - protein, 423 aa, Xylella fastidiosa
PFYLQLYFWVIIAIILGALLGHCYPAVGQQLKPLGDAFIKLVKMIISPVIFLTIVTGIASVAHVGTVARVFGKAMVYFLFFSTLALLLGLVVAHVVHPGAGMNINPVDLHQGEIANYVEKSHDLTLVGFLMDIIPKTLLSPFVGDNILQVLFVAVLFGIALALAGERGKPVLNLLDALTVPVFKLVQMLMKMAPIGAFGAIAFTIGKYGVDSLVNLGWLVGSFYLTSLLFVLVILGAVSWLCGFSILKLIRYLKAELLLVLGTSSSESALPSLMEKMVQAGCRKSVVGLVVPTGYSFNLDGTNIYMTLAALFIAQATNTELTPAHQLALFLVAMLSSKGAAGVSGAGFITLAATLAVVPEVPIAGMALILGVDRFMSECRSLTNFIGNAVATLVVSRWENALNYEQLKIALDGSEAAYQSLHA

SEQ ID NO: 9337 - protein, 629 aa, Xylella fastidiosa
LEADKQTHGFQTEVKQLLQLMIHYLYSNKEIFLRELISNAADAADKLRFEALSAPSLLEEDPNLRIRVEFDKQAHTITIDDNGIGMSRDEAIAHLGTIAKSGTADFLKTLSGDQRKDANLIGQFGVGFYSAFIVADHVDVYSRRAGLTAAEGVHWSSKGEGNFEVATIDKPQRGTRVVLHLKENEQHFAEGWTLRSTLKKYSDHIGLPIEMLKEHHGKEEEKDTPQEAEWEAVNKASALWTRPKNDIKDEEYQEFYKHISHDMTNPLAWSHNKVEGKLEYTSLLYVPTRAPFDLYHRNAAKGLKLYVQRVFIMDQAEQFLPLYLRFIKGVVDSADLSLNVSREILQSGPVVDSMKAALSKRALDMLEKLAKDAPEDYKTFWKNFGQVLKEGPAEDYSNREKVASLLRFASTYDTSGDPSVALTDYIARMKEGQDKLYYLTGESYAQIKDSPYLEVFRKKGIEVLLLVDRIDEWLMNYLHEFDGKSFVDIARGDLDLGNLDSEADKKAQEEIAKTKEALASRIKATLGEDVAEVRVSHRLTDSPAVLAIGEGDLGLQMRQLLEANGQKVPETKPVFEFNPSHPLIEKLDAEQDMDRFADLSHILFDQAALAAGDSLKDPANYVRRLNKLL

SEQ ID NO: 9338 - protein, 332 aa, Xylella fastidiosa
TMALKHFLNTQDWTCSELNALLTQARAFKHNKLGNALKGKSIALVFFNPSMRTRSSFELGAFQLGGHAIVLQPGKDAWPIEFDTGTVMEAETEEHICEVARVLGHYVDLIGVRAFPKFLDWTYDRQDIVLNSFAKYSPVPVINMETITHPCQELAHIMALQEHFGTTDLRGKKYVLTWTYHPKPLNTAVANSALTIATRLGMDVTLLCPTPDYVLDERYIDWARQNIADTGSTFQVSHDIDNAYRGADVIYAKSWGALPFFGNWAMEKPIRDQYRHFIVDEAKMALTNNAVFSHCLPLRRNVKATDAVMDGSNCIAIHEAGNRLHVQKAIMA

SEQ ID NO: 9339 - protein, 386 aa, Xylella fastidiosa
VLAFSGGLDTSFCIPYLKEQGYAVHTVFTDTGGVDEDERDFIEKRAAELGVASHLTVDGGPSIWDGFVKQLVWAGEAYQGQYPLLVSDRYLIVDAVLQRADALGTCAVAHGCTGMGNDQVRFDLAIKAQGDYTIIAPIREIQKEHTQTRLYEQKYLEERGFGVRAKQKNYTINENLLGITLSGGEIDKWEAPGEGARGWCAPRSAWPTDPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQAKVNGEIVLETRGGRVDAVAVRSPHILTSKGVTYAQTADWGIEEAEGFIKLFGMSSTLY

SEQ ID NO: 9340 - protein, 767 aa, Xylella fastidiosa
  unsure (1)..(767): unsure at all Xaa locations
PGRVRPPTTANPMHANLQTRQIIIRLLSSMASAKEISQYLKRFSQLDAKRFAVVKVGGAVLRDDVDALTSSLSFLQEVGLTPIVLHGAGPQLDEELTAVGIQKKTVNGFRVTLPETMAIVRKVFHATNLQLIEALQRNGARATSITGGVFEAHYLDQETYGLVGGISAVNIAPIEASLRAASIPVIASLGETPSGQILNINADVAANELVHVLQPYKIIFLTGTGGLLDADGKIINSINLSTEYEQLIQQPWVYGGMKLKIEQIKHLLDRLPLESSVSITRPADLAKELFTHKGSGTLIRRGERVIRATTWKDLDLPRLQHLIQSSFRRTLIPHYFETTPLLRAYVSENYRAAVILTKLGNVPYLDKFAVLDDAQGEGLGRAVWSIMREETPQLFWRSRHNNQANAFYYAESDGYYKQDHWKIFWNGLHHFQQIQQCVAHCTQHPPTLIDXRXAPPPSPLALLGARGYTGAALITLLTAHPAIELIFVSSREYHGQPVAAHNPTYCGDLRFETLGPAAVAAKRADVVILALPNGNAAPYVHAIDATAPPTIIIDLSADTRFDPDWYYGLPELTRHTYTGQKRISNPGCYATAMQLAIAPLRDQLAGPPQCFGVSGYSGAGTTPSDKNNQALLRDNLMPYALTDHLHEREVSAQLGIPVEFMPHVAPHFRGITLTANLWLQRPLTREHIKTLYATRYANDPLIDIIDPPPWVNQIAARHTVQIGAFTMAPGNKRVVIVATLDNLLKGAATQALQNLNRALGLDELTAI

SEQ ID NO: 9341 - protein, 397 aa, Xylella fastidiosa
AIDASIQTFLAADDVLLDREFFLYDITASTAHAQALQRIGLLTPDELDNILRELQHLSDEYRNGTFLLDTQYEDGHSAIESRLTERLGDTGRKIHTGRSRNDQILVATRLWLKDRLTQLSTLNRDIAHHALQRAAAEQHLPMPGYTHLQRAVVSSAGMWWAGWAESFIDNALRAADTLALIDCNPLGTAAGYGVNLPLDRPHTTTALGFARLQVNPICAQLSRGKFELAALEALGSATLDLRRIAWDLSLFTTSEFAFITLPPEYSTGSSIMPNKRNPDVIELMRATHASVAAARTEIEQLLSLPSGYHRDLQNSKGAIVRGFNRGLAALELLPALLSRLQWCPDTLRAAIDPGMYATDAAIEAAIAGIPFRDAYQMAAKTADTAAQDRTPETSLTA

SEQ ID NO: 9342 - protein, 411 aa, Xylella fastidiosa
IRHLAQQCRDAARILATLSTDAKRRLLETMATALNTDAATILAANAADLDAARTQQVGTAMLDRLALDPQRLAAMADALRDIAALPDPVGQVTRDDRRPNGIHIQKIRVPLGVIAMIYEARPNVTADAAALCIKAGNGIILRGGSEAIRSNIAIATALQRALRLASLPETALILVQDMARHTMLELLQLSDLIDLVIPRGGEGLIRFVAEHARIPVIKHYKGVCHQFVDASADIKMAIRLLIDGKTTRPAACNALETLLVHTDIAPRFLPAAAAALRPYGVQLRGDHATCTLLPDVLLATDADYAAEYLDLILAIRIVPNLDAALEHIRRYGSDHTEVIVTADPAHADTFVQQLHSAVVMVNASSRFSDGGALGLGAEIGISTTRLHAYGPMGLDALTVERFVVRGQGQVR

SEQ ID NO: 9343 - protein, 320 aa, Xylella fastidiosa
LSLPQIQSFAASDMAAIDTLIHDRLTSDIVLINQIADHIICSGGKRLRPMLTMLAGHAIGHTGPHHHQLAAIIEFIHTATLLHDDVVDGSELRRSSSTANALWGNAPSVLVGDFLYSRSFQLMTELANLEVMQILAETTNRISEGEVLQLLHVHNPDTDETTYLSVIERKTAILFAAAAQLGALASHADTQTQTRMYEYGMQLGYAFQITDDVLDYTANNSQLGKNLGDDLAEGKATLPVIHAMTHSDAATCERLRMIISKGDSDAMPEVLNAIRTTGSLDYSRQRASAYAATAERALEGLPETEAVAALRGLARYAVQR

SEQ ID NO: 9344 - protein, 564 aa, Xylella fastidiosa
MNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGELLLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDAHYVPMLLALGLTEFSLHPATLLEVRRVIRNSDLGTLKTSVTTLLRARDPEEHRR

SEQ ID NO: 9345 - protein, 424 aa, Xylella fastidiosa
MSKIVVAGGTPLYGDVRISGAKNAVLPILCATLLADAPVEISNVPYLHDVITMINLLRELGAGVTMNEGIEAKGRSITIDPRWVRQRVVPYDLVKTMRASVLLLGPLLACYGAAEVALPGGCAIGSRPVDQHIRGLQSLGAEITVENGYIKASVSQGRLKGGRFVFDVVSVTGTENLLMAAAVAQGTSVIENAAMEPEVVDLAECLITLGARVEGAGTPRIVVEGVERLNSGQYAVLPDRIETGTFLVATAMTGGRISMQQVRPQTLDAVLGKLTEAGACIEIGADSIRLDMQGRRPCSVNLTTAPYPGFPTDMQAQFMALNCVAEGVGVIKETIFENRFMHVDELLRLGAKIQIEGHTAIVQGVERLSGAPVMATDLRASASLILAGLVAEGETIIDRIYHLDRGYENIERKLGVLGASIRRM

SEQ ID NO: 9346 - protein, 389 aa, Xylella fastidiosa
SLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFRGSFHGRTLGAVTATAQPKYQEGYEPLPGGFRYVDFNHIEALEAAMVGGDVAAVMLEPIQGEGGVMPVVSGYLAQVRALCDRYGALLVLDEIQCGMGRTGALFAYWQEKVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAAEHGVLLLQAGPDVLRFVPALNVSDEELADGLVRL

SEQ ID NO: 9347 - protein, 741 aa, Xylella fastidiosa
MFSKDLEQTIGQCYKRTREACHEFMTVEHLLLSLLDNPLAHAVLKACGADVTRLKRDLEQAIEVSITRLDADDGRDTQPTLGFQRVLQRAVYHVQSSGKKEVTGANVLVAIFGEKDSHAVYFLNQQDISRLDIVNYLSHGITRMGEESDIGQAAENEAKGESEANKGDALAEYAINLNEHARNGRIDPLVGRKDEIERTIQVLCRRRKNNPLYVGEAGVGKTAIAEGLAKRIVDRSVPEVLADAVIYSLDLGALVAGTKYRGDFEKRLKGVLSVLRKTPNVVLFIDEIHTIIGAGSASGGTMDASNLIKPALASGELRCIGSTTFQEYRGIFEKDRALARRFQKIDIVEPTAGEAFEILQGLKPKYEAHHGVTYADDALRAAVDLSVKHIGDRLLPDKAIDVIDEAGARQRLLPEKERKELIDIEEIETIVTKMARVPAKQVSVSDKDVLKHLERNLKMVIFGQEPAIEMLSSAIKLARSGLGNPDKPIGNFLLAGPTGVGKTEVTKQLAHHLGIELVRFDMSEYMEPHSVSRLIGAPPGYVGFDQGGLLTEKIVKTPHCVLLLDEVEKAHMDVFNILLQVMDRGVLTDTNGREASFKNVILVMTTNAGASQSSRRTIGFTKQDHTSDAMEVICRSFSPEFRNRLDAIVQFQPLGFSHILRVVDKFIIELEMLLQEKRVVLSATPIARDWLAQHGFDPLMGARPMARVIQEKIKRPLADELLFGKLLNGGRVGIDVRDNEL

SEQ ID NO: 9348 - protein, 245 aa, Xylella fastidiosa
MSDPSKVALITGGARRIGKAIVHHLHAHGYRVAVHAHQSGHELHAFLTELERRRPSSTLALLGDLHENAVPETLIARCAGHFGRLDVLINNASNFYPTPLGEVTPAQWDDLFAINAKAPFFLAQAATPLLRKHRGAIINLTDLHGTQPLRQHAVYTAAKAALEMLTRSLALELAPQVRVNAIAPGAILWPTQGIAEAAKQALLARTPLARTGTVEEIAEAVLWLLESANFITGHTLRLDGGRTLT

SEQ ID NO: 9349 - protein, 446 aa, Xylella fastidiosa
MRVSRYFGTDGIRGRVGQGLISADFVLRLGNALGRVLAQGRDTRPMVLIGKDTRISGYMFESALEAGLVAAGADVQLIGPMPTPAIAFLTNTLRADAGVVISASHNPHDDNGIKFFSAMGEKLDDATEAAIEAAIEAPFLTVDSEYLGKVKRTRDAIGRYIEFSKASVPRGFTLRGLKLVLDCAHGATYHIAPMLFRELGAELVTIGVDPDGLNINAGVGSTHLETLAATVRESGADLGIAFDGDGDRVLMTDAQGRTVDGDDLLYVLARAWRASGRLKGTVVGTLMSNYGLEQALGTLGIPFIRARVGDRYVHQALVESGGVLGGEASGHLLCLDRATTGDGIVSALQVLEVLRHEGLTLSQALLGLHKVPQKTVNVCWSGPARAAVEMPEVRQALVEAQAAVQGRGRVFLRPSGTEPVVRITVEADDVVLMQQTLDRLADVVRD

SEQ ID NO: 9350 - protein, 271 aa, Xylella fastidiosa
LHFTKMQGAGNDFVVLDLRDGTPPPDAALVAWLADRHFGIGCDQVIAIEPPRGVGVFAAYRIWNADGSAAQQCGNGARCVAAWLVRDGSVATEHFLIDSPVQTHSVRCIGKDEYAVEMGLPVFEPERIPLSGFPNALGEYVLSLQGEVLRCGAVSMGNPHAVVEIDLIDVAPVERIGPLLQQHAAFPESVNVGFVQVIDPGLVRLRVYERGAGETLACGSGACAAAVVLMQRGRVGRDVRVVLPGGTLRVQWPVSGGPVTLSGPARCVFDG

SEQ ID NO: 9351 - protein, 307 aa, Xylella fastidiosa
FRVATGLDSMVLGESQILGQVKDSWSMARTHGTLGNTLDRLFQHSFSVAKHARTNTRIGTNPVSIASTAVRLAQDAFSPLNESTVLLIGTGETIQLAAKHLSEGRVQRLLIANRTHAQAQMLASQHGGYALPLTELNLHLAEADIIFSATAAPTPIVTQSNVESALHIRKRKPMLLFDLAIPRDIETEVGTLTDAYLYTIDDLERAVEENRRSRREAAETAEAIIELQVKRYMDTLQAHAHQAPLRRLRTFGTTTRDELLTRARQQLANGRPAGEVLEQLAHGLTNRLLHPPTAALREAALANNTEL

SEQ ID NO: 9352 - protein, 335 aa, Xylella fastidiosa
YSLFRPLLFTCDTERAHDISLRTLDIAYHSGALPLLTRHTRPLPTTAFGLNFPNPVGLAAGLDKNGTHIDALFALGFGFIEIGTTTPRPQAGNPKPRLFRLTQQQAVINRMGFNNLGVDALVRNVAGARRRNGPLGINIGKNKDTPNEQASNDYRYCLERVYALADYVTINLSSPNTAGLRALQEEQTLRRLIGELRETQETLAAKHGRHVPMLIKMAPDLSDSDIDAAARVLNEMSVDGVIATNTTVTRPLLRQHPLASEAGGLSGAPLLGQSTLVLRRLRTHLPETIDLIGVGGICCGADAGAKMAAGASLVQCYTGLIFKGPQLVGECVEAI

SEQ ID NO: 9353 - protein, 287 aa, Xylella fastidiosa
QMVDVLYTKNIEMTRQKPSSGPGFWSLVLNFLPVILIIGFWVFIMRQMQGGGAKVAMSFGKSRAKLQGDDQIKITFADVAGCDEAKEEVGELVDFLRDPTKFTKLGGKIPRGVLMVGPPGTGKTLLAKAIAGEAKVPFFSISGSDFVEMFVGVGASRVRDMFEQAKKHAPCIIFIDEIDAVGRHRGAGLGGGHDEREQTLNQLLVEMDGFEGGEGVIVIAATNRPDVLDPALLRSGRFDRQVVVALPDVKGREQISRVFYMRKLLLANDVEPSRDCRGTLWFFGYDL

SEQ ID NO: 9354 - protein, 287 aa, Xylella fastidiosa
  unsure (1)..(287): unsure at all Xaa locations
LIKFKPTSPGRRSAARVVTPNIHKGSPHASLLESQSKTGGRNHHGRITVRHIGGGCKQRYRVIDFKRDKEAIPARVERIEYDPNRTAHIALLCYIDGERCYIIAPKGLKEGDKIISGPNVPIKLGNSLPLRNIPVGTTVHAVELKPRKGAQMARSAGSSVQLVAREGVYATLRLRSGGKCVRVAGLSWXXATNLVXWLVXXRKLXXXRKSXGKGLVXXKGWSWGXLSYWCRXCXCYEXSCLXLSSXGGGEAKSGQGNPHPVTPWGVPTKGYKTRKNKRTQQFIIRGR

SEQ ID NO: 9355 - protein, 222 aa, Xylella fastidiosa
ARRPKDPAILAERSGVISFGKDTKGKQRLIIKDADGSEHEELIPKYRQIIVFEGEHVTKGETIVDGEPSPQDILRLLGIEPLAAYLVKEIQDVYRLQGVKINDKHIEVITRQMLRKVEIVDQGNSKFLNGEQVERQRVIDENAKLIARNELPAKYNPVLLGITKASLATESFISAASFQETTRVLTEAAVRGTRDNLRGLKENVIVGRLIPAGTGQTYHSQR

SEQ ID NO: 9356 - protein, 375 aa, Xylella fastidiosa
LTNLNFSSFDLHPALLTGLTRAGFTLCTPIQALTLPVALAGSDIAGQAQTGTGKTLAFLVVVVNRLLSRPGLVNRNPEDPRALILAPTRELAIQIYNDAVKFGGNLGLRFALIYGGVDYDKQREMLRKGADVVIATPGRLIDYLKQHEVVSLRVCEICVLDEADRMFDLGFIKDIRFILRRLPERCSRQTLLFSATLSHRVLELAYEYMNEPEKLVAETESVTTTRVRQRIYFPAEEEKIPLLLGLLSRSEGMRTMVFVNTKVFVEGVARALDEAGYRVGVLSGDVPQRKRETLLNRFQKGQLEILVATDVAARGLHIDGVNYVYNYDLPFDAEDYVHRIGRTARLGADGDAISFACERYAMSLPDIEAYIEQKI

SEQ ID NO: 9357 - protein, 272 aa, Xylella fastidiosa
LSGIITALVTPFDRDGAFDRDAWIRLLDMQLAGGVQGVVIAGSTGEAATLTDAEYDEMLCSAVVRVGGRVPVLAGTGLSGTAKTISQTKRAADNGAGYALVVTPPYIRPNQGGLKAHYLAVADQGGLPVVLYNVPSRTGCDLLPETVADLAEHTNIVGIKEACASHERVQALLALRRPGFAVFSGDDSSAARSMLDGADGLVSVASNVLPSAYRHLCDLARAGERGAIDLWNARLSDFHAFCGLDSNPIPIKALLQRIGIGYGLRLPLLPLS

SEQ ID NO: 9358 - protein, 234 aa, Xylella fastidiosa
LVTGGSGHLGTAICRQLIADGAHVIVHANHHRSRADTLVECLCAEGGSAEVIVFDVTAAQASKTALENLLQAGPIQIIINNAGIHDDAPMAGMSSTQWHRVIDVSLHGFFNVTQPLLLPMARTRWGRIVCISSVTAVLGNRGQSNYAAAKAGLHGAARSLAREMANRGITVNVVAPGVIESEMVGKTFTPEMIKQLVPTGRPGRPEEVAALIGFLCSEKAGYINGQVIGINGGM

SEQ ID NO: 9359 - protein, 270 aa, Xylella fastidiosa
WPAPAKLNLFLQITGRRVDGYHELQTVFRLLDWGDTIHLRVREDGQIHRIGESVTGVVEADDLVVRAAYLLKHATNVYLGADIFVEKRIPVGGGFGGGSSDAATVLLVLNALWHTRLDVAVLAALGLRLGADVPVFVHGCNAWAEGVGECLTPMILPGAAYLLLDPGVCVPTRELFLDPDLTRDASPATIGDFIAGTAFGNAFEPVLRRRESAVAGALDMLSEVGFARVTGSGSGCFVEFSTRDEAECALERLPYGLCAWVADGASRSPL

SEQ ID NO: 9360 - protein, 311 aa, Xylella fastidiosa
  unsure (1)..(311): unsure at all Xaa locations
NLMVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISVIGADRVLTIDLHADQIQGFFDVPVDNVYASPLLLADIWRAYGTDNLIVVSPDVGGVVRARAMAKRLGDTDLAIIDKRRPRANVATVMNIIGEVNGKTCVLVDDLVDTAGTLCAAAVALKQNGATKVVAYITHPVLSGPAVDNINNSELDELVVTDTIPLSDAARECEKFASLCGELLXDYSGMLWXSVSHVVDD

SEQ ID NO: 9361 - protein, 796 aa, Xylella fastidiosa
DNLIKQFTQSSPLAGGNAAYIEDLYEQYLVLPNSVDPKWKAYFDGFKGRDAGDIPHSAVIAHITDTAKQSVKQGPSDERERNIGRLITAYRSRGHLGARIDPLGLAPPSNPPDLDLPFHNLSQADLDNEFSTGGIGGQPRMKLRNLLAHLKATYTDTIGTEFMHISEFEQRQWIYRRLESVSGKIASNATNRKRILERLTAAEGLERYLHTKYVGQKRFSLEGGDALIPLMDTLVRQAGNNDVKDIVVGMAHRGRLNVLVNTLGKNPRKLFDEFEGKFEHAHHDRAHTGDVKYHMGFSADIAVGDGKQVHLALSFNPSHLEIVDPVVAGSVRSRQERFGDTERKTVLPILIHGDAAFAGQGVVMELLQMSQARGFAVGGTLHVIINNQIGFTTSARDDARSTPYCTDVAKMIGAPVFHVNGDDPDAVVFVAQLAYEFRQQFKKDVVIDLVCYRRWGHNEADEPAATQPVMYQTIRKHKTTRELYATKLEGEGVIAAGEAKAMVDDYRAKLDSGQVTTELASKHTDEFVIDWSKYLSGKLEDTVKTSVKRQTLNKLAALINTTPATVELHPRVAKIYEDRIKMAAGEQPGDWGFAENLAYATLLAEGHKLRLVGQDAGRGTFFHRHAILHDQKTDSYYLPLRQLVSNPDDATVIDSLLSEEAVMGFEYGYSTTDPNTLCIWEAQFGDFANGAQVVIDQFIAAGEVKWGRISGLSLFLPHGYEGQGPEHSSARLERFLQLCALENMLVCVPTTPAQAFHMIRRQMRMSTRKPLVVMTPKSLLRHKLAVSTLDERATGS

SEQ ID NO: 9362 - protein, 297 aa, Xylella fastidiosa
DDLRIRKIEPLTPPNKLLLQLPCDEQASLTVATSRNALHDILHGHNDRLAVVIGPCSIHDPIAAIDYAQRLHPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGKVPNYDAINVEAASQTLLKSKLPVRLMIDASHANSGKNPNNQPKVIENIVEQLKAGERRIIGVMIE

SEQ ID NO: 9363 - protein, 413 aa, Xylella fastidiosa
  unsure (1)..(413): unsure at all Xaa locations
MNFHEYQAKQLFAEYGIPVPAGRIASSADEAVTAAKSLXATGPPLXXGXHXLVKAQIHAGGRXXGPRXXXXXVXXXXLQDNRRSETGRSXTSAPXYPXXXXXXTYXSQQXLXXXXFXVXPVNLVLVTEAGEITKELYLSVLVDRGTRSITYIASSEGGVDIEHVAAETPEKIQTLNVDFVEGLQPYQGRDIGFHLGLEAKQVNQLSKIMISLYQLFNDKDLSLIELNPLAILSNGDLYALDGKINSDDNATFRHKELAAMRDKTQEDETEVLASENDLNYVTMDGNIGCMVNGAGLAMATMDVIKLNGGEPANFLDVGGGATKERVTTAFKLILSSNKVKAIFVNIFGGIVRCDMIAEGIIAAVKEVGVKVPVIVRLEGTNVDAGKQLLATSGLAIIPADDINDGAKKAVAAV

SEQ ID NO: 9364 - protein, 551 aa, Xylella fastidiosa
MTEIKEAFVPDIGDYSNVPVIEVLVAVGDTVSKGQSLITLESDKATMEVPSSTTGIIKEIKVKVGDTLSQGHVVALIEVSEETAEITTPMTVNTPTTRAHNTAPPEDGGSLIEVRVPDIGDYTNVPVIEVLVAVGDTVSKDQSLITLESDKATLEVPSSATGVIKQLKVNIGDTLSQGDIVVVLQSAESIPLTPATNKPALPPNSSPARDAISAPASPAGDTEHPTDYLRCQHRATVQGPLCQPRSTPACTPVRRGPEPHQRQREKWRITREDVQKFVNATLGTGMAEGRTPSASITTNGGLNLLPWPNVDFSKFGEIETQPLSRIKKISGANLARNWAMIPHVTQFDQADITQLEALRVQINKENAASNKNGTGIKLTVLAFLIKASAAALKKFPTFNASLDATGETLTLKKYFHIGFAADTPNGLVVPVIRNVDQKGIVEIAQETSDLAKKARDGKLTPADMSGGCFSISSLGGIGGTAFTPIINAPEVAILGVSKSLIQPIWDGTQFAPKMLLPLSLSYDHRVIDGALAAHFTTYLSQILADMRRVLL

SEQ ID NO: 9365 - protein, 389 aa, Xylella fastidiosa
SLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWSAAQGRLPEHRTIVTFRGSFHGRTLGAVTATAQPKYQEGYEPLPGGFRYVDFNHIEALEAAMVGGDVAAVMLEPIQGEGGVMPVVPGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLVSVEIAANVQRQSVALRAGLEEISEAFGGVFTQVRGRGLMLGAVLAPLYAGQASAILEVAAEHGVLLLQAGPDVLRFVPALNVSDEELADGLVRL

SEQ ID NO: 9366 - protein, 252 aa, Xylella fastidiosa
TTPVKIATRNLEFYYGTFQALKQINLEIPEKRVTALIGPSGCGKSTLLRIFNRIYALYPKLEARGEVFLDGENILSPKYSINRLRSKVGMVFQKPVPFPMTIYENVAYGIRHHEVMCKSQMNDRVEQALQQSALWEEVKDKLNQNALGLSGGQQQRLCIARAVALTPSVLLLDEPTSALDPISTSRIEQLIEELKTKYTIVIVTHNMQQAARVSDYTGFMYLGDLIEHDRTETIFSRPSKQQTEDYITGRFG

SEQ ID NO: 9367 - protein, 613 aa, Xylella fastidiosa
YPRLSRIQTPEDLRAFQESELRAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGFAELLNAEGIVLPIVHLGLPDAFQQHASREDLLAEAGIDAAGVYAALLS

SEQ ID NO: 9368 - protein, 171 aa, Xylella fastidiosa
  unsure (1)..(171): unsure at all Xaa locations
LIGPNCXGVITPGECKIAIMPADIHKPGHIGIVSRSGTLTYEAVKQTTDVGLGQSTCIGIGGDPINGLNFVDALKLFNNDPQTKGIIMVGEIGGDAEEAGAEYIKHHVKKPVVGFIAGASAPKGKRMGHAGAIASGGSGTAEGKFAAMEKAGIKTVRSPGDLGAAIASLVR

SEQ ID NO: 9369 - protein, 419 aa, Xylella fastidiosa
ARIAVVGLGYVGLPLAVAFGRQRPTLGFDIDICRVQQLCAGHDITCEIELEELQAARHLRYSSDPRELSDCQIFIITVPTPIDVAEQPDLGPLRSASMLVASVLKPGDLVIYESTVYPGTTEEVCVPLLEAGSGLRFNVDFHCGYSPERINPGDRKRRLQDICKILSGSTPDITAVVDALYSQIIVAGTWCAPSIRVAEAAKVVENIQRDVNIALVNELALIFDRLGIDTLDVLEAAETKWNFLPFRPGLVGGHCIGVDPYYLLHKSESVGYYPDLIHTARRVNSRVSRHVVDRVVALLGELSVPMTRAVVLVLGVTFKEDCPDLRNSRALDLVRMFRNLGAQVDVCDPCADPQQALEHEAVTLCTEPKAGAYDAIVLAVAHAQYRMYDVATIAALGKPQAVVYDVKSVWPRAAVTDRL

SEQ ID NO: 9370 - protein, 511 aa, Xylella fastidiosa
LNPSEISELIKTRIEQVKLSAESRNEGTVTSVSDGIVRIFGLADAMQGEMIELPNKTYALALNLERDSVGAVILGDYKHLREGDVAKTTGRILEVPVGKSLLGRVVNALGEPIDGKGALGPTQTAPVERVAPGVIWRKSVDQPVQTGYKSVDAMIPIGRGQRELIIGDRQTGKTAMAIDTVISQKDTGIKCVYVAIGQKASTIANIVRKLEENDALDHTIVVAATASESAALQYISAYAGCTMGEYFMDRGEDALIIYDDLSKQAVAYRQISLLLKRPPGREAYPGDVFYLHSRLLERAARVSEEYVEKFTQGEVKGKTGSLTALPIIETQAGDVSAFVPTNVISITDGQIFLETDLFNAGIRPAVNAGISVSRVGGSAQTKIIKKLSGGIRISLAQYRELAAFAQFASDLDETTRKQLERGQRVTELMKQKQYTSMSVANQALSIYAVNEGYLDDIPVDKVLTFEEGLHAHFSNTQGALIDKINNSGDWDNNIEAAFKQHIEEFKTTGSW

SEQ ID NO: 9371 - protein, 287 aa, Xylella fastidiosa
MASGREIKSKIKSVQNTRKVTRALEMVSASKIRKAQEQMKISRPYAQAMKQMIGHLAQANTDYLHPFLIAHKQVKRIGYIVISSDRGLAGGLNNNLFRKILGEMRQWQDKGVEVDIVTIGQKASVFFRRIKVNILGSVTHLGDTPRLEQLIGVIKVMLDAYTEEKLDRVYLVYNRFINTMVQKASFDQLLPLLAAKDKVAHHDWDYLYEPDAATVLEHVMTRYIESLVYQAMLENIASEHAARMVAMKAASDNANKLIGTLQLVYNKARQAAITQEISEIVGGAAAV

SEQ ID NO: 9372 - protein, 478 aa, Xylella fastidiosa
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGANVILASGSDSVELPFATFDGETIVDNIGALDFTKVPKRLAVIGAGVIGLELGSVWKRLGAEVTILEAMPNFLAAVDADVAKTAAKEFKQQGLDIKLGAKVSRTEISSKNNKKEVIVTYTDASGKQTLTVDKLLVAVGRKAATKGLLADGTGVQLNERGQIVVDEHCHTGVDGVWAIGDCVRGPMLAHKGFEEGIAVAELIAGMPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 9373 - protein, 371 aa, Xylella fastidiosa
SWHKKAGEIVKRDENIVDLETDKVVLEVPSPVDGVLKEIKFDTGSTVTSNQVLAIIEEESIVAAPSPAPSQVIDQKPVAVSAPAAKSNVDSLPPGARFTATTEGIDPAQIEGSGRRGAVTKEDIINFAKQNGAARASGTRLEERVPMTRIRQRIAERLMQSKNSTAMLTTFNEINLAKVSNIRKELQEEFQKAHGIKLGFMSFFVKAVANALQRFPLVNASIDGTDIIYHGYSDISIAVSTDKGLVTPVLRNVERMSFADIEHRIADYAKKARDGKLSLEELQGGTFTVTNGGTFGSLLSTPIVNPPQSAILGMHTIKERPIAENGHIVIAPMMYVALSYDHRIIDGKDSVQFLVDIKNQLEAPGRMLFGL

SEQ ID NO: 9374 - protein, 857 aa, Xylella fastidiosa
MRMDKLTSRFQNALADAQSLAVGRDHTIIEPVHVFSALLDQQGGSTRPLLVQAGVNVPLLRERLTEILEALPKVSGQTVNVSPSNELSRLFHRTDKLAQQHGDQFMASEWFVLAVVDDSGGLGQALRAAGAEKKKIEAAIDKLRGGETVQTENAEEQRQALEKYTIDLTARAESGKLDPVIGRDEEIRRTIQVLQRRTKNNPVLIGEPGVGKTAIVEGLAQRIVNGEVPEGLRSKRLLSLDLGALIAGAKFRGEFEERLKGVLNDLAKNEGRVILFIDELHTMVGAGKADGAMDAGNMLKPALARGELHCIGATTLDEYRKYIEKDAALERRFQKVFVGEPTVEDTIAILRGLKEKYALHHGVEITDPAIVAAATLSNRYITDRQLPDKAIDLMDEAASRIRMEIDSKPEELDRLERRLIQLKIQREMLKKEKDEASKQRLADLERDIEVLDREFSDLEEVWRSEKAALQGATKIKESIEQAKLDLEAAQRRQDYAKMSEIQYGVLPALEKQLVAASQAEQHDFTLVQEKVTAEEIAEVVSRWTGIPVSKMLEGERDKLLRMEADLGRRVVGQEEAIKVVSDAVRRSRTGLSDPNRPSGSFLFLGPTGVGKTELCKALAEFLFDSQDAMVRIDMSEFMEKHSVARLIGAPPGYVGYEEGGYLTELVRRRPYSLILLDEVEKAHSDVFNILLQVLDDGRLTDGQGRTVDFRNTVIVMTSNLGSHQIQELSGDDSPEVYTQMKAAVMGVVQAHFRPEFINRLDDIVVFHPLDKAQIKQIARIQLRGLEKRLAESELKLDLDDRALELLGNVGFDPVYGARPLKRAIQSQLENPLAQQILAGAFVSGDTVQVGVDGGKLV

SEQ ID NO: 9375 - protein, 169 aa, Xylella fastidiosa
LLVDRPSIDGAIAHIADDIARDYQGDVPLFVTIMHGGLPFAGQLALELGQRGQDIELDSLHATRYRGEQTGGSLVWRHYPVSAMSGRRVILVDDILDEGHTLSEIRQWCLKQGATDVSLVVLMIKCHDRCIPNMRADYYGVEVPDRYVFGFGMDIAGQLRGIPAIYAMR

SEQ ID NO: 9376 - protein, 640 aa, Xylella fastidiosa
YTIDPMLAKDAHVDRAHYKTLYHESIEQPEAFWSKVAQRLEWFKVPTKIKNVSYQLEDVHIRWFEDGELNASVNCLDRHLTLRGDKTALLFEPDAPDAPSSRITYRELYERVCQLGNALRHLGIEKGDRVTIYLPMIPDAVVAILACARIGAIHSVVFGGFAANSIADRVNDCGSKLIITADEGLRGGRKIPLKANVDAALKIHGTQSVETVLVVRHTGGTINMHTPRDRWFHDLVDIQATECAPERMNAEDPLFILYTSGSTGKPKGVLHTTGGYLVYTSYTHETVFDLRENDIYWCTADIGWITGHSYIVYGPLANGATVLLFEGTPHYPTVSRFWEVIDKHHVTLFYTAPTAIRALMREGDTPVKKTSRKSLRLLGSVGEPINPEAWHWYYTIVGNGRCPIVDTWWQTETGGILITPLIGATDLKPGSVTLPFFGIRPALVDTNGQTLDGPAAGNLVLLDSWPGQMRTLYGDHQRFIDTYFRTYPNTYFTGDGCRRDADGYYWITGRVDDVINISGHRIGTAEIESTLVAHPKVAEAAVVGFPHPIKGQGIYAYVTLITGETPSEALHQELLTRVRKEIGAIAIPDHVQWTPNLPKTRSGKIMRRILRKIAENAPDQLGDTSTLADPSIVDLLLNER

SEQ ID NO: 9377 - protein, 439 aa, Xylella fastidiosa
TEPADLQHYGRDWTRRFTPAPLAIALPATVQEVQAIVRWANDAHIAIVPSGGRTGLSGGAMATNGELVLSLERMNKMLRFDPMDRTMTVQAGMPLEAVQAAARQHGLLYPVDFAARGSCSIGGTIATNAGGIRVVRYGNTREWIAGLNVVTGTGELLELNHALIKNSSGYDFRHLMIGSEGTLGIVVEATLRLTDPPPPTKVMLLALPTFDVLMQVFAAFRAQLQIEAFEFFTQRALPHVLAHGAQAPFEHPYPYYVVTEFPCADAAQETTALTVFETCMEQGWVLDGVISQSDAQAAQLWRLRESITESIAPYTPYKNDIAVRIAAMPAFLEQAQALLSQAYPEFEVLWFGHIGDGNLHINVLKPHTVPQTDFIHTCEHVTALLADLLQRFRGSISAEHGIGLIKKPYLHSTRSLAEIALMRQIKRAFDPKWILNPGK

SEQ ID NO: 9378 - protein, 288 aa, Xylella fastidiosa
MQFKDYYATLGVEPSAGEAEIKTAYRRLARKYHPDVSQEPGAEERFKAVNEAYEALRDPNKRAAYDQLRAQGYRPGDEFHAPPNFGGGHGFNFEEVFGNASGGNFSDFFESLFAGARAGGRHAGPGGGDKSQHGDTRSKLTVPLEAIYSGGSVRVTVNGRQLDVRVPKGIQPGKVIRLNGQGSYARHLLLEIEYAPHPQFEVDGHNILHTVQVTPWQAALGTSISVPTLGGSVELKVPPDSDAGRKLRLRGRGLPGPPPGDQIVELEITAPLATNETQRKAYRALAKA

SEQ ID NO: 9379 - protein, 732 aa, Xylella fastidiosa
  unsure (1)..(732): unsure at all Xaa locations
EGTHNKDWWPNQLRVDLLHQHSNKSNPLGETFDYAKVFQKLDYAALKRDLHALMTDSQDWWPADFGHYGGLFIRMAWHSAGTYRIGDGRGGAGRGQQRFAPLNSWPDNVSLDKARRLLWPIKKKYGQQISWADLIVLAGNVALESMGFKTFGFAGGRVDTWEPDQDVYWGREMTWLGGDVRYGAVSEGVHHPDEHSGAKEKASKNSDSRVLENPLAAVQMGLIYVNPEGPDGRPDPLASARDIRETFARMAMNDEETVALIAGGHTFGKTHGAAPADNVGPEPEAGELEQQGLGWHNRFGSGKAGDTITSGLEVTWTKTPTQWSNDFFEHLFGYEWELTKSPAGAYQWVAKDAAATIPHAHDPSKKLLPMMLTSDLALRFDPVYEKISRHFHAHPDQFADAFARAWFKLTHRDMGPRVRYLGPEVPAEELIWQDPVPKVSHVLVDAQDLLALKHKISASGLGISQLVSTAWASASTFRGSDKRGGANGGRLCLAPQNQWEVNQPQQLSVVLETLRRVQTEFNAQAGDKRISLADLIVLAGGVGVEQAAKRVGIVVEVPFVPGRTDALXXXXXXSSFAPLEPFADGFRNYVKGDEVVPSEHLLIDRAQLLTLTAPEMTVLIGGLRVLGANVGGVKHGVFTDRLGTLSNDFFINLLDMGTEWAPVSKERHVFEGRDRRTGVLKWTGTRVDLVFGSNALLRALAEVYAAVDAQEKFVRDFVAAWSKVMHLDRFDL

SEQ ID NO: 9380 - protein, 698 aa, Xylella fastidiosa
QPDSSLHGLVLLAQFHGIAADPVQIAHDFGRSGEPFDETTLLLAAKKLGLKAKVVTQPVTRIAMAALPALALIPGGTAFIVAKVTGNQILIHDLADQRPRTISHDEFTARYAGRLLQVASRASVLGNLAKFDFSWFIPAVVKYRKLLAEVFAVSLFIQIFALVTPLFYQVVMDKVLVHQALSTLEVIVVGLISLALFEVVLTALRTHVFAHTTSKIDVELGARLFRHLLALPLAYFESRRVGDTIARVRELENIRHFLTGQALTSVLDLLFTVVFLSVMFWYSSWLTLIVVISLPIYVLISAFITPVLRKRLDEKFARGADNQAFLVETVSGIGTVKAMAVDPRVTRTWDNQLAGYVSASFSVTKIATLGQQSVQLVQKLTKVAVLFWGAKLVIDGQLSLGQLIAFNMLSGQVTAPIIRLAQLWQDFQQVGLSVERLGEILNTRTELPGSRMTLPPIQGRITFERLIFRYRPDTPDVLSGIDLDIQPGEVIGIVGRSGSGKSTLTKLVQRMYVPERGRVLVDSHDLSLADPAWLRRQIGVVLQENFLFNRSVRENIAMADPGIPLERVIHAATLAGAHPFIAELPEGYDTKIGEHGTGLSGGQRQRIAIARALIGDPRILIFDEATSALDYESEHAVMQNMRAICKGRTVLIIAHRLSTVRNADRIVVIDKGKIVESGSHETLLNRNNGHYAHLYRLQ

SEQ ID NO: 9381 - protein, 327 aa, Xylella fastidiosa
KKTILCFGEALIDMLAQPPVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 9382 - protein, 292 aa, Xylella fastidiosa
VRDYLTALQDRICNVVETIDGQSHFHEDHWQRTEGGGGRTRLLRDGAVFEQAAIGFSDVCGTHLPPSASVRRPELAGANWRACGVSLVFHPKNPFVPTTHLNVRYFRAEREGKQVAAWFGGGFDLTPFYPFDEDVVHWHRVARDLCAPFGDERYAAHKRWCDEYFVLRHRNETRGVGGLFFDDLDKDFERDFDYQRAVGDGFLDAYFPIVTRRHDTPYGDRERAFQLYRRGRYVEFNLLFDRGTLFGLQSGGRAESILISLPPLVRWEYGYHPLPGSAEARLADYLLPRDWL

SEQ ID NO: 9383 - protein, 311 aa, Xylella fastidiosa
LMHSVVVVGSFSIDHVWRCDTLPTPGATIAGRYSRGPGGKGFNQAVAACRAGARTYFICALGNDTDGNMARDIATKDGFTLIGESSTEPTGTGGIYVDSHGHNTIVTGAGANAVLSTHFITEQRALITSAWIVLAQLESPIETLETALRMAREAGRLTILNAAPANATATINLLKLADVLTLNETEFVALLSRHVGERISPDNVATTDGNTLHALCNKLLSSSTVVITLGSAGVFVSHSEENLRGDTQPYYRVAAEQAHTVDTTGAGDAFNGALAASLARQPNTAFIQHIRLANSYAARSTETEGGAVSMP

SEQ ID NO: 9384 - protein, 672 aa, Xylella fastidiosa
MSNPLLDFSDLPRFDAILPEHVGPAIEQLLAEAEAAVAHAEQVTPVTWENFVVPLDDTTERLYRAWGQVAHLEAVVNTPALREAYNVTLPKVTRFSSTLGQNLALYAQYKALACAPEWDRDNAVRCKVVDNALRDFRLGGAELDAAGKVRLAEIKQELSALSATFSQNVLDATEAWSYTTEAAAVLSGLPTETVATARAAAEKKGVSGWTFTLQMPCYLSVQSDADNRALRERSYHASAIRASEFGDAALDNSPHIHQILTLRSELAALLGFSCYAAYSVATKMAEDPAEVLSFLHDLAGRAKPHAQRDRRELETFACEALGLETLEAWDIAYASEKLKQARYSFSEQEVKQYFTEPKVLAGLFEVIHSLYGLWIEEDAAPVWHPDVRFYRLIDMNGQRVGQFYLDLYAREGKRGGAWMDDCRNRRDKSDGVQTPVVYLVCNFGRGNDGVLPTFRHQEVITLFHEMGHGLHQLLTRIGELGVAGINGVEWDAVELPSQFMENFCWEWERVQTMTAHVETGAPLPRSLFDRMVCARNFQSGMFTVRQLEFALFDMLLHSDFDPAQDSVLGLLERVRDEVAVNRLPDWNRFPHQFRHIFAGGYAAGYYSYKWAEVLSADAYAAFEEAPDQFAEIGARFLDEILSRGGSRSAADNFQAFRKRAPRIDALLKRNGM

SEQ ID NO: 9385 - protein, 754 aa, Xylella fastidiosa
PEHSVQYNDGRPIIYVLEDYGLCNTLILDKACRKTKLPSPLIPLPDNPLQRKRAYLALSRRSSSNSLIPNQRGGKTHSDSLANLLQAHRIRDTLDVHLVPVSIFIGRTPDRQSGWFAVLFSENWALVGRFRRLLAVLLNGRNTIVCFAPPISVRQTLNEGLPPERTLRKLQRVLRTHFRRIRETVIGPDLSTRRLLVDNVLATEAVREAIAAQAKRDGTDLSETWRKAQAYAWEIAADYSSPVIRSADFLFSHVWNRIYAGVLIHHVDSFKETAPGHEVVYVPSHRSHIDYMLLSYCLYQCGIVLPHIVAGINLNLPIVGTLLRKCGAFFIRRSIKGNMLYSIVLSEYVAQLVAGGYSLEYFIEGGRSRTGRLLQPKGGMIMMTLQAFLRQPRRPVLFQPIYIGYEKLIEGTSYLDELSGEPKKKESIWRLFWNIPKVLKQKYGQVVVNFGEPIALNDVLAELAPEWEGQALNENEKPAWLSSTVNHLARQIQTRINSAADVNPINLLALALLSTPKHAMGEADLIAQITLCKKILLELPYSNRVTVTPHTPERIIAHAEQINILTRVHHPLGDVLRVDGDNAVLLSYFRNNVLHLFTASAWVACCFKNNRRMSRIALIRLGVGMYPFLQAELFLPWTEDQFAQHIQQVIELFVREGLLLSAGNEEEDPLTRNTSQTDEVFRLRAISHSLQQAFERYYITISILVKNGPGTLSASELESLCQLAAQRLSLLYASTAPEFFDKGLFRGFIQKLRE

SEQ ID NO: 9386 - protein, 468 aa, Xylella fastidiosa
YKIADISLADWGRKEIDIAEHEMPGLMSIRRKYASKQPLKGVRVTGSLHMTIQTAVLIETLKDIGADVRWASCNIFSTQDHAAAAIATSGTPVFAWKGETLEEYWDCTLQALTFTLADGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVRTVEDTLGQADIYVTTTGNKDVIRIEHMTAMKDQVIVCNIGHFDNEIQVDALNTLTGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 9387 - protein, 145 aa, Xylella fastidiosa
LELPIDIIKIQALLPHRYPFLLVDRILELDQKQKRIVAQKNVSINEPFFQGHFPEHPVMPGVLIIEALAQAGGVMTQLDLSHNGHSSLLFYMVRVDNARFNKQVVPGDILILDMTMKRRIRNMGCYYGEARVNGEVVACADIMCA

SEQ ID NO: 9388 - protein, 191 aa, Xylella fastidiosa
LDWAKGDGLLPVIVQDADTLRVLMLGYMNSHALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARH

SEQ ID NO: 9389 - protein, 255 aa, Xylella fastidiosa
MLSRRIIPCLDVRDGRVVKGVKFRDHVDMGDIVELALRYRDHGADELVFYDIGASPQGRSVDYRWVERVARLIDIPFCVAGGIGEVETARAVLHAGADKISINSPALRQPALISALAEAFGVQCVVVGIDSIREADGQWRVRCNTGDPDKTQALPLRTLDWIVEAQRLGAGEIVLNCMDSDGVRCGYDIAQLSQARALCQVPLVASGGAGDMQHFADVFHKADVDGALAASVFHSGAILIPGLKQFLREQQIEVR

SEQ ID NO: 9390 - protein, 371 aa, Xylella fastidiosa
VFIDRDGTLIEEPPDFQIDAYEKLRLVNGVIPALLKLRDAGYHFVIVTNQDGLGSPTYPQASFDGPNALMLQIFSSQGIVFRDVLIDRSWPADNAPTRKPGIGLMVAYLQDRDIDWARSAMVGDRPTDLQFAENLNIRGFQLRTPQFGGDWDWDGIAHTLADAPRRAVVQRHTKETNIRVEIDLDGAPQARITTGLPFFNHMLEQIAKHAGISLQISAVGDLHIDEHHTIEDTGLALGQAVRQALGDKRGIGRYGFDPPQLPWQVSGAAAHGGFTLPMDETQASAVLDFSGRPYFVFEGTFVRERVGDMPTELVPHFFRSLCDASGMNLHLSVHGDNDHHKVEACFKALARALRQALQRHGHVLPSTKGAL

SEQ ID NO: 9391 - protein, 355 aa, Xylella fastidiosa
TVLDLVRQELRSFAGYSSARSVALTGDLWLNANESAWPNPADSHATMRRYPEPQPPKLRQMLAALYGCLPEQVLIGRGSDEGIDLLVRAVCEPRRDPVLVTPPVFGMYAVSAQLQNAPLIQVPLVDDAAGFHADVPAIITAAQTSRAKLVFLCSPSNPVGAAIPLQQIETILQTLAGTALVVVDEAYGEFSDVPSVVPLLARYPHLVVLRTLSKAHALAAVRIGSVIADAHLVAVLRRCQAPYPLPTPCVSLAEQGLSAAALHVTAQRVAEIRAERERLRAALACLSGVRRVYPSQGNFLLVRFDDAEAAFQALYAAGVVVRDQRAAPQLHDALRLTVGTPEQNTRLLAVLRDIQ

SEQ ID NO: 9392 - protein, 276 aa, Xylella fastidiosa
VVLCTPPSKDGRANPAVLLAARLTGVTQVFTLGGAQAIAAMAYGTASVPTCDKVFGPGNSFVTEAKQQLAQAGVVAIDMPAGPSEVLVIADAAANPAFIAADLLSQAEHGPDSQVLLLSDSDALMTAVQNALALQLQQLSRAEIARQALAQSRLIKVATLETAFDISNRYAPEHLILALRQPRAWLHRVAAAGSVFLGDYTPEALGDYCSGTNHVLPTGGAARAYSGVSVSSFQNMISVQAASRSGIAEIGGCALTLARAEGLDAHANAVALRMGS

SEQ ID NO: 9393 - protein, 573 aa, Xylella fastidiosa
TDAQAQPEKKDFIRQIIREDLAHGTHTHIHTRFPPEPNGYLHIGHAKAICLDFGVAAEFGGHCTLRMDDTNPSKEDPAFAAAIQEDVSWLGFHWNALRHTSDYFEVLYLAAEKLIADGKAYVCDLNSEQVREYRGTLTEAGRPSPWRERSPDENLELFRQMRAGTFPDGTRTLRAKIDMASGNINLRDPALYRIKHVEHQNTGNTWPIYPMYDFAHALSDAIEGITHSLCTLEFEDHRPLYDWCINHVDLPNNSHLLKPLLDKGFPQEPSQPRQIEFSRLNINYTVMSKRKLTALVDEKLVEGWDDPRMYTLQGLRRRGYTPAAMRLFVERIGISKQNSIIDFSVLENCLRENLDTIAPRRMATIAPMKLVLTNLPEDHEEQLIFPNHPKDDTQGTRTVPFSRELWIERDDFSEVPPKGWKRLVPGGEVRLRGAGIARIDEVVKNAEGHIIALHGWLDPTSRPGMEGAHRKVKGTIHWVSAPHAVAAEIRLYDRLFSIEKPDDNTDGKTYRDFLNPDSKRVVHGYIEPAAAQTAPEHAFQFERLGYFVTDRHDHDATHPVFNRSVTLRDTWQR

SEQ ID NO: 9394 - protein, 166 aa, Xylella fastidiosa
MNPAPNLVMIGPMGAGKSSIGRRIAKHFNLHFADTDHAIVERAGTSISTIFKYSGEPEFRRLEREVLHDLLNHENRLIATGGGTILDPENRHRMQERGFVVFLKINVNTQLERLAHDRYRPLLQQIDRKQVLSDLYATRQPLYQKIADMIVTTDHMSPNTATAQLI

SEQ ID NO: 9395 - protein, 313 aa, Xylella fastidiosa
LRSVTVNTPPPYTIAIGPCLLHDPPRLAATIRGRHALILSDSEVAPRYAAQLHETLLRARPDLHLNVFTLPAGETSKSLENFGAAIAQLATLGATRDACLFALGGGVIGDLTGFTAACWMRGIDYVQVPTTLLAMVDSSVGGKTAVDIPQGKNMVGAFHPPRAVIADTDTLATLPLRELRAGLSEVIKYGAIRDPVFFHWLQTTREALLARDPAALAQAIARSCEHKADIVGRDPLEKGERVLLNLGHTFGHAIETTQGYSTPGSNNLNHGEAVAVGMVLAARLSNTLGLAPAEDTETLKNLLDAYGLPTVLP

SEQ ID NO: 9396 - protein, 452 aa, Xylella fastidiosa
SLFHEDDIHGVVPGELNPGVAKLIGQAIGSAMQAKGLSDIVIGRDGRVSSSELSAALSDGLRHAGCNVVDIGLVPIPVVYFAACHLGVGSCVAVTGGHHPHDYNGFKIVLGGESLSSEAMSDLYQCITNGRLYASVDSGSLSERDVVDDYIQRIADDVQLNRPLKIVADPGHGAAEEILSRLFKAIGADLVSLYGDIDGVSLIVHPDSDEPGNLQKLIQRVEQADADLGLAFDGDAASLRVVTREGEVILSDSVLMLFATDVLQRNPGALVIYDAECTSKLSDYVLRNGGSPLMWKTGHSSIKAKMRETGAELAGEMSGYFFFKEGWYGFEDALYAAARLLEILAQREDNPSQVFAALPHAYFTAQMEQSVEGDAQACVQSFIEEVQRSVEGGVFDGARLFAFDGLRADFTDGWGLVRVSDTASALVLRFEADTQAGLERIQSAFRTHLQAL

SEQ ID NO: 9397 - protein, 622 aa, Xylella fastidiosa
TWSQDLAHKTYSIRHWADGYFEVNDAGHMVVMPLGGDGVRISLPEVVDAARAAGAKLPLLLRFPDILRHRLGKLQAAFVQAQSEWEYAGGYTAVYPIKVNQHRGVAGVLASHQGDGFGLEAGSKPELMAVLALSRQGGLIVCNGYKDREYIRLALIGRKLGLKTFIVIEKPSELRMVLEEAKTLGVLPGLGVRVRLASLGAGKWQNSGGDKAKFGLSPRQVLDVWKVLRGTEYADCLNVMHFHMGSQISNVRDIAKGMREATRYFVELSRLGAKITHVDVGGGLGIDYEGTRSRSDCSINYGLQAYASHIVQPLASACEDYDLVPPRIVTECGRAMTAHHAVLIANVTEVEAVPEGRVPGLCDDEPAVVRHMREIYGELDARPAIELFYEAQHFHAEGLAAYTLGQIDLVHRARIDDLFYAISHGVRERLSHEEKSHRPVLDELNERLVDKYFVNFSVFESIPDVWAINQIFPIVPIERLNEAPTRRGVVCDLTCDSDGTVKQYVENESLDSALPLHVLRHGEAYRIGFFLVGAYQEILGDIHNLFGDTDAVEVAVDGRGYRIAQQRCGDTTDVMLDYVGYALDEVRRVYAQRITAAGMSAAESKALSDMLEAGLTGYPYLS

SEQ ID NO: 9398 - protein, 343 aa, Xylella fastidiosa
GFAALSATGPLERFAFGRRAPRPDDVVIDILYCGVCHTDLHLARNHGGFTTYPIVPGHEIIGCVREIGKTVTRFKRGDLVGVGCMVDSCQHCQPCLKGWEQDCIEGSIFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDIIIDTVPYDHDVNPYMPTLVLEGVLVLVGYLGPLSMPVNAGGVVRGRRAISGSFIGGVPETQQMLDFCGQHGIVSDVEIIPIQKINEAYERMLKSDVKYRFVIDMTSL

SEQ ID NO: 9399 - protein, 347 aa, Xylella fastidiosa
MFINAYGAHAGDKPLESMQIARRAPGVHDVQIDIHYCGVCHSDIHLVRSEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDPFLTLLKRDGTLTLVGAPATPHPSPEVFNLIFKRRSIAGSLIGGIAETQQMLDFCAKHGIVADIELIRADGINEAYERMMKGDVKYRFVIDNATL

SEQ ID NO: 9400 - protein, 560 aa, Xylella fastidiosa
MSQTRPWLQHYPSGISTEIDTDAFRTIADVFNTSVIKYRHCPAYTNFGKTLTYGEVDLLTKQFASYLLNVLKLKKSDRIALMMLNCLQYPVATFGALCAGLAVVNVNPLYTARELKHQLVDAGSTVLVVMDNFCTTVQHIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTSNSLKEGCETVLTALPLYHIFALTANNLVFMKIGGCNHLISNPRNMRAFVKELQRVRFTVITGVNTLFNKLLNTPGFDKLDFSSLKIALGGGMVIQRSVAEQWKQVTHVPLIEAYGLTEASPAACINPLNLQEHNGSIGMPIPSTDVCIKDDTNTVLPIGEIGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPA

SEQ ID NO: 9401 - protein, 901 aa, Xylella fastidiosa
MRDSFSTHRQLHVGNQSYHYYSLTKLGEHFDISHLPYSMKILLENLLRHEDGGVTVSTAHIEAVAKWNPKAEPDTEIAFMPARVLLQDFTGVPCLVDLAAMRDAAIRLGGTAEQINPHIPSELVIDHSVQVDVFGKPEALERNGNIEFQRNKERYGFLRWGQKAFNNFKVVPPNTGIVHQVNLEHLARVVMTTEKEGATWAYPDTVFGTDSHTTMINGIGVLGWGVGGIEAEAAMLGQPSSMLIPQVVGFKLTGTLPEGATATDLVLTVTQMLRKHGVVGKFVEFYGDGLAHLPLADRATIGNMAPEYGATCGIFPIDTESLNYLRLSGRSESQIALVQAYAKAQGLWYAPNTPPPSYSTTLELNMDDIKPSLAGPKRPQDRVLLQDMQNNYREHVRALTAHRTTKANDHDTHPIKGQVDLDINGQTLQLKDGAVVIAAITSCTNTSNPAVMFGAGLLARNAVAKGLQRQPWVKTSLAPGSRVVTDYLEKAGLLNDLETLGFYVVGYGCTTCIGNSGPLPPEVSAGIAKGDLVAAAVLSGNRNFEGRIHPEVKMNYLASPALVVAYAIAGTVNSDLTSEPLGNGNDGQPVYLRDIWPSNKQIGDAIAATIGPEMFQQNYADVFKGDTRWNTIASPNGALYAWDAHSTYIKNPPYFDGMTMQTEPVKDVRGARVLGLFADSITTDHISPAGNIKQDSPAGRFLQEHGVQPTDFNSYGSRRGHDDVMVRGTFANIRLKNLMLNGEEGGNTWYRPKAGGPPEKMSIYDAAMKYNTDGVPLVVIAGKEYGTGSSRDWAAKGTKLLGVKAVIAENFERIHRSNLVGMGVLPLQFLDGQNAQTLGLDGSEIFDVTGLEGTISKHATVSAKQSDGSIKQFQVKVLLLTPKEVDYFTHGGLLQYVLRHL

SEQ ID NO: 9402 - protein, 609 aa, Xylella fastidiosa
MCGIVGAIAGRDVVPVLIEGLKRLEYRGYDSSGIAVLESGSIRRVRRTGRVAEMAVAATQEGFTASLGIGHTRWATHGGVTEANAHPHVSHGVVLVHNGIIENYEVQRERLSAFGYVFQSQTDTEVIAHLIHYYMQQGGDLLGALQCAVKALTGIYALAVMSQAEPERFVCARMGCPLLIGIGDGESFVASDISALIQATRQVIFLEDGDTAEIRRDGISIFNAEQCLVERPLHLSNVSLSSLELGEFRHFMQKEIHEQPRVLADTMEAAIDAAGFPPMLFGAQAESVFRGITGIQILACGTSYYAGLTARYWIEAIAGLPCHVEIASEYRYRKAYVNPQHLVVTISQSGETLDTLEALKYAKALGHRHTLSICNAPDSAIPRISELICYTRAGPEIGVASTKAFTTQLVVLFQLAVALGVLRGAVDAEDEAAYLEQLRQLPCSVQQALNLEPQIAGWAECFASRHHALFLGRGLHYPIALEGALKLKEISYIHAEAYPAGELKHGPLALVDADMPVVVIAPNDSLLEKVKSNMQEVRARGGELFVFADQDSHFSESEGLHVIRTLRHTGVLSPLVHTIPVQLLAYHTALVRGTDVDKPRNLAKSVTVE

SEQ ID NO: 9403 - protein, 265 aa, Xylella fastidiosa
IAFIGGGNMARSLIAGMIRQGAPSTSICVIEPIAALRDALMADFNIKAVTTATEAATDTSTWVLAVKPQVMPDVCATLPLPVQPNTPLVISIAAGITTCKLKHWLGDTCAIVRAMPNTPALLGAGVTGLFATSQTTGTQRTLAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQALVAKAIDAATLRARALGK

SEQ ID NO: 9404 - protein, 201 aa, Xylella fastidiosa
RIKFCGMTRVGDVRLASELGVDAVGLIFASGSSRLLTVSAACAIRRTVAPMVNVVALFQNNSADEIHTVVRTVRPTLLQFHGKEEDAFCRTFNVPYLKAIPMAGAEAKRICTRTLYLKYPNAAGFIFDSHLKGGTGQTFDWSRLPIDLHHPFLLAGGITPENVFDAIAATVPWGVDVSSGIELQPGIKDGDKMRQFVEEVR

SEQ ID NO: 9405 - protein, 320 aa, Xylella fastidiosa
IYARIAGTGGYLPEKVLTNDDLAHIVDTSDEWIRTRTGIRERHIAAEGETTSDLAYEAAIRALEAAEVRSADLDLIVVGTTTPDLIFPSTACLLQARLGAVGCGAFDVNAACSGFVYALSVAEKFVSSGCSKTVLVVGADTLTRIIDWSDRTTCVLFGDGAGAVVLKADEDTGILSTHLHADGSKKELLWDPVGVSVGFGEGKDCGALLMKGNEVFKYAVKALDRVVDETLEANHLDKHELDWLIPHQANLRIIEATARRLDMSMDQVVVTVDRHGNTSTASVPLALDEAIRSGRVQRGQLLLLEAFGGGFTWGSALLRY

SEQ ID NO: 9406 - protein, 443 aa, Xylella fastidiosa
GSEGWRLDAISRRQYSEDDSQCFSCADAVALPRDLNEVVAIVRACRQHRVPVIPRGTGTGTVGGAVPLHGGIVLSLARMNRIVALLPDDRCAVVQPGVINNDLQQALAPHGLFWPPDPSSTAMCSIGGNLATNAGGPRTVKYGATRDNVLGVVAVTGVGDVIRCGGAYTKNATGYDLAHLLIGSEGTLAIIVEATLKLAPQPQAIAGLRAFYQDTAAAAAAVSRLMSQPAIPATLEFMDHKAIELLYRNGSNIPMAGAMLLIEGDGNHDTLPYVLQALAQAASGEGLMDLDVAMDGAARDQLWAARKSLSPMLRTIKPGKLNEDVVVPVSRIPDLVAGIEVLAAESGLPIVTFGHAGNGNLHVNIMYDDQDAEDIMRAQATLPKLFKLVLTLGGTLSGEHGIGVAKRDFMTQAFDTPTLAAMRAIKAAFDPDGILNPGKVLPR

SEQ ID NO: 9407 - protein, 430 aa, Xylella fastidiosa; identical to SEQ ID NO: 9237

SEQ ID NO: 9408 - protein, 311 aa, Xylella fastidiosa
INGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLVAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILDYIEDKVVATDFRGETCTCVFDADAGIALDPTFIKLIAWYDNE

SEQ ID NO: 9409 - protein, 141 aa, Xylella fastidiosa; identical to SEQ ID NO: 9239

SEQ ID NO: 9410 - protein, 839 aa, Xylella fastidiosa
LCPGAYAALPYVARVYAENVLRRAAPDQWPAYLGQLIGRRCDTDIPWFPARIVCHDILGLTALVDLAGLRDAIAAQGGDASQVNPTVPVQLIVDHSLAVEYGGSDPEAVAKNRAIEARRNADRFHFIEWTRHAFENVTVIPPGYGIMHQINLEALSPVVAVQDGVAFPDTCIGTDSHTPHVNALGVVAIGVGGLEAESVMLGRAVWLRCPESVGVELHGRPRPGITATDIVLALTAFLRQARVVGAYLEFRGEGVAALTVGDRATIANMAPEYGATAALFFIDAQTVEYLRLTGRDKAQVALVDTYAKQAGLWADTLEGAQYARLLHFDLSSVARTMAGPSSPHHQLPTSALTERGIAGGLAQARAEEAAGHLPDGAVIIAAITSCTNTSNPRNLIAAGLLARNAHARGLRCKPWVKTSLAPGSQAVPLYLEAAGLLYALQQLGFGVVGFACTTCNGMSGALDPLIQHAIMARHVHTVAVLSGNRNFDGRIHPDATQAFLASPPLVIAYAIAGTIRFDIERDVLGHDADGTPVMLKDIWPGDADIDALVRRSVHPEQFRRVYMPLLQASRQWRECVPPLYAWHPQSTYIRRPPYWEGVLASARTLRGLRPLAVLGDNITTDHLSPSNAILPNSAAGEYLARMGVPQEDFNSYATRRGDHLTAQRATFANPMLLNELVRDADGKVRQGSLTRLEPDGTVMRMWEAIEIYMQRSQPLIIIAGADYGQGSSRDWAAKGVRLAGVEAIVAEGFERIHRTNVIGMGVLPLTFHPGTTRITLRIDGTELFDVCGVPSVGAVLILRIQRRDGSVAEVPVTCRLDTAEELSIYAAGGVLQRVAQQML

SEQ ID NO: 9411 - protein, 604 aa, Xylella fastidiosa
YLKQQEIKPLLRFITCGSVDDGKSTLIGHLLYGSQCLAEDQLADLTVDSQRYGTQGEHIDYALLLDGLAAEREQGITIDVAYRYFDTEKRKFIVADCPGHAQYTRNMATGASTADAAVVLVDARKGLLTQTRRHSYIVALLGIRHVVLAVNKMDLVGYDQQTFEAIASDYLALAVKLGINQVQCIPLSALEGDNLSKRSARMPWYVGPSLLEYLEALEPADVDLGAAMCLPVQWVNRPDSQFRGFTGTLAAGRVRSGDGVVVLPSGCVSRVVRVFNGDTEVHEAVAGQAVTLTLADEIDISRGDVIAATDDPPDVADQVTAYVLWMDDTALLPGRRYWLKLGARMVAASVSDIKHRVDVNTQEQRVAQRLQLNELGYCQLSLDAPVAFVPYARNRVLGSFILIDRQSNATVGAGTLDSGVHRASNVHWQPPYIDHVARARIKGQTPKVLWFTGLSGAGKSVIANIVDKRLHALGYHTFILDGDNVRHGLNRDLSFTAEDRVENIRRVAEVARLMVDAGLVVLVSFISPFRDERQLARERFAADEFVEVFVDVPLAVAEARDVKGLYAKARAGLIIDFTGIDSPYEPPQHPELHLRADQGTPEQL

SEQ ID NO: 9412 - protein, 559 aa, Xylella fastidiosa
SSSSIEDIKGKSHRLRGSLLESLANPTTGALRESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLISRAHADLYTDAAHLSEHLLPNTRAYYEIWLDEKKVAGAGEEEEPIYGPHYLPRKFKIGFAAPPINDVDVFANDLGFIAVIVDKTLLGYNVTIGGGMGTTHGDPDTWPRIGNIIGFITRADLITISTAIVTTQRDFGNRTLRKRARFKYTIDDRGLDCIVGEIQQRAGITLQPARPFVFEHNGDRYGWIEGEDGHWHLTLLLPAGRIADTEGSTLLSGFREIAQLGIGEFRMTPNQNVVIAGISPGQRAAIDALVTQYGLDTGNRAPTALARHAMACVALPTCGLAMAEAERYLPDFNAKLQPILEKYGLAETPILLRISGCPNGCSRPYLAEIALVGKAPGRYNLMLGGDQRGQRLNTLYRENITETEILAALEPLLGRYQQKRLPSEGFGDFLHRTGIIALPPYPTHRH

SEQ ID NO: 9413 - protein, 752 aa, Xylella fastidiosa
  unsure (1)..(752): unsure at all Xaa locations
GKTLYGKLWDIHEVARRDDGSSLIYIDRHILHEVTSPQAFEGLRLAGRPLWRVNANIATPDHNVPTTKAERQGSLLSIADTVSRLQVQTLDENCDDFGIFEFKMNDVRQGIVHVIGPEQGATLPGMTVVCGDSHTSTHGAFGALAHGIGTSEVEHVLATQCLVTQKMKNMQVRVEGTLSWGVTAKDIVLALIGKIGTAGGNGYAVEFSGSTIRALSMEGRMTICNMAIEAGARVGMVAVDEKTIQYVHGRPFAPKGSDWDAAVAFWRGLVSDPDAHFDRVVELSAEEIKPQVTWGTSPEMVSAVDQSVPDPERETDPVKKESLIRALKYMGLQPNDPITSIKLDRVFIGSCTNSRIEDLRAAAEVVKGRKVASTVKQAMVVPGSGLVKAQAEVEGLDKIFIEAGFEWREPGCSMCLAMNPDKLGSGEHCASTSNRNFEGRQGIGGRTHLVSPAMAAAAAVAGHFVDVREMMRDEPYVVFVDAWKXRANEGLYSMPFFDCFNTSSSAXSVSKRLFFSIPAAXXNGSAIYDRSAHRIFKHWXSLMKPFTQHTGLVCPLDRVNVDTDQIIPKQFLKSIKRTGFGPNLFDEWRYLDAGQPGQDNSKRPINSDFVLNLPRYRGASVLLARDNFGCGSSREHAAWALDEYGFRTVIAPSFADIFFNNSFKNGLLPLVLNKVEVDALFAQCQVTEGYTLTVDLAAQQVITPDGTTYAFQIDTFRKHCLLNGLDDIGLTLQYAEAIRAFEATHRIRQPWL

SEQ ID NO: 9414 - protein, 339 aa, Xylella fastidiosa
LVTGGAGFIGGNFVLQAISLGHRVINLDALTYAGHLETLAALDGCAEHLFVHGDIGDRALVSCLLDTHRPDAVLNFAAESHVDRSIDAPAAFIQTNVVGALLLLEAVCGYWKALPEAARAAFRFLHVSTDEVYGSLGETGAFTERTAYAPNSPYSASKAASDHLVRAFHHTYGLPVLTTHCSNNYGPYHFPEKLIPLVITKALAGEPLPVYGDGRHVRDWLFVGDHCTALCAVLAGGRVGETYNIGGQAERENLEVVRMICCLLDERRPRADGLSYQSQIVHVADRPGHDRRYAIDTSKLVSQLGWAPVYRFEQGLALTVDWYLQHQDWVRAVLQGRDR

SEQ ID NO: 9415 - protein, 579 aa, Xylella fastidiosa
FADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVTKFFGRISNALVVGAEIDFYRKLLQRFESEHNVPAIEIAAALARLLQGDSPFLLSVPTRPQRERSELASEHHVKRPSSFKQTERPNNTEHPKRPQRNAPARNVPEFGMESYRIEVGRMHGVKPANIVGAIANEAGLESRYIGRIDIRDDHSVLDLPAEMPHEILQHLKKVWVSGQQLQMHRIDTTETTAPAREFKSKPGGAG

SEQ ID NO: 9416 - protein, 271 aa, Xylella fastidiosa
LHFTKMQGAGNDFVVLDLRDGTPPPDAALVAWLADRHFGIGCDQVIAIEPPRGVGVVAAYRIWNADGSAAQQCGNGARCVAAWLVRDGSLADEHFLIDSPVQAHSVRCIGKDEYAVEMGLPVFEPERIPLSGFPNACAEYVLSLQGEVLRCGAVSMGNPHAVVEVDLIDVAPVERIGPLLQQHVAFPESVNVGFVQVIDPGLVRLRVYERGAGETLACGSGACAAAVVLMQRGRVGRDVRVVLPGGTLRVQWPVSGGPVTLSGPARCVFDG

SEQ ID NO: 9417 - protein, 540 aa, Xylella fastidiosa
DANQIVLDTRELSIEKIEADDGQGHLNQLKFVLFPADKILGSKLVIETPAQPTQIRVTYRTAPSASGLQWMEPAMTEGKRLPFMFSQSQAIHARSWVPLQDTPGVRFTYKAHIVSRPDVMVLMSADNDPNAVRDGDYRFKMAEPIPSYLLAIAAGDLVFKPISARSGVWAEPVMVDKAAKEFEDTEKMIGAAETLYGKYRWGRYDMLVLPSSFPFGGMENPRLTFVTPTVIVGDKSLVSLIAHELAHSWSGNLVTNASWKDIWLNEGFTTYVQARITEALYGQTMADMERQVDQMDIFAALKDIPKADQKLVLSTLTKRDPDDALSPIAYVKGAWFLQFLEQRVGREVFDPFLRGWFDSHAFQSATSEDFIVYLKQYLLSKDPNAITAEELDSWLNAPGIPTIAQKVRSLSFANVDGARIAWSGSGLLPNRPVTDGWGTQQWVYFLSRMGETLKLEQLKQLDEAYHFTGTPNGEIAMRWYPLAIRSGYTAAWPEAGAFIGRVGRLKLILPIYAELSKTPKGLLFAKQIFAKFKSLYHPIT

SEQ ID NO: 9418 - protein, 316 aa, Xylella fastidiosa
  unsure (1)..(316): unsure at all Xaa locations
MIKRIRKAVFPVAGLGTRFLPATKTIPKEMLPIIDKPLIQYAVDEAIQAGCDTLVFVTNRYKHAVADYFDKAYELEQKLERAGKYEQLELVRHVLPDGVRTVFVTQTEALGLGHAVLCAKPVVGDEPFAVLLPDDLMWSRNGGALKQMADVAEVSGSSVIAVEDVPVDKTVNYGIVGTDVFDGSKGRITQIVEKPKPDDAPSNLAVVGRYVLSGKIFEMLENTSIGTGGEIQLTDAIAELLKYERVDAYRFQGRRFDCGAHIGLIEATLHLALEHKKHGQAVREILRDTLLTVDKRXLSVFASVCVKMLIVRRPFW

SEQ ID NO: 9419 - protein, 278 aa, Xylella fastidiosa
ARILDGRRIADDLLDALKTRVDARVAAGKLPPTLAVVLVGSDPASVVYVRNKRRAAEKVGIKAYDFDLPEATTEAELAALIDRLNADPKIHGILIQLPLPGIPDAHRLIQRVDPRKDVDGFHPQNVGHLALREFGLRPCTPRGIVTLLGHTDRPVRGRNATIVGVSNHVGRPMGLELLMAGCTVTSCHKFTPPQMLEAAVRQADILIVAVGRPGVIPGEWVKLGAVVIDVGINRLDDGQLVGDVGFESAVKRASWITPVPGGVGPMTVATLMQNTLEA

SEQ ID NO: 9420 - protein, 483 aa, Xylella fastidiosa
LRILAEALTYDDVSLVPSHSTVLPKDVNLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFESELDDPVRHIMTKKEALVTVKEGADSQEVLQLLHKHRIEKILVVNDAFELRGLITVKDIQKKSDYPNAAKDAVTRLLVGAAVGVGGETERRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRM

SEQ ID NO: 9421 - protein, 330 aa, Xylella fastidiosa
INDIESLTAQALADVAAAQNLDHLEFLRVALLGKNGSITLQLKQLGKLPVEQRKAIGEKLNRVRDLISAALMDRKAALESAALSKRLIDERVDVTLPGRRGERGGLHPVTRTLERITEIFARLGYELVEGPEIEDDWHNFEALNFPLHHPARAMHDTFYFGDGRLLRTHTSGVQVRYMSDHRPPLRMIAAGKVYRSDSDQTHSPMFHQIEGLLLDKHATFVDLKGTLSEFLRAFFERDFEVRFRPSYFPFVEPGAEVDIAWQQSDSSVRWLEVLGCGMVHPNVLKNVGIDSECYTGFAFGLGVERFAMLRYGVDDLRAFFENDVRFLRQF

SEQ ID NO: 9422 - protein, 650 aa, Xylella fastidiosa
  unsure (1)..(650): unsure at all Xaa locations
MISLRHFAMRRGGRLLLSNVDITLHAGDRVGVVGRNGVGKSSLFAAIRGELEADKGNVELPGKLRIASVAQETPSLSDLALDFVLSGDDVVAEVLRVEAEANAREDWEAVAAAHQRLAEIGGYDAEARAGKLLHGLGFITQTQRRAVSTFSGGWRVRLNLARALMMPSDLLLLDEPTNHLDMDAVFWLEQWLQKYPGTLLLISHDREFLDNVATHILHLHDGNAKLYVGGYTDFERQRAEQLRQQQIAFEKEQAERVHLQSFIDRFKAKASKAKQAQSRIKRLEKLAGTEAIRMEREFRITFAPPTKLPHSLITLRQVNCGYSVLSPSTPSDPPPVDIHAAAPSQHAVILHRVDFGLEAGDRIGLLGPNGAGKSTLVKTLVSDLAPLTGERIAHPDVRIGYFAQHTVESLHEGQSPIDHFRTLAPQAPIQSIRDFLGKWNFPGDRAFEPVDGFSGGERARLALSLIAWRQPNVLLLDEPTNHLDLEMREALAEALSDFDGAIVMVSHDRHLIGLVCDTFWRVADGVVEPFAGDLDQYAAWLRTRPAARGVRAKTEEVNQPQASLTAKSLASQLPVKKSVNSQKLLVAEKHVSELETLLAELDRKLADPVNYANGEVMRRLGDEREHAARRLAEAEQAWLLLMDGXXIMIM

SEQ ID NO: 9423 - protein, 456 aa, Xylella fastidiosa
LLFGATGDLAQRYLFPSLLQLFTDGLLPQDFRIRALALSPHNTTQFRDILRPRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPASLEADRIRDEKVKVLRALRPLNAQNAAMHSVRGRYSAGTINSQPVPAYQPPEGSNVETFVGVTAYIDNWRWAGVPFHLCTGKRLAERSTQIVVTLKPVTHWLFERPDRNNAAPNRLCFKLQPQENIELNLMSSLAGPEWGTLELQPLELELSVPTGKHRHIAYERLFLDAFNGNPALFVRHDEVTAAWAWIDSVSNAWELSDLPLQPYPAGGWGPPQA

SEQ ID NO: 9424 - protein, 600 aa, Xylella fastidiosa
TDNSMSAYTITEHKYDMVVVGAGGAGLRATFGLAQKGLQTVCLTKVFPTRSHTVAAQGGISAALGNMGEDDWRYHFYDTIKGSDWLGDQDAIEYMCREAIPAVIELEHYGVPFSRTAQGKIYQRPFGGMTTRYGEGPRAERTCAAADRTGHAMLHTLYQQALAHDARFMIEYFALDLIFDNEGVCRGVLALDMAEGSLHLFRAHGVVLATGGYGRTYFSATSAHTCTGDGGGLVMRAGLPMQDMEFVQFHPTGIYGAGCLITEGVRGEGGILRNSNGERFMERYAPHYKDLASRDVVSRSMIIEIREGRGVGEHKDHILLDLTHLGPSMIQEKLPGIAESARIFAGVDVAKQPIPVLPTVHYNMGGIPTNYHGEVVRKVGNDPDAVVPGLYAVGEAACVSVHGANRLGSNSLLDLVVFGRAVANRCAETIKQSQPHKVLPSDSCDKALGLLDKLRHADGSTPTAVIRDRMQRTMQSDASVFRTSKTLQEGCEKMNEIFALFDDIKVSDRSLVWNSDLIETYELHNLLLNALATINSAEQRKESRGAHAHEDYPDRDDENWLKHTLVSVDEKGTCSFDYRPVHMYTLSKDVDVIPPKPRVY

SEQ ID NO: 9425 - protein, 238 aa, Xylella fastidiosa
PAKSGTKNARTFKVYRWNPDDDANPRTDTYEIDLDTCGPMVLDALIKIKNEIDPTLTFRRSCREGICGSCAMNIDGTNTLACTKAISACTISEIPIYPLPHMNVIKDLIPDLTHFYAQYASIKPWMRTQTPPPPDRERLQSPVDRKKLDGLYECILCACCSTSCPSYWWNGDRYLGPAILLQAYRWIIDSRDEDTGARLDDLEDPFKLYRCHTIMNCTRTCPKGLNPAHAIAEIKKLM

SEQ ID NO: 9426 - protein, 292 aa, Xylella fastidiosa
RLRIAIQKSGRLTEPARRLLTSCGLSWRQSRDKLFCYGESLPVDLLLVRDDDIPGLIAQGVCDLGIVGRNELDEQAASRRRNGLPVPYQTLRGLHFGQCRLMLAVPEEWEWQDISQLTGKRIATSYPAILADWLQTHHIAAQIVELSGSVEIAPRLGTADLICDLVSSGATLTAHQLKPVIQIMESQAVLAGMIRQPADARAGLLAMLLRRIDGMVNLRDSNLLMFRAFQEHLDALTRLLPDADPLVQLPDDGSGTLRVQTMCHGTITWQRLEELERAGAQGLMVLTVERSL

SEQ ID NO: 9427 - protein, 850 aa, Xylella fastidiosa
  unsure (1)..(850): unsure at all Xaa locations
GQTLSLMRMGPPSXGLLMSSSAVRLSTVETPVYVPRTVVHKFGGTSVADADCYRHVACLLLAREETVQVTIVSAMKGVTDTLIALAEQAANHSPDWQVLWQQTRTRHCDAAQALLGEHAATLQDWLNTRFNELHEMLVALSVIGMLPSEVLDRLQGLGEVYSAQLLGQYLQAQGEDCVVLDARQVLVVSPGEFGAEVDWATSAQHLAHWRMQHPQRRVVVTGFVASDRTGRAITLGRNGSDYSGAIFAALFEADELHIWTDVDGVMSADPRVVPDAVQLDALSYDEACELAYFGAKVVHPQTMSPVMKRGVPIIIRNTFQPGHPGTRITADSVVSGSVKGLTLSPGLAVLNLEGTGLIGVPGTAERVFAALRNARLSVVMISQGSSEHSICCLVHQTEAERARDALLYTFAHELAIGHVQRVQLTNNISVLAAVGDGMAGHLGVAARLFESLRRAHVNILAIAQGSSERNISVAIDSQQATKALRAAHAAFWLSPQTFSIGVIGPGHVGEALLDQLCTAQQQLLSKANLDLRLRAIVSRRRMLLDERGLGSDWRHAFAAAPEAVDLDAFTAHLQVAHLPHAVIIDCSGSAEVADRYADWLAAGIHVVTPNKQAGSGPLHRYHAIRAAADASGARFRYEATVGAGLPVITTLRDLMDTGDSVTSIEGIFSGTLAWLFNKYDGSVPFSQLIAQARAMGYTEPDPRDDLSGVDVARKLVILARDAGRDISLEDVAVESLVPETLCQLSVADFMERLNEIDATFAERLAAAKQRGCVLRYVAQLSPGHVPSVSLIELPSDHAFVNLRLTDNVVQFTTRRYSENPLIVQGPGAGPEVTAAGVFADLLRVAAGEGA

SEQ ID NO: 9428 - protein, 307 aa, Xylella fastidiosa
MQFDSNGRLRHLITLEGLSRDTLLQLLDCAAQNCALGVDPMGKRNVLAGMAVCTLFFEPSTRTRHSFHLAAQRLGADVLNFDASMSSTSKGESACDTLKNLEAMGVRGFIVRHPEEIVIAQLAAVVGEGTVLINAGAGRSTHPTQGLLDMLTLCQAKGNDFSKLKLLFVGDIKHSRVARSNLHALRTLGAGQIRVCGPTALLPHDGLLSGCVVSQDFDAMLEDVDVLMMLRLQRERMEEGLVPSLEHYHANYGLTAARLARAAPDAVVLHPGPINRGVEITDEVADGPQSWILRQASNGVMVRMAVL

SEQ ID NO: 9429 - protein, 562 aa, Xylella fastidiosa
  unsure (1)..(562): unsure at all Xaa locations
ISVNGGAAALRAGWRFGDRCCVCTNEXGRGSSFQTEFGIRRCCQCDDSYQPQYSYTGRMTHAQGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAVHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 9430 - protein, 887 aa, Xylella fastidiosa
TIRKLAELVNTPVEKLLEQLAGAGMKFSGPDQVVTSTEKMKLLGFLRRTHGKSDVSVGTVREAPKKITLNRRRLQEVTVNAGRNKTTVNVEVRQKRTYVKTPESEYHTPTKPPIELADAERVEILRKLEESRQRNLAEQQRLAEVDRQRVEEQERKRREEEQAELERQKTESRVVEEILVKTDSNSVKPVSKPISEERTRALPRTVRPTPAARPSVSRSDDRNSNGGVRHKPRGSHVIVSDEDDSARRFVGQMHLTAAERARRGSNTRGKGGGSHRGATHRGNENSIRSSGAHGFERPTVAVVREVAVGDTITVADLAQKLALKSGDMVKALFKMGVMVTITQTIDHDTAVLVSEELGHKVTRASSSDFEDALLAHTEEVHGEPVPRPPVVTIMGHVDHGKTSLLDYIRRTKIAVGEAGGITQHIGAYHVETPRGVISFLDTPGHAAFTSMRARGAKITDIVVLVVAADDGVMPQTKEAVQHARAAGVPLIVAVSKIDKSTADPQRVKNELLTESVVAEEFGGDTQFVELSAKTGVGVDALLDAISIQAEVLELKAVIEGRATGTVIESSLDKGRGPVATVLVQQGRLKKGDYLVCGTHYGRVRALFDEVGHQPLAASPSIPVQVLGLSGVPDAGDDFVVVDDERLAKDVAQQREAKRRESRLVTSAGNRMEDILAQMGKGENQQVLNLLIKADVQGSLEALKQALVALSNDDIRINVIHVGVGGITESDANSAVTSKATVIGFNVRADASARKIIEANGVDLRYFSIIYDVIDQVKQVASGLLGVEIREEIIGVAEVRDVFRSSKFGAVAGCMIIEGVVKRSKPIRVLRDNTVVFEGELESLRRFKENVDEVRNSTECGIGVKAYNDVRVGDSIECFERIEVARTL

SEQ ID NO: 9431 - protein, 264 aa, Xylella fastidiosa
  unsure (1)..(264): unsure at all Xaa locations
IKFENVCVDFPIYNASSRSLKKQLIQAVTGGQLRKEESGRVVVSVLKELTFTLQDGARVGLLGHNGAGKSTLLRLLNNVYFPSSGQALIEGTTGSLIDISLGTDPEATGRENIYLRGALLGMTKSEINRSVNEIIEFSELGNFIDMPLRTYSTGMHLRLAFSVSTIVCPEILLMDEWLSVGDEGFKQKAEKRLSELVQATNILVVASHSKQLILNTCNRVIWLEHGQIRMDGDAQEVCTAYFGXGVXYVTHVLRVPINGRSHVQ

SEQ ID NO: 9432 - protein, 1164 aa, Xylella fastidiosa
MRLSTIKLSGFKSFVDPATLHLPTNMTGIVGPNGCGKSNIIDAVRWVMGESSASRLRGDSLTDVIFSGSSARKPVAQATVELIFDNSDHTISGEFAAFNEISVKRTVSRDGSSVYSLNGTKCRRRDITDLFLGTGLGPRSYSIIEQGMISQIIEARPEDLRIYLEEAAGISKYKERRKETESRIRHTQENLDRLNDLREEIGKQLEHLKRQARQAEQYQTLQEERRVKDAECKALQFRELDTRLQGLRQALLQEETRLQQLLAEQREAEMRIETSRVRREESAEALATAQADVYQVGATLARIEQQIQHQREMSQRLHKARDEAQKQLIDLTRHMGDDAATLAVLREAVENNEPQLHVLREQSEFKQDALRDAEAALTDWQQRWESHNRETSEASRAGEVERTRVDYLDRQALDAERRRDLLLAERAGLDLDALAEAFEQIEVQYETQKAALDGLNDQLEQRKQTLADVQHQQRTAQTELADVRKHAQTARGRLSSLETLQQAALGQEQGAAMTWLQAHGLSSAARVGERIRVESGWENALESALGHMIEGVLVDDLQTLVEALNSLNEGHIALVADTQTQIQVAPTSLAAKVQGPVAIRRLLTHLHGAEDLVAARALQATLGEGDWVMTRNGECLGEGWLRVSRSGAAEQGALLRERDIQTLRAQIETLQEREAELEHRLTHFRDHLLMAEQHREDAQRQLYIAHRGVSELAGQRQAHHGKLEASRGRIQHIEAEIAQLLETLDTSRDQARTARATLDEAVTRMGDLESQRQALHAERQQLNLTRDQAREAARSVREAMHALALTLESQRTQMVSLSQTLQRMNNQRGQLDARLEELMNQLSEGDSPVEILEQQHQAALSERVRTEHLLVQARTHLDGIDAELRQFEHTRQQRDEQALSQRERISQCRLDQQALALGAEQRQAAVEKAGLRLTAPCDALPEAANPADWEAAIEQLDIRIRRLEPVNLAAIHEYNEAAQRVEYLQAQHEDLTVALQTLEDAISKIDRETRGRFKETFDRVNAGLQTLYPRLFGGGHAYLELTSEDLLDTGIAIMARPPGKRVSSISLLSGGEKAMTAVALVFAIFQLNPAPFCLLDEVDAPLDEANVGRLASMVKEMSEKVQFLFVSHNKSTMEAAQQLSGVTMREPGVSRLVSVDLAEATRLV

SEQ ID NO: 9433 - protein, 654 aa, Xylella fastidiosa
LNSPQRAAVLYREGPLLVLAGAGSGKTRVIVEKIAYLITSDCYPAKRIAAITFTNKSAKEMRERVAKQIKSSRADGLTICTFHALGLKFLQIEHDAVGLKPGFSVFDADDADAQINDLLHGAKQDVIDDTKRRISRAKNAGLSPEQALAAARTTREMEVATLYARYQARLIAFNAVDFDDLICLPVQILETSDQVAMAWRERIGYLLVDECQDTNDAQYRLLKVLASPRGNFTCVGDDDQSIYAWRGANAENLLQLERDYPQLKVIKLEQNYRCPNRVLRAANALIAHNAHAHLKTLWSDQKDGERIRIWECRDSEHEAEKITAEISYLGDAKQVPWSDFCILFRGNFQSRPLEKALQLLRIPYHLTGGTAFLERQEVKNLLSWLRLLVNPDDDAAFLRAVQSPKREVGSTSLAKLAELAAAKQMPMSRAAESLGALQQLPARAANGLNKFTDILRELRQQVSRVSAAELVRRLAEVSGLLTELREQSNDEASYQRRKRNVEELAEWFEGGPFGASVGDLVSQLALLSRNDKDDGGNQVRMMTLHASKGLEFRYVFIVGCEDGVLPHEVSLEEGNVQEERRLLYVGITRAKEQLWMSYSKCARRFGERVRFKPSRFFDELPAEELQRDGADPVVDAERKQERAKAGLAAIQALL

SEQ ID NO: 9434 - protein, 217 aa, Xylella fastidiosa
ESSWKAHVGNWLLRPEMRDLSSFLRARKVAGVSVYPPGSQIFAAFEATPFQRVKAVILLGQDPYHGQGQAHGLCFSVRPGMPLPPSLLNIYKELEEDLGLLRPDHGCLLPWANRGVLLLNAVLTVEDGRAGAHQGKGWEGFTDHVVDTLNREREGLVFMLWGSYAQAKGKVIDTRRHLVLKAPHPSPLSAHRGFLGCRHFSLCNQYLSQHGLGMVDW

SEQ ID NO: 9435 - protein, 209 aa, Xylella fastidiosa
MTSQRVRDRLVERLRECGIQDERVLSTIRIVPRHLFIDEALALRAYEDTALPIGHGQTISQPWIVARMTEAVMQVAPKKILEIGTGSGYQSAILASLGLEVYTIERIGKLLRQARKRFRQLGIKIRSKHDDGSTGWTEHAPYNAILVTAAAPTLIDTLIEQLAIGGRLVAPVGTASEQALVQLTRTIDGSITHEILEPVTFVSLLPGML

SEQ ID NO: 9436 - protein, 377 aa, Xylella fastidiosa
TSAVRAGIDSDTAHGAVTPPIVLSSNFSFERFGHKRKYDYTRSANPTRDLLGEALAELEGGAGGVVTATGIAAITLVLHALLRPGDRLVVPHDAYGGSWRLFNALAQKGHFELITVDLTDARSLVEALALPPKLVLIETPSNPLLRITDLGAVIEAAHRVGALTVVDNTFMSPVLQRPLEFGADLVLHSTTKYINGHSDVVGGVVVARDVAHYQQLVWWANALGLTGSPFDAFLTLRGVRTLDARLRVHQENAQMIAALLEGHGVVKHVHYPGLASHPGHVLAGRQQKGFGAMLSFELQGGEEAVRAFVSGLRYFTLAESLGGVESLIAHPASMTHAAMTPEARAKAGISDGLLRLSVGIEAGEDLIVDLVAGLRRA

SEQ ID NO: 9437 - protein, 526 aa, Xylella fastidiosa
LILLLETEYTTAPPSPINAATSDTTSPPPPSPQPAASKPTAPDQLHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAVMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNISAEKAGVNVTERGFIPVDRQMRSNVPHIFAIGDIVGNPMLAHKATHEGKLAAEVAAAETESGKHREWVARVIPSVAYTNPEIAWIGMTETEAKAKGLNIGVAKFPWVASGRAIGIGRTEGFTKLIFDEDTHRIIGGAIVGVHAGDLLAEIGLAIEMGAEAEDISHTIHAHPTLSESIAMSAEVYDGTITDLYLPKK

SEQ ID NO: 9438 - protein, 756 aa, Xylella fastidiosa
MTIVTNLGFPRIGARRELKRALESHWRGETDATQLQHTARELRARHWRLQRDAGVDLPPSNDFSLYDHVLDTAFLFDAIPQRYHGLVDADPLAGYFAMARGRQADNIDLHALEMTKWFDTNYHYLVPELHRDQHFALRGNKPIAEFEEALALGITTRPVLLGPVSFLLLSKTVDGSNRLDLLERLLPVYTQLLRQLQESGAEWVQIDEPTLVLDLDAQTQQAFRKAYATLNQGPRPKLLLTSYFGPLGDNLELALQLPADGLHIDLVRGTEQLDAVLNTLPAGRVLSAGLVNGRNIWRTALDNALTLARYAQGRVDKDHLWLAPSCSLLHVPVDLEQEKNLDADVRNWLAFAKQKLSELRVLADALDNKPEAETALTQTRQALEARRQSPKVHRPDVAQRLAALTPDTTRRNTAYPQRSQAQQHTLNLPAYPTTTIGSFPQTLEVREARAQFKSGKLSESDYEAFLKAETERCVRTQEEIGLDVLVHGEFERNDMVEYFGEQLDGFIFTKLGWVQSYGSRCVKPPIIYGDVVRPAPMTVTWSAYAQSLTDKPMKGMLTGPVTMLQWSFVRDDQERAQTCRQIALALRDEVQDLEKAGIKVIQIDEPAIREGLPLRRGEWADYLNWAVESFRIASSNVHDTTQIHTHMCYSEFNDIIEAVAALDADVISIETSRSRMELLDAFVKFRYPNAIGPGVYDIHSPRVPQEEEMVLLLKKARAVLPPEQLWVNPDCGLKTRGWKETRAALQTMVHAAQRLR

SEQ ID NO: 9439 - protein, 494 aa, Xylella fastidiosa
KYILAIDQGTTSSRAILFDHKGRITGMAQREFTQIFPQPGWVEHNPRDIMTSVYTTITELLNNTQIDVRAIAGIGITNQRETTVIWNRQTGQPIYNAIVWQSRQTKNICDQLTTAGYQDLVHAKTGLLMDAYFSGTKVKWILDHAENAHTQAARGELAFGTIDTWIIWNLTGGQVHVTDYSNASRTLMYDIHALRWDPDLLTMLDIPAAILPDVRSSSEIYGLTQTPYFHGEQIPIAGIAGDQQAALFGQACFEPGMAKNTYGTGCFMLMHTGKKAVESKNGLLTTIAWGLNGEIEYALEGSIFIAGSVVQWLRDGLRMFGKASDSQAYADRVSDNGGVYVVPAFVGLGAPYWRSDVRGAVFGLTRSTTKEHFVRAALESMAYQTRDVLSAMQADADIELKELRTDGAAITNDFMAQFQSDILAVPVLRSQIAETTALGAAYLAGLATGFWSSREEMTQHWAINRCFKPQMDKEQREHLYAGWKQAVAATLGFR

SEQ ID NO: 9440 - protein, 489 aa, Xylella fastidiosa
  unsure (1)..(489): unsure at all Xaa locations
FDLLVVGGGINGTGIARDAAGRHLSVCLCEQHDLASHTSSASTKLIHGGLRYLEYYEFALVSKALAEREILLRQAPHIVRPLHFILPHQPHLRPTWIIRAGLLLYDHLGFSRRTLPSSRRLNLAQHPAGQPLKQELHTGFMYCDAQVQDARLVVLNAMDAAQRGARILTAPAAXERAVTAHIGXLNWKTLQGRHQQIRTRAIVNAAGPWAVTFLDHIAQQPHQHTLRLVKGSHIVVPRLFEHEHAYIFQEPDRRIVFAIPYEQHFTLIGTTDVDYVADPANPHIDAAETIYLCNAVNAYFRQQITPEDVLWSYSGVRPLLNDGHNNASKVTRDYQLEILGNSAPLLNVFGGKLTTYRKLSEEAVNQLCVALDHPYRAWTANGPPLPGGEHHDIAALQNTLRQHRPWLPTATAQRLIHNYGTCAETLLGNATNLHTLGIHFGADLYQAEVDYLRTHEWACSAEDILWRRSKLGLHLDAHSTQRLEDYLRS

SEQ ID NO: 9441 - protein, 428 aa, Xylella fastidiosa
MNHSRSHALFVQAQTRIPGGVNSPVRAFRSVGGEPFFVARADGPYLFDVDGHRYIDYVGSWGPMIVGHNHPGVREAVQVAISNGLSYGAPCAAEVTMAETIARLVPSCQMVRMVNSGTEATLSAIRLARGATGRNYIVKFEGCYHGHGDSFLVKGGSGMLTLGLPSSPGVPAELSKLTITLTYNDFDAATALFEEMGHHIAAVIVEPVIGNANCIPPRPGYLQHLRTLCTQYGVLLIFDEVMTGFRVALGGAQALYGVTPDLTTFGKIIGGGMPVGAYGGRRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTIA

SEQ ID NO: 9442 - protein, 330 aa, Xylella fastidiosa
AYPHYRPRRMRRHPFIRRLIREYTLTVNDLIWPVFVHGLPRRTPIASMPGVERLSLDALLHEAEHALTLGIPLISLFPVIDPALKSLDAAEAWNPDGLVQHAVRALKTRFPEIGVMTDVALDPYTTHGQDGIINSQGYVLNDITVEALVKQSLSHAQAGANIISPSDMMDGRIGAIRKALDTHPNFVDTSIMAYSAKYASAFYNPFRDAVGSATNLGKADKKTYQMDPANSDEALREIALDIEEGADMVIVKPGLLCLDVVRRVKETFRMPTYAYQVSGEYAMIKAAVSNGWLEERSSVLETLIAFKRAGADGILTYFAPQVASWLREGK

SEQ ID NO: 9443 - protein, 203 aa, Xylella fastidiosa
LTVPTWLTLLRIVMIPVLIVVFYLPYQWSNIVATGVFAIAAITDWLDGWIARRYAQHSLLGAFLDPVADKLMVAIALFLIVQGHPTPSMAFWAAVIVSREIAVSALREWMAEIGHRAKVRVAVLGKVKTTAQMIAVLCLLYSVTPEKKAIHQIWFGHLIFQVGYWTLLISALLTLWSGFQYLRAAWPSLRTGKPVVIKTHISK

SEQ ID NO: 9444 - protein, 824 aa, Xylella fastidiosa
LPIDALLPAITTSLSNHPRLILEAPPGAGKTTQVPLALLDAPWLNGRSIILLEPRRVAARNAALFMARQCGEEVGGLVGYHIRFESKVSARTRIHVVTERILTRIIQDDPLLDGIGALLFDEFHERHLASDLGLALALDVQTQLREDLRIVVMSATLQGQRLAQFLDAPRLTSEGRAYPITITHFPARRDESLETQARRAIQHALDTHQGDVLTFLPGQREIARLQAILEKTLSPELHVMPLHGELPLQEQTRVLEPDQHGRRRIVLATNVAESSITLPGISVVIDSGLAREPAYDPNTGFTRLDVVSITQASADQRAGRAGRLAPGWAYRLWPQSQRLEAQRRPEMIQTELSGLALELTAWGSSTLRFIDPPPSGALSAARELLQRLGAISNTSTLTPLGQRMLALGIHPRLAAMLLAPHDPQEQALACDLAALLDARDPLRGSGDALISRWRALAELRSGCLPHDTRRSTLRAIDAATHQWRRRIRCDTTPPDAIEAHTLGNLLTHAFPERIAARHSSDPLYYVLANGRRMRLFDNSALHGEPWIIASELHHGIKDIQLLCGAPLDERRLHADFPERFIQHDVIRWETDKRALVAQRESCFDRIVLDVRPAGRIDPVQAANVLTGAVRTLGLDTLSWTEHLRQWQARAVALRHWMPELELPDLSNTTLLATLDTWLRPAFAGKTRLDALDEAAFEQAVKSLLSWTQHALIDRHVPAHIIVPSGMGRHIDYGLADDGTPQPPVLSVKLQELFGLPDTPHIAKNRIPLTLHLLSPGGRPLQVTQDLKSFWTNTYPEVKKEMKGRYPKHPWPDDPWTATATHRTK

SEQ ID NO: 9445 - protein, 335 aa, Xylella fastidiosa
RCFNIAIVGATGAVGEAMLSILEERHFPVAKLIPLASARSTGSQITFKGESINVLELEHFDPHGVDIALFSAGSRVSEAYAPQFAAAGVVVIDNSSAFRYEEDVPLVVSEVNPHALKQRPRGIIANPNCSTMQLMPVLAPIHREYRIERINVATYQSVSGGGRSALEELGQQTAQLLAFQEINPKRFPVQIAFNLIPHIDDFQSNGYTKEEMKLVWETKKILEDSSIQVNPTAVRVPVFFGHSEAVNIETQKKVTSEQARALLASAPGVEVVDEWQPGGYPTPVTHASGKDPVFVGRIRDDLSHPRGLNLWVVADNIRKGAALNAIQLAELVTGE

SEQ ID NO: 9446 - protein, 361 aa, Xylella fastidiosa
MGANTFGKLLAVTTFGESHGPAIGCVIDGCPPGLELAAEEFAHDLQRRATGRSRHTSARREADEVEILSGVYEGRTTGTPIALLIRNTDQRSKDYATIVRQFRPGHADYTYWQKYGIRDPRGGGRSSARETTMRVTAGVVAKKWLKQRYGVIVRGFLSQLGEIRPEGFAWDAIEDNPFFWPHAAQVPALEAYMDALRKSGNSVGARVGVVAEGVPPGWGEPIYGKLDGELAAALMSINAVKGVEIGAGFGSAVQKGTEHRDLMTPLGFLSNHAGGIIGGIATGQPIIVSIALKPTSSLRLPGETVDVDGCAVQVITKGRHDPCVGIRAPPIAEAMVALVLMDQALRHRAQCGDVGEMSPCI

SEQ ID NO: 9447 - protein, 276 aa, Xylella fastidiosa
NFVTTLTYLLPHRMLSSLARHIAYCQHPLIKQWLIDTVIAKFDVNLSEAAEPDAHAYPSFNAFFTRSLKAGIRLPDPNPDTLLMPADGRISQLGPIREGRIFQAKGQSFTATELLGDTAAASAFTNGLFATVYLSPRDYHRVHMPCTGQLLKTVHVPGRLFSVGPDAVRQIPRLFARNERLVCHFDTAFGPMVLVMVGALLVSGVETVWGGVEIPAYGDRITHKDYQGRNIAIERFAEMARFNYGSTVIVLLPPNVFTLAPHLTAESPVTLGQALA

SEQ ID NO: 9448 - protein, 381 aa, Xylella fastidiosa
ERILSLRKLRLAQCRTRTRRTIERRNGVRLEINGSWLVEFCSNDYLGLAQHFEIIAALQDAAARNGIGATASHLICGHHAIHKALEYELAEWLGYPRALLFGSGFTANLAVQQALLTKENDICVQDRLNHASLIDATRLAGCRLRRYPHLDVDGAAHQLKNAPEGAAMLATDGIFSMDGDIAPLRALSLVARTQQALMYVDDAHGIGVTGPQGRGCIAAAWLSVEEVPLQLVTLSKALGGYGAAVLGSATLIQHLAETARPYIYTTALPPAQAAAALTAIRIARRDEWRRQRLQELVERFRENSRRHGLEIMDSETPIQPLQCGDETTTMAMSAALEREGFLVNAIRPPTVPEGKSRLRVTLSALHTTEQIDTLVQALARS

SEQ ID NO: 9449 - protein, 421 aa, Xylella fastidiosa
MSKIVVAGGTPLYGDVRISGAKNAVLPILCATLLADAPVEISNVPYLHDVITMINLLRELGAGVTMNEGIEAKGRSITVDPRWVRQRVVPYDLVKTMRASVLLLGPLLACYGAAEVALPGGCAIGSRPVDQHIRGLQSLGAEITVENGYIKASVSQGRLKGGRFVFDVVSVTGTENLLMAAAVAQGTSVIENAAMEPEVVDLAECLITLGARVEGAGTPRIVVEGVERLKSGQYAVLPDRIETGTFLVATAMTGGRISMQQVRPQTLDAVLGKLTEAGACIEIGADSIRLDMQGRRPCSVNLTTAPYPGFPTDMQAQFMALNCVAEGVGVIKETIFENRFMHVDELLRLGAKIQIEGHTAIVQGVERLSGAPVMATDLRASASLILAGLVAEGETIIDRIYHLDRGYENIERKLGVLGASI

SEQ ID NO: 9450 - protein, 564 aa, Xylella fastidiosa
MNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDHLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLLLQKITNGDMLIIDGNSGEIIVNPSPQDLRHYHSRLRERAKEQRELEQLRSKHSRTRDNVDIVVQANAESPDDVSQAYTLGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGTLKTSATTLLRARDPEEHRR

SEQ ID NO: 9451 - protein, 320 aa, Xylella fastidiosa
LSLPQIQSFAASDMAAIDTLIHDRLTSDIVLINQIADHIICSGGKRLRPMLTMLAGHAIGPTGPHHHQLAAIIEFIHTATLLHDDVVDGSELRRSRSTANALWGNAPSVLVGDFLYSRSFQLMTELANLEVMQILAETTNRISEGEVLQLLHVHNPDTDETTYLSVIERKTAILFAAAAQLGALASHADTQTQTRMYEYGMQLGYAFQITDDVLDYTANNSQLGKNLGDDLAEGKATLPVIHAMTHSDAATCERLRMIISKGDSDAMPEVLNAIRTTGSLDYSRQRASAYAATAERALDGLPETEAVAALRGLARYAVQR

SEQ ID NO: 9452 - protein, 399 aa, Xylella fastidiosa
QHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVVDTGPGLSEEQCQRLFRRFEQVNGASTAARYGGSGLGLAICRELATVMEGEIHVDSELGKGTCFRVLLPLPWVLAVQPAVAVMDMEPSPCSNPLHLLLIEDDPTVAEVIVELLRVRGHRVTHALHGLEALVEVTLTRFDACLCDLDLPGLDGAGLIVQLRAQGQSFPIVVVTARTDADAQRQAFQVGCDAFLRKPVTGEMLEQVLTQVLSAPRQEVDVIRQKKGMEWEGL

SEQ ID NO: 9453 - protein, 353 aa, Xylella fastidiosa
LKNDRLLRALRRDTVDRTPIWLMRQAGRYLPEYRAARQHAGSFLKMAKTPELACEITLQPLRRFPLDAAILFSDILMIPDAMGLELHFIEGEGPRLGKPIRDAAAITQLAVPDMETELRYVMDAVRLIRKELDNSVPLIGFSGSPWTLACYMIEGGGSKEYAHIKAMAFNAPDVLHQLLNTVTDAVISYLAAQRAAGAQALQVFDTWGGILSPTMYRTFSLPYLTRIARELERGTGTEHTPLVLFGKGNGPYIAELAMSGTEAVGVDWTIELEDAARRSNGQVALQGNLDPATLYGTPNNIAREVQRTLDSYAAGNGGSREGHVFNLGHGMTPGMDPDHVSALVEAVQRLSRR

SEQ ID NO: 9454 - protein, 454 aa, Xylella fastidiosa
RIEHDSMGDLRVPIDALWGAQTQRAIENFPISGRSMPQGFIHALGFIKAAAAKVNAELGLLPKSMAKEIEAAALDVAAGRYDAEFPVDIYQTGSGTSSNMNANEVIATLAMRATKGPIHPNDHVNLGQSSNDVVPTAIRISATLAVQGRLLPALKHLRKMINKRARGLGSVVKTGRTHLMDAMPLTFAQEFGAWSAQIVSAEARLNDTLKRLHRLPLGGTAIGTGINTDPHFGRNAVKVLSALTGIHFESANNKFEGLAAQDDLVELSGQFNALAVALMKIANDLRWMNAGPLAGLGEIELPALQPGSSIMPGKVNPVIPEAVVMVALQVIGHHTAVTVAGQSGNFQLNVTLPLIAYNLLESATLLGNVVMLLADKVIVGLKVRQDRVQEVLERNPILVTALNPIIGYEKAAVIAKRAYKEHRPVLEVACEESDLNPAELARLLDPTALTEGGI

SEQ ID NO: 9455 - protein, 728 aa, Xylella fastidiosa
VNVSHVLDHLNQNQREAVAAAPGHYLILAGAGSGKTRVLTHRIVWLNEVNGVPTHSMMAVTFTNKAAGEIQQRIDLQLRHGKRGMWIGTFHSLAHRLLRLHWNDATLPENFQVIDSDDQLRLVKRVIQSLGLNDTLFPPKQAMWWINTQKDEGRRPEHIQPESHDDWIETQRRIYTEYQERCNRAGLVDFSELLLRAHELLRDTPALLTHYRSRFREILIDEFQDTNAIQYAFVRVLANDTGHIFAVGDDDQAIYGWRGAKVEHVQHFLKDFPNVQTIRLEQNYRSSANILDAANAIIAHNPDRIGKRLWTESGVGESIDLYAAYNEIDEARYIVERARQWVRDGGSYGEIAVLYRSNAQSRAFEEVLQSEHIPYRVYGGMRFFERAEIKDALAYLRLLANRSDDAAFERVVNTPVRGIGERTLDEVRHLARTQGLSLWDAAMACTQSTTLTARARNALASFLNLLQQLAVETNQMGLAERIDHMLQRSELRQHWKKEARGSLDAESRQENLDELVSVASRFVLPQNDEDTPIMTELDAFLSYACLESGDGQVQAGEEGVQLMTLHSAKGLEFPLVFLVGLENGLFPSARSLDEHDRLEEERRLAYVGITRARHKLILSYAQARRIHGKDNYNVPSRFLREIPQNLLHEVRPTIQVSHQTPLGAVQRPAHDERDAAPIKLGVNVMHPTFGCGVVVDYEGSGAHTRVQIKFDDAGTKWLVMAYAKLSVV

SEQ ID NO: 9456 - protein, 444 aa, Xylella fastidiosa
MLDKVVIANRGEIALRILRACHTLGIRTVAVHSTVDRNLKHVAMADESVCIGPAPSAESYLNIPALIAAAEVTDAQAIHPGYGFLSENASFAERVEQSGFIFIGPRAETIRLMGDKVQAIHAMKAAGVPCVPGSDGPLGDDIVANVKIAREIGYPVIIKAAGGGGGRGMRVVHTEVGLKAAIETTQCEAKAAFGNGQVYMEKFLENPRHVEIQVLADGQGNAIHLGERDCSMQRRHQKVVEEAPAPGITEALRNEIGQVCVDACIRIGYRGAGTFEFLFENGRFYFIEMNTRIQVEHPVTERITGIDLVCEQLRIAAGQPLSIKQSDVVLRGHAIECRINAEDAETFLPNPGLITAFHPPGGPGVRMDTHIYSGYKVPPNYDSMIGKLIVHGPDRETAIARMHLALSEMVVDGIKTNIPLQQRIMCDKGFQSGGQNIHYLEKCL

SEQ ID NO: 9457 - protein, 144 aa, Xylella fastidiosa
MAHLLLLHGPNLNLLGTREPEIYGRITLPQIDAALAERAAAAGHGLSSLQSNAEHVLIERIHATREDGTAFILINPGAFTHTSVALRDALLAVALPFVEIHLSNPHTREPFRHHSYLADKALGVVCGFGVDSYRIALEGVIARL

SEQ ID NO: 9458 - protein, 395 aa, Xylella fastidiosa
LFTDVELVPGDPILSLNDAYNADTRTNKVNLGIGIYCDESGCIPLLRAVQQVEEQLAKHPKPRGYLPIDGLPAYIKATQQLLFGVDSLLLTAGRVATSQTVGGSGALRVAAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPPAHGAYLVAGVLNSHELRTLWEQELTQMRERIHGLRAGLVARLKALGAPEFDFIQRQAGMFSYSGLSKIQVDRLRDEFGIYAVSSGRICVAALSQHKLEYVAQAVVKV

SEQ ID NO: 9459 - protein, 783 aa, Xylella fastidiosa
MTQSSQKALDLQVLPLRDVVVFPYMVIPLFVGREKSMRALEKAMDADKRILLVAQKTADIDDPSAVDLHTIGTYAQVLQLLKLPDGTIKVLVEGLTRVSVDQVVEHDGALRGCGIEIASTQEREEREIEAIVRSLLSLFEQYVKTNRKLPPELLQTLNGIDDPGRLADTIAAHLSVRLAYKQRLLETIEIGDRLEILIGLVDGEIDVQQMEKRIRGRVKSQMEKSQREYYLNEQMKAIQKELGDFDDLPSELEELARKIAEIGMPKSVQSKAKSELNKLKQMSPMSAEAAVVRNYLDWLLGVPWRKCTKVRKDLKVAQSTLDDDHYGLDKVKERILEYLAVQSRVKQMRGPILCLVGPPGVGKTSLGQSIAKATNRKFVRMSLGGVRDEAEVRGHRRTYVGSMPGRVVQNLNKVGSKNPLFVLDEIDKMAMDFRGDPSAALLEVLDPEQNNAFNDHYLDVDLDLSEVMFVATSNSLNIPGPLLDRMEVIRIPGYTEDEKLNIATRYLVPKQIRANGLGVEELAIGEDAIRDIVRYYTRESGVRNLEREISKICRKIVKEIALVGVKPFAKKSTKSKVLFAVTSKNLEKYLGVRRFDFGRAEEANEIGLVTGLAWTEVGGDLLQIESTLVPGKGNLILTGQLGNVMKESASAALTVVRSRADRFCIDVDFLHNQDVHLHVPDGATPKDGPSAGIAMVTSLVSMLTKVPVRADVAMTGEITLRGRVSVIGGLKEKLLAALRGGIRTVLIPEGNRRDLADIPANVTRALTIVPVKWIDEVLDLALE

SEQ ID NO: 9460 - protein, 743 aa, Xylella fastidiosa
IHQEFPQLDVAEYKRAVFGFVERKDSVNADDLVDLLIREAEARVDLTAPEWEYFAARLYLRRLYKRASRNRFYDASQKYGSFVGLQESLADRNIYSNDILRSYSKEELIEAGQMIDPERDKLFTYNGLYLLATRYLATDASRGVFELPQERWLTIALYLMQDEYGPGKGGRERRMQLVGEAYWALSNLYMTVATPTLGNAGKINGQLSSCFIDTVDDSLQGIYDSNTDIARVSKHGGGVGAYLGYVRSSGSMIRGVANSSGGVVPWIKQLNNTAVSVDQLGQRKGAIAVYLDIWHRDIEAFLDLRLNNGDQRLRAHDVFTSVCIPDLFMEAVERRGDWYLFDPYEVKRVKGWYLQDFYDEKRGDPNGSFRRKYEDVVADERISRKTVKAIDIFKRIMVSQLETGNPFMFYRDEVNRKNPNKHVGMVYSSNLCTEILQNMTPTRLIQEMISGNQIVTTKHAGDFVVCNLSSINLGRAITVQADLLGADVLERLIPIQVRMLDNVIDLNLLPVPQATITNQKYRAIGLGTFGWHHLLAQKAIHWNSQEAEQYSDVLYERINYLTIRASMELAKEKGTYAVFPGSDWQTGEYFRARDYNSPQWLELAAQVAVNGVRNAYMVAVAPNMSTAQIAGSTASIDPVYSAFYYEEKKDYRRPVAAPGLSLDTWPYYEKGAYKLDQFASIRQNARRQRHVDQSLSFNFYVPSTIRASTLLDLHMTAWREGLKTTYYVRSNDIDISECEWCSS

SEQ ID NO: 9461 - protein, 325 aa, Xylella fastidiosa
IINGKTSGILNWNDIPYPSFYRAYKELSTNFWIPDEVDMKIDKRQYGELSAREKNAYDAIIGLLATLDSPQTRFIYNVAEYITDPAAHANAAIIGQQEVIHNESYSYVLASITDLANQNRVFEIARTHPTILKRNAPIMQAYDDFMREKTAETLLYSLIQSSILEGINFYSGFAYFYNLVRQNRMTGTGKIISFINRDELAHTKFISEVIRAIVGENPELQTDALTDYVHQAFAHAIELETQWTGEVLNGIDGIDVEEMIRYVKYRANKMAGMLGIETLYTETTDNVMPWIRAYADNFTETKTDFFEMRNASYKKTNVDNCFDDL

SEQ ID NO: 9462 - protein, 179 aa, Xylella fastidiosa
MPEAVIFDMDGLMLDSERVSIECRCRAAFDLEQQIEPDYWLQMVGVSDIACHAQLSARIGAVSATALLARSDALYEAVVMKGVPHRPGIVTLLEWLFARGIPCAVGTSTRRPLALRKLNTAGLLSRFDVVCTASEVAQAKPAPDIYLLAAHTLGIVPGRCLVVEDSPIGVRAALAAGMT

SEQ ID NO: 9463 - protein, 326 aa, Xylella fastidiosa
KALVRVAVTGAAGQIGYSLLFRIAAGEMFGKDRSVILQMLELPDEKAQAALKGVMMELEDCAFPLLAGMVVTDNPDIAFKDADAALLVGSRPRGPGMERKDLLMENAKIFTAQGAALNKVARRDVKVLVVGNPANTNAYIAMKSAPDLNPKHFTAMLRLDHNRALSQLSTKLSKPVANIEKLIVWGNHSPTMYPDYRFATADGTPIIEAINDQAWNANSFIPTVSKRGAAIIEARGLSSAASAANAAIDHMRDWLLGSNGKWITMGVPSDGSYGIPEGMIFGFPVTTTNGEYSIVKDLPIDTFSKTYIDKTLAELEEERASIAHLL

SEQ ID NO: 9464 - protein, 270 aa, Xylella fastidiosa
VMKLCGFEVGLNQPLFLIAGPCVIESLQLQLDTAGVLKEITSKLGLNFIFKSSFDKANRTSGSSFRGPGLEEGLKVLEAVKTQIGVPVLTDVHEYTPIDEVATVVDVLQTPAFLVRQTDFIRNVCAVGKPVNIKKGQFLSPWDMKPVVEKAKSTGNSQILVCERGASFGYNNLVSDMRSLAVMRETGCPVVFDATHSVQLPGAQGGRSGGQREFVPVLARAAVAVGISGLFAETHPDPPNALSDGPNAWPLRTMAMLLETLVELDAVTKK

SEQ ID NO: 9465 - protein, 428 aa, Xylella fastidiosa
MTAIVKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSL

SEQ ID NO: 9466 - protein, 252 aa, Xylella fastidiosa
MRLTPLPAFDNNYIWTLIAPDGRAIIVDPGQALPILEAHSKGLIPTAILLTHHHADHIGGVPELLERWPTLPVYAPHDTRIALNYHRIGEGDSLNILGLRFQIIHTPGHTHSHLTFIGNDLLFCGDTLFSLGCGQIFEGTPTQMLASLQRLAALPIQTRVCCGHEYTLSNAAFALHVDPTNTALQKRRQQANAMRLAGLPTLPISLESELNTNPFLRTAAPTIHAATATHLQRTPIDEVEVFATLRHWKNNF

SEQ ID NO: 9467 - protein, 629 aa, Xylella fastidiosa
LEADKQTHGFQTEVKQLLQLMIHSLYSNKEIFLRELISNAADAADKLRFEALSAPSLLEEDPNLRIRVEFDKQAHTITIDDNGIGMSRYEAIAHLGTIAKSGTADFLKTLSGDQRKDANLIGQFGVGFYSAFIVADHVDVYSRRAGLTAAEGVHWSSKGEGNFEVATIDKPQRGTRVVLHLKENEQHFAEGWTLRSTLKKYSDHIGLPIEMLKEHHGKEEEKDTPKEAEWEAVNKASALWTRPKNDIKDEEYQEFYKHISHDMTNPLAWSHNKVEGKLEYTSLLYVPTRAPFDLYHRNAAKGLKLYVQRVFIMDQAEQFLPLYLRFIKGVVDSADLSLNVSREILQSGPVVDSMKAALSKRALDMLEKLAKDAPEDYKTFWKNFGQVLKEGPAEDYSNREKVASLLRFASTYDTSGDPSVALTDYIARMKEGQDKLYYLTGESYAQIKDSPYLEVFRKKGIEVLLLVDRIDEWLMNYLHEFDGKSFVDIARGDLDLGNLDSEADKKAQEEIAKTKEALASRIKATLGEDVAEVRVSHRLTDSPAVLAIGEGDLGLQMRQLLEASGQKVPETKPVFEFNPSHPLIEKLDAEQDMDRFADLSHILFDQAALAAGDSLKDPANYVRRLNKLL

SEQ ID NO: 9468 - protein, 423 aa, Xylella fastidiosa
PFYLQLYFWVIIAIILGALLGHCYPAVGQQLKPLGDAFIKLVKMIISPVIFLTIVTGIASVAHVGTVARVFGKAMVYFLFFSTLALLLGLVVAHVVHPGAGMNINPVDLHQGEIANYVEKSHDLTLVGFLMDIIPKTLLSPFVGDNILQVLFVAVLFGIALALAGERGKPVLNLLDALTVPVFRLVQMLMKMAPIGAFGAIAFTIGKYGVDSLVNLGWLVGSFYLTSLLFVLVILGAVSWLCGFSILKLIRYLKAELLLVLGTSSSESALPSLMEKMVQAGCRKSVVGLVVPTGYSFNLDGTNIYMTLAALFIAQATNTELTPAHQLALFLVAMLSSKGAAGVSGAGFITLAATLAVVPEVPIAGMALILGVDRFMSECRSLTNFIGNAVATLVVSRWENALNHEQLKIALDGNEAAYQSLHA

SEQ ID NO: 9469 - protein, 245 aa, Xylella fastidiosa; identical to SEQ ID NO: 9335

SEQ ID NO: 9470 - protein, 247 aa, Xylella fastidiosa
DLCGPCVTVATACSSSAKVFAQAARLITSGVVSAALVGGVDTLCGSVLFGFNALQLVSPEPCRPFDVHRAGLSLGEAGGFALLERLDLAPDADLLLCGYGESSDAHHMSAPHPEGLGARMAMQEALTRANVDASEVGYLNLHGTASPANDSIEAVAIAALFPPTLHASSTKAWTGHTLGASGIVESTIALLALRGNILPGTMNSEQLDPVCGPQIRCENAHTPILYAMNNSFGFGGNNCALLFKRAD

SEQ ID NO: 9471 - protein, 300 aa, Xylella fastidiosa
LLRIATRKSLLAMRQSEYVAARLRMLCPDLDVVLVPMSTRGDEILDRSLAAIGGKGLFLKELELAMLRGDADCAVHSLKDVPMDLEPPFMLAAVLSRDDPADALISNVYLSLESLPIGARVATSSLRRQAQLRFYRPDLRLFDLRGNVNTRLAKLDNGDYDAIVLACAGLRRLGLEQRMTARLAPPEWLPAPGQGAIAVESLTEDARIGTLLAGLDDLPTRQCVVAERTMNRALHGSCHVPVGAYASYGVGGMRLQGLVGCVADGRLVRAELCSAKDEGDMLGRAVAQCLLDAGAAELLA

SEQ ID NO: 9472 - protein, 220 aa, Xylella fastidiosa
MLETIEHETAPMPQWSVLWLHGLGADGHDFMPIIPELVRPHWPALRFVFPHAPVRPITINNGVPMRAWYDLVSFDFNQRADQAGIEAAVAQVQALMMREQQRGIASERLFLAGFSQGGAVVLSIGLRCKASLAGLIALSTYLPDPNVVTTTTRLLPGSNAQQFFIAHGHSDPVVPLVHGQCAAEVLRKLGFAVDWYTYPMAHQVCQEEIQALGDWLERRF

SEQ ID NO: 9473 - protein, 369 aa, Xylella fastidiosa
MSFSKHFGKLMLATCLSLSTAPAFSYSISHGKVVDDKGNQIQLRGVNWFGFETGDHVVNGLWARNWKEFITQLQGMGFNAIRLPFCPANLNSNTSPSSIDYSRNPDLQGLSSLQILDKVVKELSDRRMYVLLDHHRSDCSAISELWYTDSYGEKQWIDDLRFVAHRYTNVPGVIGLDVKNEPHGRATWGTGDPKTDWNTAVEHAAAAILEAAPKWLIGVEGIGENPICSSTIGHFWGENLEPMDCTPLKVPANHLLLMPHVYGPDVYVQPYFNSPDFPNNMAAIWDQHFGRFAKAGYAMAIGEFGGKYGEGDPRDIAWQNAFVDYLISIGVTDAFYWAANQNSGDTGGMVGNDWTTPRDDKVKLLKKLW

SEQ ID NO: 9474 - protein, 466 aa, Xylella fastidiosa
  unsure (1)..(466): unsure at all Xaa locations
SIEPSMTCRTRFAPSPTGYLHIGGARTALYCWLEARRRNGQFLLRIEDTDRERSTQAAIDAILHAMDWLGLDYDEPPVYQTQRIERYNQVAARLLAEGKAYYAYDSKDTLNAMREAALRTGEKPRYNRGCTXSQPAIPGDPNRVIRFKNPHTGTVAFDDLIKGRIQIANSELDDMVILRPDGYPTYNFAVVVDDWDMNITEVIRGDDHINNTPRQINLYHALGAPLPTFAHLPMILDEQGAKLSKRTGAADVMQYRDSGYLPHALINYLVRLGWSHGDQELFNRQALIDLFQINDVNSKAARLDMAKLGWVNQHYLKTDDPATLAPPLVWHLEQRGIDVSAGPAPTDVILALRERVQTLKEMAEKAEIWYCPLQRYDEIAVAKHLKPGAETALLHARTLLAALPAWTVDNVDTALRTIATTLEIGMGKVAQPLRVAITGTQVSPDIAYTVYLTGRNEALKRIDAAL

SEQ ID NO: 9475 - protein, 390 aa, Xylella fastidiosa
MSIVRMTDLALSGKRVLIRQDLNVPIDQGLITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARS

SEQ ID NO: 9476 - protein, 476 aa, Xylella fastidiosa
MSERQRRTRILATLGPATDPPGVLDALFKAGVNVVRLNFSHGDVSDQARRAAEVRAAAAHVGVEIGILADLPGPKIRIGRFIGGKVRLVAGARFDLLADSNASLGDATQVGVSYLGLPQDVVAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEV

SEQ ID NO: 9477 - protein, 344 aa, Xylella fastidiosa; identical to SEQ ID NO: 9266
  unsure (1)..(344): unsure at all Xaa locations

SEQ ID NO: 9478 - protein, 332 aa, Xylella fastidiosa
TMALKNFLNTQDWSCSELNALLTQARAFKHNKLGNALKGKSIALVFFNPSMRTRSSFELGAFQLGGHAIVLQPGKDAWPIEFDTGTVMEAETEEHICEVARVLGHYVDLIGVRAFPKFLDWTYDRQDIVLNSFAKYSPVPVINMETITHPCQELAHIMALQEHFGTTDLRGKKYVLTWTYHPKPLNTAVANSALTIATRLGMDVTLLCPTPDYVLDERYIDWARQNIADTGSTFQVSHDIDNAYRGADVIYAKSWGALPFFGNWAMEKPIRDQYRHFIVDEAKMALTNNAVFSHCLPLRRNVKATDAVMDGSNCIAIHEAGNRLHVQKAVMA

SEQ ID NO: 9479 - protein, 386 aa, Xylella fastidiosa
VLAFSGGLDTSFCIPYLKEQGYAVHTVFADTGGVDEDERDFIEKRAAELGVASHLTVDGGPAIWDGFVKQLVWAGEAYQGQYPLLVSDRYLIVDAVLQRADALGTCAVAHGCTGMGNDQVRFDLAIKAQGDYTIIAPIREIQKEHTQTRLYEQKYLEERGFGVRAKQKNYTINENLLGITLSGGEIDKWEAPGEGARGWCAPRSAWPTDPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQANVNGEIVLETRGGRVDAVAVRSPHILTSKGVTYAQTADWGIEEAEGFIKLFGMSSTLY

SEQ ID NO: 9480 - protein, 767 aa, Xylella fastidiosa
  unsure (1)..(767): unsure at all Xaa locations
PGRVRPPTTANPMHANLQTRQIIIRLLSSMASAKEISQYLKRFSQLDAKRFAVVKVGGAVLRDDVDALTSSLSFLQEVGLTPIVLHGAGPQLDEELTAVGIQKKTVNGFRVTLPETMAIVRKVFHATNLQLIEALQRNGARATSITGGVFEAHYLDQETYGLVGGISAVNIAPIEASLRAASIPVIASLGETPSGQILNINADVAANELVHVLQPYKIIFLTGTGGLLDADGKIINSINLSTEYEQLIQQPWVYGGMKLKIEQIKHLLDRLPLESSVSITRPADLAKELFTHKGSGTLVRRGERVIRATTWKDLDLPRLQHLIQSSFRRTLIPHYFETTPLLRAYVSENYRAAVILTKLGNVPYLDKFAVLDDAQGEGLGRAVWSIMREETPQLFWRSRHNNQANAFYYAESDGYYKQDHWKIFWNGLHHFQQIQQCVAHCAQHPPTLIDXRXAPPPSPLALLGARGYTGAALISLLTAHPAIELIFVSSREYHGQPVAAHSPTYCGDLRFETLDPAAVAAKRADVVILALPNGNAAPYVHAIDATAPPTIIIDLSADTRFDPDWYYGLPELTRHTYTGHKRISNPGCYATAMQLAIAPLRDQLAGPPQCFGVSGYSGAGTTPSDKNNQALLRDNLMPYALTDHLHEREVSAQLGIPVEFMPHVAPHFRGITLTANLWLQRPLTREHIKTLYATRYANDPLIDIIDPPPWVNQIAARHTVQIGAFTMAPGNKRVVIVATLDNLLKGAATQALQNLNRALGLDELTAI

SEQ ID NO: 9481 - protein, 404 aa, Xylella fastidiosa
LWNKPGVAIDASIQTFLAADDVLLDREFFLYDITASTAHAQALQRIGLLTPDELDNILRELQHLTDEYRNGTFLLDTQYEDGHSAIESRLTERLGDTGRKIHTGRSRNDQILVATRLWLKDRLTQLSTLNRDIAHHALQRAAAEQHLPMPGYTHLQRAVVSSVGMWWAGWAESFIDNALRAADTLALIDCNPLGTAAGYGVNLPLDRPHTTTALGFARLQVNPICAQLSRGKFELAALEALGSATLDLRRIAWDLSLFTTSEFAFITLPPEYSTGSSIMPNKRNPDVIELMRATHASVAAARTEIEQLLSLPSGYHRDLQNSKGAIVRGFNRGLAALELLPALLSRLQWRPDTLRAAIDPGMYATDAAIEAAITGIPFRDAYQMAAKTADTAAQGRTPETSLTA

SEQ ID NO: 9482 - protein, 413 aa, Xylella fastidiosa
PHIRHLAQQCRDAARILATLSTDAKRRLLETMATALNTDAATILAANAADLDTARTQQVGTAMLDRLALDPQRLAAMADALRDIAALPDPVGQVTRDDRRPNGIHIQKIRVPLGVIAMIYEARPNVTADAAALCIKAGNGIILRGGSEAIRSNIAIATALQRALRLASLPETALILVQDMARHTMLELLQLSDLIDLVIPRGGEGLIRFVAEHARIPVIKHYKGVCHQFVDASADIEMAIRLLIDGKTTRPAACNALETLLVHTDIAPRFLPAAAAALRPYGVQLRGDHATCTLLPDVLLATDADYAAEYLDLILAIRIVPNLDAALEHIRRYGSDHTEVIVTADPAHADTFVQQLHSAVVMVNASSRFSDGGALGLGAEIGISTTRLHAYGPMGLDALTVERFVVRGQGQVR

SEQ ID NO: 9483 - protein, 246 aa, Xylella fastidiosa
KLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRAAEMVANQGKAK

SEQ ID NO: 9484 - protein, 606 aa, Xylella fastidiosa
VTIEIDGQNLVVPKGSMIIQAADNAGIPIPRFCYHEKLPIAANCRMCLVDVEKVPKPLPACATPVMEGMKVRTRSEKALQYQRSVMEFLLINHPLDCPICDQGGECELQDVSMGYGRSISRFHERKRVVPDEDIGPLVATEMTRCIQCTRCVRFTADIAGTYELGCMYRGENLQIGTYDGKPLITELSGNVVDVCPVGALTNKVFQFRARPWELMAYQSLGYHDAMGSNLFLHVRQGEVLRTVPRGNEYVNECWLSDRDRYSHQGLYAADRAVKPLKKVGDQWLEVSWAEGVSAAAEILSAHRGDALGVLVHPATSNEEGALLARLAAGLGTGHLDHRIFNRDFSDVAVAEPFALPLAEIGNADLVVLFGSNIRQELPLLHARLRKAVTCNGAKVYAVNPVDFDFTFSLTGKSIVPPSQLANVLTDTALLNAAKAAARVVIVVGALAENHPQGATLRAAARQFAEVTGAALCRIPQGANAIGLTQHGVLPTGRDAAAMLVEPCQAYVLYGIEPGLDFADTATARQALHGAKVVAFSHFACASTRDVADVILPIGLLPEIDGTLTNLDGRTQAAKPGGKLPLEAREGWRVLRALGGELGLSGFDFLD

SEQ ID NO: 9485 - protein, 247 aa, Xylella fastidiosa
MRPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARA

SEQ ID NO: 9486 - protein, 617 aa, Xylella fastidiosa
MPIRQLPEILINQIAAGEVVERPASVVKELVENAIDAGATRVDIELEAAGVRLIRIRDNGHGMAAQELPLAVLRHATSKIASLDDLEAVATLGFRGEALPSIASVSRFTLMSRRATDEHGAVLQIEGGTLGEVIPHAHAPGTTVEVRELFYNVPARRKFLRAERTELGHIEEWARSLALAHPDLELRLSHNGKLSRRYKPGDWYSDARLIEILGEDFAHQALRVDHSGAGLRLHGCIVQPHYSRLNADQQYLYVNGRPVRDRSVAHAVKQAYSDVLYQGRHPAYVLFLELDPARVDVNVHPAKHEVRFRDARLIHDFVYRTVQGTLAQTRAGTPPLAVGVGDVEGEGEGARPPGRHAVSFSGRRGGASHVLGSYSTSTAPLMQGVPSVSVADAPAAYAALYAAPPTQVMDAVPQMQTGLPLAAGAGDVPPLGYAIAQLHGIYILAECADGLIVVDMHAAHERIGYERLKRAHDGIGLRTQPLLVPMTLMVAEREADVAECEAETLASLGFEVTRSGPGSLQVRSIPALLSQAEPEMLLRDVLSDLSEHGHTRRVAEARDTLLATMACHGAVRAHRRLSISEMNALLRDMEATERSGQCNHGRPTWARFSLAEIDRWF

SEQ ID NO: 9487 - protein, 514 aa, Xylella fastidiosa
LSSSDLSEPVSVKTLWGEVQRPSLPTHVCTVLPARLTPKHGSIDALDANPQASKPDTKRLQDAIDDCPAGSAVKLVIDSHRKSGFLSGPLHLKSRVTLWIDDGVTLFASRNPKDYDKGNGTCGTATSTHEFSCMPLISAINTTGSGIVGGGVIDGRGGSILTGGKHARQRTWWDLAYQNKRHALHQQVPRLIQIRGGNDFTLYRVAIENAPNFHVVADTVSGVTVWGIRILTPSLVYTTPGYHCPPGTTPDVVTPATCFTPDTVKNTDGFDPGQSNHVLLAYSYISTGDDHVAIKARGKMPSYALSFLHNHFGYGHGMSIGSDIESGVHDMEVSDLSIDGFDSPNSNGLHMKSDADHGGVVDHVTYSKICMRRLKRPLAFDTFYKPSNGNSYPLFKNIVLQDIHVLESPVFGAGQLLFMGILGSGNNMPMTLSLDNVVFDGFLPTLIAPPSSVVFANPQAVHFHFGPGPVSFAPLITSSVAYDVTVSGSPSVGNPYDCSAAFINFSSVFPDSPI

SEQ ID NO: 9488 - protein, 226 aa, Xylella fastidiosa
VSKNYRQSELDKFAAFTSGWWDPHGPQKPLHALNPVRLDYISKRVSLSGARVLDVGCGGGLLSEALARQGAHVTAIDLAPELIKAARLHGLESGIQVDYRIQAIEDLLAEQPAPFDAIACMEMLEHVPDPAAIVDACAHLLKPGGRLFVSTINRTLAAFMLAVVGAEYVVRLLPKGTHQYKDFIRPAELAAWLRHAGLHLEDVSGMRYEPWRNRARLTARTDINYL

SEQ ID NO: 9489 - protein, 469 aa, Xylella fastidiosa
LPSFLKRKSIDLITVHEEGRRLVPTLSWPHLIAFGIGAIVGTGIYTLIGVGAEKAGPAVLLSFVIAGVICACAALAYAEMATLMPVAGSTYTYSYVALGEGIAWIVGWSLILEYSLVVSTVAVGWSGYMTGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNERTGTPIATTLFTAILVATAAGLVPLGEIAALANAGTLTAFIAVALCLLVMRVREPQRVRAFRTPLAWVVGPIAIAGCLYLFWSLPKMTQSLFLLWNALGLCVYLVYGRHTSLLSK

SEQ ID NO: 9490 - protein, 403 aa, Xylella fastidiosa
MSSYLFTSESVSEGHPDKVADQISDAVLDAILVQDPRARVACETMVKTGVAIIAGEITTSAWVDLEALTRKVIVDIGYNSSDVGFDGATCGVLNLIGKQSPDINQGVDRKKAEEQGAGDQGLMFGYATNETDSYMPAAIHISHRLVEQQAKIRKKSNSPLPWLRPDAKAQITLRYEDGVASAIDAVVLSTQHDPGIKQKDLVEAVREEILKPVLPSKWLHKGTKFHINPTGKFVIGGPVGDCGLTGRKIIVDTYGGSARHGGGAFSGKDPSKVDRSASYAVRYVAKNVVAAGLADRCEVQVSYAIGVAEPISISVTTFGTGKVPDDKIEKLIRQHFDLRPYGIIKMLDLIHPIYQPSASYGHFGRKPREFAYTNSNGGRVVATAFSWEKIDKAEVLRADAKLK

SEQ ID NO: 9491 - protein, 446 aa, Xylella fastidiosa
MRVSRYFGTDGIRGRVGQGLISADFVLRLGNALGRVLAQGRDTRPMVLIGKDTRISGYMFESALEAGLVAAGADVQLIGPMPTPAIAFLTNTLRADAGVVISASHNPHDDNGIKFFSAMGEKLDDATEAAIEAAIEAPFLTVDSEYLGKVKRTRDAIGRYIEFSKASVSRGFTLRGLKLVLDCAHGATYHIAPMLFRELGAELVAIGVDPDGLNINAGVGSTHLETLAATVRESGADLGIAFDGDGDRVLMTDAQGRTVDGDDLLYVLARAWRASGRLKGTVVGTLMSNYGLEQALGTLGIPFIRAKVGDRYVHQALVESGGVLGGEASGHLLCLDRATTGDGIVSALQVLEVLRHEGLTLSQALLGLHKVPQKTVNVCWSGPARAAVEMPEVRQALVEAQAAVQGRGRVFLRPSGTEPVVRITVEADDVVLMQQTLDRLADVVRD

SEQ ID NO: 9492 - protein, 245 aa, Xylella fastidiosa
MSDPSKVALITGGARRIGKAIVHHLHAHGYRVAVHAHQSGHELHAFLTELERTRPSSTLALLGDLHENAVPETLIARCAGHFGRLDVLINNASNFYPTPLGEVTPAQWDDLFAINAKAPFFLAQAATPLLRKHRGAIINLTDLHGTQPLRQHAVYTAAKAALEMLTRSLALELAPQVRVNAIAPGAILWPTQGIAEAAKQALLARTPLARTGTVEEIAEAVLWLLESANFITGHTLRLDGGRTLT

SEQ ID NO: 9493 - protein, 741 aa, Xylella fastidiosa
MFSKDLEQTIGQCYKRTREACHEFMTVEHLLLSLLDNPLAHAVLKACGADVTRLKRDLEQAIEVSITRLDADDGRDTQPTLGFQRVLQRAVYHVQSSGKKEVTGANVLVAIFGEKDSHAVYFLNQQDISRLDIVNYLSHGITRMGEESDIGQAAENEAKGESEANKGDALAEYAINLNEHARNGRIDPLVGRKDEIERTIQVLCRRRKNNPLYVGEAGVGKTAIAEGLAKRIVDRSVPEVLADAVIYSLDLGALVAGTKYRGDFEKRLKGVLSALRKTPNVVLFIDEIHTIIGAGSASGGTMDASNLIKPALASGELRCIGSTTFQEYRGIFEKDRALARRFQKIDIVEPTAGEAFEILQGLKPKYEAHHGVTYADDALRAAVDLSVKHIGDRLLPDKAIDVIDEAGARQRLLPEKERKELIDIEEIETIVTKMARVPAKQVSVSDKDILKHLERNLKMVIFGQEPAIEMLSSAIKLARSGLGNPDKPIGNFLLAGPTGVGKTEVTKQLAHHLGIELVRFDMSECMEPHSVSRLIGAPPGYVGFDQGGLLTEKIVKTPHCVLLLDEVEKAHIDVFNILLQVMDRGVLTDTNGREASFKNVILVMTTNAGASQSSRRTIGFTKQDHTSDAMEVICRSFSPEFRNRLDAIVQFQPLGFSHILRVVDKFIIELEMLLQEKRVVLSATPIARDWLAQHGFDPLMGARPMARVIQEKIKRPLADELLFGKLLNGGRVGIDVRDNEL

SEQ ID NO: 9494 - protein, 559 aa, Xylella fastidiosa
LIPAPVQIQRGHGQIHIGPHTLISIPPNDTDAQHSATYLATLLQHTRNLTLHIHTETTPTPDSIRLQRDPQSPVTQTEGYTLQALPNQGMHITARDGAGLFYGAITAWQLLTADSNQGPTEIPTVTIHDWPRFKWRGQLLDVARHFHDVDTVKHVIDAMAQHKLNVLHLHLTDDQGWRIEIKRYPKLTAIGAERIPPGAGRHGTPERYGGFYTQDQIRELVAYATERQITILPEIDMPGHAQAAVAAYPDIIGVTSTTPPVSVDWGVNPYLFGTSTPSLDFIRNVLDEVLTLFPSQYIHIGGDEAVKDQWEASHTIRAQMRKLGVKDTHAMQGWLNTQLAQYLTTHDRRLIGWDEIIQSGLPESASVMSWRGVEGAITAAQQGHDVVLAPAGWMYLDNLQTERSDEPNGRLATLPLSRVYTLDPVPKELTPDQAIHILGLQSALWSEYIPSRWHIDHALFPRLAAVAEVAWSPMTARNWDNFLKRLPPQLHRYRTLHIDYSDGAFAPDIMLQHRSAYVLAGEPPHITLSNQTNTGQIHYTTNGNEPTLHSPRYTAPFPI

SEQ ID NO: 9495 - protein, 572 aa, Xylella fastidiosa
MLRHLLTLPLIFAIALPIGVSAAPWPAFSTRGTQFIRDGRPYQLISGAIHFQRIPRAYWKDRLQKARAMGLNTVETYVFWNLVELREGQFDFTGNNDIGAFVREAASQGLNVILRPGPYVCAEWEAGGFPAWLFADPTLRVRSQDPRFLDASQRYLEALGTQVRPLLNSNGGPIIAMQVENEYGSYGDDHGYLQAVRALFIKAGLGGALLFTSDGAQMLGNGTLPDVLAAVNVAPGEAKQALDKLATFHPGQPQLVGEYWAGWFDQWGKPHAQTDAKQQADEIEWMLRQGHSINLYMFVGGTSFGFMNGANFQGGPGDHYSPQTTSYDYDAALDEAGRPMPKFALFRDVITGVTGLQPPPLPAATRFIDLPDTPLRASASLWDNLPAAVATSADPQPMERYGQAYGYILYRTTIHGPRKGRLYLGEVRDDAHVYVDRLFVGRAERRRQQVWVEVDIPSGTHRLDVLVENSGRVNYGPHLADGRAGLIGPVMLNHERVNNWETFLLPLQTPEAIHGWTTAPMQGPAFHRGTLFIRTPGDTFLDMEAFSKGVTWANGHMLGRYWDIGPQRALYF

SEQ ID NO: 9496 - protein, 638 aa, Xylella fastidiosa
MGKIIGIDLGTTNSCLAIIEGGKGRVIENSEGDRTTPSIVAYTKDGEVLVGAAAKRQAVTNPKNTFYAVKRLIGRKFGDAEVQKDLDLVPYKITQHDNGDAWVATADGKKLAPQEISAKVLEKMKKTAEDFLGEKVTEAVITVPAYFNDSQRQATKDAGRIAGLDVKRIINEPTAAALAYGLDKKGGDRKIAVYDLGGGTFDVSIIEIAEVDGEKQFEVLATNGDTFLGGEDFDKRVIDYLVDEFNKDQGIDLRKDPLALQRLKDAAERAKIELSSSQQTEVNLPYITADASGPKHLNIKLTRAKLEALVDDLVRKSIEPCRIALNDAGLRTSDVQEVILVGGQTRMPKVQQAVADFFGKEPRKDVNPDEAVALGAAIQGGVLAGDVKDVLLLDVTPLSLGIETMGGVFTKIIEKNTTIPTKASQVFSTAEDGQSAVTVHVLQGEREQARFNKSLAKFDLAGIEPAPRGQPQIEVSFDIDANGILHVSAKDKKTNKEQKVEVKAGSGLSDSEIQQMVADAEAHREEDKKFQELVQARNHADGLIHSTRSAIKEHGSKVGGELIGRVEASLAELEAAVKGDDKNQIEAKSKTLEEVAQSLHMAATAEQQSASTGAGAGSSAKVDDVVDAEFTEVKGDKK

SEQ ID NO: 9497 - protein, 237 aa, Xylella fastidiosa
MITAEHLHKSFKTKKGLVNAVKDLSFHAADGRITGLLGPNGAGKTTTLRMLYTLLVPDQGCISVDGVDAVSDPMTVRRGLGVLPDACGIYKRLTARENIAYFGELHGLSRIDIAARLSILSKALDMDDILDRQAAGFSHGQRTKIAIARALVHDPRNIILDEPTNGLDVMTTRKLRDFLRQLRAEGRCIIFSSHIMQEVAALCDHIIVIAKGTVVVAGSGDELRARTGKDNLEDAFI

SEQ ID NO: 9498 - protein, 359 aa, Xylella fastidiosa
MTMRIFNFSPGPATLPEPVLRQAQAEMLEWNAVGASVMEISHRSAEFIALAKGIESDLRCLLGVPDDYAVLFLSGGATTQQALLPLNFAAPGQTADYVVTGAWSKTALKQASPYVNINVVADGERDGFQDIPSRAGWCLSKDAAYVHMTANETIHGVEFRQTPDVGDVPLFADFSSSIAADLIDVSKYDLIYAGAQKNLGPVGICVVIVRRTLLERTGQPRADIFTYASHAARDSMLNTPPTFNWYLLGLTVKWMLDEGGVQEFARRNQAKAQLVYQTIDQSGGFYRNGVAAAVRSRMNIPFFLPNVEQDARFAAEAKVAGLLSLKGHKALGGIRASLYNSMPLAGVQALVAFMHDFQQ

SEQ ID NO: 9499 - protein, 412 aa, Xylella fastidiosa
QGTPLHGVLSIPGDKSISHRAVMFAALADGTSRIDGFLEAEDTRSTAAILARLGVRIETPSFTQRIVHGVGVDGLQASDIALDCGNAGTGMRLLAGLLVAQPFDSVLVGDASLSKRPMRRVTDPLSQMGARIDTSDDGTPPLRIYGGQLLRGIDFISPLASAQIKSAVLLAGLYARNETVVREPHPTRDYTERMLTAFGVDIDVSTGCARLRGGQRLCATNITIPADFSSAAFYLVAASVIPGSDITLRAVGLNPRRIGLLTVLRLMGADIVESNRHEQGGEPVADLRVRYAPLQGTRVPEDLVPDMIDEFPALFVAAAAAEGQTVVSGAAELRVKESDRLAAMVTGLRVLGVQVDEIADGATIHGGPIGHGTINSHGDHRIAMAFSIAGQLSVSTVRIEDVANVATSFPDY

SEQ ID NO: 9500 - protein, 573 aa, Xylella fastidiosa
TPWRTYRRLLSYAREYRWLLVVAACGALLEAVAGSTFLALMKPITNETFIERNREVALWLPLGIVGLFLLRGIAGYITDMAMGRAARSIARDFRVCVLTKYFRLPGGRFDGEPVASMLVRLGSDSEQVAHAVIDAMKVMVQQTLQVIGALVVMLWYSWTVTLAILLVAPLLAWVMQRVAKRYRRISHHIQESNAQLMQAADQALSNYQDVKVYAAQESELERYARLANINLGLAIKVESTRSISSAAVQLLGAVGLAMLLLIAGHEALAGRLSPGDFVSLMTSMIAVIPALKQLTNVQNMLQSGIASAQRLFSVLDSPDELDTGRRPLGRARGLIEFRGITARYPGRSAPVLDSVSFVAAPGTVTAIVGRSGSGKSSLIKLIPRFYEPESGQILLDGHPLQDYLLADLRRQIALVGQQVMLFDGSIAENIAYGEMHQVVSEQIERVVVDANAQDFVNQLPEGLQFQVGVKGGRLSGGQRQRLAIARAMLKDAPILILDEATAALDNESERLVQDALQRLMPERTTLVIAHRLSTIKHADQVLVMDQGRIIESGTHVDLLARDGLYAYLYSMQF

SEQ ID NO: 9501 - protein, 257 aa, Xylella fastidiosa
TQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVCYYEQVIERTPMRRIGEPEEVAAAVAFLCLPASSYVTGECIAVDGGFMRYGF

SEQ ID NO: 9502 - protein, 322 aa, Xylella fastidiosa
KILVTGGSGFLGEALCRGLLKRGYQVLSFQRSHYQALQALGVVQICGDLSDFHAVRHAVRGVDAVFHNAAKVGAWGSYTSYHQINVIGTQHVLDACRAENISKLVYTSTPSVIHRSNYPVEGLDADQVPYSNAVKVPYAATKAMAEQAVLAANSVDLTTVALRPRMIWGPGDPHLMPRLVARARAGRLRLIGDGRNLVDSTYIDNAAQAHFDAFEHLMPGAACAGKAYFISNGEPLQMRELINKLLATANAPPVTQSLSFKTGYCIGAFCEMLWSLLPLPGEPLLTRFLVEQMSTPHWYSIEPAKRDFGYVPRVSIEEGLVR

SEQ ID NO: 9503 - protein, 420 aa, Xylella fastidiosa
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLHSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPA

SEQ ID NO: 9504 - protein, 455 aa, Xylella fastidiosa
RQRDLRVLWHPCTQMREHPDTLPLVPIVRGEGAWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACPAISTDTDDKELGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAI

SEQ ID NO: 9505 - protein, 129 aa, Xylella fastidiosa
MSDIPGDLKFLKSHEWVRIEDNNRAIVGISDHAQNLLGDLVYVELPNIGDHLDAGATAAVIESVKAASDIYSPVTGKVIEVNTTLSDKPETINEDPYGEGWIMVIEMQAPEEISDLLSPDDYTEVLESD

SEQ ID NO: 9506 - protein, 684 aa, Xylella fastidiosa
VTTSNPLLTASSLPFQAPPFDKIKDSDYLPAFEEGMKQHLAEITKIAENPDAPTFENTIEMLEHSGTTLDRVSRIFFGLVHADTNDTRQKIQEEIAPKLAAHQDEIYLNPKLFTRIKSIYDQRDTLSLDPLQKRLVERDYEGFVHAGAQLPEADKTTLRKINVEESTLSTQFHAKLVAATAASAIVVDEKNKLDGLSEGDIAAAAEAAKARKLNDKYVLALQNTTQQPISASLKDRELRAQVLQASETRAEKGDANDTRQIVQRLTQLRAQKAKLLGFPNYAAYNLADQMAKTPEAALKLLNDTVPAATAKARKEAAEIQKLIDKQRVNTKANHFELVASDWDFYAEQVRKAKYNLDEEQIKPYFELDNVLQNGVFYAANQLYGITFKERKDIPTYHPDMKVYEVFDHDGSSLALFYTDYFKRDSKSGGAWMDVFVEQNAITGTKPVVYNVCNFTKPAPGQPALLSFKDVTILFHEFGHALHGMFSKVKYPSLAGTSTSRDFVEFPSQFNEHWASDPNVFSHYAKHYQTGESMPQSLVDSIRKAKTFNQGYVTTEYLSAALLDLAWHTLPADAPLEDVEKFEADALKKYKVNLKEVPPRYRTSYFDHIWSGGYSASYYAYFWSEVLSDDAFEWFKQHGGLDRKNGDIFRDKILSRGNSIELGDLYRQFRGQNPSVQPLLDNRGL

SEQ ID NO: 9507 - protein, 202 aa, Xylella fastidiosa
DESRVGRTEPLPLDNRHYVNGHPLCDAFTGLAQIQFGLGCFWGAERLFWQLPGVFSTAAGYAGGGVPYPTYREVCSGETGHAEVVLVVYDHTVISFEQLLQTFWESHDPTQGMRQGNDIGTQYRSVIHCTTSEQYAAASASREVYQQQLNTAGYTAITTEILHPAPPFYYAENEHQQYLAKHPNGYCGLGGTGVTCAIRLQV

SEQ ID NO: 9508 - protein, 370 aa, Xylella fastidiosa
FSKLFLNMIFMLIVPLMFSALVVGVAEMGDISTLGRIGWRTLGYTVVLSSVAVLIGLVLVNVLKPGVGVDPQLAQQLLSENAERSRQIVASTDTQIHGMDMLLSIVPSNVVAAASSNDAILSLMFFAIMFGIGMVLVPQEKVETLKRAIEGVFEVSMVLIGLVIRLAPYAVACFMFNLTSLFGLELLIRLAAYVGVVVLGLSLHMFVTYGLAVWWAGRSPLRFFRETQEATLMAFSTASSNATLPTALRVADDMKLPKQISRFVLTIGATANQNGTALFEGLTVIFLAQFFGVDLSFSQQAMVMALCILGGIGTAGVPSGSLPVVALICAMVGVDPVGIGLILGVNHFLDMCRTALNVTGDLALTTLVCR

SEQ ID NO: 9509 - protein, 662 aa, Xylella fastidiosa
TRRQLANAIRFLAADAVQAAHSGHPGMPMGMADIAEVLWNDFLRHNPNNPNWFNRDRFVLSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAAGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQHPTYRESVLPSKVHKRVAIEAGVTGFWWQYVGLHGAVIGLDTFGASAPADVLYKHFNITAEHVVEVAKAL

SEQ ID NO: 9510 - protein, 259 aa, Xylella fastidiosa
FFNMKMRIASWNVNSLNVRLSQLQQWLVEAAPDVLGLQETKLEDHQFPGAALAALGYVSVYAGQKTYNGVALLARVALEDVQVGIPEFEDVQRRVIAATVDGIRVVNLYVVNGQEVGTEKYAYKLSWLDAVYHWLAEELQRYPRLVVLGDFNIAPDARDVYDPQVWNEDHILTSTTERAALDKLLGLGLHDGFRLHHQDAGIFSWWDYRQASFRRNRGLRIDLTLVSEALRAQAVASGIDRVPRGWERPSDHAPAWIEL

SEQ ID NO: 9511 - protein, 481 aa, Xylella fastidiosa
IIVGSGLAGLIAALTISPEPSVLVTRSALGAETSSAWAQGGMSVSLSPDDNPSLHLADTLAAGDGLCDAVAAESIILEALDAFHVLQHFGIHFDQDSNGHLALGLEAAHSRRRIVHVGGDRSGTAIVKALTACVLNDPSITVLEGLEARHILMADNVVCGLLLANPTSEIVLPSSRILLTTGGIGGLYDATTNPVSNFGQGIAIAARAGAVLADMEFVQFHPTALHCHNRPLALVSEAVRGEGAVLINERGERFMADIPGAELAARNIVAQAISAEITRGGQVFLDARQALGARFSTRFPTITALCHKVGIDPVHMPIPVCPAAHYHMGGIATDRQGRSSIPGLWVAGEAASTGLHGANRLASNSLLEAVVMGTRAARDITSHNTHTPLGTIPITPKKPDTTLIRPIVSQCLGVLRHAADMHRAIAALLPFVEGEKESSDPAIVALLIAIFAHLRTESRGAHARTDFPLKHDTTQRRNMTL

SEQ ID NO: 9512 - protein, 415 aa, Xylella fastidiosa
VVAGFVLGALVGWVMGPAAKTWFGPLGTLYVTLIKMIAIPLVFFAVINAIAALHGQRSVAMLGGRTFLWFIVTAVLAVCVGLGVGTLLKPGNGDFTVSVDAAWAPPDVPSPVHVLLDVVPSNPFYALTGIGTRSNNTGETTLAAGRGSILPVIFFAALLGLAIVKLGERVTEVRKLIGQMSEIMIQITRFVLEMTPLGTFGLIAALVGSYGFQKLLPFGHFVLALYLACALHIVVVYSGLLLAHGLSPLKFFRGVAPGMQVAFVSSSSFAAMPVALRAITHNLGVNKDYAAFAVPLGSSIKMDGCGAIFPALCAVFIAQYTGVPLTTNQYFVIFIASVLGSFGTAGVPGTAVVMATVVLSAAHLPLEVIGYLYAIDRVLDMMRTMTNVTGQMLVPVLVAKETGLLNTAVYEAASS

SEQ ID NO: 9513 - protein, 276 aa, Xylella fastidiosa
QRTDSYLERTLSILTQAPQRLHAAMRYTVLSGGKRIRPLLVYAAGHLFHVDEPLLDVPAAAVELIHAYSLVHDDLPAMDDDLLRRGRPTVHIAFDEATAILTGDALQTLAFECLADAPADASLRIAWLQTLTHAAGVAGMCGGQALDIDATGQSQTLKALEAMHALKSGTLMRAAVRMGALAGDPSPEDLHSLDTFAATLGLAFQVRDDILDIESSSEQLGKTTGKDAIQQKSTFPALLSVEGAKCYLQELAERLYTQLHPYGERAAPLTALARLA

SEQ ID NO: 9514 - protein, 305 aa, Xylella fastidiosa
FAFVFPGQGSQSLGMLSEFAVLYPEILDTFAEASEGAGVDLWTLSQRGPEEMLNRTEYTQPALLAASVALWRLWQARGGRAPDLLAGHSLGEYSALVAAGALSLKDGAYLVRLRGQLMQDAVAVGVGAMAAVLGAEDALVAEVCAQVAGSEIVVAANFNSPGQVVIGGHATAVDRALVLLAERGVSKTVKLAVSVPSHTPLMRDAAHRLAEAMLGLVLKVPQIPVVQNVDGRVHDGVEAIREALVKQLYLPVQWTDCVRELATCGVVRIAECGPGKVLMGLIRRIDKTLDVRSLATPTGFSDVLD

SEQ ID NO: 9515 - protein, 242 aa, Xylella fastidiosa
LQGEVALVTGASRGIGAAVADLLADHGATVIGTATSASGAQLIGDRLALLGGHGRALDVTDTAAVGALVEEIAEQFGSVSILVNNAGITRDNLLMRMKDEDWESIVDTNLSSIFRTSRAVVRNMMKARKGRIINIASVVGVTGNAGQANYAAAKAGVIGFTKSLAKEVGPRGITVNVVAPGFIDTDMTRVLSEGVRNDILNHVPLGHLGDPVDIANAVAFLAAPAARYITGETLHVNGGMYM

SEQ ID NO: 9516 - protein, 73 aa, Xylella fastidiosa; identical to SEQ ID NO: 9293

SEQ ID NO: 9517 - protein, 409 aa, Xylella fastidiosa
RRVVVTGMGMVSPLGNDLTTSWDGIVHGRSGIAPIVQIDASKFPTQIAGEIKGFDPMKFVSAKDAKKMDSFIYYGIGAAFMALDDAGLEINEINAERVGALIGSGIGGVFGIEEQTIKLYEGGARKISPFYVPATIINMLPGQLSVLKGLKGPTFSAVSACATSNHSIGMAMRMIQYGDADVMLAGGSERASSPTAIGGFCAMRAMSTRNDDPTGASRPWDKGRDGFVLGDGAGILVLEEYEYAKARGARIYAELAGFGATSDAFHMTMPVEDGEGAARCMRIALQDAKVTPEQIDYLNAHGTSTPLGDLCETNAIKTVLGDHAYKVMVSSTKSMTGHLLGAAGGVEAIFSVMALHTGIVPPTINLEEPDEGCDLDYVPHVAREAKLDVVVSNGFGFGGTNGTLVFKRI

SEQ ID NO: 9518 - protein, 556 aa, Xylella fastidiosa
FSGWLIALAVSSAATLTLPSAFKQMIDHGFSSEGQINRTFALLLLVAVILAVGTAARLFSVSLLGEKIITDLRSQLYAHLIGLDASFHDRNRSNELVSRLATDSELLRSIIGSTMSVATRSTVTAIGSLIMLFITSPRLASLSLVVIPLVILPIVLGAQQLQKAARTSQDRIADTNSFAAETLRALRTVQAYAREHYERTRFDRTLETSLQAARQRIHIQTWVTAASIVLIFSAIVGVLWAGAHDVIAGRMSAGTLGEFVLYALIGGGSIGALAEVWNELQRAAGGMGRIFELLKEKNTLTVPATPALPPHPLRGEIRFERVGFHYPQRPETPALDDIDLHIRPGETIAFVGPSGAGKSTLISLLLRFYDPTHGRILIDGVDLRQTDPKVLRTHIALVQQQPTLFTASAMENIRYGRLDATTAEIEIAARSSEADGFIRALPQGYATELGEHGLSLSGGQQQRIAIARALLKEAPILLLDEATNALDAQNEQAVQQALERLMTGRTTLIIAHRLVTILKADRIVVMDQGRIVAQGTHSELIAAGGLYAKLARLQFI

SEQ ID NO: 9519 - protein, 354 aa, Xylella fastidiosa
PRFGQLAGASPFSVRNSTLMTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 9520 - protein, 339 aa, Xylella fastidiosa
MCNKSAVITGITGQDGAYLAQLLLEMGYVVYGTYRRSSSLNFWRINELGIAQHPNLHLVEYDLTDLSSSVRLLELAAPKEVYNLAAQSFVGVSFDQPLTTTDITGVGAVNLLEAIRIVNPKIRFYQASTSEMFGKVQQTPQIEETPFYPRSPYGIAKLYAHWMTVNYRESYGIFAASGILFNHESPLRARDFVTRKITHAIAMIKLGKLDVLELGNLDAKRDWGFAKEYVEGMWRMLQADEPDTFVLATNRTETVRDFVSLAASAVDIQLEWKGQAERECGVDVASGKTLVTINPKFYRPAEVDLLIGNPAKARTKLGWEPKTTLEELCHMMMEADVRR

SEQ ID NO: 9521 - protein, 643 aa, Xylella fastidiosa
  unsure (1)..(643): unsure at all Xaa locations
LTYRDAGVDIDAGNALVERIKPLVKRSFRPEVMSGLGGFGALFNLAGKYKEPVLVSGTDGVGTKLKLAQQLNRHNTIGIDLVAMCVNDVLVQGAEPLFFLDYFATGKLDIDTATAVISGIALGCEQSGCALIGGETAEMPDMYPPGEYDLAGFCVAAVEKSQLLDGSQVREGDVLIGIASSGPHSNGYSLIRRIYERAGSPADLDIHGTRLIDTLMAPTTLYVKPILKLLHTHSDAIHAMAHITGGGLTENIIRVIPPNLGLRIDANAWTQPPVFQWLQREGALADTEMWRTFNCGIGFVLVATPNQVAPLGQALDNQGLAHWQIGRVVTPVGNERVHIDXSDNNXRHPHHTPLRYPCCLSIDLIPTSQQHVILLALKXYXSSHQRYSSIPACVPLHQRSXVASSHCVAALVTATTSKAITGHTLAHYQPHLATLALYPNSGNPLFDLTLLPFRLAILASGRGSNLQAILDAIATDRLHAEVVGVFSDRPDAPALTKVLPTHRWSADPHNSPDRITFDTTLSAAIAAVTPHWVVCAGYMRILSAAFIERFPKRILNIHPSLLPKHRGLHTHARALAAGDTEHGASVHLVIPELDAGTVLAQAVVPILTNDTAETLAKRVLVREHPLLVATLELLANGRLTVDG

SEQ ID NO: 9522 - protein, 642 aa, Xylella fastidiosa
SDLDPTGNPCTDLHTYVNGNWLKANPVPSDRTSWGAFQMLDERSNAIQRQLIEHAAADPQSSGIKKILSDLWNTGMDEAKIETQGIDPLKADLAAIDAITNQDTLVNYLRSTAAKGQGELFTLSASPDFKDPTRNIAYISQSGLGLPDPEYYTKPANKDKLLAYKAHIAKVLELSGMAAADAAQHADKIIAFETRLAKVSKTTQQIARDVTLHYNPVTPTQANKLTPHWSWTEAFKAQGVPLPDMFSLAIPAFHKEVDRMLADTDVAIWRAYLRFHTVDNASPYLSRPFVDEHFAFWNNTMRGQKEIKPRWKRVLNTINEQAGEALGQLYVKAAFPTESKVKMEALVAQLRTALKARIEKLDWMSPATKSKALAKWESFTAKIGYPDQWRSWDNLHTSRDSYLGNVLTAQQFNYTWNLSKIGKPVDKTEWGMPPQMVNAYYDPQKNEIVFPAAILQPPFFDPDAPLESNYGGIVAMIGHEMTHGYDDQGSRFGPTGKFEQWWTKADAKAFSARTTKLVTQFNSYRTEDGKQVNGSLTLGENIADLGGLNTAYDAMKNATAGQADPKTDGITREQRFFYNWATVWRAQYTPEEQAMRLKTDPHAPPHFRTIGPPSNMPSFAEAFNCKPGDAMVRHNDQQVVIW

SEQ ID NO: 9523 - protein, 300 aa, Xylella fastidiosa
SDTALLIVNLGTPEAPTAAAVRRYLGEFLSDRRVVSIPPLFWKPLLHMVILPIRGPRSASKYAKVWLQEGSPLSVYTRRIAEGLTQHLPDWRVAWAMRYGAPALTKALDALQAQQVRRIVILPLYPQYSTTTTASVQDVVEAWCKRTPQVQVECIQDYAEDPAWVAAVAASIRRHWQAHGRSEKLMFSFHGLPQRVANNGDPYPQRCQVSASLIAAALNLNESEWVLGYQSRFGTERWLQPYAEPTLWALAESGIRRFDLVCPGFSVDCLETLEEVALGFSETLAARGATMRYIPCLNDD

SEQ ID NO: 9524 - protein, 365 aa, Xylella fastidiosa
MRDEEGIGPCYVYHLPTVRERARQLNSVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRRLPAATASGDLMLIADAGAYGFSMASTYNLRGLPAEVVL

SEQ ID NO: 9525 - protein, 451 aa, Xylella fastidiosa
IVLKFGGTSVSRRHRWDTIAMVVRKRLEEHGTRVLIVVSALSGVTNELTAIAQGVVDSAQRVAALEQRHRDFLAELGLDAQAVLGTRFAMLSDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTDVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIE

SEQ ID NO: 9526 - protein, 1075 aa, Xylella fastidiosa
MPKRTDLRTILIIGAGPIVIGQACEFDYSGAQACKALRAEGFRVVLVNSNPATIMTDPDMADAVYIEPIHWRTVEKIITKEKPDALLPTMGGQTALNCALDLADHGVLEKYGVELIGAKREAIRMAEDRELFRVAMQEIGLECPKAEVAKSLERALEIQAKVGFPTIIRPSFTLGGTGGGIAYNRQEFEEIIKRGLELSPVHEVLVEESVLGWKEFEMEVVRDASDNCIIVCSIENLDPMGVHTGDSITVAPAQTLSDKEYQRLRDASIAVLRKIGVDTGGSNVQFGIDPQTGRVVVIEMNPRVSRSSALASKATGFPIAKIAAKLAVGYTLDELKNEITGGKTPASFEPSIDYVVTKIPRFAFEKFPQADARLTTQMKSVGEVMAMGRTFAESLQKAVRGLETGKVGLEPTGLDLSSEDDLVVLKRELKAPGAERLFYVADAFRAGFAVADVYALSYIDPWFLDQIEEIVAAEGRLVTDGLGSIDGARLRQLKRIGFSDARIAQLTGTNEVAVRTLRRVLKVKPVYKRVDSCAGEFATGTAYLYSTYEEECEAAPSDRRKIMILGGGPNRIGQGIEFDYCCVHAALALREDGFETIMVNCNPETVSTDYDTSDRLYFEPLTLEDVLEIVEVEHPVGVIVQYGGQTPLKLAKALEANGVPVIGTSPESIDLAEDRERFQRLVQQLGLRQPPNCTARTADEALVLAREIGYPLVVRPSYVLGGRAMEIVYSEADLARYVRDAVKVSNDSPVLLDRFLDNAVEVDVDIIADPEGQVLIGGVMEHIEEAGVHSGDSSCSLPPYSLSAATQDDLRRQVIRLAQALNVIGLMNTQFAIQSNDDGSDIVYLLEVNPRASRTVPFVSKATGVPLAKIAARCMTGKTLAEQSVTCEVVPAYYAVKEAIFPFAKLQGVDPILGPEMRSTGEVMGVGRSFAAAFARAQEAGDIRAPQPGRAFVSVRDPDKKRVLPVVLALVERGFGVVATAGTYAWLQQNGVACEVVNKVAEGRPHIVDLIKNGEIVYIINTTEGRAAIADSFSIRREALQHCVTYSTTIAGAKALVNSLEFRGTGPVWSLQELH

SEQ ID NO: 9527 - protein, 371 aa, Xylella fastidiosa
VTEPAILVLEDGTVFEGDAVGANGLSVGEVVFNTALTGYQEILTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVGKAQDAARQFAGIKGMDLAKVVSTKQGYSWYEGQLDLDRNEFKRAAPQYEVVAYDYGVKLNILRMLAERGCDLTVVPAQTPADEVLALCPDGVFLSNGPGDPEPCDYAVAAIKTFIMRRVPIFGICLGHQLLAQAVGARVVKMSHGHHGANHPVQDLRSGRVMITSQNHGFAVDEATLPNNVRVTHRSLFDGTNQGIELLDVPAFSFQGHPEASPGPHDVDVLFDRFITMMA

SEQ ID NO: 9528 - protein, 235 aa, Xylella fastidiosa
DSFLRLLIHGASGRMGQSLLRLASEDPSFQVTAAVVGNAPHRHVSDGVPFFAAAELAAVPAFDVAIDFSLPQGFSSLLALCVARAVPLVSGTTGLDSRQHEALVMAGARIPLVWGSNFSVGMAALVNLVERAGDALSGWDCDIVESHHVHKQDAPSGSALTLGEAVACKGIAPRYTSLRAGDIVGDHLVQFTGLGERIELVHRATNRDVFARGALRVARRVVGRVPGCYRVRDLI

SEQ ID NO: 9529 - protein, 432 aa, Xylella fastidiosa
HTGIAPAEYGRRRRQLMKMVGPQGIVVLPAAPERVRSRDTHYPYRQDSDFWYLCGFPEPDAVLVLVPGRCHGQVLLFCRERDPEREAWDGPRAGYDGAIEQYGMDDAYPIDDLDEILPGLLEGRSQVYYHFGRDVEFDLRLIGWVNRVRDQVRYAADSPHEFIDLGHLLHEQRLFKSYDEIVLLQCAADISVEAHLAALRYAHPGVSEYVLQAELERVFRAADSCPAYTSIVAAGANACVLHYRANAECSRDGDLVLIDAGAEYRGYAADITRTFPVNGRFSPAQRALYDLVGAAYDVALAQARPGLPYEAGHLAAVHTLTEGLLRLGLLHGRLEDNLADQSYKRFYRHKTGHWLGLDVHDVGDYRIDGKSRLLEPGMVFTIEPGLYVLPDDTTVHPKWRGIGIRTEDDVLITEDGHCVLTGVLPRSADEIE

SEQ ID NO: 9530 - protein, 195 aa, Xylella fastidiosa
IMDHSKQQNASITQAQAEEAVRTLLRWAGEDPTREGLLDTPRRVVEAYGDWFSGYREDPHDYLQRTFEEISGYDEMIVLRNITYESHCEHHMAPIIGKVHVGYLPNGKVVGISKLARVVESYARRFQIQEKMTAQIAACIQETLSPRGVGVVIEGAHACMTTRGIHKRGVSMVTSKMLGTFREDARTRAEFLQFI

SEQ ID NO: 9531 - protein, 306 aa, Xylella fastidiosa
  unsure (1)..(306): unsure at all Xaa locations
LERIGIKSDVFADIVGINARRLWNTNVQTSDVATMAARKALQDAGVAVDRIGLVVNTSVSRDYLEPSTASIVSGNLGVGEQCIAFDVANACLAFLNGMDIAGQMLERGDIDYALVVNAETANRVYEKTLERMSAPGVYRAGVPRGNGGLNPGVRCGGDGTGAYCFGAXCTSIQRGSDPLCDXMEQAMLRESGSHGYXHPLDAHXGDQTSKENLCCRKQVLGWVVEELDQFVIHQVSRPHTEAFIKSFGIDPAKVMTIFREYGNIGPASVPIVLSKLKELGRLKKGDRIALLGIGSGLNCSMAEVVW

SEQ ID NO: 9532 - protein, 300 aa, Desulfitobacterium hafniense
ITFEPLMIQAAGQEVTLIHAGRSSQDMLATVRAAMLRDEVLSLADQLNKTSATIVKLARQHAETIVPNYTNGVAAQPNSYGHYLLGINAGLERDAQRLREAYQRIDRSPMGTTVLNGTGWPLNRTRMASYLGFSALVDNAYDASQISAVDLPVEVGAIVTSIALHTGSFIEDVMTQYAQPRPWILLQEGGGNTYVSSAMPQKRNPGLLNSTREKASTAITLAMGPVIRAHNLPPGMSDAKDAVTNGQMVQSAITTLKGLDRIMTALVIDRPRALDELDSDWTASQELADELMRQVQAPFR

SEQ ID NO: 9533 - protein, 236 aa, Desulfitobacterium hafniense
QSALIAAGLTALLWRATDGVVAGRMSLGDLVLVNAYLLQMAAPLSYLGVVYREGKQMLANLERMFALLDEPVEVRDRPGAPALRVGAGEVRFENVSFRYGEREILSGIDLTIPSGRTVAVVGSTGAGKSTLARLLYRHYDPDGGRVLVDGQDLREVTADSLRRRIGVVPQDTVLFNESLYYNIAYGRPDASREEVLEAARAARIHDFIQSLPQGYDTGVGERGLKLSGERNRHRLA

SEQ ID NO: 9534 - protein, 245 aa, Desulfitobacterium hafniense
EYMSGFANEFATEALPGALPVGRNSPQRAPYGLYAEQISGTAFTAPRAHNRRSWLYRIRPAAMHKPFTLIEQDRWLSRFDEVAPSPNQMRWSAPAMPTVPTDFVDGIVTMAGNGGPEALSGCGIHLYLANASMRDRFFYNADGEMLIVPQEGRLLIVTEMGRLAVEPQEIVVIPRGVRFRVELPDGAARGYICENYGAMFKLPDLGVIGSNGLANPRDFLTPVASYEITKATSNCRPLNRTIGTM

SEQ ID NO: 9535 - protein, 281 aa, Desulfitobacterium hafniense
GSSALFLARQAVESGAVECALALGFEFMQPGALTSVWTDRERAMARFTEISAPMVQDALDAGVPSALTMFGGAGREHMQRYGTKLETFAKIRAKASRHAANNPLAVFRTVVTEEDVMNEKVMWPGVMTRSMACPPTSGAAAAIVCTEAFAKKHNLRTDVRILAQSLTTDVAQSFDPPSMIGLVGFHMAERGAKAVYEAAGVSPSDIQVCELHDCFAQNELLTYESLGFAKIGEAEKMVQDGDNTYGGKVVINPSGGLLSKGHPLGATGLAQGYEMTRQIRG

SEQ ID NO: 9536 - protein, 129 aa, Desulfitobacterium hafniense
MSEIPGDLKFMKSHEWARVEGDGKVTVGISDHAQGLLGDLVYVELPNVGDRVEAGNASAVVESVKAASDVYAPVSGTVTAVNAALADKPETINEDAYGEGWIYTVEIDEPDQLNELLSPDDYAELLEDD

SEQ ID NO: 9537 - protein, 188 aa, Desulfitobacterium hafniense
  unsure (1)..(188): unsure at all Xaa locations
RHFSMLREFHLADWFTLAIRPLLAGXPGAGCFAAMRFLQDGEVRNLMIGMALIPLAFVFDALDGRVARWRKSSSXXLGTSNLDSLADVISFGVAPAALAYACGLQGGWDWVVLSYFVGCGVSRLAXATTFHRRSAGRGXRQVKYFEGTPIPTSLLLVIVLAVAAWQGAIGDQLWFGGVRIGPWLYNPM

SEQ ID NO: 9538 - protein, 158 aa, Desulfitobacterium hafniense
MNPASNLILIGPMGSGKTCIGKRLAERFGLRAVDADRELELRAGARIAQIFEHEGEAGFRVRESAVLAELLSGDGLLLSTGGGAVLAADNRRLLRERGFVVHLQVSVEQQLERLALDRSRPLLARGDREQVLRELALARAPLYAETADLAFDTGAAGA

SEQ ID NO: 9539 - protein, 212 aa, Desulfitobacterium hafniense
VSLFDKTHLVAQADALPGRNTPMPVATLHAVNGHSMTNVPAGMEVALFAMGCFWGVERLFWQLPGVYSTAAGYTGGYTPNPTYREVCSGETGHAEAVRVVYDPQVISYEQLLQVFWENHDPAQGMQQGNDRGTQYRSAIYPLTPEQSEAAKASLARFQAAMNEANDPRTITTEIATAKPFYYAEDDHQQYLHKNPYGYCGIGGIGVCLPPQA

SEQ ID NO: 9540 - protein, 189 aa, Desulfitobacterium hafniense
IGIVSSLVNLSDGAVEIFGTDLQRRRDEAMRLIGLVPQEINFNMFEKPLDILVNYAGFYGVPREQALVRAEEELKRAQLWDKADKMSRTLSGGMKRRLMIARAMMTRPRLLILDEPTAGVDIEIRRGMWKTLREINAAGTTIILTTHYLEEAESLCRNLAIIDQGRIVQQGPMKALLAMLDVERFLLDI

SEQ ID NO: 9541 - protein, 169 aa, Desulfitobacterium hafniense; identical to SEQ ID NO: 8851

SEQ ID NO: 9542 - protein, 283 aa, Desulfitobacterium hafniense
AGIPKGVLNFLTGSAAEVGPTIVESREVRAVSFTGSTSAGEQIHKSVPMTTRTQMELGGKNPLIVMEDADLDRAVDLAVKGGLSLSGQACTGTSRILVMRDVKQAFTEKLVAKVKALKIGSGMTAGMDLGPLATRKQLETVLSYIAIGKQEATLLCGGEQLSDGDFAHGYYVAPTVFTDVTQSMRIAREEIFGPVLAIIEVDSYADAIAQANDTEYGLSAAIATRNPRYMHDFTRDIESGTVKINRTTTGNLVNAPFGGLKRSSTSTFRESGRAGLEVYTQIK

SEQ ID NO: 9543 - protein, 286 aa, Desulfitobacterium hafniense
  unsure (1)..(286): unsure at all Xaa locations
WSALDAGQRAQGXLRXXPAQETRQTTADAVAAIIAEVRADGDAALRRFGERFDGAAPEAFAVSPAEFAAAEAAVSAPLRNAIDEAARRIERFHAAGMMPGYALDTAEGVRCERILRPIPRVGLYVPAGSAPLPSTALMLGVPARLAGCREVVLCTPPRKDGSADPAVLCAARRCGIGTVYKVGGAQAIAAMAFGTATIGKCDKLFGPGNAYVTEAKRQVALLEGGAAIDMPAGPSEVLVIADAGARADFVAADLLSQAEHGADSQVILLSDDAALLDAVDSELERQ

SEQ ID NO: 9544 - protein, 387 aa, Desulfitobacterium hafniense
LDLCRAAIGSQNVLTDPADKAPYLTDWRRRYTGDALAVLRPGSTEEVAAVMRACHAHKLAVVPQGGNTGLCGGATPEPGDAAARGTVVLSLQRMNRVRQVDPLNNTITVEAGVILQQLQEAAQTHGRLFPLSLAAEGSCTIGGNLSTNAGGTAVLRYGNTRELCLGLEVVNIKGEVWDGLRGLRKDNTGYDLRDLFIGAEGTLGIITAAVMKLFPAPRARVTALAAVESPRAALALLAIAQSHAGAMLTGFELMSAMCMDLVTKHYPQLRYPFTAHHPQLVLLELSDSESEEHARTIFEKMMEVAFEAGVVKDAVVAESVQQSRDFWNLREHIPLAQVEEGKNIKHDIAVPISRVADFIETTDTLLQDAFPGARMVTFGHLGDGNLH

SEQ ID NO: 9545 - protein, 254 aa, Desulfitobacterium hafniense
QAKARMYTLILDSLQGMPDMLAFGQTGAVFQRIQEAQSELSHSERRMAKVTGTANALMGMSSHLGMLAVLVLGIILVEGRQIDGVLLGMLALGVLSSFEAVATLPAGQQYLEENEAAGRRLKHLIDEGRNLEKEKGRLDAPGLEPELAFENVRFRYEPNGPWVLDNISVKIPGGRRIGIVGQSGAGKSTLVNLLVRFWEPAAGEIRLGGVNIKELTPQVVRENMGIVSQKPYLFHATIKENLLLAKPEATNEEL

SEQ ID NO: 9546 - protein, 256 aa, Desulfitobacterium hafniense
QAMRHAVLLGGKRMRPLLVYASGALFEVAPSVLDAPAAAVELIHAYSLVHDDLPAMDDDALRRGQPTVHVAFDEATAILAGDALQSLAFAVLADTDTLDAIRVDLLRTLAQAAGVAGMCGGQALDIDATGAGVQLSLPALERLHSLKTGALIRASVRMGALCGGADTAALAALDRYARALGLAFQVRDDILDIEGDSQTLGKTAGKDLAQDKSTFPALIGLDASRARLDELGAAMREALEPFGPRAEELHALGRLA

SEQ ID NO: 9547 - protein, 293 aa, Desulfitobacterium hafniense
LHMVEAVNLALAHALANDPDVVLLGEDIGVNGGVFRSTVGLQSRFGEARVIDTPLAEGAIVGAAIGMAAMGLKPVAEIQFAGFIYPAIDNILNHAGHMRHRTRGRITCPMVVRAPSGAGIHAPEHHSESPEALFAQMPGIRVVMPSSPARAYGLLLAAIRDPDPVIFLEPTRLYRLFRQEVADDGQALPLDACFTLREGTDLTLVSWGAIVRETLAAADVLADDGVSASVIDVATLKPLDMETILESVAQSGRCVIVHEAPRTAGLGAEIAANLSDAGLYSLSAPVQRVTAPD

SEQ ID NO: 9548 - protein, 311 aa, Desulfitobacterium hafniense
PLSDNQNSLRASERGPTLLEDFILREKITHFDHERIPERIVHARGSAAHGYFELTRSLKKHTTAQVLTEVGERTPVFVRFSTVAGGAGSIDTPRDVRGFAVKFYTQQGNWDLVGNNIPVFFIQDAMKFPDLVHSVKMEPDRGFPQAASAHDTFWDFISLTPEAMHMIMWAMSDRAIPRSLRMIEGFGVHSFRLLDAKGRSTFVKFHWRPKLGLQSTLWDEAVKLAGADPDFHRRDLFEAIERGDYPEWELAVQLFDQEQADALPFDHLDPTKLIPEETIPLTVIGRMVLDRWPDNFFAETEQVAFCPSHVV

SEQ ID NO: 9549 - protein, 258 aa, Desulfitobacterium hafniense
MILPVGVPNFAEALRAGAEVFHALKSVLKGRGLSTAVGDEGGFAPDLRSNEEALETILEAIGKAGYKAGEDILLGLDVASTEFYDNGKYHLVGEGKRLTSEQFVDFLANWAAQYPIVTIEDGMAEDDWNGWKLLTDKIGNKVQLVGDDLFVTNPKIFAEGIDKGVANAILIKVNQIGTLTETLEAIAMADRAKYAAVVSHRSGETEDTTIADISVATTATQIKTGSLCRSDRVAKYNQLLRIEEQLGSAARYAGRDAF

SEQ ID NO: 9550 - protein, 216 aa, Desulfitobacterium hafniense
ATLLHDDVVDESDLRRGRKTANAVWGNAASVLVGDFLYSRSFQLMVELEQLEVMKILADTTNRIAEGEVLQLLHVRNPDTDEPAYLRVIERKTAVLFAAATRLGALLSGADAQVQQRLDDYGMALGYAFQIADDVLDYASDAQTLGKNLGDDLAEGKATLPLIHAIAHSDDAVRARLRAAVEHGDSDAMPDVLAAIHATGGLAYSRQRAQDYADAA

SEQ ID NO: 9551 - protein, 351 aa, Desulfitobacterium hafniense
LSARLLRRKSVEQLQRQAQARGELQRVLGLWHLTAIGLGGIIGVGIFVLTGTVAAGQAGPAVVLSFLIAGVASAAAALCYAEFAGLIPVSGSAYTYGYAVLGEFAGWLIGWDLLLEFALIAAVVAVGWSGYVQALLAAAGVELPLWARGAYFGEVPGQIVNLPAVFVALAITALLAFGTQAGARFNHVVVAIKIGAAALVIAAGAAFVDPARWQPFMPFGFGGVVAGASIVFFAVFGYEMMTTAAEEAIDPQRDLPRAVVLSLAIAMTLYVGICLVLTGIVPYATLDNDAPVANAFAAIGQPRVMVAISLASGCGITSVIFANLMAGARIWFALARDGLLPRWFGQTHPSW

SEQ ID NO: 9552 - protein, 221 aa, Desulfitobacterium hafniense
VASNSFGTLLTVTTFGESHGPAIGCVVDGCPPGLELAPEEFRHDLERRATGRSRHTSQRRETDEIEILSGVYQGRTTGTPIALLIRNTDARSKDYGNIAEQFRPGHADYSYWQKYGHRDPRGGGRSSARETTMRVAAGVIAKKWLAQRYGVSVRGYMAQIGEVVPAGFDLDAVEGNPFFWPHAAQVDELERYMDALRKSGDSVGARVEVVADGVPPGWGEP

SEQ ID NO: 9553 - protein, 177 aa, Desulfitobacterium hafniense
GLLPAHLLGNMWQQDWGNLWDVLAPYSEQQAGSLDINAALARQYQQALDAQQAKGGGEGASAAQQAQVEVDASLANAKRMTERAQDFYVSLGMPKLPDSYWAKTQFVKPRDRDVVCHASAWDMNMSGDVRTKMCIKPNEEDFTTIYHELGHVYYYLAYNKQPPLFQTGAHDGFHEAI

SEQ ID NO: 9554 - protein, 219 aa, Desulfitobacterium hafniense
MKAMILAAGKGERMRPLTLTTPKPLVRAGGVPLIEYHLRALAAAGFNEIVINHAWLGQQIEDHLGDGSQFGVSIQYSPEGEPLETGGGIFRALPLLGEDAFLVVNGDIWTDYDFSVLHQPINGLAHLVLADNPAHHPTGDFTLTDGQVRDGQADLATLTYSGIAVLHPQLFDGCRDGAFKLAPLLRKAMADGQVTGERLKGHWVDVGTHERLAEAEALI

SEQ ID NO: 9555 - protein, 154 aa, Desulfitobacterium hafniense
  unsure (1)..(154): unsure at all Xaa locations
DFDRVRDYLSGLQDRICAAIETADGAPGFKEDQWQXXAEGGGGRTRILRGGRVFEQAGIGFSDVSGSKLPPSASAARPELAGASWRAVGVSLVFHPHNPYLPTTHANVRHFRAMRDGETVAWWFGGGFDLTPFYPFAEDVRHWHRTARELCEPY

SEQ ID NO: 9556 - protein, 199 aa, Desulfitobacterium hafniense
LQGKVAVVTGAGRGLGRECARAFAREGADLVLIDVSGDIDGVPYPLANASQLACSEALCREEGASVLAEFADVRRMDQIGRVVDKALARYGRIDILLNNAGIAAPSGKVVHEISEDEWNLMVDVDLNGAWRMIKAVGKIMTSQRAGSIVNIASTAGTVGYRNFSGYVAAKHGVVGLTKAAALDYGPGQVRVNAIWPGSV

SEQ ID NO: 9557 - protein, 256 aa, Desulfitobacterium hafniense
DTTVKARTQSTPAKPLNHAAGGGTSNRDWWPNQLNLKILHQQAPATDPMGADFDYAEAFKTLDLDAVKRDLHALMTDSQEWWPADFGHYGPLFIRMAWHSAGTYRIFDGRGGAGAGQQRFAPLNSWPDNGNLDKARRLLWPIKQKYGNKISWADLLVLTGNVALESMGFKTFGFAGGRADVWEPEEGVYWGVETEWLGDKRYSGDRVLENPLGAVQMGLIYVNPQGPNGNPDPIAAARDIRETFARVAMDDEETVA

SEQ ID NO: 9558 - protein, 279 aa, Desulfitobacterium hafniense
LRELGIDAQVRLLDGDLTDLSSMIRAMQTSKADEVYNLGAQSFVGSSWQQPLLTAQVDGVGALNVLEAVRIVNPQARFYQASTSEMFGLIQAEMQDEKTPFYPRSPYGVAKLMAHWATVNYRESFKIHASSGILFNHESPLRGIEFVTRKVTDAVARIKLGQQKELRLGNVDAKRDWGFAGDYVEAMWLMTQQAEADDYVVATGQTTTVRDMCEIAFGHVGLKVEDHLVIDPNFFRPAEVDVLLGNPAKARAKLGWAPKTSLQELITMMVDADLRRLRK

SEQ ID NO: 9559 - protein, 144 aa, Desulfitobacterium hafniense
ARLLVLHGPNLNLLGTREPQTYGHTTLDDINEALAKRAAEAGIELDTFQSNHEGALVDRIQAARGEGVDFIIINPAAYTHTSVAMRDALAGVAIPFVEVHLSNVHRREPFRHHSYFSDQAIGVICGLGWQGYLLALDYALAQEQ

SEQ ID NO: 9560 - protein, 332 aa, Desulfitobacterium hafniense
HANLAQSSNDTIPTAIRGSPALAVHETLLPALKHLRKTIERRAKELNKTVKTGRTHLMDAMPLTFGQEFGAWAAQLYSAQQRIEDALKRLRRLPIGGTAIGTGINADPRFGKVVAKALSAVGGVRFESAADKFEGLAAQDDAVELSGQLSALAVALTKIANDLRWMNSGPLAGLGEIELPALQPGSSIMPGKVNPVIPEAMAMVCAQVIGHHTAITVAGQSGNFQLNVMLPLIAQNLLSSIELLANSSRLLADKAIASFRVNESRLKEALSRNPILVTALNPIIGYHYAADIAKQAYKQGRPMIDVRLEHTDLSRSQLEELLNPEKLTAGGV

SEQ ID NO: 9561 - protein, 217 aa, Desulfitobacterium hafniense
VETQTHGDIVEIKLARAPVNALNPALCNAAREAVEHAIGQGAQGIVLSGGPKVFSAGLDVPYLLSLGDQRDHLLLAWQSFFGLARALASAQVPVVAAIAGHAPAGGCVLTLCCDYRVMAAGDFRIGLNETQVGLVAPEGIQRLMRRVVGTYRAERLLVAGAMVDADTALRIGLVDELVEIEQVAAHAREWLQQLLSLPRSAMLQTRALARADLIEAL

SEQ ID NO: 9562 - protein, 122 aa, Desulfitobacterium hafniense
LERADQAIAMAAMFLSEHIGVRAIVAMTESGGTVRFLSRFRSNAPIYAFSRHAGARRRMALMRDVYPIDFDSRGMASRDAARNVVKQLFDAGMLEAGERMIFTSGDTMEQHGATNTLRLLQV

SEQ ID NO: 9563 - protein, 188 aa, Desulfitobacterium hafniense
EQLAETAQAMVAAGKGIIAIDESTTTIAKRFAGVGIENTEENRRAYRELLLATPKLNEYISGAILFDETLRQSTKAGVPFAKHMADHGIIPGIKVDKGPQPLAGFPGEVVTEGLDGLRARLEEYYKLGARFAKWRAVINISDDIPSGTCIEANSHALARYAALCQEQGLVPMVEPEVIMDGSHDIDTC

SEQ ID NO: 9564 - protein, 427 aa, Desulfitobacterium hafniense
  unsure (1)..(427): unsure at all Xaa locations
VAEVMRMAAPFQXSLHKALRGLETGKVGLDPTGLDLSSEADLTALKRELKEPGPERMFYIGDAFRAGLSVEDVHALSFVDPWFLDQIEELIATEREVAEGGLAALDKVRMRALKRMGFSDARLAQLTGTDETALRTLRRAFGVRPVYKRVDSCAAEFATTTAYMYSTYEDECEANPSNRDKIIVLGGGPNRIGQGIEFDYCCVHAALALREDGYETIMVNCNPETVSTDYDTSDRLYFEPLTLEDVLEIADLEKPKGVIVQYGGQTPLKLARALEANGVPIVGTSPDSIDLAEDRERFQKLVQDLGLDQPLNRTERNPDEALVLAAQIGYPMVVRPSYVLGGRAMEIVYSEAHLSRXLRDAGKVSNESPVLLARYLENAXKVDVDVIATEKAMRSQRMSQSNARSIAIPANRAPCTAPETXTENGRE

SEQ ID NO: 9565 - protein, 249 aa, Desulfitobacterium hafniense
IEVPDDAYWGAQTQRSLINFAIGQERMPLPVLHALALIKKAAARVNDRNGDLPADIARLIEQAADEVLDGQHDDQFPLVVWQTGSGTQSNMNVNEVIAGRANELAGNPRGGKTPVHPNDHVNRSQSSNDCFPTAMSIATAQAVQTQLLPAIAELSGGLAELSARHMKLVKTGRTHMMDATPITFGQELSGFIAQLDYAERAIRAAVPAVCELAHGGTGVGTGLYSPHGFWETIGAVLGGVSGLPVVTGP

SEQ ID NO: 9566 - protein, 183 aa, Desulfitobacterium hafniense
RIMLARHGEPPWNAEGRYQGQEDIALSPVGEGQARALAARLREVPITRAVASPLSRARRTAELALGEERAPMLKLDPGLMEIAHGTWEGLLASEIRERDGDRLRAWRDTPHEVLMPGGESIVHVLDRAWPAFARACEGLKDDDTLLVVAHDAVNRVLLCKILGIPLAKLWTFRQAPTTLNLLE

SEQ ID NO: 9567 - protein, 290 aa, Desulfitobacterium hafniense
LSFGVPNALEVAMAEEIVKIVPSCEMVRMVNSGTEATLSAIRVARGATGRSRIVKFEGCYHGHGDSFLVKAGSGVMTLGLPNSPGVPSALADLTLTLPYNDFDAATQLFDEVGGEIAGLIIEPIVGNANCILPREGYLQHLRALCSKHGALLIFDEVMTGFRVALGGAQALYGIEPDLSTFGKIIGGGMPVGAYGGRRELMSQVAPAGPIYQAGTLSGNPVAMAAGLATLELIQAPGFHADLERRTHVLCDGLEAAAREAGVAFHTTRAPGMFGLYFREGPVETFEDAKA

SEQ ID NO: 9568 - protein, 402 aa, Desulfitobacterium hafniense
KKETSMAANAEFNWADPLLLDQQLTADERMVRDAAAAYCQDKLMPRVLQSFRNEKTDVEIFREMGELGLLGPTIPEQYGGPGLNYVSYGLIAREVERVDSGYRSMMSVQSSLVMVPIYEFGTEAQKQKYLPKLATGEWIGCFGLTEPNHGSDPGSMVTRAKKVAGGYELTGAKMWITNSPIADVFVVWAKLMGDDGKEAIRGFILEKGWKGLSAPAIHGKVGLRTSITGEIVLDQVFVPEENIMPGVSGLKGPFTCLNSARYGIAWGALGAAEFCWHTARQYTLDRKQFGRPLAATQLVQKKLADMQTEITLGLQGCLRLGRMKDEGTAAVEITSIMKRNSCGKSLDIARVARDMLGGNGISDEFGVIRHVVNLEVVNTYEGTHDIHALILGRAQTGLQAFS

SEQ ID NO: 9569 - protein, 374 aa, Desulfitobacterium hafniense
VDFNVPMDDHGNITNDTRIRAALPTIHYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLKGKNLPGIAALQN

SEQ ID NO: 9570 - protein, 261 aa, Desulfitobacterium hafniense
  unsure (1)..(261): unsure at all Xaa locations
AVWSRPGAVYLTLAELRPLLAPGDTIVDAGNSNYKDTVLRAVELRELVLHYVDSGTSGGLWVLQEVYSLMIVGDVAAVVRLRPIFEYPAPSSERGWGRVGPSGSGLLHKMIHNGIEYGMYAGLAEGFAILGRKAEFGLDLHQIAQIWRHGSVVRSWLLDLSADALGKNPSLQGIAPYVEDSGEGRWTVAEAIDLDVSAPVITASLMERLRSREKDSFADKLLAAMRNEFGGHAIRKEXPARGAARVAGRSEPKASGLKSLP

SEQ ID NO: 9571 - protein, 541 aa, Desulfitobacterium hafniense
  unsure (1)..(541): unsure at all Xaa locations
GHPENFETPGVETTTGPLGQGLANAVGMALAEKILAQRFNREGHDIVDHRTWVFLGDGCLMEGISHEVASXAGTWGLGKLVAFWDDNKISIDGNTDGWFTDDTAARFEAYGWRVIRKVNGQDPVEIKTAIETALKHGDKPTLICCRTTIGFGSPAKAGKESSHGAPLGKDEVAATRAALNWPYAEFEIPQDIYAGWRNRDHASAQAQWQQAFDAYAAQFPAEAAELKRRIAGELPADFVAQADAYIAKQQADGQTIASRKASQMAIETFAPLLPELIGGSADLAHSNLTLWKASKSVATSDPNANYVYYGVREFGMSAISNGLNLHGGFIPFDATFLVFSDYARNAVRMSALMGAHVIHVYTHDSIGLGEDGPTHQPIEHLASLRYIPHNDVWRPCDAVESAAAWKAAITRLDGPSXLVFSRQNLTHQTRDAQQVAQIERGGYVLRDSDGAPEVILLATGSEIGLATQADDQLQAEGVKVRVVSMHSSDVFDRQPQDYREMGQTNAVRKRVANKAGVTKYWPQYVGVDREVGSINRTGTLA

SEQ ID NO: 9572 - protein, 274 aa, Desulfitobacterium hafniense
GLSVSELVFTAWASASTFRGSDKRGGANGARIRLAPQKDWEVNQPAQLAKVLTALEGIQNDFNASAGGGKKVSLADLIVLGGAVGVEQAAKNAGVSVEVPFAPGRMDASAEQTDVDSFAVLEPLADGFRNYLQGQYKPSAEALLVDRAQLLDLSAPELTALVGGLRVLGANAGGSKHGVFTDKVGALSNDFFVNLLDMGTVWKPTSDAQETFEGRDRKTGAAKWTGTRVDLVFGSHSQLRAIAEVYASSDAKEKFVRDFVAAWNKVMNADRFDL

SEQ ID NO: 9573 - protein, 439 aa, Desulfitobacterium hafniense
  unsure (1)..(439): unsure at all Xaa locations
MPRSARVRASKPLHPAVFATHPFHPNLPHTATPNGIKQMSASDRSNLRAVNLPADWSPTSWRERTALQLPTYPDQAELESALAELRHLPPLVTSWEILSLKQQLAEAQEGKRFLLQGGDCAESFDSCTSDVISNRLKVLLQMSLVLVHGMRKPVVRVGRFAGQYAKPRSADSETIDGVTLPSYRGDMVNGPAFTEAARKPEPRRMIKAHARSSMTMNFVRALIDGGFADLHHPEYWNLSWVGHSPLADEYRRMVNAIGDAVRFMETLSGSEVHNLNRVDFYTSHEALLLPYEESLTRQVPRHWGHFNLSTHYPWIGMRTAAVDGAHAEYFRGIRNPIALKVGPSVTPDQMLRTIDLLNPEDEPGRLTFIHRMGATAIADKLPPLLEAMRRDGRRVLWVCDPMHGKHEKPSNGYRTGGTENRAEIKQLXLEPGRTGWGVH

SEQ ID NO: 9574 - protein, 388 aa, Desulfitobacterium hafniense
VISTLRTGRPQSFRVKLNPSRPDDMSSHGVNALLSRYDIDPASFEDCIVGAGSNEGAQGYNIVRNVSVLSQLVTGTAGMTLNRFCSSGLQAIAIAANQIASGCSDIIVAGGVESISLTLKSVNTDHLINPLLKQQTPGIYYTMGQTAEVVARRYGVSREAQDRYSLQSQIRTAQAQAAGLFNDEIVPMAVKYRVEDKNSGDVQILDGIVDRDDCNRPDTTYESLAGLKPVFAEDGSVTAGNSSQLSDGASMTLVMSLEKALQLGLKPKAFFRGFTVAGCEPDEMGIGPVFSVPKLLKAKGLQVADIDLWELNEAFASQCLYARDRLEIDNEKYNVNGGSISIGHPFGMTGSRQVGHLVRELQRRNLRYGIVTMCVGGGMGATGLFEAV

SEQ ID NO: 9575 - protein, 207 aa, Desulfitobacterium hafniense
QALIFDLDGVLTDTAQTHYRAWKRMADEEGLAFDQHVNERLKGVDRMSSLEIILRHAGRTLSAEQKLALAERKNGYYVEAIAEVTPADLFPGVTRVLERARARGLKLGLASASRNAAVLLDRLGIAERFDYIADAARIARAKPAPDIFLDVAAALGVAPAQCIGIEDAAAGVAAIKSAGMAAIGIGDARTLAQADACLPDIAAFDVD

SEQ ID NO: 9576 - protein, 354 aa, Desulfitobacterium hafniense
YLATPPDLFVPCAKGLKAAGLLEGESRLVLEKPIGRDLASAREINAALRACLDESRIFRIDHYLGKAAVQNLLALRFGNTLLEAVWQHRWIESVDIFVGETAGVDGREGYYAGYGALRDMVQNHMLQLLALIAMEPPSALDADSIRDEKRKVLRALRPVSAADAAQRTVRGRYGAGVVEGRAVKGFVHESPVETFVAVETFIDNWRWAGVPFRLVTGKRLAERATEVVVSFRPTSHWLFERPRRGRERPNRLRMRLQPDETIELGLMGSLAAPEWGALELKPMSLDLSMSGSPQRRIAYERLIVDALRGNQTLFVRDDEVEAAWHWIDSIESAWSETAQPALEYPAGSWGPTEA

SEQ ID NO: 9577 - protein, 409 aa, Desulfitobacterium hafniense
LVTAVLVWIYDWRFAAVAIGTLLLYGLWTVAVTEWRTRYYRATVEADTRANERAVDSLLNYETVKYFNNEEHEARRYDENLRHLENAQVMSIKTLAVLNLGQSLVVALGVTAMMWLAAQGVVEGRMTVGDLVLVNAYLLQLSAPLFMLGMMYREVKQALTNMERLFGLLDERQDVRDSAGAVALASARPAVRFREVRFGYDPRREILRGVDFDIPAGATVAVVGHSGSGKSTLARLLYRFYDVETGAIEIDGTDLRALSQSSLRGAIGIVPQDTVLFNDTIGYNIRYGRPEASEAEVEAAARAAHIHDFIKGLPDGYDTPVGERGLKLSGGEKQRVAIARALLKNPSILIFDEATSALDSKSERAIQAELDRLAVGRTTLVIAHRLSTVMDADQILVMDAGRILERGTH

SEQ ID NO: 9578 - protein, 322 aa, Desulfitobacterium hafniense
IYARIAGTGSYLPAQVVTNDELAKRVETSDEWIRTRTGIRQRHVAAEGETTVDLAYQASLRALEAAGVTPEEIDLIVLGTTTPDLIFPSSACLLQHRLGANGCPAFDVNAACSGFVYALTVADKFIRSGAAKTVLVVGSETLTRMLDWTDRSTCVLFGDGAGAVVLKADSETGILSTHLHADGGKKELLWNPVGVSAGFKPEEHNAGVRVLMTGNEVFKHAVKALDSVVEETLEANGLDRHEIDWLIPHQANLRIIEATAKRLDMPMERVIVTVDKHGNTSSGSVPLALDEAVRSGKVQRGQLLLLEAFGGGFTWGSALLRY

SEQ ID NO: 9579 - protein, 225 aa, Desulfitobacterium hafniense; identical to SEQ ID NO: 8693
  unsure (1)..(225): unsure at all Xaa locations

SEQ ID NO: 9580 - protein, 359 aa, Desulfitobacterium hafniense
IGTGLFYGSATTIQLVGPAIIVSYLLGGTAIFFIVRALGEMCVDQPVAGAFSYFAYKYLGDFPGFFSGWNYWFNYIAVSMAELTVVGVYINFWYPNVPQWVTALAFLVIITLINLINVKPFGESNFWFALIKVVAILAMIAFGLVMIFFGLGEQGAVGFSNLWTHGGFLPNGVWGLLLSLVIVMFSFGGVELIGITAAEADDPKRSIPKAINQVVWRILIFYIGALTILMILYPWDQIGTSGSPFVEIFSAIGIPAAAHILNFVVLTAALSVYNSGIYSNGRMLHGLALQGNAPKFLTKVSRNGIPINGVFASSAVTLIAVILNFLVPGKVFLYLISIATIAGIFNWAMILVTQLRFRK

SEQ ID NO: 9581 - protein, 305 aa, Desulfitobacterium hafniense
TAVVLVNLGTPEAANTAAVRRYLSEFLHDRRVVDMSRWLWCPLLHFAILPLRSSKVAHKYASVWLPEGSPLAVHTRRLAEALQRELPQLRVLHAMRYGQPSWKQLLPRLREQGVKRVLALPLYPQYSTSTTASVGDVLDAAQGLDKRLVNDYHTDPEWVAAVADSVRRHRFANGAGEHLLMSFHGLPQRFAAAGDPYPQHCEASARAIAQTLDLPEQAWSLSYQSRFGRERWLEPSTADTLTALAARGVRQVDVIAPGFAVDCLETLEEVAMMLAEDFAARGGRLRYIPCLNESPAHAQALAGIV

SEQ ID NO: 9582 - protein, 255 aa, Desulfitobacterium hafniense
AVDNGIFRAYDIRGVVGQSLDPGIAELIGHAIGSVMHDQGLTEIVVGRDGRLSGPSLMAGLIAGLRKAGRNVVDIGLAPTPVTYFGAYHLRAGSCVSLTGSHNPPDYNGFKIVVGGETLSGDAITDLYRRIVGGRLHTAAEPGTLAERDISEDYVQRIASDIQIDRPLKVVVDAGNGVAGDIGPRVLAAIGAEVTPLYCEIDGEFPNHHPDPSEPHNLVDLIKMVQRLDADLGIAFDGDGDRLGVVTRDGQNIFP

SEQ ID NO: 9583 - protein, 175 aa, Desulfitobacterium hafniense
RYGSGYFYLTQRENIEIPGILLDNLNEVSQSLAEVGLSIGSTGPRPRPITTCKGAVCKFSLYDTEGYTSQLNEKIYKGYYDVTLPGKLRIITSGCFNNCSMPHVGCIGIIGKKKDQVAISLGGMAARKQFLGQEIQGLYTLDEATGIIEKAIQYYKEHGNKGERFAQMIERLGFE

SEQ ID NO: 9584 - protein, 254 aa, Desulfitobacterium hafniense
QKRMCSSFYGWYLDRRISRRKIHPFVCKFDLDLSIAEKNLKDFSSFNDFFYRKLKPSARSIDPCQDSLISLGDGKLLAYEDINLDCLVQVKGLTYSLKELIKDPETASKYKRGTCLILRLCPTDYHRFHFIDSGICEPSHRIKGSYYSVNPVALQKVAKLFCENKREWSIFHSDHFGDILTIEVGATFVGSIIQSYTPHQPVARGDEKGYFKFGGSTVLLFFEENKIKIDPDIVEQTKLGYETYILFGEKIGVR

SEQ ID NO: 9585 - protein, 237 aa, Desulfitobacterium hafniense
LSQDSAMSTFPEFRPRRMRRDDFSRRMMRENRLSPDNLIYPVFILEGQNQRQTVASMPGVERVSVDLLMPVAEDCVKLGIPVIALFPVIDPSLKTPDGIEATNPEGLVPRAVRALKDRFPELGVLTDVALDPYTSHGQDGVLDENGYVINDITVEILVKQALVQAEAGVDIVAPSDMMDGRIGAVRNALEEAGHIHTRIMAYSAKYASAYYGPFRDAVGSDSNPGQGNKMTYQMDRA

SEQ ID NO: 9586 - protein, 313 aa, Desulfitobacterium hafniense
VAAEAERDLRALMAIPDDYAVLFLQGGATAQQALIALNFANPGQAVDYVVTGHWGQDALKQVKPYVSANVAANGEAGGFRDIPARAEWNLSKDAAYVHYTANETIHGVEFRDIPDTGDVPLVADFSSSIAAEPLDVSRFGVIYAGAQKNLGPVGVSVVIVRRDLLERAGQPRADIFDYRSHVKGESMLNTPPTWNWYLAGLVFKWMLAEGGVEEFAKRNARKAGLLYEVIDNSGGYYRNEVAAAARSRMNVPFFLKDEALDKPFLKEAEAAGLISLKGHRALGGMRASIYNAMPEAGVQALASFMRDFQQRHG

SEQ ID NO: 9587 - protein, 296 aa, Desulfitobacterium hafniense
RPSPWKTADPRAAPRSPRRTHRRHAPQEPGTPRNSGDRRMSQQTPPQSFADEVRGTQAKPIDKTLSRLMDDLYDQGPGIDGFKPLSADQLRSKGIDPAGLENKDSGFLARIYGDEHGHYVVAFSGTDEGKDWLTNFRQGLGFEDAQYNQAIALAREAKVAFGDEVVITGHSLGGGLAGVASISSGIPAVTFNASGVHDKTLERIGIDADAAKREVADNGQIRRYAVKNEILTDLQEHSIPLKWAMPDAVGHKIELPDPDPQSFWQKLIPGSGIKHGIDIHYIEAVIKAQEQAMPGE

SEQ ID NO: 9588 - protein, 290 aa, Desulfitobacterium hafniense
  unsure (1)..(290): unsure at all Xaa locations
DATGREIERTLIAQALGEERILVKEEQFLLDLLKNSKGEVIGALSLNELTHELEIYLAQAVVLATGGLGQLYCYTTNPEVATGDGIAAAYRAGAQLMDMEFVQFHPTALFIPGAPRFLISEAVRGEGAQLLNAQGERFMQDVPGKELAPRDVVARGIWREQAKGEVTLDFRPIGVAKVPRRFPMIYQTCLDYGINVLEERLPVAPAAHYMMGGVRTDERGRTSLPNLYANGECACNGVHGANRLASNSLLDGLVFGGRIVEDMWTTTSLRLYXSQGSDSIRNQAYVSVXM

SEQ ID NO: 9589 - protein, 313 aa, Desulfitobacterium hafniense
  unsure (1)..(313): unsure at all Xaa locations
KVMIDQVLSHTSNEHEWFKRSRESRDNEFADWYVWADARADGTAPNNWMSLFGGVAWRWEPRRQQYYLHNFLSAQPDLNFHHPAVRAAVLDNVRFWLERGVDGLRLDAINFCFHDAQLRDNPPKPPAQRVGRGFSPDNPYAFQYHHYNNTQPENLAFLGELRALLDRYPGAVALGEISSEDSLATMDEYTRNGRLHMGYSFELLTEDYNVEHIRGTVQRVEASMREGWPCWAISNHDVQRVVTRWGRGEAPKHFATLVSALACSLRGSVCVYQDEELGLPEAEVPFEALQDPYGKNFXPNFQGRNGCRNPLPW

SEQ ID NO: 9590 - protein, 198 aa, Desulfitobacterium hafniense
PPGLLERLDLADKLKFKVEELSGGQKQRLSIALALLDDPQIVFLDEPTAALDPHSRRYTWEFIEELKRDRNRTIVLTTHYMEEAERLCDEIMIMNQGEIVGQGMPSLLIADLNAARQTRIKLAADAPGEAIARAVCARYPTAWDAFTDSLVISSNEVAEALGEAMAQAQAHGAAIVDIHLERLSLEDVFLNKTGKELK

SEQ ID NO: 9591 - protein, 319 aa, Desulfitobacterium hafniense
ARAAILDSLHALHRYPDPLGGDLKRALAHKHGVDTKQILLGNGSHELLMQLGQVFAGPGEEVVFSRYGFAVFALSTQAAGARMTIVDALPREAAMPCGHDLDAIAAAVGADTKLVYVANPNNPTGTWFGREALVEFLDKIPPQVIVVMDEAYAEMADAPDYASALSVLDRYPNVAVTRTFSKAYGLAGLRVGYLIAQPGLIAVMDRLRESFNVNGPALAACEAALGDDDHLRWACARNAEQRAALAEALNRRGLRAFPSQTNFVLAEFGARTPQVEAALVARGVILRPMGGYGLGDCIRISVGSADENRRLLAALDQVL

SEQ ID NO: 9592 - protein, 453 aa, Desulfitobacterium hafniense
DADEAASAAETPAVAIAVLAPVREDIAVVGMGGRYPGAASLDEFWDNLRSGRDSVGPMPRERLARRQRKAPSRDYRGGFLDCVDRFDSLFFNISPREAEVLDPQERLFLEVAWETLEDAGYYPELLAQDPRTRKVGVFVGAVWAMYQMLGVEEKLAGRPLTPNSFLWSVANRVSYWMNFSGPSLSVDTACSSSLTALHLACEAIRNGDCTAALVGGVNLDLHQHKFDINNAGGALSPDGVCSSFGASANGYVAGEGVGALLLKPLSQALADRDQIYGVIRGAVVNHGGRTSGYTVPNPRAQGELVAAALAKAGVDAASVGYIEAHGTGTELGDPIEIAGLSQAFASAGLPARACAVGSVKTNIGHLEAAAGVVGVSKVLLQMRHRKLVPSLHSAELNPHIDFDATPFYVQRELQDWTPRGAAPLRAGVSSFGAGGANAHVVIEQYPSAVDEET

SEQ ID NO: 9593 - protein, 363 aa, Desulfitobacterium hafniense
FCLSPQGISIGVIGPVKVGRALLAHLAAAQPRFQRESRPQRRLDLRLRALADSRRMRLAPRALEFDDAHALEAESEALDLKRFAAHVRAEHIPHALIVDCSGSDAVAARYPEWLAAGIHVVTPSKHAGAGPLARFEAIREAARHGGQFRYEATVGAGLPVIQTLRSLLDTGDELTEVEGILSGTLAWLFNRYDGRTPFSQLVREAHELGYTEPDPRDDLSGTDVARKLVILAREAGRPLSLEQIEVESLVPESLRSVSKEEFFARLDELDAPLQQRFDAARAAGLSLRYLARLDRDGRASVGVVTPQPGHAALHGALTDNLIQFRTRRYADNPLVVQGPGAGPDVTAAGVFGDLLTIAQTLGA

SEQ ID NO: 9594 - protein, 430 aa, Desulfitobacterium hafniense
EGLPDATIVEWAVKVGDTIRSTTPWMSMETAKAVVEVPSPVSGKVLKLAGGAGDVIVTGTMLAEFEIDPNMPQRADGQDTGHHHGGGHAAPAAPAPAKSEEAPAKAEGGERADSGTVVGAMQSSDAVRSEQAVAVGGVKAMPAVRALARKLGVDLSRVRATGADGTVSSDDVKRAAADGSAKVGSAPAAAVAPRAAAVAEAPAPAAAPARSTLSQSGRPMRTQPPGVAATGQPEQLKGVRRNMARVMADAHSKVVPTTLADDADIHAWLPGNDITGRLVRAIVVACKTVPALNAWFDGDKLTRTLHPQVDIGIAVDTDDGLFVPALRNADVLDARGVREAINRLRVQVEDRSIPASELTGYTISLSNFGMFAGRYATPVVVPPTVAIVAAGKGRHQMTPVMGGFESHKVIPLSLTFDHRACTGGEAARFL

SEQ ID NO: 9595 - protein, 236 aa, Desulfitobacterium hafniense
ALITGGATGIVRSIALKLAQEGVNIAVNYSRSREDAEQTSQEIDKLQVACRIYQANVAKDQEVREMIGAVVRDFGQLDILVNSAGMTHFVEHADLEGMKDEYWDEIFSVNVKGLFNTCRAAAEALKKQKGCIVNITSIAGLTGLGSSIAYSASKAAAISVNKSLARVLAPDVRVNSVAPGVVLTRWVSGQEEHITRMAEGTPLQKVCTPEDVAEVAYALIAHAGFVTGQTWVVDGG

SEQ ID NO: 9596 - protein, 197 aa, Desulfitobacterium hafniense
  unsure (1)..(197): unsure at all Xaa locations
FRLTGWKASVIILFLEXLLVGGGVIRVEEKIGKVLLSREEIQKRVAELGEEITRDYKDQNLLVLAILKGAVPFMADLIREIRIPLKYDFMAVSSYGASTHSSGVVRILKDLERSVEDHHILIVEDIIDTGLTLKYLKENLAARNPLSIKVVTLLDKPDRRKAEVVPDYIGFTIPDEFVVGYGLDFDEHYPNLPYVGI

SEQ ID NO: 9597 - protein, 521 aa, Desulfitobacterium hafniense
  unsure (1)..(521): unsure at all Xaa locations
TLGPKGRNVVLEKSFGAPTITKDGVSVAKEIELADKFENMGAQMVKEVASKTSDNAGDGTTTATVLAQALIREGMKAVAAGMNPMDLKRGIDKAVTEAVVELKXXLXXXXPXPXXXSKXKXAQVGAISANSDHNIGDLIAQAMDKVGKEGVITVEDGSGLENELDVVEGMQFDRGYLSPYFINNQQSMQAELDDPFILLHDKKISNVRDLLPVLEGVAKAGKPLLIVAEEVEGEALATLVVNTIRGIVKVCAVKAPGFGDRRKAMLEDMAVLTGGTVISEEVGLQLEKATIKDLGRAKKIQVSKENTTIIDGAGESSGIEARIKQIKAQIEETSSDYDREKLQERVAKLAGGVAVIKVGAATEVEMKEKKARVEDALHATRAAVEEGIVPGGGVALIRAKAAIAGLKGINEDQNHGIAIALRAMEAPLREIVTNAGEEPSVILNKVIEGKGAYGYNAATGEYVDMIEAGILDPTKVTRTALQNAASIAGLMITTEAMVAELPKKDEPAMPGGGGMGGMGGM

SEQ ID NO: 9598 - protein, 310 aa, Desulfitobacterium hafniense
  unsure (1)..(310): unsure at all Xaa locations
KPVVLLILDGWGHRDDPADNALAQAELPNWRALLASQAHTLIHTEGRHVGLPDGQMGNSEVGHMNLGAGRIVYQDLTRIDAAIEDGSFYANDELRAACAAAKAAGTTLHLLGLLSPGGVHSHERHIFAMIELARREGVAKVAVHAFLDGRDMPPKSAAPSLQRLQQACDEAGNARIASIGGRYYAMDRDKRWDRQLRAWDAIVEAKSEHHTETALEGLDAAYARGETDEYDAPTVIGDAQPMDEGDAVVFMNFRADRARQINDAYVDPKYDGYEARKTKLSRIVXLTEYDARLPAPVEYGPEELSNTLGE

SEQ ID NO: 9599 - protein, 375 aa, Desulfitobacterium hafniense
LKPILFVDRDGTLIQEPADFQIDSYAKLRFVRGVIPAMLKLRDAGYEFVMVTNQDGLGTDSFPRWSFDGPHELMMQVFESQGIVFRDVLIDTSFPAENLPTRKPGIGLALPLLKDRGIDWERSAMVGDRETDNGFAANLGIRAFQLRTKEFGGEWDWSGIAHVLAERPRTASVQRNTKETRIQVRVDLDRAAEPQVATGLGFFDHMLEQLGKHGGFALELSCQGDLHIDEHHTIEDSALALGQALREALGDKRGIGRYGFEPRAGQGDDVAAPIAHEFVLPMDETLARAALDFSGRPYFVFGGGFAREKVGDFPTELLPHFFRSLCETAGLNLNLNVEGDNDHHKIEACFKVVARALRQAIARQGRELPSTTGVL

SEQ ID NO: 9600 - protein, 314 aa, Desulfitobacterium hafniense
ERFFCLNSGSESVSLAARIADVNSKLMTDPGARHAGRAIKRLVIKGSFHGRTERPALYSDSSRKAYSQHLASFRGEDSVIAIEPYDADALKKAFADADAKGWFIEAMFLEPVMGEGDPGRGVPASFYALARELTRDHGSLLLVDSIQAGLRAHGVLSIVDYPGFEGLEAPDMETYSKALNAGQYPLSVLAVGERAASLYRKGLYGNTMTSNPRALDVAVAVLEQVTPQLRANIRNRGAEAIEKLEKLKHELGGLITKVQGTGLLFSCELAPQFKCFGAGSTEEWLRERGIGVIHGGANSLRFTPNFTIASDELE

SEQ ID NO: 9601 - protein, 390 aa, Desulfitobacterium hafniense
GGDGPLSVADLRSPHPLAAAFLDAAGELGLPRNDELNGGDPFGAGYLQATQLRGWRHSAARAFLRPARRRRNLDIVTGALVERVLIADAAAHGVAYRHRGQRKVAHARGEIIVCAGALASPKLLMLSGIGPAEQLERHGIGVVRDSPGVGANLQEHPGALITAQVNMRTYNVETGPLSVLRHGLDFLLRGRGPGTTPIGHAVAFARSAPQVERPDLQLVFTPIGYNTSGDGPVLLPVPAVVIAVNVCRPRARGTLRLRSADPAELPEIRLEMLADPHDRGLLREGAKLARQLYATGTMRGYVERELRPGAQVDSDAEWDAFLRKHCMRFSHPAGTCRMGVDALAVVGPDLRVHGVQRLRVADASIMPTLVSANTNAAAIMIGEKAAELIL

SEQ ID NO: 9602 - protein, 196 aa, Desulfitobacterium hafniense
LLRLRGQLMQDAAPAGIGAMAAVLGAEDALVEEICQAVSGSEVVVPANYNSPGQIVIGGHAVAVDKALTRLAEAGVRKAVKLAVSVPSHTPLMREAANRLAEAMAGLDWRAPQLPVVQNVDGQVHASVEAIREALVRQLYLPVRWTACVQALAAHGAQRAAECGPGKVLTGLIKRIDKSIDGRAIGTPAEFETALS

SEQ ID NO: 9603 - protein, 240 aa, Desulfitobacterium hafniense
GEIALVTGASRGIGAAIADELAAQGATVIGTATSESGAKAIGERLAAHGGHGRVVDVADPASVESLLDAVAKEIGAISILVNNAGITRDNLLMRMKDEDWQAILDTNLTSVYRTSKAVMRSMMKARKGRIINIASVVGVTGNPGQANYAAAKAGVIAFSKSLAREIGSRGVTVNVVAPGFIDTDMTRDLPEDAKKAMFDQIALGRFGEPADIARAVAFLAGPGAGYITGETLHVNGGMYM

SEQ ID NO: 9604 - protein, 371 aa, Desulfitobacterium hafniense
GPGALRSAVAAGSQPRLSDVHVEPQDLAFLLYTGGTTCVSKGSILNKSAHVANLQQVSAWFGDKIRPGQETIVTALPLYHVFALTCNCLVFLKAGGHSVLITNPRDMPGFVAELRKTPFTAITGVNTLFSGLLNTPGFERVDFSQLRMCFGGGTAVQRAVAERWQQVTGKALVEGYGLTESSPVAVVNPIVEGMQFNGAIGVPIPSTWPCVMNEQGERLPVGEPGELCLQGPQVMKGYWRQPEETARTIDRDGWLHTGDIARIDEKGFIFLVDRKKDMILVSGFNVYPNEVEDVMAAMPGIREVAAVGVPSEKSGETVKLVVVRSDPALTVEQIKAYAKANLTGYKRPHVIEFRNELPKSNVGKILRRELR

SEQ ID NO: 9605 - protein, 257 aa, Desulfitobacterium hafniense
TGRVTWEPVRSLWFSAMFAGAAIGGALTFSWGAFALFVASTVAVLLLGHSLGMHRKLIHDSFACPKWLEYLLVYCGVQVGLAGPIALVRTHDLRDYAQRLPHCHDYLAHRRGFLQDAWWQLHCELRLDAPPRIALEPRIGEDRVYRFLQRTWMWQHLPWALAFYAIGGWGWVFWGVCARVTAGVFGHWLVGYFAHNHGGMHHEVRGAAVQGRNVRFASLLTMGECWHNNHHAFPGSARLGLYPGEWDPGWWLLRALE

SEQ ID NO: 9606 - protein, 402 aa, Desulfitobacterium hafniense
  unsure (1)..(402): unsure at all Xaa locations
KKDQGVDLAKDRVALQRLKEAAEKAKVELSGVSTTNVNLPFITMTGEGPAHLDMNITRAKFEELTADLVEATLGPTRQALADAKLSWNEVNQVILVGGSTRIPAVQEAIKKLSGKEPHKGVNPDEVVALGAAIQGGVLAGEVKDIILVDVTPLSLGIETLGGVFTRIIDRNTTVPTTKSQVFSTAADSQTSVDIHVLQGEREMAAYNKTLGRFQLSGIPPAPRGIPQIEVKFDIDANGIVHVSAKDMATGNEQKVTITASTGLSQEEIEKMKKDAEAHADEDKKRKELIDAKNQADSMVYQTEKTLKDFEGKIPDNEAEPIKKALEELKTAAAGENIELIKEKTEGVTKVLYPIIEKMYQQTGGAAPGPDMGADPGAGGAQGDDNVVDAEYTEVDKDQKXSE

SEQ ID NO: 9607 - protein, 451 aa, Desulfitobacterium hafniense
LIFGAAARLSRLLRQQLFKHFTRMSPSFYQKYRTGDLMAHATNDIQAIETTAGMGVLTLVDSLVTGGFVVFSMAAFLSWKLTLITLLPMPVMAWVSSYYGTLLHERFFKAQEAFGDLNDKVQENISGVRVVKAFGQEEVEIESFRRLSDDVVKKNQAVAVVDSLYDPSIMLIVGLSFFLAVSFGAYEVIHLRLTLGQLTQFTLYLGQFIWPMLAFGWLFNIMERGRASYDRVQALLGVESEVQDQVSLQGAPDGSRAELRQSVKGDIYCALEQFTYPGQTKPELKRIHFTLKEGQTLGIVGKTGSGKTTLFRVLLREFAGMTGEIRIGGVSIEEIPLDSLRGIFGYVPQEHFLFSTTLAENIALGKPQAQLSEIEKAAKTACIHEDIQRFEAAYGTLVGDRGVTLSGGQKQRISIARALLLDPKILILDDSLSAVDCQKGKQILRKLKATG

SEQ ID NO: 9608 - protein, 244 aa, Desulfitobacterium hafniense
KSVRLKIRRQNAPDQPAFWEEFAVDYSPKMNIISCLMEIQKNPVNVQGKKTNPVVWECNCLEEVCGACTMNINGQARQACSALVDQLEQPIVLEPLRKFPILRDLMVDRTIMFENLKRVHAWIDIDGTYDLGPGPRMAEVDRVWAYELSKCMTCGCCMESCPQVNSRSRFIGPAAVSQARLFNTHPSGAMHKHIRLSALMGDGGITDCGNAQNCVRACPKEIPLTTSLADMNREVNKFALKRWL

SEQ ID NO: 9609 - protein, 786 aa, Desulfitobacterium hafniense
IRQCIVEAMRSSVDHGQVAHDPVADRVVIIEIYRRTSRASAIASKATGFPIVLISSLLAAGPDLDEIPYCREGTLDKYTPWGDYVVIKFARWAFEKFKGVEDKLGTQMRSVGEVMSIGKNYKEAFHKAIRSLEIGRYGLGFAKDFNTKTLPELLELLKTPTSERHFMMYEALRQGADPAELAAITYVKTWFIEQMKELVDLEEKILEYQGRELPAELLIQAKKDGFADRYLAQLLGISETQVRRQRLGLGLTQAWDAVPVSGVNNASYYYSTYNAPDKVTTSQREKVLILGGGPNRIGQGIEFDYCCVHAAFALKNLGYETIMINCNPETVSTDYDTSDKLYFEPLTVEDVLSIYEKERPIGAIVQFGGQTPLNIAAQLQEAGVRILGTVPEVIDQAEDRDQFRKMMEKLAIPMPQAGMASTLEEALAAAEMIGYPVMVRPSYVLGGRGMEIVFDEEQLREYVAAAVDITPERPILIDKFLENAIEAEADAVSDGTHAFVPAVMEHIELAGIHSGDSACVIPPLNHCDRHLRTIIDYTQRIAQELHVVGLMNIQYAIAEDKVYVLEANPRASRTVPLVSKICNTPMARLATELILADYTGQKNDIATNFKPAQISHYGVKEAVFPFDKFPEVDPVLGPEMRSTGEVLGMANSFGLAYFKAQEATHSSLPFSGTVLMSIAEQDRSSGVIEIAQEFLKLGFKIKATQGTRKFLQDHSIDAEFIHKIEEGRPNITDGIMNGEIQLVINTPIGKRSLKDDSYIRKTAIKYKIPYINNTPGGLDSAKGIAA

SEQ ID NO: 9610 - protein, 440 aa, Desulfitobacterium hafniense
  unsure (1)..(440): unsure at all Xaa locations
PIHPSPRMTRTRFAPSPTGYLHIGGARTALYCWLEARRAGGQFVLRIEDTDRERSTQAAIDAILEAMDWLGLSYDEGPIYQTQRLDRYREVAEQMVAAGTAYYAYETRDELEAVRNAALAAKEKPRYNGAYRERNEPYREDPNRVIRFKNPLDGTVVFEDKVKGRIEIANSELDDLVIFRADGYPTYNFAVVVDDLDMAITDVVRGDDHVNNTPRQINIYRALGATVPHFAHLPMILDPEGAKLSKRTGAADVMQYRDEGYLPHALLNYLVRLGWSHGDQEIFSIEEMTRLFQLSDVNSSASRLDKAKLGWMNQQYLKSDDPAEVGKHLEWHLRQQGYDLAAGPAPADIVIALRDRVQTLKDMAERAAVWFGPLTQYDEAAVAKHLNAAARAPLAEARARLAQLPAWTADAVGAALHEGAETLXPGMGKVAQPLGVASPG

SEQ ID NO: 9611 - protein, 527 aa, Desulfitobacterium hafniense
  unsure (1)..(527): unsure at all Xaa locations
LCDAILLAAHGTIQRLFCGRQHTRPRRGGGIVTLRDRPAAKYSWSTTPERLERAGVSWKLYQDMDDNFSDNPLEGFRQFRAAAPGSALAEKALKTWTLEDLASDVRSGKLPQVSWLVAPAKYSEHPGPSAPIWGADYTARVLDALTADPAVWARTVLIVNFDENDGFFDHVPPPAPPSLDAQRKPLGGSTVDLRGEHHFARSGPSHGTSADPAIYYDRPYGLGPRVPMYVISPWSRGGWINSQVFDHTSVIRFLEKRFGVSEPNISPWRRAVCGDLTSAFNFENPNHEPIPTLPYTGDADRIVAEQSKLPAPKPPATPSAARQEPGIKPSRALPYDLHVGERFDRDARSLRLNFGNSGRAAAVFHVYDLLDPEAIPRRYTVEPGRSLNGDWALRSGGARAYALQVFGPNGFFREFRGSLHGANPGATTIPDLRLRHRKLILALRNPGRKPLRLELADQYGLYAPRLERLGAGSLRYRPVRLDESCQWYDFVLIDANDPEYYRRIAGRVEIGAHGVTDPGLIXGGLSF

SEQ ID NO: 9612 - protein, 259 aa, Desulfitobacterium hafniense
TGKLAQKGISEGKLYGKIKVVASSEDQNYSYIPDLKDLKFSEEADYVYICHNNTIFGTKFNELPEVGDKPLIADMSSDFLSEPIDVSQYGIIFAGAQKNVGPAGVVIVIIREDLITEDVLPGTPTMLKYKVHLDNNSAYNTPPVYGIYICGKVFKWLKKLGGLEAMQKINEEKAAILYDYLDASAMFKGTVAKKDRSLMNVPFVTGSEELDAKFIKEAKTAGFENLKGYRTVGGMRASIYNAMPIQGVKDLVEFMRKFE

SEQ ID NO: 9613 - protein, 337 aa, Desulfitobacterium hafniense
IHYGVAASLMALQDAGIVVDDSNAERIGALVGSGIGGLLGIEEQTVKYHEGGPRKISPFYVPSTIINMLPGQISLITGAKGPNFSAVSACATSNHSIGMAMRMIQYGDADVMVAGGAERGSSPTSVGGFCSMKAMSTRNDDPTRASRPWDKDRDGFVLGDGAGILILEEYERAKARGARIYCELAGFGASSDAFHMTAPSENGEGPARCMVSALKDAGINPDQVGYLNAHGTSTPLGDLAETLAMKRAFGDHAYKMMVSSTKSMTGHLLGAAGGAEAIFSVLALHDGIIPPTINLDEAGEGCDLDYVPNVARETKIDVAVSNGFGFGGTNGTLVFKR

SEQ ID NO: 9614 - protein, 428 aa, Desulfitobacterium hafniense
LIDGEFVESRTAHWREVINPATQAVLARVPMATPAEIDAAVAAAARAFKTWRKTPIGARARIFLKYQQLIREHMGELTAILSAEQGKTLPDAEGDVFRGLEVVEHAAAIGNLQLGEFANNVAGGVDTYTLLQPLGVCVGITPFNFPAMIPLWMFPMAIATGNTFVLKPSEQDPLVTMRLCELALQAGIPKGVLNVVHGGEDAVNALCDHADIKAVSFVGSSKVGTHVYRRASLAGKRVQCMMGAKNHAVVLPDANKEQTLNALAGAAFGAAGQRCMAASTAVLVGAANDWIPELVAKAKTLKVNAGSEPGTDVGPVISCAARERVEGLIASGVEQGATLELDGRAPAVPGFERGNFVGPTIFSGVAPGMRIYDEEIFGPVLVILRAQTLDEAIELVHADPNGHGPGIFPRSGAGGRGFQDDVTFARSG

SEQ ID NO: 9615 - protein, 612 aa, Desulfitobacterium hafniense
AKPAAQPRVAHPSAILPRPAKFVPGQGAFVFGPDTAVVVAADQPGARRVGEFFAQRVQALRGFAPKLQESSGAVKGAVALSLDPKLPIGEEAYVLDIGQDGAKISARSEAGLFYGAVSLWQLAPPTAPRGETRIAAQRIEDAPAYRWRGLMLDVARHFRSVDEVKAVLDQMALLKLNSFHWHLTDDQGWRIEIKKFPRLTEVGSCRIRAGANGRDAQGKPVQYCGYYTQEQIREVVAYAAARHINVVPEIEMPGHAQAAITSYPALGVGDVLKQAPPVSPDWGVHTYLFNPQDETFGLLTGVLDEVGRAFPSKYIHIGGDEAAKDQWKASPMVQNKIKSLGLKDEAALQSWFVGRIGAHLQQRGRVLVGWDEILEGGKLPADATVMSWRGDAGALQAARDGHDVILAPDRKLYLDYAQSERDDEPSGRYPVATLRAFYEFPMTPPGMDAEQTKRVIGAQGNLWTEHKRSFDQVQLALHPRLDALAEVVWSPAQGRDWNDFQRRLVPQFDRYRALKVGFSDAAYAVETKAEPDAGGARVTLSSQTGFGEIRYRTDGGAPDASSPVYAQPFQAALPLDVVATTFFDGHPMSAPRRFQVQTAADLASAAAPSSRP

SEQ ID NO: 9616 - protein, 508 aa, Desulfitobacterium hafniense
  unsure (1)..(508): unsure at all Xaa locations
LAYASQGGLGLPDRGYYFDADKRDKLEAYRKHVAKVLELAGASAADAEKQAKAVIEFETRLAQASLSSEQLSRDIALYYNPISPAQADELTPNFSWTQFFXVAXGVATPKLFSLAMPGFHKEVSKMIADTPIEAWRAFLRYHAVDAASPYLSEAFVQESFEFHAKAMRGQKEPKARWKRVLGGIDDQAGEAMGQLYVKVAFPAEAKAQTQALVQQLRTALKARIENLSWMSAETKKKALEKWASFTPKIGYPDKWRDWSGLKTGHDSYYANVKAANKFNYKWSLGKIGQPVDKTEWGMSPQTVNAYYNPLQNEIVFPAAILQPPFFDPKADEAANYGGIGAVIGHEMIHGYDDQGSRFDPTGNMANWWTPADAKGFAARSQKLIEQFDGYEAAPGLKVNGKLTLGENIADLGGLATAYDAMHLAVGDKPDPKTDGLSRDQRFFLNFAVSWRDRYTSDLLKVLVASNPHAPSDLRAIGAPSNLPAFAAAFSCKPGQPMVRAGDKQVVIW

SEQ ID NO: 9617 - protein, 387 aa, Desulfitobacterium hafniense
EIKDEFLARTSHELKTPLHGIINISGHLLKGETSSLSLEQRENLLLLQDTSSRLSLLVNDLVDIIKLRHEDLQLNLITVDLYVVIQLVFQLLSFDLQGKEVKMLNKVKPMTFVEADENRLRQILYNITSNAMKHTEKGEIVAQAREEGLDIVLTISDTGKGIPQEHWELVFKDFNHDSLPQQDYKQGMGLGLYISRQLARKMKGEVWIADSVVNKGTSMAVRLAKGQCLNTEMTAGSVLERKVWSSKPTSSGLSEKMKKILIVDDEPTNIRVLSLMLEGEYQVSAAYSGEKALESLKNEKFHLLLTDLMMPGMSGIELTQQIRQNYSLIELPIIIATARNREREIELAYQNGANDYITKPFTAEEVQWRVRSLLKLTDTMEKAFESE

SEQ ID NO: 9618 - protein, 172 aa, Desulfitobacterium hafniense
  unsure (1)..(172): unsure at all Xaa locations
RXRRRVKMYYSTTYLSPICTITLACDGDNLIGLWMEGQRFHGGTLPESMIEKDDIPIFDAAKAWLDRYFAGERPATSELPLAPMGGEFRQGVWDILCQIPYGQVITYGDIAKQMAEKMNKKCMSSQAIGGAVGHNPISIIIPCHRVVGAKGNLTGFGGGISRKIQLLEHEGV

SEQ ID NO: 9619 - protein, 376 aa, Desulfitobacterium hafniense
  unsure (1)..(376): unsure at all Xaa locations
AKHGGXKVFIHALLDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGRPLQLHYVCMTEYDDKLKGAAVAFPAQNLDNTLGEVLAKHQKKQLRIAETEKYAHVTFFFNGGVEEPCPGETRCLIPSPQVPTYNLLPEMSAYGITEELLKRLEREEDEVIILNFANADMVGHTGEFEATVKAIAAVDQCIGQIVPQVLERQGTVIITADHGNAEAKVDLQTGQPLTAHTTNPVPLILVNDQLKGKTLREGGALRDVAPTMLRLLEIPQPQEMTGKSLI

SEQ ID NO: 9620 - protein, 326 aa, Desulfitobacterium hafniense
FHARVRAPTCEVPMFEKILIANRGEIACRVIRTCRKLGIRTVAVYSEADADAQHVRQADEAYPIGGPRPAESYLRGDAILEVARLSGAQAIHPGYGFLSENADFADAVEAAGIAFIGPKAASMRKMGSKAGAKELMQAAGVPVVPGYTGADQDPALLQREADRIGYPLMIKAAHGGGGKGMRIVREAGEFAANLESCQREARNAFGRDRVLLERYVERPRHIEIQIFGDNNGQVIHLNERECSAQRRYQKVLEESPSPFLSPEQRAQMGAAAVQAGHAIDYVNAGTVEFIVGQDGAFYFMEINTRLQVEHPVTELVTGLDLVEWQL

SEQ ID NO: 9621 - protein, 234 aa, Desulfitobacterium hafniense
  unsure (1)..(234): unsure at all Xaa locations
IVFEHVSFHYEGKPVLKNINLTIEKGKSVAIVGPSGTGKTTLINLIPRLYDVTGGRVLLDGQDVRDLDLNFLRQNIGMVAQDTYLFNGTIRENLHYANEHAQEEDLIRVCREANIYDFIRTLPDGFDTLVGNRGLKLSGGEKQRLAIARVLLKDPKVLIMDEATSSLDSLSESLIQEAIEPIAFKGSTXLLVMRPIWLFPRIMSVNDIIVLQEGEIVQQGTHWELLKEDGLYKL

SEQ ID NO: 9622 - protein, 156 aa, Desulfitobacterium hafniense
  unsure (1)..(156): unsure at all Xaa locations
KPVISFKDITTLLKDGEAYRAEVDAIVERVRESQPDLIVGPEARGFLLGAPVAYALGIGFVPVRKPGQLPGKTVSETYELEYGSDTLEVHADAIQPGQRIAIVDDLLATGGTTSATARLIEKTGAQVAGMSFXIELGFLEGRKRLEGYEVFSLIKY

SEQ ID NO: 9623 - protein, 312 aa, Desulfitobacterium hafniense
VEVGVLYSFINYLDRFIDPVNMILMRLFSRLQQAIIAAERVFEVLDDGRTTTALGLNAVQEAGDPPAPGIEKGEIEFRNVSISYDGVTEVLTNISFTVHPDGTVALVGHTGSGKSTISNLLMKFYPVNQGEILIDGISLHDFSQEELRTQIGLVAQDPFLFVGDIANNIALNRPAVGEREVNAAAEFVEADQFITKLPQGYQEPVSERGSTLSSGQRQLICFARTIAGEPKILILDEATASVDTETEEAIQTALNKMRQGRSTIAIAHRLSTIQDADLILVLHQGQIVERGNHNELLAQKGLYYKMFLLQQG

SEQ ID NO: 9624 - protein, 329 aa, Desulfitobacterium hafniense
  unsure (1)..(329): unsure at all Xaa locations
RIAINGFGRIGRLSMRAILERKSSLDIVAVNDLGSPDLLGHLFKYDSIHDILPYDVEVKENTLEVLDQKVAFLAEKDPGKLPWRELGVDLVIEATGRFTKREQAALHLQAGAKKVIISAPGKHEDITIVMGVNEHLYNPAEHHILSNASCTTNGLGPPXPRVLLEEFGIEQGMMTTTHSVTNDQRILDLEHKDWRRARAAYESMIPTTTGATKAVELVLPDLKGKLKGLAVRVPTPNVSLIDFVANLSRSTTKEEVNQKLREAAEGSLKGYLAYSELPLVSHDFNGNPHSAIVDGLSTLMLGERMVKVLAWYDNEWGYSNRIVDLVEYI

SEQ ID NO: 9625 - protein, 300 aa, Desulfitobacterium hafniense
MRRTKIVCTIGPSSESNEKIRQLLKAGMNVARLNFSHGTHGEHGKRIRTLREEAQKLGVHLGVLLDTKGPEIRTGTVPEEGVQLNSGDTFILDTDLSTLGSAERVGITYLQLWQEVHQGTHILLDDGLIDLEVIASEEGKIITKIQNGGVLKSKKGVNVPGVPIQLPAITEKDRDDIIFGLREGIDFIAASFARKAADILAVRRLVEEEGANVKIIAKIENREGIEHLDEILEVADGLMVARGDLGVEVPVEEVPIHQKDMIEKCHHLGKTVIAATQMLDTMIRKPRTTRAAASDVAHAI

SEQ ID NO: 9626 - protein, 220 aa, Desulfitobacterium hafniense
GKKHVLKEIDLEIPYGHIYGLLGPSGCGKTTIVKIIAGILEATSGEAYVLGERMPRLSLMNKVGYMAQSDALYGTLTAAENLQFFGAIYGMGKGEIKKRTAEVMELVNLTEHLHKPVQAFSGGMKRRLSLAMAVMHNPPVLVLDEPTVGIDPLLRRTIWAELNTLARQGITILVTTHVMDEADKCHSLAMMRDGRLIAKGTSRELQDTIGVNDIEEASIY

SEQ ID NO: 9627 - protein, 255 aa, Desulfitobacterium hafniense
KNMFNLQGRVAVITGASSGLGTQMAHGLAEQGADVVLLARREERLRKVAEDIESQYGVQAYPFPCDVTQLASVQPAVQAARERFGKVDILINNAGIGSVAPAETMDDEVWEHNLSVDLTGVFRIAREFGKVMLEAGYGRIINISSMYGMVGNSATPASAYHAAKGGVVNLTRALAAEWADRGVTVNCLCPGYFETELTVDLLKTEEFKAYMERTVPLKRYGNSGELNSAACFLAADESSYVTGAILPIDGGYTCV

SEQ ID NO: 9628 - protein, 398 aa, Desulfitobacterium hafniense
  unsure (1)..(398): unsure at all Xaa locations
ERYYLPVYRPRRIVLDHGKGSRVWDLDGREYVDFGAGIAVNALGHAHPALIAALTEQAGKLWHTSNVFVSEPPLRLAEQLVSASGFAERVFLCNSGAEANEAAIKLARKWATGEGREPERRVILSFRGSFHGRTLAAVTATAQPKYHEGFEPLPPGFRYSDFNDLAAAEAAMADGAVCAVLVEPVQGEGGVTPASEAFLQGLRALCDRHGALLILDEIQCGMGRTGELFACHAYGVKPDVVTLAKALGSGFPIGAMLVGPKPAQSMQFGAHGTTFGGNPLAAAVAGAALRELRSPELLANVARQAQAIRAGVAALDAELELFSEVRGRGLMIGAQLRGEHAGKAGEILDRCVEHGLLLLQAGPDVLRFVPALNIGDADIADGLQRLRAALLQFLGRXT

SEQ ID NO: 9629 - protein, 174 aa, Desulfitobacterium hafniense
  unsure (1)..(174): unsure at all Xaa locations
KQLGFMYDQTKCINCKLCAXACKDTNKWEPGAEWRKVYVAEPASNKVYLSMSCNHCADPACMAVCPVKAYTKRDKDGIVAHNTKKCVGCAYCLYACPYHAPQFVKSGTGAVTKCSFCAEIQDQGGKPACVSACPTGALTYGDITELRKTPGAVAPEVNGLPPASITNPSLVIIP

SEQ ID NO: 9630 - protein, 315 aa, Desulfitobacterium hafniense
NLIYSDLQRVEKELHAYINTDFPILDQSAVQLLEAGGKRLRPAFTLLAGKFYGYPIDRLLPVAMALELIHMATLVHDDVVDASMTRRGRPTVKAKWGNVVSIATGDYLLAKALELLAQINHPEVSKILAEVSVEMSQGEIQQIKASNDVNQNLKQYYYRIKRKTAMLISASCKLGALISAAPRREVWALGAYGHALGMAFQIVDDVLDVTAEASELGKPVGGDIRQGIMTLPLILALHQSGERERLHELLVKPEKDEDDVREAIKMIKDSGAIADSMHYVDLYISKANSYLQELPNVPTRKALVDLAYFVKERKF

SEQ ID NO: 9631 - protein, 420 aa, Desulfitobacterium hafniense
  unsure (1)..(420): unsure at all Xaa locations
QYQVGILGGGPGGYVCALRAAQLGLSVVLVEKERLGGTCLNKGCIPTKTLVKSAELWREIKHAEEFGIQLGGALLHYPQIAARKKEVVNTLVSGIEQLMKAKKITVLKGWGEVKEANRIEVTTETGKVELHVENLVLATGSIPTKIPVPGVDLPGVVTSEELLEQETLPDSLVVIGGGVIGLEFASIYHEFGVKVSVVEMLPSLLPNIDEEIPKRLAPLLKRSGLEILTKAFVREIKPKEEGLVVIVEDGKGLKELPAQQVLLATGRRPSLSGIHGDALGLELDRGAIKVNSQMQTSVPKVYALGXMXXVXXXXXXGXXXLAXNVASMQGMVAAEHMAGQQVSMEGRAIPSAIFTYPEIAAVGETEQALKASGQNYKVSKFPFSANGKALALGEIMGLVKLLADEEGVVIGASIMGPQAS

SEQ ID NO: 9632 - protein, 333 aa, Desulfitobacterium hafniense
LTIRIGINGFGRIGRNVFRAAFGRENIEIVAVNNRSTGEILPHLLKYDSVHGIFPAQIQHTEDGFTVDGQLVKVVSHTDPGDIPWGELGVDIVIESSGKFNNGPACQKHLNNGARKVIISAPAKEEDITLVMGVNEEIYDPQKHHIISNASCTTNCLAPVAKVIHKNFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQ

SEQ ID NO: 9633 - protein, 248 aa, Desulfitobacterium hafniense
MRLMNKVAIVTGAASGMGKSIALLYAKEGAKVVVSDLNLEGAHKVAEEITSAGGTALAIKTNVAVEEDIQALVDTAVSTYGTVDIFVNNAGIMDNFEPAADIEDKNWERIFAVNTTSVMRATRKVLPIFLEKSSGVIVNVASAGGLNGARAGATYTASKHAVIGFTKNTGFMYAQQGIRCNAIAPGAVETNIGSTITDPHKFGSARAYAGMATNPRMGKPEEIAQVALFLAAEESSFVNGAVIVADGG

SEQ ID NO: 9634 - protein, 527 aa, Desulfitobacterium hafniense
QVQGYLLAILGVIGVRGIFQYCSEVTAREAAIRVKERVRVRFLHKILALGPVYARGERGGELLNTAVEGIEALDDYFARYVPQLILAVLVPMLTLAFVLPKDFQSALVLIITGPLIPFFMILIGKLAEKKSLRQWQSLSRMSAHFLDMLQGLTTLKLFGRSKDQATVISRVSEAFRKSTMSVMKVAFLSAFVLEFMGMISTAIIAVTLGLRLINGTVPYAEALFILILAPEFYLPLRTLGLSFHARLSGSNAAQRIFEVLELENQLESELNGVELGGGAEEPGHLFRGEQGAPWLTFKQVDLCYEQEGERVLKDINFTLRLGERVALIGPSGAGKSSLLQILLRFVEPTQGKVLINDTVLNRIPAAAWREMISYVPQKPYLFAGSIMENIRFGNPGAAWADVVRAAQLAMAHEFISELPQGYDTLVGEGGARLSGGQAQRIAISRAFLKDAPLLLLDEVTSGLDNENEKDLLIALEGLCQDRTVIFTTHRMRTTIEADRILVLDKGRIIEEGSPQTLLNNQGLYTHF

SEQ ID NO: 9635 - protein, 287 aa, Desulfitobacterium hafniense
NRPYLPGVVLPPTVRPTGDAGALEEAEMLVLSVPSHSVRETAQKIRAYLQPGTIVVNTAKGLEEGSHKRLSQVLTEELPHHPIVVLSGPSHAEEVGKDMPTTVVVASQNSQAAEAVQDMLMTPKFRVYTNPDTIGVELGGAFKNIIALCAGFADGLGFGDNTKAALMTRGIAEITRLGAAMGGNPLTFAGLAGVGDLIVTCTSRHSRNHRAGVALGEGKPLEQVLKEVGMVVEGVRTTRVAYELSRQYEISMPITEQAYQVLFQGADPRAAVSALMMRGKKHEIEEV

SEQ ID NO: 9636 - protein, 533 aa, Desulfitobacterium hafniense
VWYNCYEEGVPKRIEIENISLYEMFERSAKNFGQRPAIVFGGKTWTYTDMERDVDRLAKALSRLGVKPKDRISINMPNSATWMISFFAIMKVGAIVVQTNPLYVEGELKALMNDSGAIGMITVAPLYPRVQGIRQETSLKWVLVEGLKAMGLDEGEGTCDFHGCLNDDSEVEWSKPVIDPQTDIAVLQYTGGTTGTSKGAMLSHGNLYANAYQIWEWIKGSPGQEKSLCVIPLFHIYALSVCMNTSILGGSAVIPVPKFDADLILKLINDEKPTLYPGTPTMYVALINHPKLKEHDVSSIRACVSGSAPLPVEVALRFGELTGGKLVEGYGLSEASPVTHINPFPSARVGSIGTPVSNTQAKIVDIELGDKELPVGEVGELAVKGPQVMLGYWQRENETRAVLRDGWLYTGDLARMDEDGYFYVVDRKKDMIITGGYNVYPREIEEALYAHPAVREAICAGVPDSYWGEKVKAYVVLREEQQVTEEELLSFLKKELASYKVPKQIEIRDNLPKTAVGKVLRRFLVEEEKQKLE

SEQ ID NO: 9637 - protein, 380 aa, Desulfitobacterium hafniense
QVFNPQPQKALDLLAKGLSKEQILSETGLTVGVNNVSFTVNEGEIFVIMGLSGSGKSTILRCLNRLIEPSAGAILIDGVDITQLKPQELRQTRQKKLGMVFQQFALLPHRTVLQNTVFGLEIQGADRAAREQKARDCLAMVGLAGWENSYPDELSGGMKQRVGLARALANDPDILLMDEAFSALDPLIREEMQDELLNLQQKMNKTIVFITHDLNEALKIGDQIAFVRDGSLVQVGTAEEIVGSPADDYVAKFARGVDLSRILTLKDIMKRPQPVVQLKDGPNVALKVMKEHGLSSVFVVDRSKRLHGLINADLAIEARQKGVHSLQEVELIEVLALQGNVLVQDILPVIANTKVPLAVVDEEEHLIGIIVRGVVLAALA

SEQ ID NO: 9638 - protein, 476 aa, Desulfitobacterium hafniense
LKVRFAPSPTGPLHIGGARSALFNYLLARKEDGVFIVRSEDTDLERSSRESEHNIMEALRWLNIQWDEGIEVGGDNGPYRQTERLALYQEYTDRLLASGDAYYCYCSEEELEQERQDLMAKGETPRYLGKCRHLSAAERQTYEAAGRKPVVRFRVPEGRQILINDRVRGEVVFDSDGIGDYVIVKSDGIPTYNFAVVIDDTTMNITHVIRGEEHLSNTPRQVLIYQALGLPTPEFAHISLILNTEGKKMSKRDGDTAVIDYQAKGYLPEAVVNFIALMGWSPPGEEEFFTLEEMTQAFSLERVSKSPAVFDLNKLNYMNAHYIKQADPERLTDLAVPYLREMGAIPQGTLSEEERAWVTHYVQAIINHLSYMAQVKDFVHYVQGGEAPTPEGEALEILQGEQVPAVLDLFVEKLKSLEAIRVDTVKPLFKQITKETKLGGKQVFMPIRIALTGQMHGPELYDIVPLLGLENVLSRL

SEQ ID NO: 9639 - protein, 175 aa, Desulfitobacterium hafniense
  unsure (1)..(175): unsure at all Xaa locations
KKVVLAYSGGLDTSIIIPWLKENYGYEVIAMAADLGQGEELEPLHEKAIKSGASKLYIEDLQEEFVTDFIYPTLKAGAVYEGKYLLGTSFARPLIAQRLVEIAAKEGAVAIAHGATGKGNDQVRFELAVKALNPDLEIISLWGIWDIKVREDAMTMLXEGILSCMKDALSMDRSL

SEQ ID NO: 9640 - protein, 303 aa, Desulfitobacterium hafniense
GRDFICLQDFTPDEILYMLKVAKELKEEKKGGTPHPILQGKSLAMIFTKSSTRTRVAFEAGMLQLGGHALFLSNRDIQIGRGEPIKDTARVLSRMVDGIMIRTHSHQDVIELAKYADIPVINGLSDFLHPTQVLADLLTIQEHKHCLEGLKLTYIGDGNNMAHSLMFAGKMGMHVVIATPAGYKPDAQVVAQAQAQAKQYGGLVEWVEDPLAAAEGADVLYTDVWASMGQEEEAAIRMKAFQSYRIDRETMERAQANAIVMHCLPAHRGEEITEEVLEGPQSVVFDEAENRLHAHKAIMALLI

SEQ ID NO: 9641 - protein, 358 aa, Desulfitobacterium hafniense
ADEQEIKKAYRKLARQYHPDVNPGDKDAEEKFKEATEAYDVLSDTEKRARYDQMGHSAFDPNQQGFGGFGGDFGGFGDIFDMFFGGGGGGGQRRQGPTRGNDLRYDLTITFEEAAFGTEKEIQVPRQETCTECHGSGSAPGTHPTTCSQCHGTGQVKATQRTPFGAIQTARTCPACNGSGQFISSPCKECSGKGTTRKVKTIKVTVPPGSEDGLNLRFSGNGEAGLRGGPSGDLYVVLNVKAHKFFEREGNDVYCEIPITFVQAALGSELDVPTLDGKVKMKIPEGTQTATVFRLRGHGIPYRRGNGRGDQHVRVVVATPTKLTDRQKELLREFGEVTSDQQQMGKKSFFEKVKENIR

SEQ ID NO: 9642 - protein, 715 aa, Desulfitobacterium hafniense
  unsure (1)..(715): unsure at all Xaa locations
NKDWWPNRLYLNIRHQNSALGNPMDPDFNYAEEFQKLDLAAVKKDLSALMTDSQDWWPADYGHYGPLFIRMAWHSAGTYRLNDGRGGAGDGTQRFAPLNSWPDNVNLDKARRLLWPIKQKYGKKISWADLMVLAGNCALESMGFKTFGFAGGREDVWEPQEDIYWGSEGEWLGDQRYSGDRDLENPLAAVQMGLIYVNPEGPNGQPSVLASGRDVRDTFKRMAMNDEETVALVAGGHTFGKCHGAGPASHVGPEPEAAPLEEQGLGWKSTFRSGKGGDTIGSGIEGAWKPNPTTWDMGYLETLFKYDWDLVKSPAGAWQWVPTDPAAADTVQDAHDPAKRHAPMMTTADLSLRMDPIFGPIAKRFRDNPEEFADAFARAWFKLTHRDMGPRSRYLGPEVPEEELIWQDPVPPVDHELIDEQDIADLKAKLLASGLSVSQLVSTAWASASTFRGSDKRGGANGARIRLAPQKDWEINQPAQLAEVLAALEGIQTEFNSSQSGTKKVSLADLIVLGGAAAIEQAARNAGQTLVVPFTPGRTDATQEQTEIYSFAVMEPKADGFRNYLKGKSSAPAEEMLVDRAQLLTLTAPEMTVLLGGLRVLNANYGQSKHGVFTQRPETLTNDFFVNLLDMGTEWKAVSEEKALYEGRDRATGELKWTGTRVDLVFGSNSQLRALAEVYACSDSQDKFLQDFVSAWNKVMNADRFDLAXDNSRLD

SEQ ID NO: 9643 - protein, 787 aa, Desulfitobacterium hafniense
KVSRRSFLKWSAAVAGSSTLVGCMPLTSGAGAEPAVAQAGNRHLDAEIKPSICWHNCGGRCQIKAQVKDGVVLSFVTDNEGPDTPDNLQARACLKGRSQRQRLYHPDRLKYPMKRVGERGAGQWEKISWEEALDTTASELKRIINQYGNESVYFIYASGVGGAFNQSYVGGASARLLNALGGYLSFYGNYSQANYMYAIPYMFGAGYGGSSPTSFSDAQLIVMFGDNPASTRVGGLNSTYYLKLAKENGTKVIVIDPRHSDTVGTFADQWIPIRPTTDAALVAGLAYVILTEELHDQAFLDKYCIGFDEEHMPEGVPAGNSYKSYLLGVSDGQPKTPQWASEITGVPVETIIQLAREIAGAKPCFILQGRGMQRHANGEFQALSVPLLALMTGNMGKLGANPGMYEGFTSVKMGAYPAGTNPIQTKVSFFMFTDAIEKGGNHTKENGGLQGADRLQHGIKFIWNYGGNALINQHSDTGRTTELLKDTSKCEFILGIENFMTPSMEYADIILPDITQFEQEDIVTRALGQGLALYGQKLVDPLYECKGVYEICTELAKRLGVLDKFDEGKSQEQYLRECVAVAQAAHPDFPSFEAFREKGIYKTKPKKVIAYQAFVEDPEKNPLQTPSGKVEIFSKTLYDMNNPERIPAVPKYVAVAEGPKGALKEKYPLQCIGHHSKRRVHSTFDNLPWMEEAEPQKLWLNPQDAAARGIEDDDTVKIFNDRGTVKVKVKVTPRLIPGVCSLPQGAWYTPDAQGVDTRGCINTLTTWEPTALAWGNPQHTNLVQVEK

SEQ ID NO: 9644 - protein, 216 aa, Desulfitobacterium hafniense
LTIQGLTKRYKDKTAVNNINLTLTPGVWGLLGANGAGKTTLMRMVAGILTPTSGKVQYDGIAIKTLGEAYRDVFGYLPQTFGFYPEFTVADYLHYMAALKGLPQKKTNQKIDELLHRLTLADVRNKHIRKLSGGMQRRVGIAQALLNDPDILILDEPTSGLDPGERIRFRNILSEFAQQRIVLISTHIVSDVEYIANRNAIMKDGHIIAAGTTDEL

SEQ ID NO: 9645 - protein, 333 aa, Desulfitobacterium hafniense
YVDIPSTVRQTIREIGYTRAKYGFDADTCAVLTSIGEQSADIALGVDRALEAKNGEMSEEEIEAIGAGDQGMMFGYATNETESYMPLAIDLAHRLARRLSEVRKSDILDYLRPDGKTQVTVEYEDNRPVRIDTIVISTQHHPEATQERIRRDLLEHVVFPVVPSELLDESTRYFINPTGRFVIGGPQGDAGLTGRKIIVDTYGGMARHGGGAFSGKDPTKVDRSAAYAARYVAKNVVAAGLAERCEIQLAYAIGVAQPVSVLVETFGTAKIDEEKIGELVKNNFDLRPAGIIKTLNLRRPIYRQTAAYGHFGRTDLDLPWEKTDKAAALREQA

SEQ ID NO: 9646 - protein, 395 aa, Desulfitobacterium hafniense
LQKIMEDYGTPFHIYDEEAIRKNAQRLQAAFAWAPGFKEYFAVKALPNPYILKILGEEGFGADCSSLAELILAEKAGITEENIMLTSNNTPAEEFQKAKDLWAIINLDDITHIDYLEKHTGLPEVLSFRYNPGSLRAGNAIIGNPEESKYGLTKEQLFQAYEIVRDKGVKRFGLHTMIISNELNPDFFIETAEMMFDLAIELKEKLGIRLEFVNFGGGIGIPYRPEQEPVNLETIGEGVRKVYEEKIVAKGLDPLRICLECGRMITGPYGYLVTKVLHRKDTYKNYIGVDASMSDLMRPGIYGAYHHITVMGKEDLPEDHIYDVTGSLCENNDKFAVDRELPRIEIGDTLVIHDTGAHGHAMGFNYNGKLRHAELLLQADGSVKLIRRAETLEDY

SEQ ID NO: 9647 - protein, 310 aa, Desulfitobacterium hafniense
KELKIFCGNANRALAEEIVDYLGVPLGEAKVKRFKDGEITIAIDESVRGADVFVVQPTCNPTNDNIMELLIMIDALKRASARRITPVIPYYGYARQERKSKARDPITAKLMANLITTAGADRVVTMDLHAPAIQGFFDIPVDHLPGVPILAEYFKSKELENVVVVSPDHGGVQRARNLAERIGAPLAIIDKRRPEPNVSEIMNVIGDIQGKQVIMIDDIIDTAGTITQGAQALKDRGAQDVYACCTHPVLSGPAFERLENSVIKEVVITNTIPVHPEKMISKIKVLSVAPLLGAAIVRIHEDLSVSKLFS

SEQ ID NO: 9648 - protein, 698 aa, Desulfitobacterium hafniense
QYRIEGEFCPNCSAKMEQALSATAGIGETTINYAMKTVLLPPGMMSKAQEIIERIEPGVKLMPVEKKAVKNSIHDAEEEAKETKQKLLKIFIAGIFLVIGLIFGSRWHNTSLEVLEYLVFLLAYGLVGYEVLAKAFRNIMRGSVFDENFLMSIATLGAIAIHELPEAVGVMLFYAVGEYFEDRAVNRSRRSIQAVLNIRPDYANLVNGLETKRVDPDDVHIGQLILIRPGEKVPLDGEIVHGSSYVDTSALTGESVPRSVKVGDSVLAGIINTSGVLTVRVTREFADSSVQKILDLVENASARKAKTEKFITTFARYYTPAVVIIALGIALIPPLFMGGDFREWLYRAMTILVISCPCALVISVPLGYFGGIGGASRHGILVKGANYLEALTSVKTVIFDKTGTLTQGVFEVNKIETSGHYTEAQLLEIAAAAEVHSSHPIAKSIRDKWGKEIDSVSLTHYEEISGKGIRSEFKGKVVLVGKKDLLLENSIAVPELEMSEVGTQVYIGVDGEYAGVLMISDRSKEGAKEVVAQLNQRGITTVMLTGDQRSVAEAVAEQLGIREYHGDLLPEDKVTWLEHYQQKLKGKGKVVFVGDGINDAPVLSRADIGVAMGGLGSDAAIEAADVVLMEDRPGKLVSAMDIAQFTKKVIWQNIGFALVIKLGFIGLGMFGVANMWEAVFADVGVALLAILNATRVRR

SEQ ID NO: 9649 - protein, 370 aa, Desulfitobacterium hafniense
EYQGKEWLAKAGMPVPKGRPASTPEEAREAAEWIGGPVAVKGQVQAGGRGKAGIVKLVNTPDEAAAAAAEILSKTVKGLPVRKVLVEEKLDIKKEFYCSFVVNGAKEARSPMLMFSVEGGMDIESVPEDKLLKINVDPINGLQTYDAVDLAAKAGIAPEELTKFAKFLTKLSQTYKKYDCMTLEINPFVMTGNGNLICADCKMEIDNSSVGRHPEFGFDIARDLPGEPTELDYIGWSIEETDARGTGFLMNMGYDEVSPGYVGYHPIGGGSAMMGLDALNQVGLKPANYADTSGNPVASKIYRVAKSVLSQPNIDGYLLGGFMMANQEQWHHAHAIVKVLREILPTQKPGLPCVLLLCGNREDESLEILK

SEQ ID NO: 9650 - protein, 296 aa, Desulfitobacterium hafniense
MGILINKETKVVVQGITGREGSVRTKYMKDYGTNLIGGTSPGKMGQEVHGVPVFNTVKEIVREQGDIDFSVIFVPGSALKTAVMEAADAGVKNIIPCVEGTPIHDIMEMIAYAKGKGSRLIGPGSIGILTPGEAVVGWLGGNVEWANKFFQKGHIGVFSRQGGQSGTIPWVLREGGFGVSTVIHTGTEPVLGTSMADLLPFFEEDPDTHGVAVYADLGGTQDDACADVIAAGHFTQPLVISVAGAWAPAGQRFSHASNIVERGRGSAKSQMEAITKAGGLVADRPTDLPLILKEQL

SEQ ID NO: 9651 - protein, 690 aa, Desulfitobacterium hafniense
MAKTLVIVESPAKAKSISKFLSNNYTVKASMGHLRDLPKSQMGVDVDNDFEPKYIAIRGRGDLIKELRAAAKTANKILLASDPDREGEAIAWHLGHLLGLDLAEKCRIEFHEITKPAITAAIKHPRQIDSSKVDAQQARRVLDRLVGYQLSPFLWRKVKKGLSAGRVQSVAVRLICDREEEIREFIPEEYWTLTASLKSEGGVFSAKLARKGEHRIAIASEEEMQKVLQELADQTYRVKDVRTKEKKKQPSPPFTTSSLQQEAHRKLNMSPKRTMMLAQQLYEGIELGKAGGIGLITYMRTDSVRISETAQEEAKEFIAEHYGADYYPPEPRQFKSKGRAQEAHEAIRPTSILRTPDSVKEFLSRDQLRLYRLVWERFLASQMSAAVLDTLTVEVEAGEYLFRANASTVRFPGYLAVYEDGQDENDDQEEGTLAANIQPDESLNVLQLQEKQHFTEPPPKYTEASLVRKMEEEGIGRPSTYAPTIETIQSRGYVAKEGKQLSPTELGEIVVSILKEYFPEIVDLEFTANMEKRLDDIEEGALPWKAVIRDFYGPFAESIEEADQVMGKVQIEDKVSEEICENCGRNMVIKMGRYGKFLACPGFPECRNTKPLLEEVGRPCPDCGNPLVIRRSKKGRKFYGCSTYPECEFVSWELPAPEPCPKCGGLMVVKTSKQGQKYVCTNSECRFDKQ

SEQ ID NO: 9652 - protein, 318 aa, Desulfitobacterium hafniense
VRKIAVLTSGGDAPGMNAAIRAVVRKGIYHGLEVFGIRKGYEGLIHGEFITMHLGAVADIIHRGGTMLMTARSQEMLTPEGQKNAAAQLRYRGIDALIVIGGDGSFRGAQTLSAQGIAIVGIPGTIDNDITGTDLTIGFDTAVNNVVQAVSKIRDTATSHDRTFLVEVMGRDCGNIALQSGVACGAESILVPEIEPDLDDIVAKLERGHQRGKHHSIIMVAEGAMSAWNLGEELRQRTGFETRVTILGHIQRGGNPSALDVVLASQMGGKAVEILCAGETDRMTACVNQEIQSLPLEVAYGERKPFNKVLYDLANQLA

SEQ ID NO: 9653 - protein, 327 aa, Desulfitobacterium hafniense
VSVGIVGTGSYVPDKVLTNFDLEQMVDTNDQWIVSRTGIKERHIAAPETPVSELCYQAALRALEDAKLAPEELDLVIVATITPDFVFPATACLVAERLGAKKAAGFDLQAACTGFLYGVATAAQFIATGIYKNALVIGGETLSKILNWEDRGTCILFGDGAGAAVLQPVEEGYGFLGYDLGMDGAGGSLLTMPGGGSMHPASAETVAKKMHTIQMAGSEVFKFAVRIMGETALKALDKAGLGIGDVDCLIPHQANTRIVDAAVKRLGIDAGKVVVNLDRYGNMSAASIPVALDEAARSGRLNYGDIMVMVGFGGGLTWGAAVVKWSK

SEQ ID NO: 9654 - protein, 602 aa, Desulfitobacterium hafniense
  unsure (1)..(602): unsure at all Xaa locations
QRLXAVLKEVQEREDIILFIDELHTVVGAGAAEGAMDAGNMLKPMLARGELHMVGATTLDEYRKYIEKDAALERRFQPVTVGAPSVEDTISILRGLKERYETHHGVRITDGAIIAAAVLSDRYISDRFLPDKAIDLIDEAAARMRMEITSDPYELDQIKRRILQLEIEREALKKEKDEGSKERLEKIEEDLANLKEERSALEAQLQGEREVLTRINSLKEDIDQNRLKMEQAQQAFDYNKAAELQYGILPKLEKELNALEEQLRNRKNTLLKQEVGEEDIAEVVAKWTQVPVAKLLESEMDKLVHMEARIHQRVIGQEEAVKAVADAVRRSRAGLQDPNRPLGSFLFLGPTGVGKTELAKALAEFLFDDDQGIVRIDMSEYMEKHTVSRLIGAPPGYVGYEEGGQLTEAVRRKPYSVVLFDEVEKAHGDVFNVLLQLLDDGRLTDGQGRVVNFKNTVVILTSNIASPLIQELTASGAAQEVLRSRVTEELRLHFRPEFLNRLDEIIVFHPLGQEHIGSIVQIQINKLRDYLAPRKMTLELSQGALNKIIQQGYDPIYGARPLKRVIQQNLQNPLAMKILQGILHEGDHVLVDLDPQGQLLFK

SEQ ID NO: 9655 - protein, 389 aa, Desulfitobacterium hafniense
REAGDFTVNQYLSPIAANLPPSGIRKFFDLVSTMKNVISLGVGEPDFVTPWTVRESGIFSLEQGQTMYTSNSGLLELRQALSWNMEKKLGLEYNPNDEILITVGASEAVDLAMRALLGPGDALLLTDPAYVSYGPCATLAGAEVHYVPTREEEDFRVRVEDLERVYTPNAKVLVLSYPNNPTGAIMTWEDYQPIAKFVQDHDLIVVADEIYSDLSYGGSHTAFASLPNMRNRTLHISGFSKSYAMTGWRIGYVAGHHDFIQAMTRIHQYTMLCAPITAQLAALEAVRSAEQAMQDMVATYDRRRRLMVHGFRKMGLSCFEPLGAFYTFPSIKATGLTSEEFANELLQEEKVAVVPGTAFGPSGEGHIRCSYAYSTEQIQEALTRMERFV

SEQ ID NO: 9656 - protein, 814 aa, Desulfitobacterium hafniense
KYTEKALKALQFASDEAKRMGSNVIGTEHLLLGLVAEGEGIAAKSLHGIGVTPEKIREQIGNLTGIGQPFTGEVSLTPRVKRVMELAHEEARRHGVSYIGTEHLLLGLLMEGEGVAARVLRNLGVSPERIWKQVVQLLGGQPDDIPMPGGAPGPGTAKNNGAANTPALNEFGRDLTQQAREGRLDPVVGREDEIERVVQVLSRRTKNNPVLIGEPGVGKTAIAEGLAQRIINNKVPETLAGKRVVTLDLSAVVAGSKYRGEFEERLKKVMEEIRVDGRIIVFIDELHTLIGAGAAEGAIDAANILKPALARGELQCIGATTLDEYRKYIEKDPALERRFQPITVGEPTVEQAVQILLGLRDRYEAHHRTQITDEAVEAAVKMSDRYISDRFLPDKAIDLMDEAASRVRLAAFTAPPDLKSLEEKIEALKSEKEAAVLGQEFEKAAKFRDEEHQLREELAQLRNTWESKRDISQSQVTADDIAQIVASWTGIPVKKLAQEESERLLGLEETLHQRVVGQEDAVKAVSRAVRRARAGLKDPKRPVGSFIFLGPTGVGKTELARALAEALFGEEDALIRIDMSEYMEKHAVSRLVGAPPGYIGHDEGGQLTEAIRRKPYSVILLDEIEKAHPEVFNILLQVLEDGRLTDTKGRTVDFRNAVIIMTSNVGASFMKKEALGFASRRDEETEYKNMSSRVMEELKKTFRPEFLNRVDEIVVFHSLQTEGLLKITEILMKQVNGRLQEQGYDLQVEKSALELIAKEGNDPTFGARPLRRAIQRLIEDSLSEKILLGEFKSGDKIKVEAVEDKMKFAKVRAR

SEQ ID NO: 9657 - protein, 185 aa, Desulfitobacterium hafniense
QDNKQKKYGMVIDLRKCVGCMSCSVSCKMENGVAFGVFRSWVNMTEKGDFPTVKRYYQPRLCNHCENAPCVEVCPVKASYKREDGMVLLDKKKCIGCGYCVASCPYNARYMSKTQKVADKCTFCDHRVDNGGEPACVKNCMGKARIFGDLNDPSSEVSQLISRNAVQVIKPEKGTKPQVFYISAD

SEQ ID NO: 9658 - protein, 375 aa, Desulfitobacterium hafniense
YYMPTVNLMGAGAAQEAGKQAKILGGKTALLVTDAFLNQSGLAKQIAEIIEAEGVKVVIYPGAEPNPTDKNVHDGVAVFEKENCNMIVSLGGGSAHDCAKGVGLVAGNGGNIRDFEGVDKSAKPMVPMIAVNTTAGTASEMTRFCIITDTDRHIKMAIVDWHATPNVSINDPLLMIGKPAPLTAATGMDALTHAVEAYVSTAATPITDSAALMAIKLISKYLRRAVANGQDFEARDQMAYAQFLAGMAFNNASLGYVHAMAHQLGGFYNLPHGVCNAILLPRVSRFNLIGNLERFVDIAEALGEEIKNLSARDAAEKALTAMTTLSQDISIPSGLTELGVKEEDLQTMAVNAMKDACSLTNPRLAKLEDIIQIYK

SEQ ID NO: 9659 - protein, 269 aa, Desulfitobacterium hafniense
  unsure (1)..(269): unsure at all Xaa locations
KHFAVIGDPIAHSLSPVMHNAGYKALNLAADYQKFQVSPEDLGEAVLGLKALGFSGWNVTVPHKETILPFLDELTEEAVRAGAVNTVKVDKGRLIGHNTDGSGFVRSLQEHMELDERQQIVILGAGGAAKGIAMALAPFQAQLCIMNRTPERGAELVEKYXSGADKRTRRNGEGEPWLVQADCVIQTTSIGLKKEEYPFSLAGIRPGTLVVDIIFNPWETPFLHSAKAMGCKTVNGIDMLLYQGVNAWEFWLEDKAPVESMRKALYQAL

SEQ ID NO: 9660 - protein, 257 aa, Desulfitobacterium hafniense
  unsure (1)..(257): unsure at all Xaa locations
AYAKINLALAITGRRPDGYHELESVMQSIGIYDRIRVTLAEGXIQCSCGEWSGPENLAYRAAEAFLSGLGSSQGIHIDIEKNIPVQAGLGGGSADAAAALQALNKLFKEPYTEEELKSFAAQLGADVAFCLKGGTQWATGVGEELKGLPHAPKINLVLIKPDQGVNTAEAYRAFDQEGKFSHLDYAGWQEALASGRAESLIPLLYNDLEPASMKLLPEIAWVKEELMKQNGCLGALMSGSGSAVFGIVQTEEQAEKI

SEQ ID NO: 9661 - protein, 321 aa, Desulfitobacterium hafniense
IEITDLRKSFSVKAKGRIIKVEAVRGVTLAVKRGEIFGFLGPNGAGKTTTLRMLTTLLPIDEGKGTICGYDLVGQPQEVRRHIGYVSQLGGADWEATGRENLILAGQLYGMKRHDAEQRTGELLAVFELAELADRVVRTYSGGQRRRLEIALGMINRPEVLFLDEPTTGLDPQNRANLWEQIRKLKEGGTTIFLTTHYLDEADALSDRLAIMDCGIIVAEGTPQELKEQISGDVIQIRLADDRTQQAKRLFDKVSFINEIRLEGEDIYLYAKNGAQVLPRIFEMLEAEGVQTQSVSIATPSLDDVFLKQTGRLLRDGKEDI

SEQ ID NO: 9662 - protein, 174 aa, Desulfitobacterium hafniense
MFKRKGFLFNANLCIGCRACEMACRNENHTPANIHWRHVKEIDLGTYLSMACNHCDSPECFRVCPQHAFNKRKDGIVEIDSSLCNGCRLCVKACPYDAPQYNINTNKVTRCQMCYPRQDHGLPPACVEACTTGALTTLDLNDPQLPETVRVIPGFTDIRLTKPSILFYPTRPKR

SEQ ID NO: 9663 - protein, 428 aa, Desulfitobacterium hafniense
RNTCPRHCYGSCSMISHMSGGKLTRVVGDSEHGYTRGRLCAKGYSLIQYALDEYRLKYPLRQVRRGSGEWRRISWDQAYEIIASKMIELNTRYGSNLGLGYYKGNGNAGLLHQAVEGMFAGLGPHTRPIGDICSATGETALRETVNELRNPDPEKMSDAGLIVIWGANPANTNINQMKFIYEARQKGTPLVVIDPLLTHTANRADLYVQINPGTDAWLAWGIAKLLIESDKIDKEFIRQKTREFHRYKQGLEGITLEEVCSHTGVHLRVVEELADLYARFHPAANWLGFGMQRYPTGGESVKAVSALAALTGSFGSVGGGVYFRHRPQEEFPLHIAKHQGVKQPLLTSSREVPANDFPGRAMKLQEPPLKMLWVSCGNPLAQDYNLRAWRDLFQQMEFIVTVDLYLNSTARQSDLVLPAASFFEEEDL

SEQ ID NO: 9664 - protein, 1056 aa, Desulfitobacterium hafniense
  unsure (1)..(1056): unsure at all Xaa locations
ISEVRRRIAQKLTRVPMGYVLDTPSGKFKNSMVEKVDSIEPTLAHVLPEMTSNLLVPLAIVGYLFVLDWRMALISLITLPIGAVCYMGMMKDYEKRFGEYVGVGRHMNATAVEYINGIEVIKAFGQSATSYKKFADAVHKNATYGLDWMRDVQLYFSMGIGIWPAVLIGVLPLGCVFYMNGSLSGADFITIMILALGIMAPLLSAMYYTDDLAKIKVIIGEIGDILDEGEQVRPTVLARLDGTDIALKGVTFGYGETEILHGVDLAIPAGSVTALVGPSGSGKSTIAKLIASFWDVKDGTLSIGGVDVRNIPAPQLMDKIAYVAQDNFLFDQSILENIRLGRPAASDEEVREAAKAAGCHDFIMGXADGYDTVAGGAGGHLSGGERQRITIARAMLKNAPIVILDEATAYTDPENESVIQDAVAKLVAGKTLIVIAHRLSNITDSDQIALIEKGRVAALSTHEQLLESSPLYQELWRAHINAKDAAXGGNKMIGTIRKFFAFAGKRGKLMQKGIALALINSIFQALQILALAVVLQGIVEGTMTAGTAWTSFAIMFLSMLGAILTRQRATMAQAEGSFMMCADKRTEIGDRLKYMPMGYFNDHSLGAITAAVTNTMEDVQDIAPRVMDKIIHGYVHAAIITLMLLFFDWRIGLIILAGILVFMGANGLMQKKSRTISPARVAAQSALVGAVLEYVQGISVVRAFNLAQAAGHTLDQAIDECEKNNVGLEIAFIPYMFLQSLILKLFSILVVIAAIAFYLTGSMNLTTCLLMLISAFIIYSQLETAGSMSALLRAIDISIDRVEEIHHTPVMDELGKAIHPQSYAIEGRNVSFSYDKKKILDDVSFRIPAGTTTAIIGPSGGGKTTLCHLITRFWDVDSGSITLGGRDVRDYSLDSLLANFSMVFQKVYLFNDTILNNIRFGKPDATLEEVREAAKRARCDDFIMMLPEGYDTMVGEGGATLSGGERQRISIARAILKDAPIVILDEATANVDPENESRLQEAIAEMTKNKTIIMIAHRLKTVRNAQQILVLDQGRIVQRGGHEQLMAEGGLYADFI

SEQ ID NO: 9665 - protein, 219 aa, Desulfitobacterium hafniense
IDVHNMTKTYGKLKANDNINLSVSAGELAVLLGPNGAGKSTLIKSVCGLLRYEGSITIGGHENHTVEAKRLLGYVPEFPVLYPMLTVGEHLEFIAKAYRLESWEERAQELLRRFELDDKQLKLGKELSKGMQQKVSVCCALLPEPKTVIFDEPLVGLDPHGIRELKNLIARLRDSGCALIVSTHMIESMEDNWDVTYIMVKGKIERVVRRGDIAGQSLE

SEQ ID NO: 9666 - protein, 231 aa, Desulfitobacterium hafniense
LNLVQANITSGGYLKKDLILKDISFEVKPGELVGLIGPNGAGKSTILKAIMGQLPYLEGKVEFENAHTHYAYIPEQPVLYDNLTLWEHLEFAAAVGKMSQETFVPRVEELLKLFRLHKEKHQLPVTFSKGMQQKVMLILGFLLRPPLYIVDEPFIGLDPHGMRDFLQLVDQVRQDGAGILMSTHSLDTAEKICTSFILIHEGTIISQGNLEDIRRQSRLPEGSLFDCFINL

SEQ ID NO: 9667 - protein, 304 aa, Desulfitobacterium hafniense
MDKIIEVVDLHKSYGHVQAVKGLNFYVEKGKLFAFLGPNGAGKSTTIDIICTFLKPDRGRVVVDGYELGKEDNKIRSVIGAVFQDGLLDPLLTVEENLQIRGGFYGLKKAVLADSIKSIAVLTGVAEFLKRPYGNLSGGQRRRADIARALVNAPKILFLDEPTTGLDPQTRKNVWETIQKMQKEKDMTIFLTTHYMEEAAEADYVIVIDNGEIAAKGTPTELKRDYASDRLKLSYHDKEKLSTALQEMHIPYHQVADQIIIELSSTLEALPILAGCQAYLTGLEVSHGTMDDAFIKITGKEIRE

SEQ ID NO: 9668 - protein, 576 aa, Desulfitobacterium hafniense
ILKRFISYYKPYRLLFYTDMLCAIIVSAIDLSFPMILSYLINRVFIQGREAILNTIMVVGIALLAMYIIKYFCQYFIVSYGHIMGAKMETDMRRDLFTHLQKLSFSYYDKRNTGELMSRLVADLFDISELAHHGPENLFISILKIVGSFVILMTLNVQMTLALSIVTLVIIVFSLYKNKVMQPIFSDNRVKIAKVNSSVQDSLAGIRVVQSFANEGIEKKKFAHSNEAFLESKTGAYKVMGGFHAWNSFFEGLLYIVVVVTGGIHIANGTLRPSDLAVYILYINIFINPIDVLINFTEQFQKGYAGFKRFVEVLETHPDIKDEPGAKPLTQIKGDIEYQSVSFGYDEEESHVLDQVSLKIKAGETIALVGPSGGGKTTLCSLLPRFYEVTSGTITIDGQDIRKVTLASLRNAIGVVQQDVYLFDGSIKQNIAYGKAGATDEEIIEAAKKANIHEFISSLEEGYDTYVGERGVRLSGGQKQRLSIARVFLKNPPILILDEATSALDNESERYIQKSLEELAQNRTTIVIAHRLSTIRNADEIIVITDEGIKERGNHQELLEIEGIYAHYYRMQFEGL

SEQ ID NO: 9669 - protein, 357 aa, Desulfitobacterium hafniense
KLAILTGGGDCPGLNAVIRAAVKTACHRGIAVVGIQDGFRGAVEGDFRPLELKDVSGILPRGGTILGTTNRDNPFAYPTQVGEERQVQDRSAEVLDRFKAEGIDALIAIGGDGSLSIAWEFAKQGLKVVGVPKTIDNDLMCTDLTFGFQTAVATAQDALDRLHTTAESHHRIMILEVMGRYAGWIALYAGVAGGADVILIPEIPYQLESIAEAVQRRARLGKHFSIIVVAEGAKPLGGDMVVERTMSGRTDPIKLGGIGAKLAADLEKVTDMETRVTVLGHLQRGGSPIAVDRVLSTRYGVAAVEAALAGDFGMMVALQGQDIVRVPMAEAVHKLKQVEPDDPVLNAARSMGIEFGD

SEQ ID NO: 9670 - protein, 174 aa, Desulfitobacterium hafniense
GFYFDVNKCIGCRTCQVACKDRNRLDVGILFRRVKSYETGAYPAARVYHYSGACNHCQEAKCVQGCPTGALHFADDGTVQHDRKKCVGCKYCTWNCPYSVPQFIEEAGVIGKCDSCKDLRDAGENPVCVDACLMRCLEFGDLDQLAAKHGAHLVKELPVLPSAQVTNPSLLINP

SEQ ID NO: 9671 - protein, 458 aa, Desulfitobacterium hafniense
MLSQTIVDRLKEIVGEKNVVTKPTELFAYGYDGTLLSGDAIGAVFPETTDQVVELVNYMNEQDIKLVPRGAGTNVSGGTIPSEKSIVINFTRMTKVLEIDTENFVAVVEPGVVNFDLQQELEKVGFYYPPDPSSWKASTLGGNIGECSGGPRCFKYGVTRDSILGLEVVLPNGKVIRTGGRNFKSEPGYDLTRIIVGSEGTLGLVTKAYLRILPKPVTKKTMLAIYNKVEDASQTVADIVAAGIIPTTLEMMDNLLINTTEDYCHAGLPRDAGAILIIEIDGYPEDMDEQIETIREVTKKANARDFKIAQTAAEVDQIWLSRRVAFGSVARVKPCYSIQDITVPRSEFPQAIEGILKIAKEYDMIIGLVAHAGDGNLHPLVLFDQRHADEVERVHGAEGALSKLAVSLGGTMSGEHGIGVVKKKYMDVEFTPGAMEAFRKLKKTFDPANRFNPDKIIS

SEQ ID NO: 9672 - protein, 229 aa, Desulfitobacterium hafniense
  unsure (1)..(229): unsure at all Xaa locations
IKTHQLTKRYGDVPVVNQLNLEVRAGEIFGFLGPNGAGKTTTIKILTGLMEPSEGEALICGYDIRKQPTQAKALMAYVPDQPKLYGKLSAWEFLXLIGDLYQIPKDVSRKRAEMLMEMFGLLDRADELLEGYSHGMRQKVVLASALIHQPKVILLDEPTVGLDPASARLLKDVLQELAHQGAAVFVSTHILEIAERMCHRVGILEKGKLIAQGSPEELRQNVGHGGESL

SEQ ID NO: 9673 - protein, 589 aa, Desulfitobacterium hafniense
KARDFNKTLRTLTGYLTPHKTTISIVVFFALFSTVFTIVGPKLLGKVTTKLAEGLFAWYNQTGLLTDFNYIGKIIGALVVLYVISSICSYVQGYLMSGVAMDVTYRLRKEIAEKMSRVPLNYYDTRSHGEVLSRITNDVDLINQTLNQSLNQIITSAASIVGILIMMLSISWMMTVAALLVIPLSLGIVGVVIKRSQRFFREQQHSLGELNGHIEEMYGGHTIVQAFNGEAESVAFFERVNDQLYHSAWKSQFVTSIMMPVMSFVGNLGYVVVSILGGYLAVKRVVDIGDIQAFIQYMRSFTQPIAQLSSISNTLQSTAAAAERVFEFLAEGEETPETAHPVTLDQFSGHVRFEHVSFGYSKDKQIIHDFSADIKAGQRVAIVGPTGAGKTTIMKLLMRFYEIDSGRILISDHDIYDFSRHDLRSLFGMVLQDTWLYNASIKENIRYGTFAATDEEVMEAAKAAHCDEFIRALPGGYDMVLNEESSNISQGQKQLFTIARAILADPKILILDEATSSVDTRTEILIQKAMENLMRNRTSFVIAHRLSTIRDADMILVLKDGDIVEQGNHEELLAQNGFYADLYQSQFEE

SEQ ID NO: 9674 - protein, 279 aa, Desulfitobacterium hafniense
LDKDSYVIFDGAMGTMLQKYDLAPGQPPEVLNITRPEVIEEVHRKYIKAGSNIITTNTFGAIETKLNGTGYSVEEVVQSAIAIARRAAGKNLVALDVGPTGELIEPLGDLSFEEVYDLYACQIKAAALTGNVDLVLIETFFDLTEAHAAIRAAKDHSSLPVICTFTFQQKGRTLMGKDIKTVVTSLEEYGVDAVGVNCSLGPGEMLSIVETMVSSTQLPILVQPNAGLPKLIGDRTVYDVEPEEFARYIQVMANLGVKWFGGCCGTTPEFISAIKESLG

SEQ ID NO: 9675 - protein, 397 aa, Desulfitobacterium hafniense
  unsure (1)..(397): unsure at all Xaa locations
VHSYIIDEGEMVPVPGRLIYRGYDITDLARGFMEDNRFGFEETAYLLLFGRLPNRQELIDFHNLLDIYQKLPDNFARDMILNVPSKDIMNGMARSVLGFYCYDTNPDDTSIRNVLKQCIRLIAAFPALAVYCYQAYTHYHGNKSLVIHSPQPELSLAENILYMLRPNHKYTELEARLLDLALVLHAEHGGGNNSSFVTHVVTSTGTDTYSAVAAALGSLRGPKHGGANHKVIQMFQDIKEKISDWQDEDELSAYLXQILLXDAFDRSGLIYGIGHAVYSISDPRAVVLKHYASKLAAEKGLDNEFNLYAKVEELAPKVIAKHTKIYKGVSANVDFYSGFVYQMLNLPLKCFTPIFALSRIAGWSAHRIEEIVNGGKIIRPAYKSVVPRQKYVPLNKR

SEQ ID NO: 9676 - protein, 306 aa, Desulfitobacterium hafniense
  unsure (1)..(306): unsure at all Xaa locations
IEVKNLVKQYKNAKTPSVDGVSFTVNKGEFFAFLGPNGAGKITTISILSNTLAKTSGEVNIAGFDVEKEARQVREKIGIIFQKTRLDVQLNAEQNIRFHAVLYGMCNYQTSFKLPCRSPIRKRVXDLTEIVGIEDALFKPVKNLSGGMQRKLEIIRSLMHTPEVLFLDEPTQGLDAVSRRGLWDYIDRVRQEYGTTVFLTTHYIDEAEKVDKVCIINHGKIAACQSPTELKQSLLRQELIVDAADRNALTAELSGLNLSYKLNGQISVPLQGQRAQELIARLQTPLTVLRIHEPSLEDAYIEFLNK

SEQ ID NO: 9677 - protein, 537 aa, Desulfitobacterium hafniense
  unsure (1)..(537): unsure at all Xaa locations
DNENKSSNFLRSIILEDLREGKVEEITTRFPPEPNGYLHIGHAKSICLNFGLADEFKGKTNLRFDDTNPVKEDTEYVESIKEDVKWLGFDWDNLFFASDYFAEMHKRAVLLIEKGKAYVCDLSAEEIRKSRGTLTEAGKESPYRNRSVAENLELFERMRQGEFKDGEKVLRAKIDMGSPNINMRDPVLYRIAHATHHNTGDTWCIYPMYDYAHPLEDAIEGITHSICTLEFEDHRPLYDWVVRECEMEHVPHQYEFARLNMTNTVMSKRKLKQLVDEKVVDGWDDPRMPTISGLRRRGYTPEAIRNFAQAIGVARADSVVDSKMLEHFIREDLKLKVSRPMAVIRPLKVVITNYPEGQVERLDADHNKENPEMGKRKIPFSREIYIEQEDFMEVPPPKYHRLYPGNEVRLMDAYFIKCEEVIKDDEGKIIEIRCTYDPETKSGTGFTGRKVKGTIHWVEATQAVPAEFRLYEPLIQDDYINPNSLEIRQGFVEPYMKEAKXQDKFQFPRHGYFNVDPNYTTPESLVLNLIVSLKSSF

SEQ ID NO: 9678 - protein, 334 aa, Desulfitobacterium hafniense
LPPAEEIIAHLPLSKEVAELRDKRVDEMKKILTNEDQRFLLIVGPCSADHEDPVCEYIERLAKVQEKVKDTLLIVPRIYTNKPRTTGEGYKGMVHQPDPEKAPDMCEGIKAIRRLHIRAISEFGMPAADEMLYPENYSYLADVLGYVAIGARSVENQQHRLTVSGVELPVGMKNPTSGDMTVMFNSLIAAHSNHSFIYNGWEVETTGNPYAHAVLRGAVNANGENIPNYHFEDLIRTAREYERLELVNPAIIVDVNHANSMKCFYEQPRISGEVLYSRRYDSLLKKMIKGLMIESYLEEGRQGIGENIYGKSITDACLGWESTEKLIYSIAENV

SEQ ID NO: 9679 - protein, 276 aa, Desulfitobacterium hafniense
MPVKGFKPYSPGRRQMTVSTFEEITKTTPERSLLAPLKSKAGRNNQGKLTVRHQGGGHKRKYRLIDFKRNKDSVPAKVASIEYDPNRSANIALLHYLDGHKAYILAPNGLQVGQMVVSGPDADIKVGNALPIKNIPVGTLLHNIEMKPGKGAQLVRSAGGSAQLMAKEGKYATLRLPSGEMRMVHIDCRATIGQVGNLEHENINIGKAGRSRWLGIRPTVRGAVMNPNDHPHGGGEGRNPIGRNPVTPWGKPALGAKTRKKKNPSNRFIVKRRGKK

SEQ ID NO: 9680 - protein, 607 aa, Desulfitobacterium hafniense
MCGIVGYIGKRPAIPVLLDGLKKLEYRGYDSAGVAVLEQDAITTCKAVGKLAVLEEKLGTDFSQTCIGIGHTRWATHGRPSDLNAHPHLDTEAKFAVVHNGIIENYIELKEWLVEQGHTFVSETDTEVLPHLVEYFYKGDLVATVREVLNKLKGSFAILVMSRQDPDILVAARKDSPMVVGLGEEEFFVASDIPAILNYTRKTYIIEDGEMVILTKNGVEVTDFEGKEKEKQLYEVKWDAVAAEKAGYDHFMLKEIYEQPRALRDTLISRLEDDKVVLNEVDLTAEQLRSFRKVFIVACGTAWHAGLVGKTLIERWVRLPVEVDIASEFRYRSPLVDEHTLVVVISQSGETADTLAALREAKRNGARIVAITNVVGSSVAREAHDVIYTWAGPEIAVASTKAYTTQLEGVVLLGLYLAQTRGTLATEKIRKIITALRRLPAQAQEILDESEHIKDLAQSFVEVEDAFFIGRGLDWNVAMEGALKLKEISYIHAEAYAAGELKHGTLALITDKTPVIALATQMDVYEKTLSNIIEVRARDARVIGITFKSNKDLDKSVDRVIYLPETIGELAPILTVIPMQLLAYYVSVARGCDVDKPRNLAKSVTVE

SEQ ID NO: 9681 - protein, 443 aa, Desulfitobacterium hafniense
LGKLFGTDGVRGVANKELTPDLAFRLGQAGAYVLSKEHPHPRIVIGKDTRISGDMLEAALIAGICSVGADVLRVGVLPTPGIAYLTRTLKASAGVVISASHNPVQDNGIKFFSSTGYKLPDAVEEEIEDLVHSHEKPWAIPVGSEIGRVIEIQDAQRRYMDFLKGTVGSLAGIKVVYDGSNGAASHVGPQVLRELGVEVIPLSVTPDGININAGCGSTHPEVLQQAVIEHKADLGLANDGDADRLIAVDENGEIVDGDFIMVICALALKAKGQLMEDSVVVTVMSNLGLHIALKEAGIRVYETQVGDRYVMEELLKTGARLGGEQSGHIIFLDHNTTGDGLLTALQLLAVLKEQGKPISKLAAKMQRLPQVLINVRVKDKKKAMENPYVFQKVEEVKRFLGERGRVLVRSSGTESLVRVMVEGQDHEQLMGLAQSVVDIIKRE

SEQ ID NO: 9682 - protein, 428 aa, Desulfitobacterium hafniense
MHNIARELNDQIRAENPHVYELLSDLGRNLYYPKGILTQTDEATEKAYRFNATIGMATEKGQPMFLPVIQETLSQYNPQDIYTYAPPAGKSKIRAVWREKLLKDNPSLQGKTMSQPIVTNALTHGLSIAADLFLNPQDVLVLPDKLWGNYTMIFGTRRNAEMRNFTFFTENGEFNTQGMKEALLAQKAQGKAVLLLNFPNNPTGYTPVEKEAQAIVEALLEVAEQGINVAVLVDDAYFGLFYEDSIKESLFGRLANIHPRILAVKVDGPTKEEYVWGFRIGFITFGDASSVVCDVLENKTKAIIRSTISNASHPAQTFVLHALASPDFEKQKAEKYKIMEGRALKVKEILNRGDYQDLWDYYPFNSGYFMCLKLKGVKAEELRLHLLHNYGVGVIALGESDIRVAFSCVEEEDLEELFKLIYQGTKDL

SEQ ID NO: 9683 - protein, 592 aa, Desulfitobacterium hafniense
  unsure (1)..(592): unsure at all Xaa locations
FPYPAYRKGQRELVVAVYKTIKEKHKLYVQAPTGIGKTLGTIFPALKCLLEGLETPIFYLTAKTITRTVAEGSLLMLQQQGLSLKRVTLTAKDKVCFCPECECTPEDCSYAKGYYDRLGPALEDIFERDHWNREQIENCARNHGVCPFEFSLELTNWADLVICDYNYVFDPRVFLKRFFLEGGDYAFLIDEAHNLVERAREMFSAQLNKEEFLHLKNLVEDQEPVLGKRLQTVNKNFLKLKKQGLEVEKDAPTALYSSLERVVNEAEKFFKKEETPPWKEKLTELYFNIQAFLHTAESYDEHYLTYYQYPEQDVRVKLFCVDPSQQLAQVLNKGRAAVFFSATLSPLEYFIQVLGGEKESYKLQLPSPFPHENLCLMLQKQISTKYNQRSLSLDPIVEGITQLVQGKTGNYLVYFPSYEYLERVRERLLQAHPEFKVLTQTMGMTEADREEFLEAFQEEPRESLVGLALLGGIFGEGIDLTGERLSGAVIIGVGLPQIGTERDIIRAHFQERYGQGFEFAYMYPGMNKVLQACGRVIRTEQDRGAILLIDERFARLSYRRLFPKEWHAIHTLQDNSRIPSLLKAFWESSXNK

SEQ ID NO: 9684 - protein, 422 aa, Desulfitobacterium hafniense
VKIGLLGLGTVGSGVIQILEQNANDIQNRSLSQIKVSKVLVRNLKAPRSIAGDFTLTDQAADVLTDPDISIVVEVMGGIEPAKTYILEAFKQGKNVVTANKDLLALHGQELLDAAKEAGKDLYFEASVAGGIPIIAALKQSLAGNRISEVLGIINGTTNYILTAMTEQGRDYQEVLKEAQELGYAEADPTADVDGLDAARKLAILASIAFNSRVTVNDVYVEGIAKITSEDIAYARELNSTIKLLAVAKAQADGIEVRVHPAFVPDNHPLAAVSGVFNAIYVVGDAVGETMFYGRGAGSLPTGSAVVSDIIQVVRNINADSTANINCTCYNELAIKSEQDFKSAFYIRLRVKDEPRVLATLALLFAEAGVSFASIIQKQKKRQEAEIVLVTHPTQESCLREALDSVRAYSKVLSIHNVIRFE

SEQ ID NO: 9685 - protein, 226 aa, Desulfitobacterium hafniense
EKVAIVTGGSSGMGLAIARRLKEAGIEVIIFDIQKPPEEFPFYHVDIRDDGQIKSALSHISQLDILVNNAGIYFERYLEDTTNEEIDNMVDINIKGTYLMTRNALAKIKERQGSVIIIASCMGLVPELTSPLYCTTKAGLIMLTKCLAQQYADCGVRVNCILPGPINTPLLQKSFPDEATAARCAERVPLKRIGEPEDIANMVAFLVSGEAGYITGGAFPVDGGVS

SEQ ID NO: 9686 - protein, 619 aa, Desulfitobacterium hafniense
GKIQEVNDMACELIGLTRAEIIDLSREVIKVKSPLTLANEFTQKLLSKNYLVFEGMLLTHQGKEIPVEVKAHYHVLNGRRMLLSIARDISNQKRIHKILLASHNKYRQLFDNITDAVFVYELQKDGYPGLLIEINEKARRLMGYHEETFMFSAGPCIRPSSPQLTLDDVWQSLERTHSASFEGICTNLEGEDIPVEVNCHTFPLNGSKVMLTLLRDITERKQIEQERKRTEAEFQQAKEKAEAANRAKSEFLANMSHEIRTPINGIIGMIDLTLLTSLEKTQRENLKIAKNCAYSLFKIINDILDFSKIEAGKLTVEEIEFNLKEVIEQIIKTHSPEAERKGLDLAYTLSANLPDYYKGDPERIKQVLNNLLSNALKFTERGEVSLAVKRLQGDEDVSDLKFTVMDTGIGIAEEDQLHLFEEFNQVDGSITRKYGGTGLGLAISRKLVEMMGGRIWVESEKGKGSSFGVVLRLKHGDKDTLRFKSTQNNDQSREGSTARSYRILLAEDHIVNSIVITEMLKIQGHRVDIAMDGEEALALYHQNPYDVILMDIQLPRLDGIEVTKRIRASEGAQSRTPIIALTAYALQGDREGFLQAGMDEYIPKPVMMEELIMVLDRVV

SEQ ID NO: 9687 - protein, 425 aa, Desulfitobacterium hafniense
YQEAKDYLVSLTKFGMNFGLGRIEELLKRMGNPEERLRVVHIGGTNGKGSTTMMTAEILEDAGYRVGVFTSPHLHDYRERITINGEMIPKGEVTRLIQILRPHLEELVQKGVEHPTEFEVNTAMALMYFADQKVDLVLLEVGLGGAIDSTNVVKPLISVITNVGMDHMDYLGETYEEIAGVKAGIIKAGAITVTAADRPEVLNVIRKKAQEMNSPLWVVGDDVRWEIRWSGELEQEFDLAGLRGAYNKLRLRLVGEHQVVNAATAVTVCELLKFEYGMNLERRNIYEGLRKAVWPGRLELLSLKPKVLIDGAHNVDGAHALAKALNIFQRQRLVLCLGMLGDKEREKVVDILVPLADEVIITKPNSPRSGNWEYLHELVKEKGKPVLTIEEPRLAVEEAFRRLDKEDMLCVTGSLYMIAEARQAL

SEQ ID NO: 9688 - protein, 194 aa, Desulfitobacterium hafniense
IRWNADGLIPVVVQDVDTREVLMLAYMNEEALRRTLQEGRAWYYSRSRQSLWLKGETSGHTQEVVDLRFDCDRDTILLTVRQKGVACHEEFYSCFHYGVQGEGYVTLGAPEEVPAIPLGRTMELLAEVIHSRNMERPEGAYTTYLFDKGLDKILKKVGEECAETIIAAKNSSAEEIRYEVSDLIYHVLVLLEER

SEQ ID NO: 9689 - protein, 259 aa, Desulfitobacterium hafniense
  unsure (1)..(259): unsure at all Xaa locations
MLAKRIIPCLDVHEGRVVKGTNFVNLRDAGDPVELAALYDREGADELVFLDISASAEGRETMVEVVRRTAEQVFIPFTIGGGLRRVEDIRKMLRAGADKVSLNTSAVQTPGLIEEGAHAFGSQCIVVAIDARQTRPGAWEVYIHGGRTPTGKDVLQWAEEVERLGAGEILLTSMNRDGTKNGYDLELTRAVSRAVSLPVIASGGVGTLEHLAEGLTIGEADAVLAASIFHYQEYSIGEAKAYLEERGIPVRKGXMGSPA

SEQ ID NO: 9690 - protein, 194 aa, Desulfitobacterium hafniense
MREAHIERQTKETRIRVKLNLDGAGTAQVDTGIGFFDHMLEALARFGYLDLEVAAEGDLQVDPHHTIEDCGIVFGQAIREALGERRGIERVGDTLLPMDEALVQVALDLSNRPYLVWDVECPEGMVGGFPVEMAEEFFRAVSVQAGITLHMRLFSGKNRHHILEAIFKGFGRALGLALRENPRFQGVLSTKGVL

SEQ ID NO: 9691 - protein, 349 aa, Desulfitobacterium hafniense
  unsure (1)..(349): unsure at all Xaa locations
IRTLKAYESKSIPDCVRLDANENPLPWPPGMIEQLLGSAIAFNRYPDGGAQELKEALSRYTGVPAEGILTGNGSDELIQLLMTTFGGEKGAVVIHPPTFSMYEAAARVTGTEVLEVPLLLTETSRDFRLDVEGILKAAAQPQVHMIVLCNPNNPTGTLFPREEILRIVAESGKIVIVDEAYGEFSGESVVDQIPYCPNLLVMKTFSKLFAMAALRLGYLLGQPSIIGALNRARQPFNVNSFSQKAGVIALNYGEEYAEQGRILIAELARIAEALTAFASVKVFATRANFLLFQPEDPDRVYQELIGKGFLIRTMGNLPLVGKALRLSTGLPEENERLIKALGEILKXLS

SEQ ID NO: 9692 - protein, 424 aa, Desulfitobacterium hafniense
MEIKTLEELDLTMLTRKSYGDDQLLEHKVAEILSEIKKEGDSALYALTEKFDGVDLRPSGLRVRAEELVKAYSQVDEEFLAALRLAKEKITSYHEKQKRTSWLDAQEDGSILGQLLLPLKRVGIYVPGGTAAYPSSVLMNAVPAVVAGVEEIVMVSPPRKDGSLLPEVLVAAAEAGVTEIYKVGGAQAIAALAFGTGEISPVDKITGPGNIYVTLAKKQVFGTVDIDMLAGPSEILILADESAQPEELAADLLSQAEHDPLASSILVSPDRKVLEETVAEVERQLKLLPRQDIARASWETYGAAILVKDLAEGMNLVNQIAPEHFELVIKEPYSWLGRVRNAGAVFLGRFSPEPVGDYFAGPNHVLPTGGTARFYSPLNVDTFMKKVSVISYSEKALQRDGKHIAHLARKEGLEAHARAVEARK

SEQ ID NO: 9693 - protein, 764 aa, Desulfitobacterium hafniense
MGTGLMSLTACSQNASLTGSEAASAGEQIIPTASTQDCGGRCLIKAHVKDGVITRISTRGAYEEDEPGANMKACLRGRSYRKHLYHPDRLKYPMKRVGKRGEGKFEQISWEEAIDTIAKETRRIFDQYGPESRYCNVGTGDTGGVIYRMGLGGRFLSATGGHLPLYNSVSMGNTGTATPYVYGVAATASSLDSLKDTKLVILWGHNTTETIFGASNYYFRQMKNRGCKFICVDPRNSNTAVAFADEWIPLLPTTDNALMDAMAYVIVSENLHDQAFLDQYVQGFDEEHMPEGVPAHESLVSYLFGKKDGVEKTPEWAEAICKVPAETIRRIAREYATTKPAALIQGWGPQRHSCGERTALGATMLASITGNVGVLGGWAGGYIGLSRKGCVGLPDVPNPYPGAIPTLSWVDAIECPEKVTPAEGLLGVDKLNSPIKMLLNLAGDFIANQNPDINRTIRVLEDESLVEFIVVSDLFMTPSARYADILLPGNTFFERYNIGATWNNGDYFILSQKIVDNYYESRSEYDWLAEVADKLGAKDVFTGGKTEEEWVRWIVDETRAKYPETLSWEELEKVGISKFHYDGPRVAFQDQIEDPVNNPFPTPSGKIELFSKTLYDMHNPEIPAIPVYVPAWEGPEDELTEKYPLQLIGWKTKARDNSTFYNNPWLQQAMVQEVWINPMDAKPRNIVTGDRVKVFNDRGTTMLQARVTSRVIPGVIAAPTGSWFTPDGKGGCTNGNLNVLTTLRKTALSHGNTQHTSLVEISKL

SEQ ID NO: 9694 - protein, 682 aa, Desulfitobacterium hafniense
ENQQTNQKSLDLDAARVSHNKGYLTTNQGVGVSNTDDSLKAGKRGPTLMEDFIFREKVTHFDHERIPERVVHARGSGAHGYFQVYENLSHLTKAHFLSDPNLITPVFVRFSTVAGFRGSSDTVRDVRGFAVKFYTQEGNYDIVGNNMPVFFIQDAIKFPDLIHSLKPEPNNEMPQAASAHDTFWDFVVNTPETMHNVMWLMSPRAVPKSFRMMEGFGINTFRLVNAKGEFKFVKFHWKPVLGVHSLVWDEAQKVAGKDPDFNRRDLWETIEHGQAVEFELGIQVLKPEDEFRFDFDILDPTKLWPEELIPVQKIGKMTLNQNPDNFFAETEQVAFCPANVVPGIDFSNDPLLQGRLFSYLDTQLSRLGGPNFHQLPINRPLPKVNNNQRDGMHRMTIDEGQTSYYPNSLNKGEPHAARAGESHFEHYQEKVDGHVIRERSESFRDHYTQPAMFWNSMSDWERQHIIDAFRFELGKCKHKHTHQKLVDMLGNVDPELAQKVAEGLGATPPANGANPTTASSPALSMANTAKSPKTRKVAVLLESGFDKAQFDALTATLIAAGACFDVVSCKLGPVTAGDNGRVEGNQTYATTASVFYDAVYIPGGSHTEALKGSADVKGFLLDTFNHYKTIGLSGEASALLGLLPSGQKPAPGIVCESAGNMEIYANNFLAALTTGRHFERNV

SEQ ID NO: 9695 - protein, 523 aa, Desulfitobacterium hafniense
AERLQSFGEISLSKQVLQALSEMGFEEPSPIQKAAIPVAMDGVDLIGQAQTGTGKTAAFGIPICEKVNPKFQAVQALILTPTRELAVQVSEEISKIGKYRHIKPLPIYGGQSIDRQIRALRFGSQVVVGTPGRILDHLNRGTLKLQYVKMVVLDEADEMLDMGFVEDIETILKQVPKEERQVMLFSATMPPEIKKLAQNYMHQPKSVAVSRDELTVPLIEQVFYEARDKIKVDALCRIIDMEDIGQAIIFCRTKRGVDELVAALEARGYFADALHGDLSQQQRDRVMKKFRDGKVELLVATDVAARGLDIDNVTHVINFDIPQDPESYVHRIGRTGRAGRKGQAITLVSSREYRQLRLIERLIKTRIIRKELPTLADVSERQAENLKNQLVKILQRSHLGTYRSIVGSLLEEYDSMDVAAAALKFAVEGVEERSEEEDDIAFGNTGAAPGMVRLFMNIGRLQQVRPQDIVRWIADESGIPGNIIGMINIYDKFTFVEIPEQHASRVLSCMHQNMIKGRKVNVE

SEQ ID NO: 9696 - protein, 406 aa, Desulfitobacterium hafniense
WVSGYNVLPIGLLVLLGVAFWKFMPRSMVGGSEKGVRISGSTVDFEDIGGQNAAKKELQEALDFLLYSERMRELGIRPLKGILLSGPPGTGKTLLAKAAARYTDSVYLAISGSEFVEMYAGVGAERVRKLFKKARESAKKEKKDRAIIFIDEMDILGAKRGSNVSHHEYDQTLNQLLVEMDGLGNSEQGTQILLIAATNRAEALDPALLRPGRFDRLVKVDLPDKEGRLAILKIHTKNKPLASCVDLEQIAQETYNFSGAHLESVTNEAAVFALRDDAREVNMFHFREAVEKVLLGEKLDRKPTDEELQRVAIHEGGHALLAEFVRPHSVSQISIRSRGNALGYVRHYPKDDLYLYTQAMIEEQIMVALAGAIAEETILGTRSTGAAGDYEQALHMVEKMLASGMS

SEQ ID NO: 9697 - protein, 602 aa, Desulfitobacterium hafniense
EIRQLLDIVINSLYTDREIFLRELISNAADASEKVRYMQLSGQNVKDQELPLEIRITPDENAKTLTIADAGIGMTKEDLIENIGTIAHSGSKAFVQRLAEAGDKKDVNLIGQFGVGFYSAFMVADKVSLTSRSYEPDAQGYRWESDGRGSYSISEAMDLPRGTSITLHLKEDAHSFAQADTVKRIIKQYSSFVPYPVYVGEEKINTVQALWTKNKNEISEEEYKEFYKYIANAYDEPLMRMHFSSDAPINLNALLFVPKSNMEKFGFGRMEAGVNLYCKKVLIQEKAKDIVPEWLRFARGVVDSEELPLNISRETMQDSALIAKLNKVVTSRFLKFLDDQAKNEPEIFKEFWNEFSIFLKEGAANDFTHRQEILKLLRFESSKTGEGELISLGDYVGRMKEGQEAIYFINGPTRQIIEEGPYLEVFKNKDYEVIYTYDGIDDYVFDMIREYDGKRLLSADHGDLNLADEDGASAEEKLLSEEELKEFNDWLKEVLGEKVTEVRESKRLVDSPAIILSHYGTHSMQRMMQLMNRDLQDVPAGILEINPKHVLIQRLNDLRKQEDSFAPLAAEQLFANAQIAAGIIVDPRSMVSRLNEILEKAL

SEQ ID NO: 9698 - protein, 792 aa, Desulfitobacterium hafniense
LQNKTKISRRAFVKWSAAATATAAIAPSLVGCSTQTQASGEPAVVQAGQRLAGAEEKPSICWHNCGGRCQLKAYVKDGVVVRFGTDNVGPDTPEDLQARACLKGRTQRQRLYHPDRLKYPMKRVGERGSGEWARISWEEAFDTTAKELRRIIDQYGNESVYFNYACGAYGLLNQTNSNNSLRRLLNIMGGYLQSYGNYSQANYMYAVPYMFGNPYSGSSPTTFPDAKLIVMFGDNPACTRVGGFNSTYYLKLAKQNGARIIVIDPRHSDTVSTFADQWIPIRPTTDSALVAGMAYVMISEGLHDQAFLDKYCLGFDEEHMPEGIPAGNSYKSYILGESDGKPKTPEWASEITGIPVETIKQLARDIAGTKPGFILQGRGIQRHGNGEFQSLAVPVLSFMTGNVGILGSNPGLYEGGPSVKTGNYPIGTNPIKTKISIFMWTDAIERILTKEQDRIEGADKTKSTIKMIINYGGNTLINQHSDSGRTAALLKDDSKCEFILGMDNFMTPSMRYCDIVLPGVTQFEVNDMITRSMGHGVAYYGQKLVEPMFECKTINEVGRALAERLGVLAQFDDGKSEEDYLREFVGVSQASHPDFPSYEEFREKGIYKTKATKVVAYEKFIKDPEANPLTTPSGKFEIFSKDLYDIQNPQIPAIPKYMPAEEGPEDPLKEKYPLQCIGHHTKRRVHSTFDNMPWLEEAEAQMLWLNPQDAAARGIKDHDLIKVYNDRGTVKVKVKVTPRLIPGVCSLPQGAWYTPDQSGVDVRGCINTLTKWTPNPLSKGNPQHTNLVQIEK

SEQ ID NO: 9699 - protein, 185 aa, Desulfitobacterium hafniense
MAKQYGFYMDQSNCIGCFTCQIACKDKNDLEVGQCWREVHEFQGGDTILEGGVYRSNVFAYWLSMSCNHCQEPKCVQNCPAGAMYKREEDGIVLVDQNKCLGCGYCTWSCPYGAPKLAGKTVSKCNFCIDLLEQGKNPACVDACIMRVIEFGPIDELRAKYGNVDEVKGLPSAQITKPCIVISPH

SEQ ID NO: 9700 - protein, 608 aa, Desulfitobacterium hafniense
IILIAIMLIRFANPPATQPLDMDYTKFYEAVVTGQVEEVVISTDDNVNTYEVKTKDGQQYVVLGEAKDVDLSAQMNEHKVNVRVNPPVTTPWWAGLITTVLPFLLIGGFIFFMMQQSQGGGNRVMQFGKSRAKLVTDEKKKVTFADVAGADEVKEELEEVVEFLKFPKKFNELGAKIPKGVLLFGPPGTGKTLLARAVAGEAGVPFFSISGSDFVEMFVGVGASRVRDLFEQAKKNAPCIVFIDEIDAVGRQRGAGLGGGHDEREQTLNQLLVEMDGFNGNEGIIIIAATNRPDILDPALLRPGRFDRQVVVDVPDVKGREEILKVHVKGKPMHNDVELDVLARRTPGFTGADLANLVNEAALLSARRNEKEIKMNALEDSVERVIAGPEKKARVISDYEKKLVSYHEAGHALVGEMLTHTDPLHKVSIIPRGRAGGYTLLLPKEDRNYMTKSHLLDQVTMLLGGRVAEALVLHEISTGASNDLERATGLVRKMITELGMSEELGPLTFGQKEGQVFLGRDIARDRNYSEAVAYSIDKEARRMIDECYLKAQTIIQENMHKLNAIAQTLMEKETIEAKEFAELMARFDQPVETAQVSEPSETENNTTE

SEQ ID NO: 9701 - protein, 149 aa, Desulfitobacterium hafniense
MEKTFIMLKPDAVQRGLVGQIIARFEAKGCKLVGMKLMSVDQALAEQHYAEHKGKSFFEPTVQYIMSSPVVAMVWEGKNVVALARELMGATNPANANPGSIRGSFGMDISRNVIHGSDSVASAEREIALYFRPEELCDYRKAGEEWLSE

SEQ ID NO: 9702 - protein, 198 aa, Desulfitobacterium hafniense
  unsure (1)..(198): unsure at all Xaa locations
SPIRTXGVEKMGKRYAMVIDLRKCVGCHACQVACKSENNVPLGVFRNWVDELETGKFPNVSRQRLPRLCNHCENPSCVKVCPVKATTQKEDGTVVIDYDLCIGCKYCIAACPYDARFINPERRTAEKCDYCYARVEAGLQPACVNTCIGGARIFGDLNDPTSEVAKFVATNPVKVSKPETNNGPQTYYIGADEKTLRP

SEQ ID NO: 9703 - protein, 168 aa, Desulfitobacterium hafniense
MDMIPSFFTLGNLFFGFLSLLWTMNGGYKMAAGFILLSVLMDSMDGKVARKLSVSSDFGKELDSLCDVVSFGVAPAILTYQLVLATHMGVWGMLLAAAFALCGAVRLARFNVLNISTHFLGVPITFAGGLMALMVLFYRNLPWLVFPVALAVLAVLMVSTFKVPKLGK

SEQ ID NO: 9704 - protein, 275 aa, Desulfitobacterium hafniense
QHQDKQPGLETLMNPSPIFEDLNYRPSGKLQGKVALISGGDSGIGKAVAILYAKEGADIAIVYLDEQVDAQATKERIEQLGRRCLLIPGDIGEENFSNQAVQKTLDTLGGLDILVNNAAEQHPQNSLLDITAQQIEQTFRTNIFGMLYLTKAALPHLRYGSVIINTASITAYKGDAKLIDYSASKGAVVAFTRSLSESLIKQGIRVNGVAPGPIWTPLIPASFDANEVSTFGSTTPMQRAGQPVELAPAYLFLACEGSAYMSGQMLHVNGGTIVN

SEQ ID NO: 9705 - protein, 381 aa, Desulfitobacterium hafniense
MNTYGRLPMAIVKGKGTTVWDIEGKQYLDFVTGLAVSSLGHSHPAVVEAIQKQAEEILHTSNLYWIPNQIALAEKLVEHSFADQVFFCNSGAEANEAAIKIARKYAKEHYSEDKYEILTLVNSFHGRTLATLTATGQTKYQKGYAPLPEGFTYVPINDLAQLEEKMNPKVAAVMLEPIQGEGGVFPLEVEFLAKARKLCDDYGALLIFDEIQVGLGRTGKLFAYEWSNVVPDIMTLAKALGGGVPIGVMLAKEKVASTFKPGDHASTFGGNPLATAVGCAVMDVLTEEGFLEDVQKRAQYFKQELQKLADKYQTGTEIRGQGFILGWPLDRLGAEIVEGAREKGLLINFVGGKALRFLPPLNVSYQEIDEAITILDQIFAE

SEQ ID NO: 9706 - protein, 288 aa, Desulfitobacterium hafniense
LDKARVLIEALPYIQKFAGKTVVIKYGGHAMLEQDLKEKVMLDILLLHSVGIRPVVVHGGGPEINSMLTRVGKESHFVRGLRVTDKETMEIASMVLVGKLNTEIISLLNRFGGRAVGLSGKDAQLLQAVKKPMQFQNSQGELEDVDLGFVGEIEQIRPEIVTSLVEQGYIPVISPVAGGEDGESYNINADTAAGEIAKALKADKFLLLTDVPGVLRDVEDKDSLLSVIKEDEISGLIDLGVISGGMIPKVECARAALQGGVGSVHILDGRIPHAILLELFTDGGIGTM

SEQ ID NO: 9707 - protein, 395 aa, Desulfitobacterium hafniense
PRGFRATGVKAEIKYPDKYDVALVYSEVPAQAAGVFTRNKVKAHPLILTKKHLENGIARAMVANSGNANACVGKPGDEAAWAMAVKTAEVLGIAPEDVLVASTGVIGVELPVESVTRGIEKASLEIAEKISPEEMTQNSHQAALAIMTTDTAVKEAACELSTENGVIRLGAMAKGSGMIHPNMGTMLGFITTDAAIPASELQELLREAVEDSFNMVTVDGDTSTNDMVLVLANGKSGITLNPEEWAEFRRMFWAVCQKLAQDIARDGEGATKFLEVQVLGAAAVEDARKIAKSICGSSLVKIALYGEDANWGRILAAAGYSGAEFNPNQVEIYLGHVLVAKEGQGVHFSEEEAKKVLSRKDVLIKLLLQEGQAQATAWGCDLTHDYVTINGDYRT

SEQ ID NO: 9708 - protein, 351 aa, Desulfitobacterium hafniense
VKVGIIGATGYTGQELVRLLQNHPEIELAYLGSSSNSGAVYGEMFPQFSGLSASLDAESGLGTGKLDDEQVPDLDVLFCALPHGLTAGRTAQWLSRGIKVIDLGADFRLKDGAVYEAWYKVQHPAQELLPEAVYGLPELYRDKIAGKTLVANPGCYPTATLLALAPLLRKGLLQKDGLIIDAKSGVSGAGRGVALGNHFSEVNENFKAYGVASHRHTPEIEQQLSEAAGAELLVNFTPHLVPMIRGILATIYAQVTPGVTEADLKACWQEQYEEEEFVHILPEGIWPQTKFALGSNHSFLQLKIDPRTGRAILVSALDNLVKGASGQAIQNMNLICGLPENMGLKMRGLWP

SEQ ID NO: 9709 - protein, 401 aa, Desulfitobacterium hafniense
MTKIQMNVPLVEMDGDEMTRIIWDYIKEILLYPYIELKTEYYDLGLQKRDETDDQITVDAALATKKYGVAVKCATITPNAQRVEEYNLKQMWKSPNGTIRALLDGTVFRAPVLVEGIKPLVTTWKKPITIARHAYGDIYKNVEYRVGGPGKAELVFSGEHGEESRQTICNFEGKGILMGMHNLDSSIESFARACFNYALDVKQDVWFATKDTVSKQYDHTFKDIFQEVYDKEYKERFAAAQLEYFYTLIDDAVARVIRSEGGYIWACKNYDGDVMSDMVATAFGSLAMMTSVLVSPEGNFEYEAAHGTVTRHYYQHLKGEETSTNPIATIFAWTGALKKRGELDGLPDLADFAAQLEEASLKTIEAGIMTKDLALISELPNIKTVNTKDFLEEIKKTLDTL

SEQ ID NO: 9710 - protein, 261 aa, Desulfitobacterium hafniense
ESMNYSLSAGGKRIRPVLALAAAHAVGGDCEDILPAVCALELIHTYSLIHDDLPAMDNDDYRRGRLANHKVFGEGQAILAGDALLTYAFELLAQPMSGVDSQRQLRAVREVAQAAGPEGMVGGQMLDLEAEEKQLNLAELEQVHRLKTGAILVVAARLGAILAGGTEEKIEALTSYAQAIGLAFQIKDDILDLESDSETLGKPVHSDLRQHKSTYPSLMGLAGAKLELKIKTDEAHAALAVLGERAGFLHELADYIAQRKY

SEQ ID NO: 9711 - protein, 601 aa, Desulfitobacterium hafniense
  unsure (1)..(601): unsure at all Xaa locations
LAKIEQPRDLKGLTYPELEQLAQEIRAEMIDVVSANGGHLAPNLGVVELTLALHRVFDSPKDKIIWDVGHQAMSXTSQAQRIKAXAYKGLSGFPKRCESPHDCFETGHSSTSISAAVGFAKARDLRKEKNQVVAVIGDGAMTGGMAFEALNHAGHTKTNMIVVLNDNEMAIAQNVGAMSSYLNRLRTDPRYDRSKDEIENLLKRIPGIGSKMAKAAEKAKDSLKYLLVPGLLFEEMGFTYLGPVNGHDQIALEQVFEQAKMVKEPVLVHVLTQKGRGYEPSEKNPALFHGVGPFNKVTGEVIKKPAPPTYTQVFGEALCELAEKDPRITAITAAMPSGTGLNLFAQKFPDRFFDVGIAEQHAVTFSAALAFGGMKPVVSIYSTFYQRAYDQVLHDVCLPHANVVMAIDRAGVVGDDGPTHHGVFDISFLRVIPNLVFMAPKDENELRHMLYTSLQLDGPVALRYPRSVGQGVELTEELRELPVGKAEILQEGKDITLIGVGPMVYTCLAAAVELRHRGVEATVINLRYINPLDRESILRYARMTKRIITVEDHMLAGGMGSAVMEVLGDEGLTDVVVERLGYDEYVDQGAISLLHQGYGLS

SEQ ID NO: 9712 - protein, 366 aa, Desulfitobacterium hafniense
MKLFEYQAKELFAESGIPIPQNALIGDISELNSALEKIGLPCVLKAQVLQGGRGKAGLVKFVRTKEEAQKEAERILEATGKKLLVEEAVPYEREMYVSITVDAASGLAMVMACLEGGVDIEQIARTTPEKIIKEKVDMSLGLMAYQADNIMYGLGLEQSAAKEGSKILLKLYQLFVKYNAELVEINPLMILRDGTMAAADGKFNLDDNALYKQNRFSLTRDHYKSDFEYEAALDGIPYIAFEGDIGMMVAGAGLANVVLDLIHYYGGTVANYLEFGGPNYHKAQQCMKMMLKAKPKCILIATFGTIARADVMAQGIVEAVKELKPEIPIVAVIRGTGEEDAQKLLRSAGLPSLSDTEEAVRKAVEI

SEQ ID NO: 9713 - protein, 303 aa, Desulfitobacterium hafniense
  unsure (1)..(303): unsure at all Xaa locations
LSIIIDHTTPVLIQGITGKEGSFWAKHAKNYGTHIVAGVTPGKEGQDVDGIPVYHTVRRAVQEHPIEASLLVVPPKAAKGAVLEALDSGIKVIVVTAEGIPLHEMMQLRKIALEKQAMVIGGNTTGIISTGKAMMGFFPYWLDRVYKPGRVGVMTRSGSLTNEVTAEIVKAGFGPSSIVGVGGDPVPLTRFAEILPLFEKDPDTDAVVMIGEIGGTMEEDVAEAIEQRIFTKPLIGFMGGRTAPKGQKMGHAGAIITAGKGTVEDKVEALAKAGALVADRPSMIGQLLQKVLXLERRAERKET

SEQ ID NO: 9714 - protein, 346 aa, Desulfitobacterium hafniense
GANSLNKLPEVISRKGISKILIVTDQGISSLGLVNSFLQDLDKAGVRYTVYDKTVPNPTLDNIEEALKLYQEQQCEGIVAFGGGSPMDCAKGVGARVANPHKSISQMKGVLKVRRKLPPLFAIPTTAGTGSEATLAAVISDPRNREKYPVNDTALIPHYAVLDPLLTVGLPKHITSTTGLDALTHAVEAYIGRSNTQETTELSRKAVRLIFDNLYIAYSQGENVKARENMLKASYYAGVAFTRAYVGYIHALAHALGGFYGVPHGLANAVILPCVLEYYGEAVHERLAELADVLEMGSPGDSHEQKATLFIEAIKELSKKMNIPRKIDGILAEDIPLLVEHAWKEA

SEQ ID NO: 9715 - protein, 443 aa, Desulfitobacterium hafniense
MPDIKEILVKQKAFFQTGKTKELQFRVDMLNKLRSAIKIHEEEIMAALKADLNKAPFEAYATEVGMVLEELNYTLKHISSWVKPKRVRTPLVHFPSASYLYTEPYGSVLIMSPWNYPFQLALAPLVGAISAGNCAVLKPSEYSANTSAMIERIVKEIFDESFVAVVRGGREANKTLLNEKFDYIFFTGSVGVGKTVMESAARHLTPVTLELGGKSPCIIDDTADLELAAKRIVWGKFLNAGQTCVAPDYLLVHRTVKEKLIQEIKKSITAFYGHDPLGNEDYPKIINQKHFERLLGLLKSGRVVEGGRSDEKTRRIAPTILDDVTWESPVMQEEIFGPLLPVLEFESFDAALAMVNQHPKPLALYLFTRSKDHEAQAISKTSFGGGCINDTIIHLANPNLRFGGVGESGMGQYHGKGSYDTFSHTKSIMKKSNKLDIPLRYPP

SEQ ID NO: 9716 - protein, 347 aa, Desulfitobacterium hafniense
KIIILFGGQSGEHEVSLNSASSVLKAIDQEKYEIETIGIAKNGQWHWGIRPEQWQQDPALEGIPVILAHDPTNPRFIALDGSSLPQDGKFALIFPVLHGPFGEDGTIQGLFEMANIPYAGSGVLGSALGMDKDRMKAVFTEAGLPQAPYITVLRTMLQKPMEQLLDNIEHSLGYPCFVKPANLGSSVGISKARNREELIQALQLAAEYDRKLVVEQNIVGREIELSVLGNEDAQASIPGEILPAKDFYDYEAKYIDTGSQLVIPAPLAPEVVRSLQEKAVAAFKAVEACGLSRVDFFVTEGGQIYINEINTMPGFTQISMYPKLWEASGIPYTELITRLIELGFQRF

SEQ ID NO: 9717 - protein, 171 aa, Desulfitobacterium hafniense
SMFKTIIEVIEIVIIAFALSWVIRTFVLEARLVPTGSMLPTIQLQDRIIVDKFFFKHFGDFERGDIIVFHPPSSAHSSDDFIKRLIALPGDTIEIKDHKTYINGQEVEEPYVMEPQIKNLEPLVVPEGSVFVMGDNRNSSADSREWGFLPIENISGMTLFRYWPLNHIGTI

SEQ ID NO: 9718 - protein, 341 aa, Desulfitobacterium hafniense
YPVFLGARLEELGDYLTTRIGAGEHLLVITHPNVGDYYLDTLQKGLSSFMVNTLIVPQGEDEKSLDRLSDLTSEAIACGADRKTVVLALGGGVIGDLAGFFASVFMRGMRYVQIPTTLLAMVDSSIGGKVAVNHAAGKNLLGDFYPPLAVWTDFSTLETLPWEEMLNGLAETIKHAVIADEELLSFIEKHQEEIMARKPELYKELTSRSSAVKVRLVSEDETEQGKRMFLNYGHSFGHALEAEVAYQGITHGQGVSIGMVAAAHLAQERGLMNSGEVERLIKLLKAFGLPVTVRAKNPRVLTDLMGADKKNYKGQKVLVLPKGIGQGIVIRDANDEEILRA

SEQ ID NO: 9719 - protein, 166 aa, Desulfitobacterium hafniense
AHNDNIVLVGFMGTGKSTVGRRLAKLLGREFIDTDLEIERLTEMTVSEIFRRHGETRFRSEERLLVKRLAEHKGYVIATGGGTVLNPENWRDLAQSGVIIGLYAPLDEIYKRIGYRNDRPLLRGDRQVVEELWAKRQPIYNQANWTIDTTHKGIEQVVEEIFSLYE

SEQ ID NO: 9720 - protein, 282 aa, Desulfitobacterium hafniense
REVLLPDGTKLPKLGQGTWYMGEKSRLWQQEVKALAMGIEYGMTLIDTAEMYGEGAAEELVGEAIKPYPRETLHIVSKVYPHHAGRKTIFKSCEASLRRLGLDYLDLYLLHWRGNIPLEETVECMNELVAQGKIKHWGVSNFDTEDMEELWQTPGGDRCSTNQVLYHLNSRGTEYDLQPWLKAHRLPMMAYCPMAHNLSTRQRIAQNPVVQEIAQNYGLTVEQILLCFVLGQENVMAIPKASQPDHVKDNAQVYDISIHEEDWQRINLAFPAPQHKTYLDIL

SEQ ID NO: 9721 - protein, 787 aa, Desulfitobacterium hafniense
LKITGMTCANCALTIEKGMAKLPGVKAATVNFASEKLSLDYDPALLDEKTILEKVKDLGYGAYMERDEGKAQFKVSGMTCANCALTIEKKLRNTPGIQTVAVNFATESVTAEYDPNLIDLETIYEQVRDAGYTPIENKEESREDNHVKSQRNWVIFSAVLSAPLMPMMFMPMTHGIMYTMFILATIVQFTAGLTFYRGAYHALKNRSTNMDVLVAMGITAAYGYSVMTTFPHIFFEGDTFFDTSALLITFVRFGKYLEAKAKGRAGQALKRLLELQADRARLLINGEEKEVPASSVKIGDIVLVKPGEKIPVDGVIVEGQASIDESMITGESIPVDKGAGENVIGATINRSGSIKVSTTKTGKDSVLSGIIKMVEDAQGVKPPIQRLADKISNVFVPVVVAISILTFIIWYVFLDSAFVFAFTAAIAVLVIACPCALGLATPTAIMVGSGVGLNRGILFKSAAVLEGIAKVEAIGFDKTGTLTKGKPEVTHLMAYEGYAQKDLLRIAAAGENPSIHPLAQAIVQRAKDEGIEVEEVQDYHEESGHGTLCSYQGKKLLIGNKKLMLKENIPTEAVEKDFQELANEGKTTSFVAYDGKVIGIIALADVLKESTQEAIKRLHGLGIKTFMITGDNKKVATVIGNEVGIDEVVAEVLPQDKIEIIKRYQNDGLKVAMVGDGINDAPALAQADIGIAIGSGTDVAKETGDVVLVRNDLLDVERAIRLGRKTLTKIKQNLFWALIYNTLGIPIAAGVLFPITGELLPPEWAGLAMAFSSVSVVTSSLLLSRYS

SEQ ID NO: 9722 - protein, 1181 aa, Desulfitobacterium hafniense
VFLKSITIQGFKSFADKVKLELGQGLSVVVGPNGSGKSNVADAIRWVLGEQSAKNLRGSKMEDVIFSGSSVRRPVGMAEVSLFFDNSTGIFPLEYQEVIITRRVYRDGEGQYFINRSSCRLKDIHELFMDTGAGKEGFSIIGQGRVEEILNLRSEERRTLIEEASGITKYRMRKREALKRLDETEHNLERIQDILAEIEGQLGPLEEQATIAREAVELTTEQKALEIEMVAFDLKEVRHKLTSSVQETEELQSAIAAAVADLSQKESGILSNKVKLNLLDEQIQKQQETTYQLDQAVNQIVQELRLRQEREGYLGEQINRVTTELSNHEEKVRQSTEQLRALEDRKALLHKTLDQANQALAADEQRLVEAKARNGLEEIEILRGSLSHLQSKLAESSAELNRLTHQLATLNSTHEQLIKEKKDKEGALLSHEQQEAQVQEQLKTQEGLQTDIRLQAEKAQQENAQFREQSKAGQRELQELNRDLEKKSARYHALKNLEDSLEGYQRGVRELMLAKKKNQPSCGDLCGTLADLLQVEERYEVAIEVALGAGIQNIVTATERGAKEAVHYLKSHNLGRATFLPLDVIQGGKAAVAKEAAKDPGFIGVAVDLITFAEKYRKAFESQLGRTLIVTDMEAATRVARASGYRARIVTLEGDQVHPGGSLTGGSLQRKGSNILGRSREIQELRQECDERRTQQKELELKAGALSIQIQKGEENLKHLMAEEQELKSALAVLRTQELNLRAQAQRIRDEITAVTIRVAGIEQERDELQSHKALEAEEQSKLTDSIQEAQEALARQEEKNRQASREMEQLQERLTQTKVQAAKWEQELKQAVERLVQDQALLGENKHLLERKRKDLQDLEESKARLAFEQGDWESRRREAGEQQQQAQEVLIALRKEREVLSKELMDQEGLAQKKRQEQQTLEQKLHNLELKTARWDAEWETGSKRLLEEFDLTWEEAQAYQSERNRAELAARVQEIKLRMELLGPVNQAAIEEYPKLQERFDFLSVQKQDLEEANESLQQLIAELDKTMSERFEEGFIAVNEAFKVVFKELFNGGYAELRLVDPANLLDTGVEIIAQPPGKKPQLLSLLSGGERALTAIGLLFALLKVKPSPFCVLDEIEASLDDANVSRFAQYIHRLANSTQFLVISHRKGTMEAADVLYGITMEESGVSKLLSVQLE

SEQ ID NO: 9723 - protein, 521 aa, Desulfitobacterium hafniense
DFNAVFNIGMLLVCFYAASGIFSFAENFIMATVTAKISKSMRTDIAKKINKLPLKYFDKTSYGDVISRVTNDVDAIGQTLNQSLDNLVRAVTMFVGSLIMMFYNSWILALVAIGSTLIGFVLMALIMSKSQKYFTVQQQGLGDINGHIEEIYSGHNVVKAYNGGSKAKKTFEEINTSLYDSGWKSQFMSGMMMPIMGFIGNFGYVAVCVVGAALAMKGTISFGVIVAFMIYIRLFTQPLSQLAQSMQQLQRTAAASERVFEFFAEEELAGESQQLKKLENVKGHVEFQNVHFGYEKDKTIINNFSAQIRAGQKVAIVGPTGAGKTTMVNLLMRFYEIDSGEIRIDGIPISHVSRENVHDQFCMVLQDTWLFEGTIKENIIYNKQGVTDEEVIAACKSVGIHHFIRTLPQGYDTILNDKANLSAGQKQLVTIARAIIQNSPLLILDEATSSVDTRTERLVQDAMNKLTQDRTSFVIAHRLSTIKDADLILVMKDGDIIESGDHEELLGKGGFYAELYNSQFE

SEQ ID NO: 9724 - protein, 581 aa, Desulfitobacterium hafniense
MVRIFKYLKAEEWLMAGISLIFIVAQVWLDLKLPDYMAEITTLTQTPNSAISDIWLNGGYMLLCALGSLAAAVVVGFFAAKIAASFSQRLRSLLFNKVESFSMEEINRFSTSSLITRSTNDITQIQMLVVMGLQLVIKAPITAVWAITKISGKGFEWTMVTGVAVLIMIIMVTFLLIVALPKFKKMQTLTDNITRVTRENLTGLRVVRAYNAENYQEEKFETANEELTSTQMFTNRAMAVMMPVMSMLMSGLSLAIYWIGAYLIDAAGALDKLGLFSNMVVFSSYAMQVIMSFMMLVMIFIMLPRASVSAKRINEVLDTEPRILDGTKTEGQPGLRGEVVFKSVSFQYPDAAEPVLEDISFTASPGETVAFIGSTGSGKSTLVNLALRFFDATQGEILIDGVNVQEYKLEALFNKIGYVPQKAVLFKGTVESNVAYGDNGGEGYPLDEVKKAVQIAQGADFVEKMDGQYQAAIAQGGANVSGGQKQRLAIARAVCRKPEIYIFDDSFSALDYKTDRVLRSVLKQETAGVTSLIVAQRIGTIMDADQIIVLDEGKIVGKGTHKDLLRDCTVYREIAMSQLSE

SEQ ID NO: 9725 - protein, 419 aa, Desulfitobacterium hafniense
MKICVVGAGYVGLVSAAILADWQHNVVCVDHNEQKIEDLLAGKLPIFEPGLQELVELNRRRQYLRFTAEMAEALRGCEMIIVAVGTPPAENGHPNLEDFWAVVKSFRENVGNNVIVMIKSTVPVGTGEAVSLYLNEKVSHTFSVVSAPEFLRQGTAVHDFLHPDRLVVGCMSPEIREQMKELFQPLDCPKVFTDWHSAEMIKYASNSFLALKISYINTIANLCEAVGGNIQDVAAAVGLDHRIGQAYLKPGVGFGGSCLAKDTQGLIAQGEVHGVNVWMFKDVLEVNYEQRVHIVQRLTEVLGNLKGRKIAILGLAFKANTDDLRDAPSVTIIAQIIKLGGLVKVYDPVVDSSSLPNIISVSTADNPYAACQGVDAVIVLTEWEEFLDLDLKRLQKSMNAPVFIDGRYLFERKRLLEAG

SEQ ID NO: 9726 - protein, 427 aa, Desulfitobacterium hafniense
PRTSCALGGALATMSALPRVVPIIHSALGCGGNLSGAAAFGAGYCGSSYASGQSAPTSAVTETEIVFGGSDRLHEEIQSTLDLIDADLFVVATGCMTEMIGDDVQGVVSEFAGGRKPVIAISTPSFKGDAYAGYSITLEGIFNKYLPRSNSKKPKLVNLFGLVPSYDPFFRGDLSEIKRLLEKLGLEANTFFTPDQTFANLTSAPSATLNILFSHVWGVEFVKNFEQTHGTPYWITDLPIGPEATDHFLREVAEKLEIEPQRVEEVIAQENKEYYGYFQRAVDIFTDADYKFYAAIITNSNYAIPYAEFLEKELGWVPKDIFITDLLHDGQKERLREAFQAKNLLGELIFERDTSRIGVTLRQRHPQDQGQRYFDAYAPLYLLGSSLEKELAVGRGLHYLSVSFPVYNRIIVDRGYSGYRGGLHLFE

SEQ ID NO: 9727 - protein, 468 aa, Desulfitobacterium hafniense
FSGCGKELLDCAQSGCMLQKNRKFWQAGACQMQLSLMMAATVENSVIIMHGPVGCGSTLHSLGPAANKGKAKRGKKPQALVWLSTNLQESDVIGGGEKKLRETVEYADKTFRPEIIFVVSTCTPSIIGDDVEEVVHQTQKGVAAHLVSIHCPGFRTRVVATAYDSFYHGLLKHLPLEPLPAEAFIPLKENDPGYELAAQQFAYRKSRTVNLFNATSIGPADEEELVRLLKALNLNVQVYTEYSSLAEYRKMSQAALNISMCNVHDDYLLAYLQDKYALPYVIQGMPIGTKAVRKWLLAVAEHFDLEEKANRLADQEEKQVNEALQPFLPALKGKRVLISGGVIRVAEEAKVLKDLGLEVIGVRAYHYDNGAEPVYGSLVDELPEVHVSVSNQLFELANQIARYQPDLVIAHNGTQGWVAKMGVPAIQLFDVDRAYFGYRGLFSLVKRIAFAFENTSLPRRLAQHVNLP

SEQ ID NO: 9728 - protein, 176 aa, Desulfitobacterium hafniense
ILAQKGFYYDQTTCIGCKACQVACKDKNDSAVGVRYRRVYDVETGKFPNPRRLHFSISCNHCEEPKCVANCPTGALEKRKEDGIVIHHYDKCIGCRLCTWSCPYGAPQYREEEGKVGKCDMCADLLAKGENPACVDACVMRCLDYGDIDELRQKHGQNADAPALPSSKTTKPNIVI

SEQ ID NO: 9729 - protein, 164 aa, Desulfitobacterium hafniense
GFLFNVDRCIGCHACVLACKNENKTAAGVSWRRVTNTGEGHYLSISCNHCSSPECFRVCPEHAYIKRRDGIVLIDSNRCAGCQTCVGACPYGAPQFDPVADRTSKCDYCIDRQKAGLLPACVTACPTGALQVHEFDKYSEKDTVPTVEGFPDIRLTKPSIRFYP

SEQ ID NO: 9730 - protein, 431 aa, Desulfitobacterium hafniense
QIFHNVCPRNCYGTCGILSTVENGKLLKVEGNPKHSYTRGRLCAKGYAYTEYVYSPRRLKYPLRQFPRGSGNWQRLSWDEALEIIASKMIELHDRYGSNLACGYNKFSGNLGILHYATEGMFRGLGSYTKVHGDLCLSAEGDALNYNRGRGELLRDPEDMAKARGIVLWGVNPARTAVHQWSFINRARDKGAKLLVVDTLFTPTAAQGDSYLQIRPGTDGLLAMAALKYLWQMDRLDMDYIQEHVHGWEAFASYLQEEVSLEEASAITGVPLEGIKELAEMYLESPCATWVGFGLQRYSNGGQSVRGIDALVTLTKNQNQPGGGLYYFNFLDIFPLHIKNFPRPTEQEKASVRSLNIIHFAQEALALENPPLKLLWLAGHNPFSQGQNFQYWQKLVNQLELMVVVDLFMNETTAQADIVLPAASPFEEYDL

SEQ ID NO: 9731 - protein, 122 aa, Desulfitobacterium hafniense
ELKYSKSHEWAKVEGNTVTLGITAHAQDSLGDVVFVELPDNDTTVVAGEAFGTVESVKAVSDMIAPVSGKVIDYNQEVLDSPELLNDDPYGEGWLIKVEVDDLTVLDELLSAAEYEAFLAEE

SEQ ID NO: 9732 - protein, 273 aa, Desulfitobacterium hafniense
AQLLDGKEISKVLKEEIKEEVKRWKEQGVNPKLAVVLVGDDPASVVYAKSKQKVSDSLGIDFELTVLPADSSEESILALIDSLNANPDVHGIMIELPLPKHISKERVMAAVRPDKDVDGVHPINRGYILSGEEGLFPATPESCIEIMLRSGVEIAGKHVVIVGRGETVGKPLVFLILKHNATVTICHSRTPDLGAFTRQADIIVAAVGKAKLVKKDMVKPGAIVVDAGINEIPGGICGDVDFEEVKEVASLISPVPGGVGSLTTALIMKNVLK

SEQ ID NO: 9733 - protein, 329 aa, Desulfitobacterium hafniense
RLLEASGVPATDAGIVSSILVDTSLEGIDTHGISRLPVYLKCLLKGRINPKPKIQETIDAAVARVDGDNGLGQLVAYRAMNSAIDLAKIYGIGFATVKNSNHFGAASTYCKLAAAQQMIGQAYTNSPSGIPPWGGRAPYFGTNPISYGFPHAEYPVVVDMSSSTVARGNIILAAKNGEEIPEGWAMDKDGKATTNAKAALEGAVLPIGGAKGYTLALAAEVMAGIISGSAYGSHVGWIYDEGREPVNIGHSFLAINIAKLMPVEEFSQRMGDMIREVKAIPKAEGITEIRIPGERRQANAEQRKQDGIPVAEGLLQELNMLAEKLAIPI

SEQ ID NO: 9734 - protein, 244 aa, Desulfitobacterium hafniense
MNVEGIGRICNLGTGTVGPGITLTFALAGYEVNMYGRSNDSIKRGMNAITDMLKKFREHGLVKDSDIPEIIGRIKGVTTLEEAADGVDFVIESIVENLSAKQEIFAKMERLCLVNTIFASSTSGLTTSAIAESLEYKERFIVAHFWNPPHLIPLVEIVPGQYTSQNTTNITSKLLLKIGKKPVILKKEALGFIGNRLQFAMLREALSLIDSGVATKEAIDTTIKYALGRRLSTTGPLESADLSG

SEQ ID NO: 9735 - protein, 442 aa, Desulfitobacterium hafniense
WLKKQALEKPHKLFLNELSFQEVDRRVSDLAGRIYPFVKAEDRVALYAHNSVEMALFFMALQALQMEVFMMNTRLTGEERAKKLKTLNIRVTFSDDDTFIPFGRVLAGDYDEQARCREEEAPEKIAVIMDTSATSGDYKSVPLRRKQLDAHVQASRQVLGVREEDNWLLVLPMYHIGGLAILMRSLYNGTRVTLMGKFDEEQILKGIEEGSLTMLSLVPTLLMRIVNRIRQHRLRVVLVSGEFIPKSLVEICLAKRIPIYKSYGMTETTSQCTTFCVAENPAKLDAVGLPLPGVTLRIVNPDAEGIGEVAIQSPMVMDGYLGKEAVEGFLNTQDMGYVDEEGYLYILDRRKDMIISGGENIYPREIENVLYAHPEISECAMVGMKDEKWGQVPVLFVVSSLGDEELRDYLAGKLARYKLPRKIVHLRSLPKNATGKILKKNL

SEQ ID NO: 9736 - protein, 421 aa, Desulfitobacterium hafniense
MAMTITEKILAEHAGLDKVVPGQLITAQLDLALANDITGPVSIREFEKFGVETVWDKTKVALVPDHFTPNKDIASAELSKALREFAKKQGIVHYWEQGRVGVEHCLLPEQGVTLPGDVIIGADSHTCTYGALGAFATGVGSTDLAAGMATGEAWFRIPESIKFIFKGTNFQPWVSGKDLILYTIGKIGVDGARYRSMEFTGEGIAALSMDGRLTMCNMAVEAGAKNGIIPPDEKTLAYVNERAKRPYKVYHSDPDAQYVEVYEWDVADIPLQVAFPHLPENAKPVSEGKGIKIDQVVIGSCTNGRLEDMQVAAQILKGQKVHGDVRLIVIPGTQDIYKQAMQEGLIDIFIDAGAVVSTPTCGPCLGGYMGILAKGERALSTTNRNFVGRMGHPESEVYLSGPAVAAASAVTGEISHPEEVL

SEQ ID NO: 9737 - protein, 462 aa, Desulfitobacterium hafniense
MLKAEALNELIQVLGKENVVTEHEELLSYSYDATAAMPHQTPDVFVTPKTTEQVSEVMKIATKYDLPVYPRGSATNLSGGTIPIEKGIVMSMLHMNQIIEVDAENLTATVQPGVIIQDLNDAALEHGLFYPPDPGTVKTATMGGSVSESSGGLRGLKYGVTKHYVMGMKLVRANGDIIKWGGKTVKNVTGYDLTALFTGAEGTLGIITEIIVKLNPVPEARKALLGVFDDIDKAGNAIAAIIRNKVIPATLEIMDNITIRTVENFTHAGLPVDAEAILLCEVDGYKEAVEREAALVEKILKEQGAVEINVAKTDEERDKIWLARRNALPALAQRRPTTVLEDATVPRSKIPHMIKAIRQIAEKYDLLIGTFGHAGDGNLHPTILTDENNKEEMERVDKAVEEIFQVAVSLGGTLSGEHGIGMAKAKFLPLEFGEAGVKLLKDIKEACDPDYRINPGKMVRRD

SEQ ID NO: 9738 - protein, 283 aa, Desulfitobacterium hafniense
RIRKAIIPAAGLGTRFLPATKAQPKEMLPIVDKPTIQYIVEEAVHSGIEDIIIVTGRNKRAIEDHFDRSIELETFLQKSEKEELLDMVQDIARMVDIYYVRQKEALGLGHAIYCARKFIGNEPFAVLLGDDIIHSEVPCLRQMMHVYERHGASIVGVQQVPLEDTSKYGIVDAVPLDDSLYRALDLVEKPQPEDAPEARLAIMGRYILNPEIFGILESIPPGKGGEIQLTDGLKELARFQEILAYEFDGQRYDVGDKLGFVQATIEYALRREDLAEPLMRYLK

SEQ ID NO: 9739 - protein, 727 aa, Desulfitobacterium hafniense
AKIHILDIQAANQIAAGEVVERPVSVVKELIENALDAQATQIEVIIEGSGVERIRVQDNGQGISAEDLPLTVLRHATSKIRTIDDLNRLRTLGFRGEALPSIASVSRLEIISRPPEEISGRVLRIQGGEQLEFSETGCPPGTTITVDDLFYNTPARRKFLKSKNTEFGQISDVIGRLSLARPDVSFTLKHPKVLVLQTPGKGNLLESIGAVLGQATARRLLPLSCSLGDWRLEGYISPPDLVRSTKQGETLIVNERIIRSNSISRAISEGYHTLIPAKLYPITILKLHIPPHEYDVNVHPTKMEIRFHKEKELMEFIAEGVRRTLLQARPIAPFVKVKNTPSPKESLPGADKVDRPVQGALNFAPKSPHSLSQGKTIPIPYKHSSYSPLGPANGLSASQRDRELNAGNEFKAGHKLNAHEFAETAKFLIKDLNPQERPPVNEQKLFLESQEPFQVTPLKADRLEPDLSLESDAFLGANISGTDISGADTLGRADAPLAEEEVGAGSTAELELSVAEENHESNEITEITDKIKEQSPLLALRPIGQVFNTYIMATDGEQLVIFDQHAAHERINYERLLAEHQNNPGNSQMLLIPLTMEFTPGEEEALLEHFLLLNEMGFILEHFGTRTYLLRGIPAYSGPYQGEQLLRDFLDQVMLNHIPPTMDKLLEEWIYMLACKASIKAKENLTLFEMEQLIVQLSKTLNPYTCPHGRPTMIQLTKEELEHRFYR

SEQ ID NO: 9740 - protein, 842 aa, Desulfitobacterium hafniense
TPMMQQYKSIKSQAPDAILFFRLGDFYEMFGEDARTAAPVLEIALTGRDSGGGERIPMCGVPHHAVDGYLLKLVSAGYKVALCEQVEDPQATKGIVRREIIRIISPGTMTDSLVEQANNFLAAVYHDQDWGLAFVDVSTGEFTVFQTESIDILTTELSRIRPSELLLPAELLKAKHWRPYYLTQREKKTYQHTLLEQRFTEQTELFQEFPTAMKAANGLWQYILETSPGIDPSHILKINAYRPEHWMLLDPWTRRNLELTESIRGQGKKGTLLSVLDFTKTAFGGRLLRRWIEQPLLLKEEIEKRLDYVEALVEDSFLRGDLIQLFNKVFDLERLMGKVSYGTANARDLLSLAQTLGVLPQLRALLAEGKSASLQAFIPALEGLDPLAVTLEQAINPEAPISLKDGNLLKAGYSEEIDELRSISSGGKAWVAKLESMEKDRTGIRSLKVGYNKVFGYYIEVTHANSHLIPAEYIRKQTLANAERFITPELKEYEQKILGAEEKVTQLEYQLFLELRETVRGQAARILEAAHALAEIDVYASLAEAAVRHHYSRPVMKGEGGLTIIEGRHPVVESMLQDTSFVPNDTILTEDKHLALITGPNMAGKSTYMRQVALIVLMAQIGSFVPAQQATIPIADHIFTRVGASDDLASGQSTFMVEMYEVAHILRHVTPHSLIILDEVGRGTATYDGLSIAWAVAEYLAGQENKPKTLFATHYHELTDLEETHAGIFNLHVGVREHGEEIVFLHKIIPGRADRSYGIQVAKLAGLPANLLHRAKIILHELESSAKENRQEHLLNKEKATQLSLFEVQPLDPLLQEVSELSVEDLTPRQALDYLFDLKERI

SEQ ID NO: 9741 - protein, 1015 aa, Desulfitobacterium hafniense
  unsure (1)..(1015): unsure at all Xaa locations
MEVTRRGFLKLSGASLFALASGLGFDPQIAQAQGFSLRIEGTTKIPSICHFCSGGCGLLLHIKDEKLVYLDGDPDNPVNSGALCPKGASLGHVANAKDRVTKPRYRAPGSSDWQDISWDEAINKIASKIKEVRDTTWMATEEIGGTAYNVNRADGIAVLGSAEVDNEESYLIKKLSELIGTPYNEHQARIXHAPTVASLSPSFGRGAMTNSWTDMQNTKCFLIAGSNCAENHPIAMRWINKAKENGAKVIVVDPRFTRTASQADIFAQVRPGADIAYLNAIINYILENKLYDQDYVLNHTNGLYKISKDFKFADGLFSGFDPETKKYNFDSWAYQLDAENKPVKAESLDDPDCVFGKLKEHFSRYTLEVGADISGIPAEKIKEIADTFCNTRPGSILYALGMTQHTTGVQEIRSYAIIQLLLGNVGKAGSGIQALRGEPNVQGSTDMANLFNNLPGYLPAPVHTDKDLRSYLVRSGSAFERHIISQLKAWFGENATKENDYCFNYLPKYNSGKNYSMVKLWEAANSGQFKMLLNFGSNSMVSIPNRQIVREGLAKLDMLVIADVYEVETAQFWREKDPTTGELLVNPAKINTEVILLPAAFVYEKGGTLSNSGRWIQWKDAALKPPGEAKPDLDILDHIYHKLKELYAGSTDPKDEPILKARWDYGHEPDPLKVLQEISGYDETTGKVLPTLADYLKAPIGSASSGCWIYAGVTGNGNLAARRDNSDPSGLGLYRNWSFSWPGNIRILYNRGSCDMNGQPLDENRKLIWWDAAKNSWEGNDGADVPDKTKGPDTPEGKQVFRMNPEGVGRLFTAKYFSGIPATPAADGLPHIGVRPAGQCNDGPLPEFYEPVESPTVNSLHPDVSSNPTVPIPNFLPGVTNHGSKEDFPYVLTTYALVEHFCAGGITRNIPMLNELMPQPFAEISKNLAQKIGVKEGDMVEVSSARGKVQVVALVTDRIQTLKINGQDSETIGMPWSWGFASLSPGPTTNNLTISAIDPTAGTPEYKCCLVNIRR

SEQ ID NO: 9742 - protein, 1088 aa, Desulfitobacterium hafniense
  unsure (1)..(1088): unsure at all Xaa locations
FSFLSSVLSHGAAYKILFELRMKFAGHISQLPMGFHTSNSTGKLRKLMDENVEKLELFIAHQLPDAVGSLASPVVMLVVLFLFDWRMGLACLVPIVLSFMAQAGSLANPESKEFMESFQDLQDKMNSSAVEYVRGIYVVKAFNQTVFSFRKFHDTILAYKDSAIRYTHSVKNSYCAFLVLLNSVFLFLLPVGILIGSRAADYQAFAIAFLFYLIFSMGIAGPVSKLMYVFVQGFMVSSSIKRVRGVFDTPVLSVGVNREKPRGNGISFEHVFFSYNKDDAKGTLHDISFTAEPGQVTALVGPSGSGKSTIAQLIPRFWDIDSGQIAIGGVNITDIALDDLMQSVSFVFQDVFLFQKSILENIKIGNETASDEDAVWAAKAAMCHEFIERLPDGYHSVLGSKGTYLSGGERQRVVIARAILKNAPIVILDEATAFADPENEQKIQLALEKLMKHKTVIVIAHRLSTIKNADKIIVVDEGRIAEQGTHEELIRYGAKYGHMWDVYSKALNWKLAXGGNHMLKKLLALTDKSHKELKKSILASFLAQLSLSLPVMILMMTFIEILQPFWGGEVEWPKLWILAAASVVVVVLAFIAHRYEYGKTYVTAYEAAEEKRTGLAEHLRKLPLSYFGKKDLTEITVNMMSDCGTIEQSFSSIIPAFGGTLINLLFTCVLLAVFDWRMALAIFISVPVSFGFLLLCRTMHDRIGRAHLQSKLDASEQMQEYLEGIKVIKAFGLGGDKFKSLEEAYRQLMKISTKTETVNGALTTISMMMLRFSIPLTIFVGLSLVTAGSLDLLYFLLFLIFSSRIYTSLSTPLALWGDLLYSLLAIKRLHEVYEETPMGGSDGVVLQHYTIEFDHVSFGYQEEAVIKDISFSIPQGKVTALVGPSGSGKSTLSKLIARFWNVDAGSIRIDGTDIRKIDPERLLTWISFVFQDVVLFNDTIYNNIAIGKSGATREEVEEAARRANCHDFVSRLPEGYDTLVGENGSTLSGGERQRISIARALLKDAPIILLDEATASLDPENELEIQEALSQLIKDKTVVVIAHRLRTIAGADNIVVLENGRIAEQGSGPELLRAGGLYAKLFGIQQET

SEQ ID NO: 9743 - protein, 390 aa, Desulfitobacterium hafniense
MQDVVIVSGARTPIGDFNGALKDFKAVDLGMIALKGALQKSNLEPAQIEEVIAGHVYQAGCKGNPARQVAMGVGCPVETVAATINQQCPSSMRATEMVSQEIMLGKIQIGAAVGIESMTNVPYLLLKARGGYRMGSDTLHDGLLYDALIDAFYNYHMGITAENLAEMYGISREEQDEHALESHRRACRALKEGKLKEEIVPVEIVTKKETRLIAEDEHPREDVTLESFAKLRPAFQKEGTVTAGNASSLNDGAVALLLMSGEKAQELGFKPLARIVATASASVDPKIMGFGVVPAVRRALNFARMDTKDIDLWEINEAFAAQFLACNRELKLDLDKVNVNGSGISLGHPVGMTGARLILTLIQEMKRRRNQYGCASLCAGGGPAMAVVVE

SEQ ID NO: 9744 - protein, 290 aa, Desulfitobacterium hafniense
RLNAAIIGPGNIGTDLMYKILRRSEYLELKLVAGIVAESEGLRLAREEGVATSAAGIQAILDRKDIDIVFDATTAHAHAQHAPLLKDAGIIAVDLTPAAVGPYVMPVVNLEEHIDAMNVNLITCGGQATIPIVYAISRVVPTAYAEIVATIASKSAGPGTRQNIDEFTLTTAKGIVDIGNAQKGKAIILLNPADPPMMMNNTIYALIDQVDPAIEQKITESVEEIIKEVQAFVPGYKLKIPPMFDGNKVTVMIEVEGSGDYLPQYSGNLDLETCAALAVAEKMAKHKLAA

SEQ ID NO: 9745 - protein, 417 aa, Desulfitobacterium hafniense
IQGEIEVPGDKSISHRAALFGGMAQGETHITNFLLGQDCLSTLACLKTLGVEWERRDAEVWIRGRGFENWHEPQDILDVGNSGTTMRLMLGVLAGCPFSATLTGDSSIRSRPMARVTLPLQEMGARILGRQEGKYAPLTIQGGLLQGIQFRSPVASAQVKSAILLAGLRAKGETMVTEPCLSRDHTERMLRGFGVDLKSEGRTAKVRGGAALSGQEVAVPGDISSAAFFLVLGTLIPQGELLIKNVGMNPTRTGILDALWQMGADIQVEEEREECGEPRANLRVRPAQLHGIEIQGEMIPKLIDEVPVLAVAASLAQGETVIRDAAELRVKETDRIQTVVQGLQALGANAQELPDGLRIQGAKSLRGGAAHSHGDHRLAMAWVVAGLLAEEGISLQGIEAAEVSFPNFLELIHEIAE

SEQ ID NO: 9746 - protein, 337 aa, Desulfitobacterium hafniense
MIIVLKRGAGEAEVQEINERLSQEGFKIHLSQGVEKIIIGAVGDRSRLKALDLEALPWVEKVVPILAPYKLVSREFQSGNTIIKIGDYEIGGEEIHVMAGPCSVESRAQIIETAHAVKEAGATFLRGGAFKPRTSPYAFQGLEEEGLKLLAEAREETGLLVITEVVDVRDVELVAHYADILQIGARNMQNFFLLKEVAKTNKPILLKRGPSATLEEWMMAAEYIMDGGNYQVMFCERGIRTFETYTRNTLDLSMVPALQSLSHLPVIVDPSHGTGRWNLVPPMAKAAVAAGADGIIVEVHPQPEKAVSDGKQSLTPDNFASMMAELEILAQALGRPV

SEQ ID NO: 9747 - protein, 499 aa, Desulfitobacterium hafniense
IGLLSPLGLYSLAVALGKHGINIMALLSLAAKVYGEKIGLIDEKEELTYRELYARSRRIALLLQEKYQLQRGNKVGLICKNHTSLIKALFAVAQSGADIYLLNAEMSSSQFNQLAEQIDFNLVIYDFEASPLLEASVYQKGKLLSYHEHLPALNNLAEQSFPENLQIQPSSSGRLVILTGGTTGKARAAAHQPSLYNYLNPFLTLINRLKLTHYQTAYIATPLYHGYGLAILLVLITLGKKVVIQKGFDQVKACRLIRKHQVEVVTVVPLMIDKMLKQNPEDLQSLACIVSGGAELNPKLTRETTEKLGDVLYNLYGTSEAGLNIIATPQDLSYAANTLGKIIKGVRLKVMDDNKHEVPIGSVGQFCIKNAWSMGNKSGPWLETGDLGYRDHQGYYFLCGRVDDMVVSAGENVYPADLEQVLRNHPHIKEVAVIGISDERFGQRLKGFVVREEGACLTQEELLAWLRPRVARFQLPKEIVFVQQLPYTPLGKIDKQQLR

SEQ ID NO: 9748 - protein, 235 aa, Desulfitobacterium hafniense
LGRSTEAGWRPSLRGKTILITGASSGIGEALAYQLADSECHLILVARTEAKLFQVKQNIEQKKAAVSIFPADLREPEQVKELLNFIEQLPAGLDVFVNNAGLSIKRGIKDSLDRYHDFTRTMAINYLAPVQLALSLIPLLEKNKGQIINISTINVLLLPLPHWAAYQASKAAFDTWFRSAAAELNAMGIATSSVYLPLVRTPMILPTKEYQKLPAMSPKQAGKIVAKLIYTQRSK

SEQ ID NO: 9749 - protein, 578 aa, Desulfitobacterium hafniense
ELKRMANQIRQDIITMLVPAKSGHPGGSLSAADILAALYFYEMKVNPEDPHWAERDRFVLAKGHAAPVLYAALAEKGYFPKEEILGLRQTGRILQGHPDMRKVPGVDMSTGSLGQGLSAANGMALAGKADKKDFRVYVVLGDGEMAEGQVWEAAMAAAHYKLDNVTAVLDYNGLQIDGTTDNVMASDPLDDKWRAFGWHVIEVDGHNMEELLAAFAEAKTIKGKPTILIARTVKGKGVSFMENQVGWHGNAPSAEQAEQALKELRERRHALAKQATRDAYGKTLVALGAENKDIVVLDADLSKSTKTADFAKHYPERFFNMGIAEANLMGTAAGLAAAGKIPFASTFAIFATGRAFEQIRNSIAYPKLNVKIAATHAGVTVGEDGGSHQAVEDVAIMRAVPNMTVLVPADGVETQQAIRAAAAYEGPVYIRMGRLDVPLLFDDQYQFEIGKANVLREGSDCVVFANGVMVAAALEAAQDLEQENIRVAVVNVASVKPLDVQTIVACAQKTGAAVTAEEHNIIGGLGSAVAEALSEQAPTPLVRVGIKDTFGESGRPLELLEKYGLTKKEVVAAVKVAI

SEQ ID NO: 9750 - protein, 284 aa, Desulfitobacterium hafniense
  unsure (1)..(284): unsure at all Xaa locations
IVTQILNAKPVVQAMKENLRQEVAALQAEGKAPTLGIIRVGSRPDDVYYENNIIKNCETVGIATKTYPLDLNISMEEFTAVMTQVNDDPSVHGIMLFRPLPPQLDEEVIKHLISADKDIDCMSPLNLEKVFEGDMSGLLPCTPAAVMAILRHYDIELKGANAVVMGRSLVVGKPLSMMLLQDNATVTICHSRTRNLPEVAKNADIVIAAMGRARMIDDNYVAENSIVIDVGINDAGDGKICGDVDYDAVVDKVKGITPVPGGVGSVTTTILLNNLVRACKSQXS

SEQ ID NO: 9751 - protein, 187 aa, Desulfitobacterium hafniense
MQLIEQAKIREAVLMILEAIGEDPEREGLKDTPDRVARMYAEIFSGLAEDAGVYLECVFTEEHEEMIVVKDIPFYSTCEHHLVPFIGKAHVAYIPAGGKVTGLSKLARVVESIARRPQLQERLTREIADVIMKKLNPQGVAVVVEAEHLCMSMRGIKKPGSKTVTSAVRGLFRKSAKTRAEFLSLIK

SEQ ID NO: 9752 - protein, 183 aa, Desulfitobacterium hafniense
MAKQLGFFLDVNRCLGCGACIKACANHNRLPPSLTWRKLRQVEDVDYDRGQISRFFLSTACNHCANPECLRVCPYGAYAKRRDGIVLHFPDKCGSCKSCVASCPFGAPQINPQTGKAGKCQLCHERLDKGNAPYCVQACVTGALQLREIQGNPTDRILRLTAPLPTLRLTKPSTFYYPPRGTK

SEQ ID NO: 9753 - protein, 289 aa, Desulfitobacterium hafniense
MFKLHGIYAPIPTPFKDNKIALDELAGNMEFWLASQLEGIVVMGSNGEFIMLSPEEKCQLITAVCTQAKGKKPVVVGTGCESTQETIEFNHFAAGAGADAALVLSPNYFKKAMNDTVLKKFYLEVAEASPIPIILYNMPGNSGINLSAKLVAELADHPNIIGIKDSGGNIVQIAEIIHSAPDDFAVFAGSASFLFASLALGAAGGTLALANVFPNECARLQELVDKGKFAEAKELQLNLIEANNAVTTRWGVGGLKAALELIGLYGGEPRKPLMPLGDEDRELLAAIIK

SEQ ID NO: 9754 - protein, 408 aa, Desulfitobacterium hafniense
IRDIGLAPQGQLKIDWVQAHMPVLNTLREEFEKTQPFQGKKVTICLHLEAKTAYLAKVVQAGGAEVTVAASNPLSTQDDVVAALVAGGVHAHAWYGATDEEYHQHLHKALDFEPDYIIDDGGDLVSTLHKERRELLPKVLGGAEETTTGILRLRAMEKNGELAFPMMAVNDAEMKYLFDNRYGTGQSVWDGIMRTTNLVVAGKTICVVGYGWCGKGVALRAKGLGARVIICEVNPIKANEAWMDGFEVMPMLAAAPLGDFFVTVTGNKNVISGEHFQVMKDGAILANAGHFDVEVNKVQLAAMAQSCHEVRRNIEEYLLQDGRKIYLLAEGRLVNLAAGDGHPAEVMDMTFALQALALHYLATAKTPLEPKVYSVPTEMDMRVAELKLKTLGLSIDQLSEEQKSYLAS

SEQ ID NO: 9755 - protein, 751 aa, Desulfitobacterium hafniense
LEDLNPVQRQAVEHREGPLLILAGAGSGKTRVLTYRIAHLIAQGVEPWHILAITFTNKAAQEMRDRVYSLVGSEGRGLWVATFHSACVRILRSEIGYLPGYSRSFVIYDSGDQLALIKSCMKELNLDEKKFAPRAIEAVISDAKNKLLTPEDFSRRAKDYFEQKAERVYELYLKKLLANNALDFDDIIMLTVRLFRENPEVLSQYQDKFRYILVDEYQDTNHAQYALVNLLAKKYRNLCVVGDDDQSIYMFRGADVQNILDFERDYPEAKTLKLEQNYRSTKSILQAANSVVQNNTERKEKSLWTENEDGQPIVYYVADNEHDEARYMGERIQRLLNVEGRKFNEFAVLYRTNAQSRVIEERFMKEGIPYRIFSGLKFYERMEIKDILAYLRILHNPADQVSFSRVLNVPKRGLGESTLEKILDYANEQEMPVLDAIMEADYIPELQSRAKKPLLAFAHLMQELRALAAAESSVTKLVEEVLKRTGYWDNLVSDKSPEAEARLENLREFLSVTAEYDEKADNYETAVVQEGIEDALVPGLTGFLEQVSLVAQIDSLDQADDAVVMMTIHSAKGLEFPVVFLGGMEEGIFPSSRSMLDPVLLAEERRLCYVAITRARERLYLAYAQQRMLYGRTQYNRPSEFFQEIPTHVLVDRDPIDPPPTRAQKAHSAAARPAATPSGGPSPWRTGERTIGNPVQDAPGVDYKVGEKVEHAKFGKGVIVAIKGEGSSAELSVVFGGEIKKLMAEYARLVK

SEQ ID NO: 9756 - protein, 186 aa, Desulfitobacterium hafniense
  unsure (1)..(186): unsure at all Xaa locations
MADYVMFIDPNRCTGCNACRIACQTQWGLAPTLKFNSLIEQETGKYPKVQRLITPVQCQHCDDAPCQKVCPTGATYKREDGIVLIDAQKCIGCKYCMVACPYNARVINEHGVPEKCRFCAEYVVNGETPACVSTCMNDVRVFGDLDDPGSPLHELLKNQDLIQLRADLQTKPRIYYAKSKRIXGGE

SEQ ID NO: 9757 - protein, 717 aa, Desulfitobacterium hafniense
ISRRSFLKLAAATTTAVALPQALKMDFQAFAEEAKHAEVTRVPSLCNGCSSYCGVWAYVKNGRLWKIEGNDIHMKSRGHICARGHGIAQNVYNPGRVTQPMKRVDNKNNFQPITWEEAFQEVGAKMKAIVEEHGGDKMVWACHGGKESYAQQFMDIIGSSTYITHYATCFSAKTNIWQNMVGGMFNPDFDQAKTMLFVGRNYAGGIIPAAMKRITEAKAKGGKIIVVDPRFCELATIADEWIPIRPGTDLAFFLGIAHTLITENLYNQSFVEQYVYGFDEFWMHNKDFSADQAATICGIAADKIREVARELAGSAPHAFLDPGYHGLAAHYQNSNETMMLNIIINALLGNFWKAGGLFPAASTTFGHPEATYYGPVAAKGIRADGAGEVGEYPLVEPSRGIPQRIPDMIEKGRARMVFFYSYNPLRSAPEPEYQKKIKNADLVVSIPYDWNETSLYTAHYILPENHYLERTEHPKVINGNIYWPATQVATRFKALESTTSSLDLLDIMKGLTKAYGIENLYGYTVEEELEVALGPIGVSVDELREKGCIELMPSVLPKEEGLTFGTFTGKIEFSIGAWRKEGYLGVPTWVPPLVEPAEVNQFRLIHGKQPWHSHIMTTNNPYLMAITEEKKGTYMWMNSSRAGELGIQEGDWVTVSSDITSKQVQVHITEGLHPECVWLPSTYGTFSEKLELGYGQGVNYNDFIPARIDKKTGHVMG

SEQ ID NO: 9758 - protein, 888 aa, Desulfitobacterium hafniense
  unsure (1)..(888): unsure at all Xaa locations
EWLNLTIDEKEVVVPKGSTVLEACRMYDIPIPTLCQDPELTNAGACRLCIVEIAGMRNLPPSCVTQVTQGMVVKTQTPKVRKSRKVILELLVANHPLDCMTCQKMGDCALAQYAYEYGVTGEDYRGERRELPLDDSNPFILRDPNKCILCGKCVRACEEIQGRSVLDFFKRGFDSQVGPAFDVPYSESECVFCGSCVSVCPVGALVEKKMVGQARAWNIEKVQTTCPFCGTGCNFDLNVSNGKVIGVTSNPESPVNGKALCVKGRFGMDLIHSPQRLTTPLIKKDGEFVPAGWDEALDLIAAKFSQIKEDYGPDSFAALSSARCTNEENYLMQKFMRAVIGTNNVDHCARTXHAPTVAGLATSFGSGAMTNSINEIPNAEVMFVIGSNTTEAHPIIGTKMKQALARGAKLIVADPREIELARDAHIWMRLKPGTDIALINGIMNIIVENGWEDRAFIEERTEGYQELRENLKKFPPEEVSKITGVPVELMAEAARLYTSVERAQIFYTLGITEHVCGTDNVMSLANLAMLTGNIGKESSGVNPLRGQNNVQGACDMGALPNVYPGYQSVTNPEARAKFEEAWGVSLNPNQGFMIPDMFDSAVKKELRAMYIMGEDPVLTDADANHVRKGLKALDFLVVQNIFMSETAELADVILPGASFAEKDGTFTNTERRVQRVNRAIKPIANTKADWEIICELSNRMGYPMAYPSPAEIMLEVASLAPQFAGVTYERLGKKGLQWPVPHAEHPGTKFLHQGKFTRGKGVFTVIEHQLPDELPDEEYPFLLTTGRKLQHYNISTRFSAALDEHAPEELAELNPKDARRLGIQDGEKIKVVSRRGEVVTKVWVTKRVPPGVLFMTLHYRESPTNVLTNGAYDKVTKTYEYKVCGVRV

SEQ ID NO: 9759 - protein, 493 aa, Desulfitobacterium hafniense
MKKYVLALDQGTTSCRAILFDRESQIVGVAQKEFTQIYPQPGWVEHDPEEVWSTQYGVIAELLARYQVTSEEIAGIGITNQRETTVVWDKHTGKSVTNAIVWQCRRTAPLCDELKMKGLEPLFKEKTGLVLDAYFSGTKIRWILDRVPGAQEKAEKGELLFGTMDTWLVWNLTKGRIHVTDYSNASRTLLYNIKTLAWDPDLLQVLNIPLAMLPEVKPSSTIYGETAAEGLFGHPIPIAGIAGDQQAALFGQACFAPGMAKNTYGTGCFMLLNTGEELYESRHGLISTIAWGLDEKVIYALEGSVFMAGAVMQWLRDELKLIETAGDSEYFAGKVADNGGVYLVPAFTGLGAPYWDMDARGAIVGLTRGSNKNHIIRAALESMAYQTRDILEAMEADSQLPLQLLKVDGGAVVNNLLMQFQADILGVEVERPHCIETTALGAAYLAGLAIGFWSSKEELRDKAKMERSFKPQMAEERKEKYYQGWHKAVRQIM

SEQ ID NO: 9760 - protein, 796 aa, Desulfitobacterium hafniense
ANEEGTWITAACWHNCGGRCLNKALVVDGVVVRQKTDDTHPDSPDYPQQRGCARGRSQRQQIFGADRLRYPMKRKNWNPGDGGKRELRGKDEWVRISWEEALDHVAAELKRVKETYGNKAILAKSTGPALNAYGGAMTYWGCTSDGAWPKPQQFMNGGRSRGSNDRLDLRNSKLIVLWGANPVWSSGGNPAYNFKQAKEAGAKFIIVDPLYNDTAQLLADQWIPVRPGTDTALLLGMAHYMITNNLHDQEFLDKYCVGFDAEHMPEGADPKENFKDYVLGTYDGTPKTPEWASEHCGTDPDLIRSFAHEVAVTKPMTFTSSSAAARTSVGEQFCQAFLTVGWMTGNVGKPGASVCSNNRHNTQSYGGPALVKAGGAGGKSPANPVYKEPTFPGPDPFKTDWHGIVIDEAWDAVINGEYTAGVRGKQPCDIRMIWNIGSGNVLNQNTDIMKGIEAFRKVEFVVTSAHFLTATAQYADIVLPATTEWERLGGFLTGNPEMIIFYSQITQPMFEAKDDDWMYAEIGKRLGLDPADFDPLSPEQKLFNMVSGCTVMKEDGSGYEKLVTITAEDIAALGVKGTPQEGRISYQEFKEQGVYQVPRSPGDQYTYIDYKDFIEDPEKNPLGTESGKFQIHSQGLADTINAYGWNTLAPIPKYQYVTEGYEETFANFEKKEKSGYPLQLTTIHYARRSHSTLDNISWLREAFQNRLYIHPADAAARGIAKNDIVKISSRHGQVIRPVYITERIMPGTLTLGQGAWAEVDDETGICKAGATNVLNGGLPTGQGVQAYNTCNVQVEK

SEQ ID NO: 9761 - protein, 362 aa, Desulfitobacterium hafniense
DFTWNLFKESGADKGNVMISAPSVYLALGMALNGADGETREAMLKALSAQNIKLEDLNAGLSAWSNSLMDKKNKTDVRIANSIWIRNGFEADPAFLQTNGDYYQAGIRSLDFADPSAPKIINQWVEEKTEGTIDKIIETMDDDLMMYLINAIYFKGDWQEPFKAGSTYTGTFAAPAGGVETPFMRRSGNMDYIQNQGATGVILPYADERFAFVGILPEEGKSPRDFINTTTAADMLKLISTKKIKNVDLSLPKFASSYENELRDELNALGMDVAFDPFRADFSLMNKAHNKDLFIGGVKHKTYIKVDEKGTEAAAVTGVEVNTTSMPIDLTQVVFDRPFVYAIIDWQTNSPLFVGIMEDPTI

SEQ ID NO: 9762 - protein, 432 aa, Desulfitobacterium hafniense
EDFHSSISFDQRLYKQDIQGSIAHARMLGEIGVLTSAEAQQIIEGLKGILTDIREGKIQFEIGAEDIHMNVEKLLTERVGTVGKKVHTGRSRNDQVALDLRLFLREEIDHTQELLIALLRTVLDLAKEHQETYMPGYTHLQKAQPISFAHHMMAYAQMFLRDLGRLKDTRQRLNVSPLGSGALAGTTFPLEREMVAQELGFDGITWNSLDGVSDRDFALEFLSAASILMMHLSRLCEELVLWSTGEFQFVIMDDGYSTGSSIMPQKKNPDVAELVRGKTGRVYGDLVALLTVMKGLPLAYNKDMQEDKEQVFDAVDTIQKSLLVVEPMLRTMKVNKKAMAEGAKGGFTNATDLADYLAKKNVPFREAHEIVGKLVLYCSKRGCGLEDLTLKEFQEHSDVFAEDLFESIGIEYCVRQRHIPGGPSPESVAQAI

SEQ ID NO: 9763 - protein, 721 aa, Desulfitobacterium hafniense
  unsure (1)..(721): unsure at all Xaa locations
TAPGCHNSCGVLLYTKDGKLEKVEGDPLNPFNNGKLCMRCLNLVEAVDHPDRLKYPMKRVGERGENKWQRISWDEAYAMICEKVNYYKKNFGPESIVGVHGTGRNINWQLPMLFNAGIQTPNISTLFFSGFACYLPRIVGSTAVNGDFMIVDASVQHPDRYANAEWQAPECVIVWGNDPLKSNADGFLGHWLVQCMQMGTKIISVDPRLTWWSARAEVWLPIRPGTDAALAIGMLNIIIEEDLYDHDFVENWTYGFEELAARVKEYPVAKVAEITGLPAEKIQKAARLFAQAKPAAIQWGLAFEQQISCMSLVLAVADLIGITGNIDVPGGMLLVRHPLTPTVIIIAAASSPLRKXPPRNXMGQPRGLPRTVLFPMLIRMSSCGAMETGKPYPLKMLWVQSSNSLACPAMDAPRALEAMKKMEFILVADPFLTPTAVAVADIVLPVGMGPERNSVRNWWTPMRAQSKVCQYYEAKGDEEIVVEFGKRLNPEAFPFENDVDLLNWYLTMDGDYPGNWSDLREKTWEYWDWDAAYRKYEKGMLREDGEMGFNTPTGKLELAPLMYMQWELDPLPFHIEPPEGPVTTPELYAEYPLILTTGARSYEFFHSEHRQLPTMREFHPDPLVTMHPEVAAANGIKEGEWVWIESPRGRFKQKAYLTPGINPQVINAEHGWWFPEQGPENWFGVFDSNPNNLTRAEVTGQGGIGSPIKSMLCKIYKVEEG

SEQ ID NO: 9764 - protein, 299 aa, Desulfitobacterium hafniense
KISVIGSGFTGTTTAFMLAMKGLGDIVLLDTQANENPTKGKALDIMEAGPLTRSSVRVTGTSDYQDTLDSDVVVITAGIARKPGMSRNELCDINAGIVTHVVRQVVQHSPNSTLIILSNPVDIMTYVAFKESGFKRNRIIGQSGVLDSARFRYFVASELKVSAEDVTGFVLGVHGDDMVPLVRYCSVHGIPIQQLLPEAEIEKIMERTRQAGSEIVNLLGNGSAYYAPAAALTEMIESILLDKHRVMPCIVHLEGELGYQDLVLNVPAVIGRQGVEKILPIDLLPEEEDLIERSVASIR

SEQ ID NO: 9765 - protein, 585 aa, Desulfitobacterium hafniense
RMSDLPKGGSFLFGETRFQDVFTPEDFTLEHKMLYRTAMGFVTDRVLAVMEELEEKRDGLNKQLIQEAGELGLNGLDIPEEYDGLDLDKISTTIVAECIGKGGSFAMTQGGHTGIGSMPIVMFGTHEQKKKYLPGIVSGEKAGAYALTEPGAGSDAMSAKTRADLSPDGKYYLLNGTKQFITNSAFADLFIVYAKIAGDKYTAFIVDADSEGLSLGPEEKKMGIKGSSTRQVILDNVKVPVENILFEIGRGHIVAFNILNLGRYKLAANALGASKHALELAAAYANERKQFGTPIANFGLIKEKLAKMAIKTYVMESMLYRTGGLLDGILHGLDTSGENGGQVAAKGIEEYALECSMNKIFATEAQGYVVDEGVQIHGGYGYCSEYSIERLYRDARIYRIFEGTNEINRTIIPITLLRRADKGDLPLQEAVQKLKEYIAAGGAAREDEAGLIQAAKDMFLLTMAAGLQKYGKNLQKEQEIVGKLADLAIQAFAMESAWLRTQKAVANEGETKAKLKSWMTSAFIYGTIGYLESIAKEILSALAEGQELESLLKDLQAVTQCTLGNTIALHRDIAAAVSEAGKYAV

SEQ ID NO: 9766 - protein, 444 aa, Desulfitobacterium hafniense
KISISDVVDQIGVSKYTYKTYFLVGLTLIFCGFSYMIVSYTMPQMSAEWGLTKVQTGSLASWSLLGLMVGGMIAGIISDSIGRKKGLAIFTIWFSLLTFPIYFVNSFEAFAILRILGGVGFGACIPIAITLMAENVPTKNRGFFISSIMSFYVLGWVVAGVVAIYVVPTFGWRVCYLIGVLPVLYAFVLMAALQESPHWLLGKGREKEAIEVLKRIEMVSKGKANDYAPGSLFLPPRPKKVGVGALFSREYSRATMALWIIYFMGSVVIYGINGWLPTLLVDKGYGLVKGYSFAVLQNVFGAIGGLCTGYVADIIGRRTNVIIGWIATAVAILLLGVASNQWMVVICGMLVGLAMNWGLSGTQPLLAEGYPTEFRSTGVASAQAFGRVGGFLGPIVAGYVQQLGVGFTGTFVFFAVPAVIASFVALFFVVETKGKSIERISANA

SEQ ID NO: 9767 - protein, 302 aa, Desulfitobacterium hafniense
RSIIIEHNNLGTVLMLQNVDALQKTEIDVRQKLNKKGLAAKYTFDAIIGQSEVVQKIIRVAQKYAVANSNVLIIGETGTGKKLFAQSIHNHSMRQNQPFVAINCAALPEQLLESELFGYVAGAFTGAAKGGKVGLFELAHKGTLFLDEIAEMPMGLQAKLLRVLQEREIRKLGDDKIIPIDVRIIAATNEDLRLKVQEGKFRQDLLYRIDVLSLSIPPLRERREDIKAIAKTFLAEFSQNRQQSIRLSQEGLMELMRYDWPGNIREMRNVCERLSVLSENKTSGVHEVKEVLNIKKEPPLNL

SEQ ID NO: 9768 - protein, 336 aa, Desulfitobacterium hafniense
RRFMEQAFTACGVSEADGQIVVDNLLYAELRGIKSHGVSRFPVYLRRIQMGAVNPQPQISMEQRTPVLLKVDGDNGLGSVVMVHALNRGMELAEQLGICAVGIKGSNHCGASGYYCELAAEQGLVSIVLTDGPPATPPWGGRKAYFGTNPMAFGLPRAQKPHIIVDLATSLAARGKVIRAAAQGEKIPEGWALDREGLPTTDPQAALAGVLLPMAGAKGYALSLVVEHLAGVLVGAGFGKDVAWQYSEGNKPANVGHFIILVKADAFMEMADYHKRTEQFVEEIKKIPLAPGTKEIKLPGERSWEQQQNTEAQGIILDADLQAALQTIAQELTINL

SEQ ID NO: 9769 - protein, 296 aa, Desulfitobacterium hafniense
RKVRIIGVPIDLGADRRGVDMGPSAIRYAGLHERLKKLGWEVEDVGNIDVPIAETREIKDPLLKYLPEISEVNQKLYPLVAQAIKEEVIPLIIGGDHSLGIGSLAGCAASGKQFGVIWFDTHGDYNSMETTSSGNIHGMPLAVANGIGVKELTSIGGAARKIKEENTVIIGARDFDDEERAMIRQSGITVFTMSDIDRLGMEAVVRQGLEIANRGTHGVHISFDLDVLDPSEAPGVGTPVQGGMTYREAHLAMEMVADCRCLLSMDVVEVNPILDAQNKTAELAVGLISSAFGQKI

SEQ ID NO: 9770 - protein, 1164 aa, Desulfitobacterium hafniense
MRPIKLKIKGLNSFIDTQEIDFSQLTSRGLFGIFGPTGSGKSTILDGMTLALYGAVARGSTNYMNTNCESLQVSYEFQIAEKDTKTYRVDREFRRDKKSGNVRTHSAKILLITAGGETVLEEQVREVTKKSEEIIGLTLEDFTRTVVLPQGKFSEFLRLEGRDRREMLERLFNLQRYGDELSSRLGARIRQELDKANVLAGQLKSYEECSEELLEAKNKELSSLEERLVQFQAELKKAAEDFHNGKEVWELQEELNRQEVQKTELEKTEAVIKESEIQATLGERSLRVKPYLDQYEDTLGKIATTQVQVAQLEGDTAALSLQKKEAEAQWEQAGAQKDKVLPALRLREQSAADAILEKKKLESLIQEKKSLQENIGRLEQEREEKQGRVHKGEEFIAKVNADIQEKEQKVEALTIDQEFKQKINEALLTFSRWEEAGQQVVSLGSEVKIIDEKLQEAQEKGLKFSQELEAKTEILQGFALTLQNLEETCPGDSETLVTLQEKLNQVKEQWARHHEYSAAISRSEAGIRDLLPKLDTAQQQKAQLTQKITELESALKKIERENLAYALRVALVEGEACPVCGSTHHQPDHGNAAVGTEKLEEIQAALREKKEHEQSLYQEMIQAQEQIKTLESTVKDCREKTAALGEAYKAYDPEAMQKEFETLRDGISRYTKQKGELEAEINRLTQEKNQLAIKLNEQNTIKAETKAQLESRGKNLELAKAKYEAYEQELTALRAELNIQDLKQEHQEIAAKEKEKAGLESELKGLRDTLKKAQARKEFLSTELSALTESLKESLGTLKEKESSIQDKHTAIKAKVGEVENIETYQKEVLSQITRIEQIYAQAETRKNETEKQYNECYVRLQSAHTSRQGLAERSQKDKESLDKVLQEEQIENIEEAKSHLLSRDEIEKLKKQVKDYQDSLTQIFGAIGNLQKKLGGRSLTAERWEQLQRHKEEKEILCKGLEESKIEIETHVKTMKENLVKKKDLLKSQAELERQLGLLRDLEKLFRGKRFVEFVAAHQLKYVSMEAGKRLREITGGNYGLEVDQNGKFLIRDYKNGGAQRDATTLSGGETFLASLSLALALSDQIQLKGTAPLELFFLDEGFGTLDDNLLEVVMDSLERLHHDRLSVGIISHVDSIKNRVPVKLMVTPAQAGLGGSKVAIEV

SEQ ID NO: 9771 - protein, 583 aa, Desulfitobacterium hafniense
KGGGFLLAEVTPEQVYVPEELNEDHLQLKKMTRNFVEKEIGPKIEALEEQEDGLIRDFMAQAGELGLLGLEVPEELGGMSMDKFSTVVVGEEIPRGASFAVAFMAHTGIGTLPIVYFGTPEQKAKYLPGLATGEKIAAYCLTEPGSGSDALGAKATAVLNAEGTHYLLNGTKQFITNAGFADIFLVYAKVEGKLTNFIVERTMPGLSFGPEEKKMGIKGSSTRQVILEDVAVPVENIVGELGRGHVVAFNILNVGRFKLAAAAIGSAQLALEVTLKYAAERKQFGVPLSSFGAIQTKFAEIAAQTYLAESVVYRTAGLMEEACQDLDVTGDCRKEAGKAIEEYAIECSLNKVLASEVLDLAVDEGVQIHGGYGFIAEYPIERMYRDSRINRLFEGTNEINRLLVPGTLLKRAMSGELPLLAAAKNVSKDLMSAGLGSEEEGLAALLNMTQKAKKLCLMAAGIAAQNLGMELKDNQYVLLGLAEMVLQVYAMESGVLRALKVQDMDVTEDHKLFVEKAATLGAYSAMNIIEQHAKEVICAAEQGDSLSTVLAGMRKLLRRPTVDMIGLRREIAKLVVEKGKYPV

SEQ ID NO: 9772 - protein, 388 aa, Desulfitobacterium hafniense
  unsure (1)..(388): unsure at all Xaa locations
MKEAFIIEAKRTAIGKAGRGSLAHMRPDDLAAFVIQDVLKSAPNLNSADIDDCVIGCSFPEGEQGMNMARVIALRAGLPIDVSGLTINRFCSSGLQAISLAADRIRLGEAHAMLAGGAESMSAVPMGGGKPAPNPYMMEHCPEVYLSMGLTAENVAKKYEITREQQDEFAAASHQKAHAAQVGGRFEEEIVPVLIASGKKGEVWFSKDEGIRADSTVESLGKLKPAFKNGGCVTAGNSSQTSDGAAATLLMSEEKVKELDLKPLALWRGFAVAGVEAELMGIGPIKAIPKVLKQVGLTLEQIDLFELNEAFASQSLAIIKTLGIDPAKVNPNGGAIAFGHPLGCTGAKLTATLLHEMKRRGLKYGMVTMCIGGGMGAAGVYELLXWDT

SEQ ID NO: 9773 - protein, 797 aa, Desulfitobacterium hafniense
MNMAIYKVAVLGSGVMGSTIAAHLANAGIPSILLDIVPPSLLPEEEAAGLTLASPQVRNRFAASNKAKLIKMNPAPLFVPEFADRIEVGNFEDDLPRLQEVDWVIEVVVERLDIKIDLFKKVAQHVRPGTIVTSNTSGISLKSMTEGLPEEFTKSFFGTHFFNPPRYMKLFELIPGPNTDPTVIQEMEEFAERVLGKGVVYAKDTPNFIANRIGVFGLAATIREMQRSGLTIDEVDALTGPVMGRPKSASFRTVDMVGLDTFVHVANNVGDNVPEEKEFFVMPDFIHTMIKNGWLGDKSKQGFYKKVKTAEGKEVLVLDPHTMEYVPKKKVKFACLDKAKNAGGLKDKMKTLVNGKDPGAEFAWNVLKEVLLYAARLAPQIADDLTALDAGMKLGFNWEMGPFETWDALGVKATAERIAAEGGTLPEIVAKLLAEGKDSFYEKTEGGDTLYYAGGEYKEKAASPYSFSLKKAHKQGKKIFGNSGASLVDMGDGVACLEFHSPNNSIGGDIMNMIHKSLAEVEKNYLGMVIGSQGKNFAVGANLMLIMMEAEEGNWDDLDLMVREFQRGTMALKYAKKPVVAAPYGMTLGGGTEVCLHSHAIQPAAETYMGLVELGVGLIPGGGGTKEMALRAMEGILPGVVVAPDYFFAKRFEVVAMAQVSTSAEMARKLGFLRASDRCSMNADHVLLDAKARVLDLARDFRPIIPQKVKAAGPGVCAFLEMALYGMKEGRYISEYDAHLGKKLAYAMTGGDVLAGTLVDEQYLLDLEREVFLSLAGEPKTLDRIRHMLTKNKPLRN

SEQ ID NO: 9774 - protein, 432 aa, Desulfitobacterium hafniense
LKDKLQDHSATVGVIGLGYVGLPLAVEKGKVGFSVIGFDINAARVAKVNAGDNYIADVKDEELLELTQKGMITATTDYAKLAECDVVVICVPTPLTITRDPDISYIQASSEQIAKYLKPGQLVTLESTTYPGTTEEVILPMLEQSGLKVGKDFFLAFSPERVDPGNKRFTTNNTSKVVGGMTPVCLEVAYTFYAQTIVNVVPVSSPAAAELTKVFENTYRAVNIALVNELMLLCDRMGIDIWEVVEAAGTKPFGIQTFWPGPGVGGHCIPIDPFYLTWKAREYDFHTRFIELAGEINVEVSYHVINKVIRALNNENKSLKDAKVLILGVAYKKDIDDVRESPALKIMELLRKNGANIAYHDPYIPVIEPHGGSTVHLENTELTDEALAAADCVLILTDHSVVDYERVAEKAPLIVDTRNATRGVENNREKIV

SEQ ID NO: 9775 - protein, 240 aa, Desulfitobacterium hafniense
NQTIIKAKDVSMCFQMSYDRIQSVKEYIVQTFKGKVRYEEFWALKDINFEIKKGEVVGLVGSNGAGKSTLLKIISGILKPTSGKIQVNGSIVPMLELGSGFDFDLTGRENIFLNGAVLGYSEKFLNKKYDEIVSFSELGKFIEVPLRNYSSGMIARLAFSIAAMVEPDILIVDEILSVGDAAFQRKSGERMKEMMNGGTTVLLVSHSIAQIQELCDSAIWLQNGQQVLSGDADIVCGNYI

SEQ ID NO: 9776 - protein, 289 aa, Desulfitobacterium hafniense
TMKGIILAGGSGTRLYPLTMVTSKQLLPVYDKPMIFYPLSTLMLAGIKDILIISTPQDLPNFERLLGDGANFGINLSYKEQPSPDGLAQAFIIGEEFINGDSCAMILGDNIFYGSGLTKHLRAAAEQKEGATVFGYYVEDPERFGVVEFDEKGKAISVEEKPFNPKSNYAVTGLYFYDSKVCEYAKCIKPSARGELEITDLNRIYLENGSLDVITLGRGYAWLDTGTIDSLTEAAEFVKVLETRQGVKISALEEIAYHNGWITKKKLLESAQKYGKAAYGEHLKKVAEG

SEQ ID NO: 9777 - protein, 421 aa, Desulfitobacterium hafniense
QRSKEAFARANGVLPGGVNSPVRAFKSVGREPIFIAKGQGARLWDIDGNSYLDYVLSWGPLILGHAHPVVVGAIKAAAERGTSYGAPTEIETECAEEVIKAFPSMEMVRMVSSGTEATMSALRLARGVTGRNKIIKFEGCYHGHGDSLLIKAGSGALTFGVPTSPGVPSSVASQTIVAQYNDLEGLKEIFKECGEDIAAVILEPVTGNMGVVLPQPGFLAGLRTLTQDYGSLLIFDEVMTGFRVSYGGAQGRYQIDPDLTCLGKVIGGGLPVAAYGGKRKYMEQVAPSGPIYQAGTLSGNPLAMAAGLATLKLLQQEGVYEGLEKKTARLAEGLQSIAQELGFPIWVNSVGAMFSAFFTDQPVIDFKSACSSDVERFGSFFRGMLERGIYLAPSQYEAVFLSAAHTDADIDYTLEQARDVL

SEQ ID NO: 9778 - protein, 318 aa, Desulfitobacterium hafniense
RPRRLRSSAAIRRMVREHHVRIEDLIYPMFVTFGEKKKIPVSSMPGVYNYSLDEYIVALKDVVEAGIPAVLLFGLPESKDAAGTGAYDQHGIIQEAVRLTKKHYPDLYVITDVCLCEYTDHGHCGVIQDGRVLNDPTLKLLAQTAVSHAEAGADMVAPSDMMDGRVGAIREALDEAGYTDIPIMSYAAKFASAFYGPFREAAGSAPQFGDRRTYQMDPPNGNEAMIETALDVEEGADMLIVKPALAYGDITYRTKEQFGLPIVAYNVSGEYAMVKAAAEKGWIDEKRVVMESLVSMKRAGADLIITYHALDAARWIKE

SEQ ID NO: 9779 - protein, 300 aa, Desulfitobacterium hafniense
SVKIGTRDSQLALWQAEWVKRKLEEYYPEREFVLVPMKTKGDKILDVPLAKIGDKGLFTKELEVGLLNGEIDCAVHSLKDLPTVLPPGLEIAAFCEREEPRDVFLSKDGTPLGSLPAGSIIGTSSLRRKAQLQNYRSDLSFADLRGNLQTRWRKLQESDMAGIVLAAAGVKRLGWEDRITEYISEEIMLSAVGQGAIAVEIAAQRADVREMLDLLNHGDTERAVKAERALLYRLEGGCQIPIGAWAVTEQQQIVLKGMVASLDGQRILKVTLSGEHPEELGRQAADLLIAQGALEILQEI

SEQ ID NO: 9780 - protein, 442 aa, Desulfitobacterium hafniense
  unsure (1)..(442): unsure at all Xaa locations
VFPITIGLNHKTAPVEIREKVSFHPSEINKALMELNELSALNGIVLLSTPAIVWEIYAAXSQKXXELGVSVIKKFLGPXIWEASRKKILXSIXLYXXILFMKFRXRHLFRWSXXPXPGXXHGEMXXEXSXXXXXXXXXXXXXAEXXYEKSSQLNLSNKIIHAIFQNALAVGKRVRSETQIDQHPTSVSYTAVELAKQTFGDVQGKSILILGAGEMSALTAKHLVASGADTVLVSNRSMQRAQALAEEFSGRAIPYEELDTALAEADIVISATAAAHFVIKPERMRRVMEQRRQRALLLIDIAVPRDIHPNVGELEGVTLFDIDDLRGVVDSHQKAREEAALQAGRILEEEMGRFVKWHNSLYVVPTIVALQRRGEEVREIMLKSALNKLGPIDEKQEKIIRSMANSIVTHLLHAPIANLKEAANTSQGHLYTEILQNLFDLD

SEQ ID NO: 9781 - protein, 449 aa, Desulfitobacterium hafniense
LNLGHKLLQYEAQKLISFHTPGHKGKAEFFTDLHFPDQDLTELPGLDMLHSPAGVIAQAQARAAAVYQSDASFYLINGATVGNQGMFMALAGTGKRGKDLQLPKVLVERQSHRSVFSALVLSGCEPEYIPSVVHPEFGLPLGLKSIAEVDLGEFLGVHLTYPGYYGTLPDLAMIAAQRDRQAVQVSILVDQAHGSHYLSPLFPKGALAYGADLVLCSTHKTLSALTQAAMLHVQGSRIPLSALKEALELLQSSSPSYLLMASLERAVEHALESRRWELLHEAVQELHHRVGGSLRILNPQDVGTYGIAGLDWTKIMINTQRLGVAAPRCVEHLRKSYGIDPELWDDKNILFLLGIGNTPEEVEILTKGLLSLASLNKDVVASPEEMVFEIPLPPVRLTPRQAYFARKRKIPLAESVGHIVGESISPYPPGIPWIVMGEEMTPEILELLT

SEQ ID NO: 9782 - protein, 420 aa, Desulfitobacterium hafniense
LNELKIINPIQKALAAQGYSEATPIQAEAIPHLLEGLDLLGCAQTGTGKTAAFAIPILQSLAMGQGLLKGKRQIRALVLAPTRELATQIAESFTAYGVNLPLRTLVIFGGVGQAPQTRKLEKGIDILVATPGRLLDLINQGFIDLSHVEHFVLDETDQMLDMGMLHDVKRIITYLPRERQNMLFSATMPVEIEKLADTILKGPVKIAMTPEFSPLDIIEQEVYFVDKANKAALLTYWLKNNEYDSVLVFSRTKHGADKIVKELNKKGFTAVAIHGNKSQANREQALHAFKKRKTRILVATDIAARGLDIQELSHVINYNLPEVPETYIHRIGRTGRAGLGGKAITFCDFEEKPLLRDIQKRIGKTLPEVKEHPYPLVNTVIVPKAKTSQQAAAARPQKPATAKTAAYSQQGAHRAKPNPR

SEQ ID NO: 9783 - protein, 720 aa, Desulfitobacterium hafniense
  unsure (1)..(720): unsure at all Xaa locations
SCCTVNCTSRCHLKGHVQGGKIVAVTPGLLPGRDDYPNACLRGMSYAQRLQDPKERVLYPMKRVGERGEGKFEQITWDEAYDIIAEKLTETKENYGTQAASFFTMSGNLAKLAWESTTRLGACFGGTTYITEGLMGDHGASMGMRLVFGQERGGHDTRDYLNSKLVIIWGRNLADTHTSELRYIIKARENGAKIIVIDPRQSSTAAVADQWVPIRPQTDPALALGMINYLISHNLHDTAWLKANSCAPLLVRNDNGQYLRLGEQYAVWDENSRTIVPADTPNINPALAGEYTSAEGLKCHPSFVDLVDEAAKYTIKATAEICGLEEAVVEQLAHEYATMKPAGIRMGQGMQRVYHSFSPFRTVATLAAVAGYIGVSGGGASHMGGTSSINPIPGVTVPDFNFKEWTDIGGKPITERKSAHIYDMAEKGEIKFLWIGVSNFVNQSPDANRVINKVLPNIPFIVHVDPFWTWTGKYADLVLPGKTHWEVWDILVRSPWVMLDQPAIPTMGESKSDCEIASGVAERLGFGHLWNKTDEEWVRTFMTSEHPAFASFNWDKFVGEGIFTRSDGIFDPVYSFKDQKYKTPTGKFEFYTERLKELGEHVPTYKPMLENPRGELGKKFPLVCINYHDRLNVHTQHMLYPALRIVQSEPEIQINPVDAAARGITHGDKVKVFNDRGHCVVKAFVTEGIVPGVTAIASGWSPDYYIKGICKTXPTXPLIR

SEQ ID NO: 9784 - protein, 183 aa, Desulfitobacterium hafniense
QYGMLIDTTRCVGCQTCVIGCKINHKVPGDAHWSSVEMIGSRIMYQPAGNYPNPVLAFRPRLCNHCADPACVKNCPTGAMHKDDNGLVSVNQDVCIGCKYCVWTCPYDAPEFDTEKKVMSKCTFCMELIAKGEKPYCVESCPGEARIFGVISDPDSEISRLIAAKHAQPFLPKFGTGPSVYYV

SEQ ID NO: 9785 - protein, 219 aa, Desulfitobacterium hafniense
LLAHVVEKIGPARIALASSLSIEDQVLTQMLLKIDARARIFFIDTGRNFQQTYDLMEETMSRYEFHYEVYAPENSELEPFLAEYGPNAFYDKVELRQKCCELRKVRSLQRVLSTVDGWICGLRKEQSPTRQEIGLLEWDSRHAIYKVNPLAAWSEEQVWAYIRRENIPYSSLYNKGFRSIGCQPCTRAVAPGADVRSGRWWWEDPSKKECGLHPSLNPP

SEQ ID NO: 9786 - protein, 284 aa, Desulfitobacterium hafniense
IKVEGAFYKYPGAPRDVIQDISFTVRKGEIFGFLGPSGAGKSTLQKILTGVLRDYQGRVQVLGTEMKHRKSSFYERIGVDFEFPNFYGKFTALENLQYFASLYHQKTLDPLTLLEQVGLQHDAHKRVASYSKGMKMRLGFVRCLLHNPQLLFLDEPTSGLDPANARILKDMMLEQKAGGKTIILTTHNMHDAGELCDRVAFIVDGKIRALNTPQAFQVDRSGSAEVNYSYRRDGRTVDRRSTLTQLGQDDEFVKALQNGSLLRIHSKERTLEEVFIALTGRQLQ

SEQ ID NO: 9787 - protein, 276 aa, Desulfitobacterium hafniense
SIQLLNKARQGHYAVPAFNFHNLEIMQAIIKTAEKQQSPVILQITPTYLEKIGDIAATAMARAAAKEAKVPVALHLDHSNSLSWIKWALAHGFTSVMIDASTLPLNENIAYARQTVEWAHAHGAAVEAELGHIGGIEDGQETGTNPNMGLADPVEAVKLVTESGIDAFAPAVGTAHGLYKLPPNINFSLIDTLSSLVNVPLVLHGGSGIPDDMIRKAIEKGIAKVNIGTELKVTWAKAMTEALITEQEPWKTALKVHEEVGQVVAHKISLCGSNGK

SEQ ID NO: 9788 - protein, 451 aa, Desulfitobacterium hafniense
VINPATGKVFCEIGYGEVDDALSAVDAADRAFGAWSKTSVRERADILNRTADLLRQRADHIGLILAAESGKPVPQAVGEVKFSAEYFQWFAEEIRRPYGQSIPSDAANKRHHVYTQPAGVALCLSPWNFPVSIQARKLAPALAAGCTVVARGSEVAPLSLIELFKCLQDAGIPKGVANSIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIREAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVA

SEQ ID NO: 9789 - protein, 336 aa, Desulfitobacterium hafniense
MSVRVAINGFGRIGRLTLRAILKQSLPVEVVAINDLGSPDLLAHLFKYDSLHGILPNSVEIDGDTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSMIPTTTGAAKAVTLVIPELAGKMNGLAVRVPTPNVSLVDFVANLTKSTSKEGVNAALREAAEGKLKGYLEYTELPLVSRDFNGNSASSIVDGLSTMIIGERMVKVLAWYDNEWGYSNRIVDLVKLIVMKGL

SEQ ID NO: 9790 - protein, 636 aa, Desulfitobacterium hafniense
NLEALLEEDRQFIPSEEFHKNALIQSADIYEQGQSLGFWEEQAKQLSWLSPWEKTLEWNPPFAQWFVGGKLNASANCLDRHLQDWHRNKAAIIFEGENGDSQVLTYQDLHREVSKFANVLKANGVNKGDRVTIYLPMIPEAVISMLACARIGAPHSVVFGGFSSEALRDRVIDAQAKAVITSDGSFRRGNTIPLKDNTDIALDGVDCVEHVFVIQRTKQTVQMKEERDLWYHEEMAKASPVCPAEPMDAEDMLFILYTSGTTGKPKGVVHTTGGYMVGVSTTHRWVFDLKEEDVYWCTADVGWITGHSYIVYGPLANGATVLMYEGSPDYPNRDRFWEIVEKYKVTILYTAPTAIRTFMKWGPQYPQSRDLSSLRLLGSVGEPINPEAWMWYYKYIGGERCPIVDTWWQTETGMIMMTPLPGITSLKPGSCTVPFPGVRIEVVDSAGHPVPKGGGGYLAIKEPWPAMLRNIYGDPARFERTYFGNWPGVYFPGDGAKWDKDGYFWILGRVDDVINVSGHRIGTMEVESALVDHPSVAEAAVIGKNHEVKGQALACFVTLKEGIEITPDLEDELKKHVAKKIGALARPDDIFFTAELPKTRSGKIMRRLLRDIAEGRAIGDTTTLADASVVNTLKAN

SEQ ID NO: 9791 - protein, 300 aa, Desulfitobacterium hafniense
KDLLHIEDLPAKEIQLILNTAKPMKEIMSRAVKKLPTFRGKSVYNLFFESSTRTRTSFETAAKILGADTSSLAVAQSSLNKGETLLDTVRTLQAMKPDLVVIRHSSSGAAQFLAKELKAGVINAGDGQHEHPTQALLDLYTMQERLGSVEGRKILLVGDILHSRVARSNVWALKNLGAEVVLVGPPTLLPPEIKSWGVKTTFNLDEELPGSDVIMALRLQLERQQSGLLPSLREYSQLYGITAERVKKTGKQTLIMHPGPVNRGVEIESSIANSSQSVIEEQVTNGVAVRMAIMYLLLGG

SEQ ID NO: 9792 - protein, 358 aa, Desulfitobacterium hafniense
LVLQDGTAFEGERFGAWPEDKEQKVQAGEVVFNTSMSGYQEMITDLSYTGQILVLTHPQIGNYGWHDEENEADKILLRGLVVRELSQGEGSAHGDRSLEEFCRLHNIWGLKGIDTRALTRHIRNQGTLPGVFAQTLEQGKKYWQEYADISSAAEKEPHWVYQATVKESYEIPGSGPYVAVLDCGAKRNILRALQQRGLRIRVFPAWSSAEEILASSPKGVFISNGPGDPSGLPELIETVRTLLPQLPIMGICLGHQILALAAGGKTYKLPFGHRGGNHPVQDLRTGQTTMTAQNHGYAVAEESMAGTGFQIILRNLNDGTVEGMEHTQYPVYSVQYHPEGAPGPEENGMLFEGFFAAI

SEQ ID NO: 9793 - protein, 1043 aa, Desulfitobacterium hafniense
NKVLVIGSGPIVIGQAAEFDYAGTQACRALQEEGVEVVLVNSNPATIMTDQEVADRIYIEPLTVEFLERIIERERPDGIIATMGGQTGLNLAFQLAEKGILQRCGVQLMGTSLDSITKAEDREHFRSLMRELGEPVPPSVIVSDLEEALSFGEEIGYPVIVRPAYTLGGTGGGIAHNREQLKEIAKSGLQASLIDQILVEKSVAGWKEIEYEVLRDSQGNCITICNMENMDPVGVHTGDSMVVAPCQTLTDREVQALRTSSRKIVAALGIEGGCNVQYALHPERLEYVVIEVNPRLSRSSALASKATGYPIAKVAAKIALGYTLPELTNAVTGKTSACFEPALDYVVVKIPRWPFDKFSDADRRLGTQMKATGEVMGLGRNLETALQKAVRSLEIKAFGLLLPEFQELTDEEILERCQKPDDQLLFILAEGLRRGLSLEQIQKASSWNPYFLTAIERIVRMSETLQFSPWNGELLLKAKRMGFADRELARLWQTTEKEIYAYRQEKGLQPVFKMVDTCAGEFEALTPYFYSSYDQEDEGIPTQRRKVVVLGSGPIRIGQGIEFDYCSVHSVLALKKAGVETIIINNNPETVSTDFDTADRLYFEPLTLEDVSAVLEREQPEGVIVQFGGQTAIGLAKPLAERGYNILGTGIEDIDRAEERGQFDEVLHTIGAKRPKGGQASSLAEAVEVAARIGYPLMIRPSFVLGGRAMEIVYSASELENVVNRAMADFPGQELWMDQYLVGKEVEVDAISDGKNVSLPGIMEHLERAGVHSGDSIAVYPPQTLSEPLIQRITLLTTEIARALNVIGLLNIQYVIFQDEVYVIEVNPRSSRTVPFISKVTGLSIVDYATEVILGKTLTELELPLGLWPLPERVAVKVPVFSFSKLHRVEPSLGPEMKSTGEVMGVDRTYEKALYKALLAGGFNMSAHGSLLVTLADRDKAEGIPLVKKFADLGFRILATEGTAKTLREEGIQVAPVAKLHQGSTEITDAIRQGVIQCVLNTTTHNKKQESDGFAIRRTAVEQGIPCFTSLDTASAWVHVLMS

SEQ ID NO: 9794 - protein, 767 aa, Desulfitobacterium hafniense
SKERELPLLPLRGILVFPYMVIHLDVGRERSMAAIEQAMMDERLILLSAQKETEIDSPDPDDIHTIGTLAEIKQLLKLPGGTMRVLVEGKSRGKILEFITDEPYFKVRVEEVEEGVKENTPEIDALTHGVIHQFEEYAKLSKKVPQETLGTVLGVNDSGRLADIVASHLNLKLGDKQAILESLEVAQRLERLTEIIMRENEILELERRIGLRVRKQMEKTQKEYYLREQMKAIQKELGDKDEKQAEVEEYREKVAQAKLPEEVAERALKEIDRLEKMPQASSEGTVVRTYLDWILALPWTTMSKDKTDIKRAEKILNDDHYGLEKIKERILEFLAIRKLTPKMKSPIICFVGPPGVGKTSLAKSVARALDRKFVRMSLGGVRDEAEIRGHRRTYIGALPGRIIQGMRTAGTANPVFLLDEIDKMASDFRGDPAAALLEVLDPEQNFSFSDHYLDLPYDLSHTLFIMTANSLYSIPRPLLDRMEVISLSGYTEDEKVNIAKRYLVPKQMKAHGLKASQLEIGDKVILKLVQGYTRESGVRNLERQIANLCRKVATRVVKKEWKTAELRPEMLEEFLGSPRYQFEKARIKPEIGAATGLAYTEVGGDVLTIEVIPLPGKGQLTLTGKLGDVMKESAYAGRTFVRSHSRELGIPDDFYEKTDLHIHVPEGAIPKDGPSAGITMATAMASALAKRAVPSDLAMTGEITLRGNVLPIGGVKEKVLAAHRAGIKQVILPEQNRKDLEEVPENVRKELEFHFVSRMEEVIKIAL

SEQ ID NO: 9795 - protein, 865 aa, Desulfitobacterium hafniense
QEETLKELNVNPATGLTSQEVQARLEQYGTNKLKGKPKKSLIALFFAQLKDMLIYVLIGAALITFFIGEYVDSIIILLVVVLNAAIGVFQEFKAEKAIEALQQMTTPKTLVRRNGEVLEIQSEELVPGDIVLIDAGRFIPADLRLIESANLQIEESALTGESVPTEKVAQEVLQDPKTPLGDQVNMAFMSTLATYGRGEGVVVGTAMETEIGKIAKILDEEIDEMTPLQKRMEELGKVLGYLAIGICVLIFVISFFQKRDLFEMFLTAISLAVAAIPEGLPAIVAIVLALGVTRMSKINAIVKKLPAVETLGSVNIICSDKTGTLTQNQMTVVKYYTLNNLQEVPREGSDFDASIQAKELMKTFVLCSDATYEQGQGTGDPTEIALVVLGERFNLGRKTLHAEYKRVGENPFDSDRKLMSTLNEENTGYRVHTKGAIDNLLKLSTTALVDGKVVLLTEEMKQEYLRVADEMSDAALRVLGAAYKDVDRVISPQEMEQALTLIGMVGMIDPPRLEVRDSIRDAKLAGITPVMITGDHKNTAVAIAKELGIAESIEESMTGAEIDQLSDEEFSRRIGSLRVFARVSPEHKVKIVKAFKSHGNIVSMTGDGVNDAPSLKNADIGVAMGITGTDVSKGAADMILTDDNFTTIVHAIEEGRNIYNNIKKSVIFLLSCNLGEIVAIFFSVLFFWPVPLLATQLLWINLITDTLPAIALGVDPGDKEVMRQKPRNPKESFFAHGSGIRAIIGGVLIGALTLVAFYIGLREYGYTLGSTDIPADILTYARTMAFVVLAASQLFYSLSMRHATKSIFAVGIFSNRYLIAAIIVGLLLQLMVISVPFLSSAFKLQMLSLRDWGIVLCLAVIPLVL

SEQ ID NO: 9796 - protein, 749 aa, Desulfitobacterium hafniense
VIRTSVWSPPGCHPVGCGLKLYVNQAGILEKIEGDENDPITKGRLCVRCLDLKEVIYNPSRILYPMKRHPQDRGKADKWERTTWEEAYAMIKQKRDFVIKNYGVEAIAAYSGTGRNGGIMVQEFAHEVLGTPNACYTQSGYACYTPRAAATAAITGCYYPEIDYGGGVEGTYDNPDYKIPEVIVLWGKEPLPSNGDGLFGHALIDLMKRGTQIISVDPRVNWLATRSAVHLRLRPGTDAAMGMAWLNVIINEELYDRDFVENWCYGFDELKERVADMTPEKAAEICQVDGEIIRKAARMYAVAAQAGIAWGLAIDQNQNGTQAAQCILSLIAITGNLDKPGGQLVGEAKPAVPEAEDGMTSTYAATGHQLDGWVALGEELRNKTIGMQEYPLYVNSIRNAHADLMLDCLMTDKPYRIVMAMIQSTNIIAPTNSAESKKWHQALKRLDFIFATDVFMTPTIQACADLFLPLKCAPEHDSINYTHYSGSQIHFGITNKAIEVGQCKSDVEIAVELGKYLGREQYVTRHTDEKAWLNNRRAQRNLMGGGKEDFDTIREKVHIQQGRKYYKYKTGHLRPDRQTGFLTTTGRVELYSYMFEGVGSDPLPYYQEPPFSPYSTPELAKEYPFILTTGARTYAYFHSEHRQVPLLRELNPNPLLEVNPEDAAALGLLEGQWVEISNQFGEAKFKAKVTPTVRQGTVMAQHGWWFPEQEADEPNLSGVWHSNVNTLIPNHYNGSLGFGAPYKCMICKI

SEQ ID NO: 9797 - protein, 754 aa, Desulfitobacterium hafniense
  unsure (1)..(754): unsure at all Xaa locations
RXXCKERMKQMAVKYKKGTEKDYTVRTCAWSAPGCHPTGCGLLMHVKDGRLVEVEGDPEHPVSQGRVCVRCLSLPEAVYHPDRILYPMKRAGKKGGDKWERITWDEAYDLIEEKVRYYQKQYGPESIAMMGGTGREATFYFPALSYAVLQTPNNVGVLSGLSCYGPRCAVTEYVLGAGYPEIDYAAYFADRYDNPEFQLPEYIIIWGKSPLESNSDGFFGHAIVDMMKRGTKIIAVDPRVTWLTSRAEYHLQLRPGTDAALALGMLNVIINEDLYDHEFVEKWTFGLDALRERVQEYSPRRVADICWIKEETIVQAARAFAQAGNSSIQWGVALDMNWNGIQAIQGVLYLMTLTGNLDVPGGNTLAEPASFMGKWRYDTHKQIPEEIYENRIGNKEFPFFNYGLMACSPDNTLEYFEQQQPYPIKMVWSNSQNPLANAAPVPKRWYEAFKKIEFWVCQELFMTPTVAAYADIVLPIATFAEHDGVVIPHFGRNSAFLGAVNQCIERVGECKSDLEICFELGKRLNPQAWPWQTVSDFFTEQIEEKTGLDYPGLKDKVVQQQHYVYRKYEQGLLRSDGEPGFETLTGLIELKATIFESWGEDPLPYFQEPPFSPYRTPELFAQYPLVLTTGGRKFTSFHSEHRQIPSLRQITPWPTVEIHPDTAAGLGIQDGDWVAIENHLGQCRMKALVQPTVHPKVVHALHGWWYPEQAGTEPNLFGTFKSNINMLMPHKKIGKLGLGANYKSNLCKVYKVSG

SEQ ID NO: 9798 - protein, 424 aa, Desulfitobacterium hafniense
NNMLHKMSDLDLIVSHGRVAKIVGLMIESDGPRVSVGEYCRIHTQQGKEIPAEVVGFRNSTTLLMPLAELEGIAPGDRVVPQQHKLEVGVGQALLGRILDGLGRPLDGRPMVTQRDYPLQNAPPSAFLRPRIRDPLSVGVRTVDGILTIGRGQRIGIFAGSGVGKSTLLGMMARNTTAGVNVIALVGERGRELRDFIEKDLGEEGLERSVLVVATSDQPALVRLKAAFTATAIAEYFRDQGQDVLLMMDSVTRFAMAQREVGLTAGEPPATRGYPPSVFAMLPKLLERSGMSEIGSITGIYTVLVDGDDHNEPIADTVRGILDGHIVLTRELAMQNHYPAIDTLQSVSRVMNDIIAPEHKELAGKLREHLAVYHDAKDLIDIGAYVTGSNPRIDAAIRHIEGINGFLRQDVEEKVSFDQMLRQL

SEQ ID NO: 9799 - protein, 260 aa, Desulfitobacterium hafniense
KKISFIGAGNMAEAIIKGLMVTGSYEIRVTNRSNQAKLAQMKEDYGVIPVSFREAVKDSEIILLAVKPKDVGEALAQIREGISSNQLLISVAAGIPLALLEKHLPHCPIIRAMPNTSSAVLHSMTGLVKGQGVNEAKQRDVEDIFGAVGKYIWITEEQINPLIAMSGSGPAYFYLFTEALVKAGVDMGFSQEVAENLAKETLMGAAKMLAQSGKSPGELRVAVTSPKGTTQEALEVFREQGLEELVAQAAKACKHRAQAM

SEQ ID NO: 9800 - protein, 410 aa, Desulfitobacterium hafniense
ELITIGQKAKDAARKLAYAGTAAKNKALLAMAEALLNHEQKILEANRKDVEAAIQKGTKKSLVNRLALTSEGIRQMSDALKEVVNLGDPVGEGEFWTRPNGLRIQRTRVPLGVVAMIYEARPNVTVDAAALCLKSGNAVILRGGSEAIESNKILSKVIAGAAESQGMPTACIQLLENTNRQWVQQLMKMNGYVDVIIPRGGAGLIETVVKEATVPVIETGTGVCHAYVDGEADLAKGVSIVFNAKTQKPGVCNALEAVLVNEAVAQEFLPLLGEKFRDYGVEIRGCEKTCAILPYAAKAKEEDWGIEHLDLIISAKVVQGVDEAMDHIYQYGTKHSETIITENYTTAQRFLNEVDAAAVYVNASTRFTDGGRFGFGAEIGISTQKLHARGPMGLQALTTMKYMVYGEDHI

SEQ ID NO: 9801 - protein, 724 aa, Desulfitobacterium hafniense
TGPGCHNGCGVLCYTKDGKLEKIEGDPNFSYNQGRLCLRCINMVEQIYNNDRLKWPLMRVGKKGENKWKRVSWDEAYDWIEAKHKEISQKTGPQGIVSLVGTGRNCMWQPAMITRAVFGSPNLSFGFLSADSCYQPRMTANLIKQGDCWVLDASQFHPLRYDNPEWKVPEVVVVWGNEPLASNGDGFVGHWLVDLMKLGTKLIVIDPALTWLAAKADLWLKIRPGTDCALALGFLNVIINEDLYDHDFVEQWTYGFDELVERVQEYSVEKAAEITWIPKEQITEAARMYAKAKPAGIQWGLAIDMQIAGMEASAAISDMVAITGNLDVPGGNILLRYAYNSSKKYGCGLECISEEMLQKRIGTYESAIHESGYTPFIPPDKLLETMESGKPYPVQMLWVHGSNPIANMAGEAPRVYAAWKNVPYTVVVDYYMTPTAVAFADLVLPAAMSVERDSYRSWWQPLRAITKAAEPYFESKADEQIVLDLGKRINPEYFNKYKDVRDLLTDMLYDDGNGVDYDFEALTHKVYDWWDWNHTYKKYEKGLLRQDGQPGFVTATGLYEVSSPLFDVWGFDPLPHHMEPYEGPYSTPELMKEYPFILTTGHRQIGLFHSEHRQLPTMREVHPQPEMDINPETAQKLGLQEGDWAWIENKRGKCKQQVKFNYGLDPKVVRARHGWWFPEKEGAEPVLFGVFDSNSNNLTTMGVHGPTHYGAPYKSTICKVYKVE

SEQ ID NO: 9802 - protein, 284 aa, Desulfitobacterium hafniense
IMTAMVTPFNDKMEVNYPEAEKLANYLIEHGNDGIVVCGTTGESPTVSAEEKIELFKTVKKAVGSRATVIAGIGSNTTDGSINLARQAEKTGVDGLMAVVPYYNKPSQEGLYQHFRAIAEAISLPLMVYNIPGRTSINLLPETVLRLSEIPNITSIKEAAGSMDQVSEMRRILPEDFLIYSGDDSLTLPMLSLGCDGIISVAAHVVGDEIKQLVDAWFNGEPQTALQWHLKLMPMFKGVFVTTNPVPVKYLLKKAGINAGGVKLPLVCAAPEEEAFLDDLYQKI

SEQ ID NO: 9803 - protein, 406 aa, Desulfitobacterium hafniense
VRVLVQKFGGTSVSSAERRAQVAAKVSEAVREGYSPVVVVSAIGRSGDPYATDTFINLVNGITLESPKREMDLLMSCGEIISGVVLTSTLKSMGLEAILLTGGQAGIITNDCYGDARIIRVEPKGILDHLSEGRVVVVTGFQGVTEDGQVTTLGRGGSDTTASALGVALNAEAIDIYTDVEGIMTADPRIVEDARILDVVTYNEICHLAHQGAKVIHPRAVEIAMQRNIPIWIKCTFSDARGTLVTSIQPDMGAGTDITGDRTITGIAHTPNVTQIQVPTHDVADVLQVDKQIFKGMALADISVDFISVQPESVLYTVPDEIAEKAMKILDNLGFKPTAVPGCAKVSIVGAGIAGVPGVMANMVEALSDAGVRILQSADSHTTIWVLVNKEDMVPAVQALHKKFLL

SEQ ID NO: 9804 - protein, 326 aa, Desulfitobacterium hafniense
VAIVGATGAVGQEFLKILVERNFPVEELRLLATKRSAGKKILWQGREIEVQETTHDSFKGIDIALFAGGSSSTEFAPSAVKSGAVVIDNSSAYRLDPEVPLVVPEVNPEDVKWHKGIIANPNCSTIIMAVALKPIFDLAGIKRVVVSTYQAVSGAGREGIEELEDQVRNWVQGEEVKSQTFPYQIAFNLIPRIDVFQEGDYTKEEWKMVKETQKIFHVDTMPITATTVRVPVLRSHSESINIETERSVGLDEVKAAFQKAPGVIVEDNPAEDRYPMPWFTSDTDEVYIGRIRKDFSIENGINLWVVGDQIRKGAATNTIQIAELLL

SEQ ID NO: 9805 - protein, 264 aa, Desulfitobacterium hafniense
ILVFVSGAGGKMGREVVRTILDQEDMQLVGASDARQQGRDIGELLAMAPLGIEITGPLEVAHLKETRADIMVDFTNPQSVLKNAKCALAAGVVPVLGTTGLDEADISEIRDLVDQTKVGAFIAPNFAIGAILMMRFAQEAAKYFPHVEIIELHHDQKLDAPSGTALKTVEWISEVRKPLVQGHPNEYEKIKGSRGGDVDGIHIHSVRLPGFIAHQEVIFGGLGQALTIRHDALSRETYMPGIMLAVRKASQLSNLVIGLENFLE

SEQ ID NO: 9806 - protein, 408 aa, Desulfitobacterium hafniense
MYQKTVLPNGVRIITEEIDYVRSVAVGIWVGAGSRDEREGYEGISHFIEHMFFKGTKNRTARDIAESLEAVGGQLNAFTTKEYTCYYAKVLDEDMDLAMDVLNDMFFESLFDENEIEKEKKVVIEEIKMYEDSPDELIHDLFSDHVWNDHPLGRPILGTEESVKGLSREKILDFMDHHYAPDNLVIAVAGKIKHDEVLKKLAPLYGEFKRGGRRILEETPKGQQVQEMILKDTEQMHLILGVPGLGQEDEDLYPMHILNNILGGGLSSRLFQEIREQRGMAYTVFSYHSTYVDTGLFAIYAGTTPSNSQEVVECVLAEILDIKKNGISQSELQRTKSQIKGGLYLGLESASSRMSRLGKTELTYNRVISPEEVVEKLERVTVEDTKRVINRLWKRDKISLLMLGPAGN

SEQ ID NO: 9807 - protein, 522 aa, Desulfitobacterium hafniense
IADRSVDTARLVSLLLIILSLYLGNLLLNLLNGTMTLRISQKLVYTLRQEFFAKMQRLPLGFYDTRSHGDTMSRITNDMDNISSTIAQTTTQLIASILTLAGSLAVMLSLNVPLTLVVLLCVPLVFVLTKTIATRSRAYFLAQQGSLGALNGVIEENILGLKMVKAFNRQEEVLRQFQEINQGLRASSYKAQVWSGCMMPLMNVINNLVFAAVAICGGILTLSQGLAVGTVVSFLTYSKQFAHPLNSVAGMFNTIQSALAGAERVFEILDYEEERADEENALEMEHPAGAVTFDEVSFSYDKTQPILKEVSFQVNPGEVVALVGETGAGKTTIVNLLTRFYDADSGEIRIDGVPVTRIKRASLRRCFSVVLQDTSLFSGTIMDNIRYGKEDATEEEVIRAAQIAHAHGFITKLPQGYGTRVSAANDNLSQGQKQLISIARALLCDSPILILDEATSSVDTKTEKDIQKALVSLMQNRTSFLIAHRLSTIRDADRIMVIGEGQILESGNHQSLMEKQGRYYEM

SEQ ID NO: 9808 - protein, 561 aa, Desulfitobacterium hafniense
YNYLGKYKIPFLIAVLCVTLEAVCDLLGPTLMARIINQGIEKGSLAEVYYWGALMLAVTLLGACFAVTRSNLSSYVSQRMGGDLRADLFGKIISFAEQSGDKIDGGSLITRMTNDTSQIVQFVNGMMRIFLKAPLTGIGSVILASWLNFRLSLIIYGVVAVVSLLIYASMKFSYPRFYQLQKAVDRVNLKVQEYLIGIRLVKAFGTYEQETEKFAEANRELMQKGISSQMVITVISPFLTLVVGTGTAAVIFLGSRLFMLDLADLGDMMAFTIYMAQILTSLIMLTTVFTTFVRTKASMERIGEVLDCAEDFPPSGAGRKLQGKITFDKVTFAYPNGSGVPAIRELSFTVNPGGSLAIIGPTGSGKSTIAWLLLRFYDADRGRIMLDDYPIQELGADEIRHNIAIVPQKPLLFSGTVAENLRWGDKQASPEELRQAAEKAQADFIGQMAEGYDSLLGSEGVNLSGGQKQRLSLARAILKKAPILILDDATSALDAVTEAKVRENLKHNDYRQTLVMITQRCGTAMSADQILVMENGRPAGLGSHEELMRTCAIYQDIYHTQ

SEQ ID NO: 9809 - protein, 1116 aa, Desulfitobacterium hafniense
  unsure (1)..(1116): unsure at all Xaa locations
FARSDLQAIVAPVLIALAAVLLRGFLSRMMESYSKVVAAKVKNKIRLLVFDKILHLGPGYLSDKRSGKVQSLVLDGIESLEPFLVNYIPQIITISISGLAIGIYLTSLDVVTGLIIIVSMLLCVIVPYLTVPLVSRSIVTYWRSYATLNAQYIDAVQGMSTLMAFKASRAKGRELAENAQGFYVQAIRNTTFSLIDSGLMMLLTSVASAITVAIAAYRAESGIFPVMAISTFLFLAAECARPMSELNGHWHNSFLGLSVAEELFEIVDEELKITEKEHADTVSLDGPLPAVQFQDVTFAYNEEAKPALAGINLEIKGGQTIAVVGKSGSGKSTMVNLLFRFYEPTQGSILMNGINIKDYGISYLQSKIAVVFQDTYLFYGTVFENIRMSHTDAADDKVIAAAKAAGAHEFIMELPQGYATVVGERGVNLSGGERQRLAIARAILKDAPLLILDEATSSVDARNEALIQNTLDSLTKGRTTIIIAHRLSTVQNADKIVVLDHGELAEAGTHEELLLKGGIYADLVRAQRGDENNAXRGKQAXNDAHXKYPPPYRSMKPYSLEMIATIVTTFLKHIGTIGSAGIVAYMAALAMEGRLLPEFRVLFSWLCVCIVLRAVMYYGEMWFGHDVAYRVLRDFRIKLYDKMETISPAFVLKKRSGQIGATLMSDVEILEWFLAHTFGSFLVAVAITIVLLVLLAKIHILLSLLMMIFSILTIWTPFLLQKKADEQGRQVREKAAEANAVTIEGIQGLRELLTLNYLERYKGRNKESMQSLYDAQLTYGKRAGTESALMQIFVGVFTVVVMAVTAVFVSQNVLAFEVYPMVVMLSALLFSPIIEVCGVARNLGNVFAAANRIQTVFDTAPVVKDDGKDMDCSSLQHRVVFEHVSFRYDDDLDKVLDNVSFAIEPGQTVALVGPSGAGKSTCINLLLRYWDAEGGSIRIGGVDIRHMSLDNLRDLTAAVLQDVFLFNVSIRENIRLGRPEATDGEIEEAAKAAYAHDFIMELPNGYDTIAGERGFCLSGGQRQRIAIARAVLKNPPILVLDEAVSSLDSENEKFIQQALHDKLGDRTTVVVAHRLSTIMAADKLVVLDKGRVVQVGHHSELIAQEGFYKDLVANQV

SEQ ID NO: 9810 - protein, 722 aa, Desulfitobacterium hafniense
SSCTMECLHHNLKAYVVDGKLVKVESCEADETVACLRGLARTQWVNHPERIKMPMLRDGEKGSNRWQEISWDEALDLIVEKIKETQAELGNQGICLRSFSGNFGSLSNAVAASFFNYLGGFTPVVGSLCCQAVTGSMTPIFGSRYEDTRDSIRDSRYLLAWGNNPAVTMQSYFKWYQEAQAQGAKMVTVDPRFSETAAQSDEWVPIIPGTDTALALGMIKIIIEENLYDADFIRAHSSLPFLVAETSGKPALEDEEDPTSFLVLDEASGQITRHDGPGVVPALTVRNTAWASQYKTQFDILADECRPWTPEEVEKETDVPAASTIRMARDYATIKPAMLIQNMGGFQRTEWGSYAAAAHMYLAVLTGNIGGRGNGICDAGGVTTSIKVGNAIPSPKPQGEFGAVRGARFGRDILEDKPNKIGFLWTMTSSIMTQNPNTGAVKEALKKIPFVVTVDSLMTSTALYSDLVLPCTTIFESENVLASSRSHYVQLMEKAVDPPGEAHDDLWIFTQLAKRLGFGDAFDKPVAEHIKAVLEPTGITYEELLEKKCINPLPEVYIPFENGIFKTPTQKAEFFVYDWHEKGFNPMLAYIRAEESVKGNPELAAKYPLACVQRKTNRTIHSTFGSLQWLNQAVSDVPHVMIHPDDAGPRGIAHDDWVILYNDRGQHRCKANVSAHIKRGVVTAENGWWEQQGGSSSYITSDFVEHLSGGQSCNNTLVQVRK

SEQ ID NO: 9811 - protein, 693 aa, Desulfitobacterium hafniense
GAASLAMILAYYGKYITLEELRIACGVSRDGSKASNLLKAARNYGLEAKGYRKEPEALRRMPLPLVIHWNFSHFLVLEGFHKGKAVLNDPAAGRRTVSEEEFNLAFTGIVLSFTPTTEFQKDSRKPGLSLALRRRLKGSEQALIYIILLGLALVIPGLIIPVFSRVFVDDILLGGLHSWVWPLLLGMGITAMLRGVLTWMQQYYLLRLETKIALATSGQFLWHIFRLPSEFFSQRAAGELTSRIQSNDKVAKLLSGKLATTALNVLMIMFYFTLMLTYSWILALVGLAIAFINVGYLIAVSARRVDLNRRLLQDEGKLIGSSMAGLQIIETLKATGSEANFFAQWSGYQAKLLNAEQELGVSSQFLSVFPSFLTGINNALVLVIGGFLILDGQMTIGMLVAFQSLMSSFMTPVTGLVGLGAELQEMTGEMNRLDDVLNYPLGRDQGDQGGRGEQEGLGGTAEPPAGQKLSGYVELRNITFGYSILEPPLIEDFSLSLRPGSRVALVGGSGSGKSTIAKIIAGIHHPWSGEILFDGQPRASFTKEVLSNSLAMVDQEICMLQGTVKENITLWDGTISEFGMIRAARDACIHDEITARPGGYEQMVEEGGKNYSGGQRQRLEIARALAQNPVILIMDEATSALDPITEKNVDEYIRYRGCTCIIVAHRLSTIRDCDEIIVLEKGKIIERGTHGSL

SEQ ID NO: 9812 - protein, 241 aa, Desulfitobacterium hafniense
  unsure (1)..(241): unsure at all Xaa locations
SETGCVRKNNEDAFLALPEYGVYAVADGMGGHLAGEVAARTALDELIKGAPHLGAQENEDLENQVREILVRANREVYMSSTRNPATEGMGTTLTVLVFRETKVVLAHVGDSRAYVWRNEQLIQLTRDHSLVGELVRLGQISSEEADSHPKRHMLVRAVGAGWDVEVDSQFLELQTGDIFFLCTDGVSNVISDRELEEEFLQKGSWEEHLERLHQLIIERGAPDNFTALCCITEXQNEKGLD

SEQ ID NO: 9813 - protein, 516 aa, Desulfitobacterium hafniense
RRAVLSVSNKTGLVELARGLVELGFDLISTGGTFKTLTEAGLPVRYVTEVTGFPEILDGRVKTLHPRIHGGILARATAEHLQQLEDNGIGLIDLVVVNLYPFKETIARPGVSFQEAIENIDIGGPSMVRAAAKNQERVSIVVNPERYPEVLQALREQGEISYDMRKRLAAEAFAHTAEYDQCIAGYLTAALAEESVSSSSSPFPATITLGGQKAQDLRYGENPAQKAAFYRGADAAGTLAYGEQIQGKELSYNNWMDMDAAWGIVQDFSEPACAIIKHTNPCGTALGKTALEAYEKALAADPVSAFGGIIAFNRTVDAECAASLKAHFYEVIVAHEFSSDARAILQEKKNLRLVKVAQDGKPAHTPWKVRSIQGGFLIQEEDEGTTPISAWEVVSKRQPEPEELRELDFAWRVVKHVKSNAIVLAKAGQTLGVGAGQMNRVGSVKIALEQAGDKAQGAYLASDAFFPFPDSLEEAAKAGVRAVVQPGGSVRDAEVIEAADRLNLIMVFTNRRHFKH

SEQ ID NO: 9814 - protein, 529 aa, Desulfitobacterium hafniense
  unsure (1)..(529): unsure at all Xaa locations
GYSYRQAGVDIDAGNQAVELMKPAVKRTVRPEVMGGLGGFGGLFALDLKKYPEPVLVSGTDGVGTKLKLAFQMNRHDTIGQDAVAMCVNDILVQGAEPLFFLDYLAVGKLVPERVAQVVGGIAKGCELAGCALIGGETAEMPGFYDEGEYDIAGFAVGAVNRPDLIDGSQIQAGDVLIGLPSSGFHSNGYSLVRKIFTPDLWEKNYPELGETLGEALIRPTRIYVKTVLPLIESRKVLGMAHITGGGLTENIPRILPEGLGIKIARSAWQVPALFTLLQRLGEVEEAEMLRTFNMGIGFVLIVHPEDVDFIQTQLQAAGEKCFVLGEVSGQSEGVSYLXCGSECLRSGRGSNLQALIEAWKLGELNGELVAVGSDHEEALALKRAEEAGIPHGAFPLSRFSSRQEQEKAILTWLREQKVEILVLAGFMRVLSKEFLQDIQIPVLNIHPSLLPSFQGLHAQRQALDYGVKISGCTVHFVDEGLDSGPIIAQEAVPVLPGDTEDSLSARILEAEHRLYPEAVGWVVGGRIK

SEQ ID NO: 9815 - protein, 386 aa, Desulfitobacterium hafniense
NMYVPTRFVFGSGRLRELHQQKMPGKKALITISNGKSVRENGALDRTQEQLRLAGVAMVVFDKIGANPTKTAVMEGAKSARDHGCDFIVALGGGSVMDAAKAIAMMATNDGDLWDYVGGKTGKGQALRHEPLPLVCITTTAGTGSEADQWGVVTNEETNEKIGVGGYDASFPVVSIIDPELMVSVPPKFTAYQGFDALFHATEGYISKFASPMSDMYALTAIENVGNYLVRACRDGRDMEAREGMAFANTLSGVVMTVSVTTAEHSLEHAMSAYHPELPHGAGLIMISRAFYEFFIEKHACDQRFVRMAQALGMKDAARPEDFITMLVKLQENCGVADLKMSDYGMTPDEFDKLAANARETMGGLFAANPYAMTHEDCVEVYRKSY

SEQ ID NO: 9816 - protein, 211 aa, Desulfitobacterium hafniense
  unsure (1)..(211): unsure at all Xaa locations
MAKLGITIDQSRCVGCNTCAVACKMQNNVPMGMLWNRVLTESGEGLDSAEGEYPHLTKNWLTVACQHCENAPCVKVCPVGATYKAEDGRVLINYDRCIGCRYCMAACPYNARVFNWQRPVRQPDFSCGDAPVRPSGVVEKCSMCKERTDQGLEPLCVVVCPAKARKFGNLDDLNSPVSQAIRGKNSYRLLEELGTKPQVYYLRXRRXEYGQ

SEQ ID NO: 9817 - protein, 783 aa, Desulfitobacterium hafniense
MEISRRNFIKASGGLAAFGMIGTGSLNRWIRPAAAEGAEEEKIAYTFHPPNCGGRCSMKCTVRKGKLVKIEPNEWPDGHHKKVCLRGLSEVERVYSPDRLKTPLKRVGERGEGKFVAISWDEALTTIADKLTEIKGKYGGKSILWSNSSGVQYPMSTLAALIGAQEHGALDFGIDMSQAGGQSIVMGPFNITNTNEITDWVNSNLVLLVGNNLLETSLTDAAFFFDAKEKGTKMVCIDPVFSTTAAKCDQWIPLRPGTDSALYLGMIHLVLNNQWYDQEYVRSYTSAPFLIREDNQRILRDEGNNYLVWDKNSDSPRPVDAPGILPELEGEFTVNGVKVKTVLTAFTEHIRQYTPAWAAKVTEIPEEVITDLTREYALGGPASIQWGLGGPDKWYHSDTTGRLATILAGLTGNIGRVGGGVGQGTQHVTCWSWVTAMGSWDLPPEFAPAPAEVPFSDIPTASTSIKAFFFQGNMLHQMIPDYNTSLKWADSLEFIAVVDNQHCDSVNYADIVLPACSSFESEYDIAYLINERNHILLQQKVIEPLFESKSDFQIEKELAQKLGLDQYLPETPEDYVRALLNSPDPALQGITVEALKANQCIMRLNVPDQPYVAYLDRVFGTESTKLEFYNELFLEDHCAFPVWEEPNEASPANPLYQKYPLMLGSPHARFRAHSTFSNARWLLQINNEPLVRINPIDAQARGIQNKEFVEVFNDRGSFQCRCQIVNDMRPGMVQLSEGWWSRYFQKGDLQEVTNPNKNPRGKKLLYGPIVAFLDTLVEVKKVE

SEQ ID NO: 9818 - protein, 185 aa, Desulfitobacterium hafniense
LIGKEVNEFKVQAFVEGAFKEVTKGDLLGKWSVFVFYPADFTFVCPTELGDLADQYDEFKKIGVEIYSVSTDTHFVHKAWHDASDTIRKIRYPMLADPTAKLAKDFEVYIEEEGLALRGSFVVNPEGKIVAYEVNSNNIGREASELLRKVQAAQFVAEHGDQVCPAKWRPGAETLKPSLDLVGKL

SEQ ID NO: 9819 - protein, 420 aa, Desulfitobacterium hafniense
  unsure (1)..(420): unsure at all Xaa locations
MDRYVITGKQQLEGRLRNSGAKNSSLPLLAASLLVSGKTTLLDIPHLADISNMIEVLEYLGAHVEDQKEALLVDASDLARWEVDEGLMRQMRASNLILGPILARNGRVRISKPGGCAIGSRPMDQHIKGLQELGVKVKEKHGYIEAWADQLQGAKIYLDLPSVGATENLMMAAVLAKGTTTIYNAAREPEIIDLQNFLNKMGAKVRGAGMDVLRIEGVSKLYPVEHTVIPDRIEAGTHMVAAVMTQGDIEISNVIPEHLEPVTAKLLQAGAEIILGDDTIRVKGKRRIKGVDCKTMPHPGFPTDMQPQFMALLSMAEGTSIITETIFENRFQHVDELRRMGAQITVEGRTAIIRGVKSLEGAFVEATDLRAGAALFLAALAAEEATVLEKVGHIDRGYDNLEEKYRSVGAKLKRVKSXSA

SEQ ID NO: 9820 - protein, 1176 aa, Desulfitobacterium hafniense
  unsure (1)..(1176): unsure at all Xaa locations
NYVAKMGGALLLAALISLAFGLLAGRTAAVASAGFAQNLRQDMFYKVQSFSFVNIDKFSTASIVTRLTTDVTNVQNSFQMLTRMAIRSPIMLFFALFVSFSIDQKLSLIFLGSIPILGVGLWLIMSNVHPIFARVFRTYDKLNNVVQENLRGMRVVKSFVREDFETQKFMAISQSIYKDFTKAERLLVFNMPLMQFCMYACILFVSWFGARAIVASGGDPVAGLSTGELLSLITYATQILMSLMMLSMVFVMLTISRASAARIVELLEEESNLQNKDHPVCQVPNGDISFENVSFSYSKDADKPVLDRINLDIRSGETLGILGGTGSSKSTLVQLIPRLYDVTEGKVKVGGVDVRDYDLETLRNQVAMVLQKNVLFSGTIKENLRWGNEQATEEEMIQACKLAHAHDFIAGFPHQYDTLIEQGGVNLSGGQKQRLCIARALLKNPQILILDDSTSAVDMETDAQIRKALAEHLPDTTKLIIAQRVSSVQDADRIIVMDDGKIKAVGSHEELLQTSEIYKEVYESQAKGGEEGXWDSEAGRERVRLMAGDFPAGNRPMTNSTPQTAKRLLSYLRDYKVQTFFVMVAILISALVGVLSSVFLKILIDDYIAPLLLEAVPNYAGLLRIIMVMAGIYLIGVLATLIYNWIMVSISQGILKKIRDEMFSHMQKLPVKYFDSHTHGDVMSHYTNDTDTLRQMISQGIPQTFSSFITIVAVFFAMLYLSVWLTVFVVLCIFLILKVIGSIAGKSGTYFMQQQQSLGTLNGYIEEMIHGQRVVKVFNYEEKSKESFNRKNEELCAHATAANSYVNIIMPMMSNFGYLLYVALAIVGGLLVIGGVTNLTITGTNALTLGTIASFLQLSRSFIMPIAQVSQQLNAIIMALAGAERIFKLLDEKPEKDEGQVTLVHVKQERGPIVETSSHTDGWAWKIPQEDGMVDYRELKGEVRFFDVDFGYEENKMVLHNITLYAEPGQKVAFVGATGAGKTTITNLINRFYDLADGKIRYDGININKIKKEDLRRSLGIVLQDVNLFTGSVMENIRYGRLDATDEDCIAAAKLANADGFIRMLPQGYQTVLSGDGSGLSQGQRQLISIARAAVADPPVMILDEATSSIDTRTEAIVQRGMDSLMEGRTVFVIAHRLSTVKNSDVIMVLEEGRVIERGSHEKLIAEKGKYYQLYT

SEQ ID NO: 9821 - protein, 894 aa, Desulfitobacterium hafniense
WHVLPWLDVVKALEVHPGKGLNLKEVNRRLGEVGRNILETKKGVHPVFLFLGQFKDFMVLVLLAATIVSALLGEIADAVTIMAILVLNAVLSFIQEFRAERSNESLKSLTAPEARVLRDGLESRITAADLVPGDIVLLEDGDRILPTSMDQAVNVEVEESALTGESHPVAKRLAPLTDELTPMADRVNMGYMGTSLVGGRGAGVVVATGMETEMGVIAGMIQSVEEEETPLQKRLAQLGKYLVIISIIVCGIVVLTGVLRGEGFYKMFLAGVSLAVAAIPEGLPAIVTVALAIGVQRMVKRKAIIRKLPAVETLGCATVICSDKTGTLTQNEMTVRQIYTDRTMVAVTGQGYDPKGDFHGADPTKEKGPLQSALKIASLCNNSSLTRKGVQVAGMFRAAGKDSPWGIEGDPTEGALLVAAAKAGIWRETLERKEERVGEIPFDSDRKRMSVIYKGKREKKAYVKGAPDEILRRCRHELTSEGIVELNELRRRAILRANDEMAKKALRVLALAEKPLQENERIDERVEEDLTFVGLMGMIDPPRASAAKAIKVCRRAGIKPVMITGDHRLTAEAVARELGILKGNGDGILTGSDLDRMSDEALEKEVMNISVYARVTPKDKLRIVRALKKNDQVVAMTGDGVNDAPAVKEADIGISMGKTGTDVTKEASAMVLADDNFATIVAAVEEGRAIYDNIRKFIRYLLSCNIGEVLVMFLAALVGLPLPLLAIQILWVNLVTDGLPAMALGVDGMDKDIMNRKPREPGESIFARGLARKIMVRGLIIGLGSLLVFVTAMFLGVNMLAARTMAFTTLVFSQLFHVFDCKSETRGIFEVGIFSNPYLVAAVIGSTLMQLSVIYLPPLQAIFKTTPLMGWQWALILAVAGGPSILIGLYRLVR

SEQ ID NO: 9822 - protein, 276 aa, Desulfitobacterium hafniense
KMHGLGNDFVFIDHFQGAPAELPDYPELARKLCHRQFGVGGDGLIMVLPSDKADARMRILNSDGSEPEMCGNGIRCFARYIYDQGYVSQNPLQVETLAGILTLQLSITGDQVTGVRVDMGEPILKSEQVPVLIQGDPVVGARLDVDGQEFEFTAVSMGNPHCVLFVEDYETLDFERIGPAIEKHPLFPRKTNVEFIIVNSPRELTMKVWERGAGPTLACGTGACASVVAAVLNGRTERKVTVHLPGGDLLIEWGEDNRVYMTGPAAYVFKGVLLED

SEQ ID NO: 9823 - protein, 175 aa, Desulfitobacterium hafniense
QKGFYFDMTACVGCRTCQIACKDKNNLNVGTFFRKVRAYETGVFPQPGIYHYSETCNHCEKPKCAEGCPTTALHKLENGIVDHDKNKCIGCRFCVWNCPYGVPQFIEALGQISKCDMCKDLVEEGANPVCVDACPLRAIHWGELEELKAQYGSGSVRDLAILPDSSITQPSLLVK

SEQ ID NO: 9824 - protein, 838 aa, Desulfitobacterium hafniense
ISRRTFLAATAAGTAGLALAGCSGNILTPAGANLDTAKEGKWVSATCWHNCGGRCVNKAYVVDGVIVRQKTDDTRPDTPDAPQQRGCLRGRSQKHQAQGVDRLKYPMKRKNWEPGGGKKELRGQDEWVRISWDEALDILTSELQRIKGAYGNASILVPGEANSEVMNLMSIYGGFVPSWGTMSFGSWFITPHIIGFADNLFDPKALNDRFDMRKTDLVVAFGINPAWSSLGNPMYHFLQMKEAGTKFIIIDPFYTDTAATLEAEWIPIKPATDMTLLLAMAYTLIVEDDPVNKPLIDWDFLNRCTVGFDVEHMPADAETNENFKDYVLGKYDNIPKTPEWASEICGIDPHTIKYLARAIGMQNKVSILASWASGRAQNSDNLPQMFMTLGAMTGHFGKSGHMTGASCWNYAGNPGPALVNPGGSGEPFLGSPLKEVLCEADMWTGLLRKKYLPNSIMKTIKYSPPTWQDTVKGVDLKTRVQEEDINIQMIWHTSEATLQTRDGMNKGIEAHRAVEFVVSQSHFLTTNSKYADLVLPVTTLWERAGDIDGLFSNRDVLIVSSQVIEPIFEAKDDNWIAVEVGKRLGLDVSQIVVSDRKQQLFNKLAGSTVVKEDGKTFEPLVDITAEDISEWGVSGQPQTGRIPLTKLLEDGVYQVERHEGDNYGFIAYEDFRKDPEKNPVNSVSGKLEIYSQTLADIINNLGYTKISPYPKYVPPIQGYEATFSDWQSKAKGAYPYQLITPHYLRRSHSIFDNILQLREACPNPVFLSAQDAAAKGIKDKDTVLITSEFGQVLRNACVTERLVPGVVALPHGSWCDVDEKTGIDHGGADNILSGNVPT

SEQ ID NO: 9825 - protein, 809 aa, Desulfitobacterium hafniense
GIINKQINRRNFLKASAIGAAGLALPGCSSSTLTNTGVDATADGNEGQWITAACWHNCGGRCLNKALVVDGVVVRQKTDDTHEDSPDFPQQRGCARGRSHRKMVMGADRLKYPMKRKNWAPGGGNKELRGQDEWVRISWDEALDIMASELTRIKDAYGNRAIFAPVGGSDSLQAVPRLLSAFGGYTARWGSVSWGSWPTVYSKVTGQPHNGASDGNDRFRLRESKLIILWGANPAQSSQGLPAYNYLQAKKAGVKFIVIDPIYSESARVLADEWIPIRPATDTALILGMAYYIIKNNLLDQNFLDNCTIGFDADHLPEGADPKDNFKDYVLGTYDNTPKTPEWASEICGVPAVKIAEFAQEYATTKPAAIISGGAPARINNGEHLPHAMMTLAYMVGNVGIPGAGVSPNMHNSATNAGPALVKAGGNGLPKIVNPIDDSINSGEMYDAILNGKYIKQKGEIRDINIQMIWTWFSHNLNQRAGSSQGIDAYRKVEFVVAQNMFLTADAQYADLVLPVTSEWERLGGLLTGNREILIHYRQIVEPQYEAKSDLWIVKEIGKKLGIDPTKVCPVSEEQQMYNQLAGAEVIKEDGSGYEKLLTLTAEDIKVLGAEGEPQTGRITYQEFKEKGIYQVPRHKGDKLEFTSFEDFVADPANHKVNTPSGKFEIYCKSLADNIEKVGFTSKSPIPKYEPSVEGYEDGQKNGYPFQLITIHYFRRSHSTLDNVTWLREAFNQECRLNAQDAAELGIKTGDIVKVTSQHGSVIRPVYVTETITPGVVSLGEGAWIDMDEGNGVDKAGCTGILNGPIATG

SEQ ID NO: 9826 - protein, 377 aa, Desulfitobacterium hafniense
LNFNLTEDQKMMRKMVRDFVEEEVIPQAAHTDETHEFPLALVHKMRELGLLGIPIPEEYGGAGSDFTSYTLALEEIARGCASTAVIMAVHTTLGTFPIYYFGNEEQKQKYLPKLAKGEMLGAFALTEPNSGSDASSLVTTAKRRGDHYVINGSKRFISNTGYAGIYTVLASTDRTKGSRGITAFLVDADTPGLIIGKKEKKMGLHGSSTRELIFEDMVVPVENRLGEEGQGFKIAMALLDDGRIGIGAQAVGIAQAAFEAALAYAQERVQFKQEIMNFQGIQFMLADMAAQLEAARLLVYQAAVRRVEGVPYSKEASMAKLFASEMAVKVTNDAMQIFGGYGYTREYPIERYLRDAKITQIYEGTNQIQRIVIAKHL

SEQ ID NO: 9827 - protein, 279 aa, Desulfitobacterium hafniense
MKTIMIIGAGQMGSGIAQVAAQAGYTVILNDIKEEYVARGLKGIEKNLDRSVEKGKLTAEEKSKILGQLQASVSLQDGVLADLVIEAAVENMAIKHDIFQTLDRVCPEHTILASNTSSLPITEIGACTKRPDKVIGMHFMNPVPVMKLVEIIRGLATSDEVYTEIENLSVAMGKTPVEVNDAPGFVANRILIPMINEAIWTLNEGIAKPEAIDNVMKLGANHPMGPLALADLIGLDTVLAICDVLHEGLGDKYRPCPLLRKYVKAGWLGRKTGRGFYTY

SEQ ID NO: 9828 - protein, 379 aa, Desulfitobacterium hafniense
MIFELSEDHVMMRKMVRDFAENECAAGAEERDEKEEFPREIWNKLAELGLAGITFPEKYGGVEADYLSYAIAVEELSRVDASVGVTVSAHSSLCANPIYLFGTEEQKQKYLVPLASGEKMGAFGLTEPMAGSDASGTRTTAVKDGDDYIINGTKIFITNAYEADTYVVTAQMDKSKGNKGIAAFILEKGMPGFSFGKKEKKMGIRSSATYELVFDNVRVPGENLLGQEGQGFKIAMVTLDFGRIGIASQALGIAQGAYEQARKYAKERVQFGQPIAQFQANQFKLADMATQIEAARLLVYQAAYLATQHKPVSKASAMAKLHASETAMWVTTQAVQMHGGYGYTREYPVERMMRDAKITEIYEGTSEVQRIVIGSHILK

SEQ ID NO: 9829 - protein, 389 aa, Desulfitobacterium hafniense
VVIVSAVRTPLGSFGGALENFTGAELGAIVIKEAIKRAGILPAQVEEVIMGNVLSAAAGQNPARQAAIKAGIPQEVPAWTLNKVCGSGLKSVICGAQAILAGDADIIVAGGMECMSSSAYALPKARKGYRMGNDSLVDTMIMDGLTDAFHNIHMGLTAENIAEQFQISREDQDALALRSQNRAEAAIQSGLFDEEIVAVEIPQKRGEPLVFSQDEFPRFGTTADTLTKLRPAFKKEGTVTAGNASGINDGAAAVVVMSKEKAEELGLAVLAKITSWASAGVDPLIMGTGPIPATRKALAKAGLTIADIDLVEANEAFAAQAAIVTRELGLDVEKTNVNGGAIALGHPIGASGTRVLVTLLHELKRRDGQRGLATLCIGGGQGVSLIVER

SEQ ID NO: 9830 - protein, 374 aa, Desulfitobacterium hafniense
VNFELSGETLMIRDMVRKFAQNQLAPLAPELDKSHEFPMATWNKMRELGLTGFPIPEEWGGGGGSYLDFAIIVEELAKACASTAVITSVHTGLGCMSMYLYGSQQLKEKYLERLATGEIIGAYALTEPNAGSDAGALRCKAEDRGDHFLVNGGKIFITNGTVATTFCTFVKTDPTQPKGKGITCLLIEKDLPGFTISKPVEKMGMHGSPTVELIFENVKVPKENVLGEINNGFAVAMGLLAGGRITIGAQGLGIAEGALDYTINYIKERQQFDKPLAANQGVQFMIADMATKIEAAQMLIYRAAWLKDHQLPHNKEASMAKLFATDVAMEVTTNCVQLLGGYGYCSEYPVERMMRDAKITQIYEGSNQIQRMII

SEQ ID NO: 9831 - protein, 404 aa, Desulfitobacterium hafniense
RQVVCVEACRTPYGKSLGALLEYDAAQLGALAIKEVLRRTKGKVAPGEVDYVIMGHVVQAGSGQVSSRQATLLAGLPEHVPSITVNKVCSSGVKTIDLGAQMIALGRAEIVIAGGQESMSNIPFSLPDMRRGRKMGLPTIDCVDLMVKDGLWDSFYERHMAIHGSEVADEFGYSREEQDEWALHSQLAASAAIAAGKLDAEIFPVAVKTGKETLEKDEGPRANTTLEGLAKLGPVFDHISAVTGKPGSVTAGNAPGTNDGGDVCLLMSRAKADELGLKPLFSIVDYAEVSQPTKDIATVPGLSIKKVLEQNKLTLEDIKLIEINEAFAAVALVSARTILGMTKEQMYEKVNVNGGAIAYGHPIGATGARIVMTLAYELKRRGGGYGVCGICAGHAQGDAMLIYV

SEQ ID NO: 9832 - protein, 279 aa, Desulfitobacterium hafniense
MKKIMVIGAGQMGGGIAQVAAQAGYSVILNDLKEEFVTRGLSVIEKNLRRNVEKGKLEATESAATLGRITQSTALQDAASADLVIEAAVENMVIKSQLFTQLDEICPEHTILATNTSSLPITEIAAFTKRPDRVIGMHFMNPVPVMKLVEVIRGLATSDEVYKTIEALSQEMGKTPVEVNDAPGFVANRILVPMINEAVYTLYEGIATVEDIDQVMKLGMNHPMGPLALADLIGLDTVLSISEILHEGLGDKYRPCPLLRKYVKAGWYGRKSGRGFYQY

SEQ ID NO: 9833 - protein, 481 aa, Desulfitobacterium hafniense
RMSYGELKREAGQLAKALACLNIQAGDKVLAILPNWHEFIVLFFALAKMEAVLVPCGVSLTAKEISQRCQMIQPKLAFVSGHDQLRWLEAEAGCCKIIAVRFEDKKAMGYSELLALGEKNREQKLPGKRQDEVMCTIIFTSGTTGAPKGVELTDRSIMQTAISIGIRLESSHRDVFLVPLPCTHLFGIVTGMVVPLYVGAKIVIMERFRAKEALKLIEQEQITVHHGVPTMFIRELEDYKGHEVNLQSLRTGVAAGAICSEEVLKKITDIFKFNLMVAYGLTEFVGVSMTTLSDTIEDRLKTVGKPYEGIQVRAVHESGRTAEPGEVGELCCKGYGAMKGYYQLPAQTRKVLDAEGWLHTGDLARIDERGYITIVGRKKEVIIRGGYNIYPREIEEVYYNHPEVMEACVIGLPHQDLGEQTVAFIQLKSHSQQTAALLREYAKGKIAKYKVPDRVLLVEQLPKLSNGKIDKRELGKMAVSL

SEQ ID NO: 9834 - protein, 381 aa, Desulfitobacterium hafniense
MDFRMSEEQELLLESLCELIAREVTEADVKTWYENHAVSEKFNKAFIEAGFGFLGIPEEHGGTPADVTTLMLVSEEVVHQTCATIPLLSNILNMYDVVEFGTPEQIKLTMDITKETGSPAFLLAISEPQAGSDNMRMTTTAVHKDGKVILNGSKTWITHGGVAPYALVFAKEDNSDLTNKAISMYLVPSDTPGIKFAPLHKIGQTTTVFAEMYLDNVVCDESCLVGKKGEGFMQLMKNLEVERLLISSFSLGLAQAAMDDAAAYAGQRMQFGKTIGSFQLIQQKLTDMEIKIKNMRNMLYEAAWKADNGISIKLDSALAKRYICMTATEVCYEAMQIFGGLGYTTETRVSRAWQDARGWEFAGGTNEIMVHIAGREIVKKY

SEQ ID NO: 9835 - protein, 454 aa, Desulfitobacterium hafniense
EWLNSVEYREKNFAREKLVINPAKACQPLGALLCALGIEGCLPFTHGSQGCTAYFRSTLSRHFREPVASVSDSMTEDSAVFGGQANFIEGLKNAYTVYNPKVIAVYTSCMAEVIGDDISSFLGNAKDQGAVPMDFPVALANTPSFKMSHIAGYDIMLKGLIECLATPRQEDQINERLYVVPGFDTYPANLREYKRLLNMMNVPYTLLPDYSNVVDTPNLGKYELYPGGTPLVEMEEALNGLGYLLCQTYSTSNTKKYLTGESIPVEAIPMPIGMAGTDRFIEAAAKLTGKEVSEEITYERGLAVDAMTDAHQYMHGRKFALFGDPDLLLGLVSFLLEMGGEPVHIVCSNSTPLFKKDMERLLASSPYGQGATLYPNKDLWHLRSLLVTEPVDMLIGDSHGKWAARDAGIPLVRVGFPFYDRVNLHRYPIVGYSGVINLITMIVNTFLEEKDRAS

SEQ ID NO: 9836 - protein, 430 aa, Desulfitobacterium hafniense
GAGSPQLCMKALPGEGAERSCAYDGARVVLMPITDVAHLVHGPIACAGNSWDNRGARSSGSQLFRRGLTTDLMENDVVYGGERKLKEAILEIAAHHRPQAIFVYATCVSALIGDDVSAICEQAEQELTIPVIAVNCPGFLGDKNIGNRIAGEVLFDRVIGTGEGPDEKVPLSVNLIGEYNIAGDLWGILPDFENLGITVQATITGDAKFEDIASAHRACLNVLICSKSLTNLARKMEEKYDIPFMEGSFYGIHDTSETLINIAKALGDLDLLKRTKTYVQKKEEETREMIAGYKKCLEHKQAILFTGGVKTWSMVSTLAELGINILAGGTQNSTPDDFQRMKALMDPTAQIIEDTSPAGFLKIIAEKKPDLIVAGGKTKYLAHKTRTPFLDINHGRKLPYAGYEGMVTFAGSLARTVNSPVWELLKQEFP

SEQ ID NO: 9837 - protein, 422 aa, Desulfitobacterium hafniense
NPQKNSPALGATLAYLGINGLLALLHGSQGCSSFIRLQLNRHFKESIPLNSTALLEDSVIFGGWEHLKKGIAVAADKYKPQIIGVMSSGLTETYGDDMASALASLYSERPDLEDLPVVLASTPDYIGSMQDGYQRTVEALVDALVGLNHHSPASALKTDIQEAPYLALLPGCHLTPADVDELKEIVRDFGFRPITLPDLSVSLDGHAELEAAPVVQGGTLLEDFQLLPRSRACLSFGLSMEKAGETLKEAYHIPHYNFPSLSGLTATDGLILTLAKLSGKTIPEKQLRQRNRLLDTLADYHDQLGKLRVAIALETDLLYSLGSSLVEVGAELTVALAASQAGTDRLSLPVPMEVGDLETLEERAGQSKLIIANSNGRQAAGQLKLPHLRAGLPVFDRAGYPQTCWIGYEGTQRFLFATLNAV

SEQ ID NO: 9838 - protein, 299 aa, Desulfitobacterium hafniense
MADIIKTQGLCKHYGKTPGVSDLDLSVAEGAVYGFLGPNGAGKSTTLKMILGLVKPTAGSITVFGKTMNHRSRMSILKDVGSLIESPSYYGHLSGYENLRIIATLKGTPEKDIGRVLEIVRLENQKNKKTNQYSLGMKQRLGLACALLGNPRLLILDEPTNGLDPAGIQEMRELIRSLPKEYGITVLVSSHLLSEIEQMATNLGIISKGRLVFQSSLGALHQKSSPSIAIRTLDNHRAAAVLREQGIAVQCQQDYLLLPAFADGELSRLTLNLFEQKVGVVRIEQREKSLEDIFLELTG

SEQ ID NO: 9839 - protein, 454 aa, Desulfitobacterium hafniense
KQRRLGGKLNMTYVQEVLEQAVKRNPGEAEFHQALREVLESLEPVLEKRPDLKEAGILERIVEPERQILFRVPWVDDQGKVQVNRGFRVEYNSAIGPYKGGLRFHPSVYLGIIKFLGFEQIFKNSLTGLPIGGGKGGSDFDPKGKSEGEIMRFCQSFITELYRYLGADTDVPAGDIGVGGREVGYMFGQYKRITNRYEGVLTGKGLTFGGSLGRTEATGYGLVYFMEEALKAVGKSFSGATVVVSGSGNVAIYATQKATQLGGTVVAMSDSNGYIYDKDGINLDTVRQLKEVERKRLKDYVSIHPTAEYYEGCAGIWTIPCAIALPCATQNELDGEAAEVLVKNGCYAVGEGANMPSTPEAVDVFLQHKIIYGPGKAANAGGVAVSALEMSQNSMRYSWTFEEVDAKLKNIMVNIYHNASKAAQEFGFEGNLVAGANIAGFLKVAEAMKAQGTV

SEQ ID NO: 9840 - protein, 880 aa, Desulfitobacterium hafniense
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLEPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENQAIYAQFVKTSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGEKVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQAAARLVKEGYEIYPEVMIPLVIHVKELAKLRKVTEEAAQTVMAEQGVTFAYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPFRVPIACLAAAQAAVSSK

SEQ ID NO: 9841 - protein, 361 aa, Desulfitobacterium hafniense
LLKTYEVDAMYDVLIIGAGPAGSSLARLIGDKYKVLLIDKRDLANENPHNLAGKCCGGLLAPDAQKMIAKLGLGIPKDILVNPQLFAVRTIDLTNNLERLYQRFYLNMDREKFDRWLVSILPKKVDKKFNAVFKDFVEIPGGYEVKYIHNGQEISAKTRVIIGADGAFSKLRRFLNQDINGPEKYIAIQEWYECPHHVPYFTAIFDEEISDFYSWIIPKENYLLLGSALKPKEKAREKYELLKTKLTQRGFNFDNKIRTEGAYLYRPKKVSQFYAGRDSIALVGEAAGGISPSSAEGISYALKSSAYLAQSLEEGIDGFLDRYKLKVKGIKLNLLLKNLKSPAMYNPLLRQLAMKSGLQSI

SEQ ID NO: 9842 - protein, 728 aa, Desulfitobacterium hafniense
ASSGEAVFSGACRGNCAGGCFLNIHVRGGKVVRTSMREMPNPDYNRICVKGLTHMQRIYHKDRLKYPMKRIGERGAGQWERISWDEAVTTIADKWQEYQREYGKEAFAIYWGSGNYGVLSGQGMGCTTSRLLNVTGASNISMTVDAAHGHSAGNALGWGPNFTLNELADLKNAKTILCWGANPVISQQQSTHFLMEAKENGTTFIVIDPIYNITASKADKFVPVRPGTDGALALGMMNIVVRENWIDVPFLKASTVAPFLVKEADGHYLRLSDLGLLAEGQRDDIVVRSAEGKMGLPQEITDPVIEGSFEINGHKVNTAYTLLLQRIAEYPPEKAAEICNLSVSQIEEITKIYATNKPSTIYQYFGIDHYVNGHYSIFDIYALAMITGNLGKSGAACGMGETLGINFTNLAGTLFPAGATGPSLTMSATQMDSVMNEHKYGNKDVNVKGIYITNANVVANSAERKYTLDWLNKMEFIAVADMNMNETAQYADILLPVSHWFEQEEAFCNYSTHPYVIFQEKAIDPLYECKADFEINKLIAQKLGYGEQFNLTEMEYLNLWLDNDEARRLGITLEALREKKILKCLPGDLYINGENGVFGTPTGRAQFYVENPAPNMNYDQQWDIEKERLPYWEPPNEVWHENPLTKKYPFTIISDHVRFRTHTQWWDVPALLELDPEPILKISSEDAAQYGIKTNDLVKIYNDRGHVVMKAAINDGLPQGVLTAPKGW

SEQ ID NO: 9843 - protein, 206 aa, Desulfitobacterium hafniense
MMRYAMAIDLKRCVGCHTCSVACKMANNLPNEIWWNRILTVGGEAMDTAAGTFPNNTLEYLPVNCQHCANPACVKACPVGATYQREEDGVVIQDYDQCIGCRYCMVACPYSGVRQFNWKKPEYHVDFAVGDANITPHQYNTVSKCTFCVHRLAEGKKPACMELCIGRARYFGDIDDPESEVSKAIQGRTYFHLLEEKGTRPHVYYL

SEQ ID NO: 9844 - protein, 715 aa, Desulfitobacterium hafniense
  unsure (1)..(715): unsure at all Xaa locations
EQIFSGACRGNCAGGCFLNIHVRNGKVVRTSAREMPNPEYNRICVKGLTHVQRIYSKERLKYPMKRAGERGEGKWERITWDEAISTIAQKWKGYQDEFGKYAFGVMWSSGSYAALSGVGIGSAINRLQNANGALNITAAVDMARGQGTKPALGQGTFVTANEPADLKNAKTIFCWGANPVGAQQQSTHFFLEAREKGAKIVVIDPNFNALAAKADIFVPVRPGSDAALALGMMNIVVRENWVDEPFLKKSTGAPFLVKESDGKFLRQSDLGIHIPEGAKDELIVWNQDSDTYGTADTVSNPALRGSYTINGVKVTTAYDLLLERIAEYPPKKAAEICNIPVAQIEEITELYATNKPSAIYEFFGIDHYVNGHYGYFAMAILAILTGNLGKPGAFCGWVRTWPLIGSIWRERCFPMERSPLFPYLLICSXNSGNXNVWXNSHRFEGIYFTHVNQIGNGAERKATLEVMKKLDFIAVADLNMNETAQYADILLPVAHWFEVDDVFVNYSTHPYVILQEKAIEPLYECKSDFEIYQLLAEKLGCSDAFAMDEEDYMRLWMDTDGARKLGITLEKLKEEKILRALPGDPYIYAEGGAFATPTGRAQLYNEAPAPNNNYDQVFDLAKERLPHFEPPLEAWHENPLHAKYPFSVIQDKGRWRTHSQWWDVPMLKELSPKPFVKINPADAAARNVKTGDIIKLYNDRGYVKIKAIVDRGIQP

SEQ ID NO: 9845 - protein, 205 aa, Desulfitobacterium hafniense
MRYAMAIDLKRCIGCHTCAVACKMANNLPNEIWWNRILTVGGEAMDTAAGTFPNNTLEYLPVNCQHCANPACVKACPVGATYKREEDGIVIQDYDKCIGCRYCMVACPYSGVRQFNWKKPEYHVDFAVGDANTAPHQYNTVSKCTFCVHRLAEEKKPACMELCIGRARYFGDIDDPESDVSKAIKGRSYFHLLEEKGTKPNVYYL

SEQ ID NO: 9846 - protein, 169 aa, Desulfitobacterium hafniense
MAGQKAFLYNQNYCVGCHSCETACMVKNQVDVGVSWRTLDSFEVEINGRMVERYLSHSCMHCAEPQCASVCPTKAYTKREDGLVIQDHDKCVGCGYCIYACPYQAPKMNPHTKKVEKCTGCYDLIDAGEQPMCVRGCPVQVLKIEDIDKLDAEGAVKEAIGSRPLPPIH

SEQ ID NO: 9847 - protein, 640 aa, Desulfitobacterium hafniense
CPRNCYDTCSLIGEKVDGRIVRIVGDPKNPITAGTPCVKGQTHINVLYHPDRILHPLKRVGKKGEGKWEKITWDEAYATIVQKLKEAIDQYGSESIMPYNFSGTIGFVHQHGVPWRFFNKIGATNITRTVCNTGGKAALPYTYGDFSSIDPETFAKTKCYVTWGTNESYTNVHSVKFIQQARDNGAKLIVVNPHRHPLASQADLFIQLKPGTDAAFALGVQHIIINENLYDKDFVENYTMGFEELKKQVQNYPPSKVAQLCEVTEEEIREFVKMYTQAKPSIIRMGFGFERRTHGGGMVRAISFLPALMGVVGVEGGGFSYVNYNHYPFDNSYTKRPDLAPRKMRTINMNELGKAIAGELPTTKENPVKVLICFGGNPIPSAPNVNLIKKGLAREDLFTVVHEVFMTDTADYADIILPAAHFIEFEDVIADYLGWYVRYSEQGLEPMGESKSNVQLFNELAKQMGFTDECFNETSTDIIKKGILNKPIFKDITYENLRRNHWIKVDFGNVFSDHKFNTPSGKIEFYSENITKAGLHPVAEYLPEEESQDGSPDLFAKYTINLLTPASPQLLSSQWHNVPYIQENLGEPFVTINAKDAEDRGIKDGDYCLIQNDRGQVKLKAKVSNSAVKAGVAVSFKSYW

SEQ ID NO: 9848 - protein, 202 aa, Desulfitobacterium hafniense
KLGMVIDLKRCTGCTTCANACKMQNNVPMGMLWNRVLTEGGEEYDTAAGVYPHVQRRFLPVACQHCENAACVKVCPVGATYKDESGRVVINYDRCIGCRFCMAACPYNARVFNWEEPVRDPGFNYGDKDVPLRKVGVVEKCSMCKERTDTDLEPMCVKCCPAKARKFGDLNDPDSEVSRLIRERHGEQLLAEKGTKPQVYYL

SEQ ID NO: 9849 - protein, 765 aa, Desulfitobacterium hafniense
MNISRRNFIKGGVAGTATLGLSGSLLFADRWLRPATAASDSEERIAYTYHPPGCGGRCAYKCTVRDGKLVKIEPNDWPDHRYSVLCTRGLSELQRVYSPDRLQTPLKRVGERGEGKFVPISWDEAITTVADKFKELHSQYGGKSILKMISANQEYTMPLLSSLLGIPVALETSIDTGIASGVEEVTGDAPFGYAMHEITDWVNAKTIILIACNILETTVADSQFFFDAQEAGAKIIVIDPNYSTTATKADQWIPIRPGSDPALLLGMINHILANDWYNHDFMQKNTSAPFLIREDNQHLLRQNDSADGPAQNPFMVWDALSNSAQPYNATGVQPELEGEFTVNGVKVKTVMSALKEQMKHYTPAWAAEMTEIPEQIIIDLTRQYAQGGPGYLGWGFGGAEKISNSDIFGHAAAILGSLTGNFGRVGGGVGNALFHKYNWGLVTKLGAWSLPPQFKIPPMEIPTTLMGTQPNSVKAVLNLGNSFQQHFANFHHAEAWLKQLEFVVTVDIFDNASVAYSDIVLPIGSCFESNYEITRFQVNRNHALLSEKVIEPLFESKSDFEIEKLLAARFGLEEYMPKTPEDYIRAQLNSPDPFLKGITVEALKANKFIMRLNCPTEPCIGHLDQKYKTPSGKLEIYNEAMIEFAQALPAYEEPVELSSELKQKYPLQFAQYRSRFHVHSQFMRVSWIRQFCPEPRLELNPLDAKSRGLANGDLVEVFNDRGKLKARCKFMDSLRPGSVRMEEGWWSKDMPEGDINYLTNDTFNP

SEQ ID NO: 9850 - protein, 689 aa, Desulfitobacterium hafniense
MAQTYCNVCTADCPASCRLLTDVADSRIIGIKGDPRDPYTRGKICAKGYALKELVYSPDRVLYPLKQQGKGSGNWQRISWEQAFLEIGNKLVGIAQEYGSLLPVSMNKFLGTTGLLSQSVEGFFSSLGPITALMGNPCVSAGTDAFILNYGALKKPLPEDMKNSRLILIWGANPAWTAIHQMRYIFEAQDQGAIVVVIDPIFTSTAARSDIYYRIRPGADGDLALGLAKILVEENLIDHEFLDNFTFGWPEYRDYLETVDLNQVSSSTGIPLAELYELARLYGTIKPATIRLGPGIQRGPSGGQNARIIDCLAALTGNIGISGGNVHYTSYEQLLHAGKYGQLRLPYGIRQGLSENNEGNTGHRILGTDWYTHLDTLDPPLKFLWVAGRNPVAQDPDPAQLIQALKTIDTVVVAEQTLSATAQMADYVLPVSSPFEFEDVVISFWHYGAAINQQAIPPLGESKSDFAIMHGLASVLHQLKPGLSSFPLHGDPRTWLTQEFTSLNDFLGITDYRELAHNPARVNLPAVPWQDRQFPTASGLYEFYSFTAAFHQTPPLPIPVDQPVSSRSYPFRLMVSRSPITLNSQFYTIDLLRRLENLPLLLIHPDTGKQKNLAEGDLAKVYNEMGELELPVSFSLSLPPDIVLTYMGTEDIHNTLINTLLSFESTDLGQIFSGSPGIAYNNCFVNLVK

SEQ ID NO: 9851 - protein, 465 aa, Desulfitobacterium hafniense
  unsure (1)..(465): unsure at all Xaa locations
MLSQTVIKRLKEIVGEKNFVTGKADLFPYTYGFCTLLSGDPLGVVSPQTTEQVVELVKYLNEHNIKVIPRGAGTNVIGGTIPAEESVVISFTRMNKILEIDTENFVTVVQPGVVNFDLQLELEKRGFYYPPDPSSAKVATLGGNLAESSGGARCFKYGVTRDYILGVEVVLPNGKVINTGGRNFKSEPGYDLTRILNGSEGTLGLVTKIILRVLPLPMARRMMLAVYDKVEDAAQTVDGIFAAGIAPATLEMLDNFFINTTEDFCPTGIPRDAGAALIIEIDGYPEDMNEQVRIIGEITRKAKARDFKIARSMGEVEQILTPRKVGFGSIASITPSYSINDIAVPRSNFSQAFAGIKKIAKDLNVKIGVLAHAGDGNFHPFILYDQRNKEEVERVHAAEQALCEMALSFSGTITGEQGVGIAKRKHLDKQFKPEAMEAFRKIKRSFDPQNRFNPGKIFDSXQRLI

SEQ ID NO: 9852 - protein, 384 aa, Desulfitobacterium hafniense
LILAMDEEKVIYPKEYLMDLGQARLLGLRFAERYSGRGLQWVDEVSVLEEIGVLGTSLACLYSLPSIVGEAINHFGSEVLKDRYLKPTLEGKLYTAEALTEPRGGSDFFGATTLARREGDVYILNGQKRFVVGAEGADYFMVYAKTDPEGPAHQSISAFIVDRGPGVEVEHIYGLMGTRGGGAGRVVFKDVKVPAENLLGVENGAADIFYQMMIPERLTSAAGALGMARAALEVASDYSTRRKAFGRKIKDFQGVNFKVADSITRLDAARSLVYTTARAVDSGVPGHVARRLVSEAKKFATDSAWAVVNDGMQIMGGIGYTNVFPIERLLRDIRLIMIWTGTNEVMNLIIQHEYYKERRGNLQFHRSLEEDAVNAHLTEEKVYE

SEQ ID NO: 9853 - protein, 573 aa, Desulfitobacterium hafniense
PWRAQYDQQVPHYLSYPEETVDGLFRKSVQKNSGEVALIYFNKKMSYSDLGNKVERLAGSLQKLGIDPGDRVALLLANCPQYVIAYYAILAIGGVVVPVNPLSTESELLHIFRDAQVKAAICLDLLAERLENVRDICHQAGETQLLKHTFYTALNEYMPFPLKFLYPFTRKLSPGGKERLKVAGRFKDLLNEGNGPVLKDYPSQKVDVRKDIAVLIYTGGTTGRPKGVMLSHYGLLANAYQAIAWVQMGSKDRLVTVLPAFHGFGMSVCMNAPLFSGASTILIPRFEAKDVLKAIHKHKPTYFAGVPTMYIGMINYPQLKRYSLSSLVGCFVGAAALAPEVKRSFEELTGARLMEGYGLTEGVNALCCNPLRGENRTGSIGFPFPDVDFKIRDIDTGEEELPPGESGELVIQCPDLMLGYYNRPEETAYALRDGWLYTGDIATMDEDGYFYLVDRKKDMIITGGFNVYPREVEDVLYEHPAVREACVIGVKDGYSGEKVVAFVSLKDGAAATEQDVIAFCRKHLVPYKVPKTVEFRTDLPKTAIGKILRRALRDTPPAEGEAKQSAKEAAATK

SEQ ID NO: 9854 - protein, 325 aa, Desulfitobacterium hafniense
MPKREDIKKIMIIGSGPIVIGQAAEFDYSGTQACKALKNLGYEVVLVNSNPATIMTDAGTADATYIEPLNVQRITEIIEKERPDALLPNLGGQSGLNLSSELAKAGILDHYGVKVIGVQLDAIERGEDRIAFKETMERLGIDMPKSSPAYTVEEAEKIAQELGYPVVIRPAYTLGGTGGGLVYNVEELKTIVNRGISASMIGQVLVEESVLGWEELELEVVRDSKNQMITVCFIENIDAIGVHTGDSFCSAPMLTISQELQERLQKYAYSIVEAIEVIGGTNVQFAHDPKTDRVVIIEINPRTSRSSALASKATGFPIALISSLL

SEQ ID NO: 9855 - protein, 269 aa, Desulfitobacterium hafniense
IQTREGTRIYYRQRLPAHPKAVVMICHGYAEHSSFYVQFMEFLAEHDYGAYALDHRGHGHSEAERGHLDRFEVFLEDLDVFVDHVRELHPTQPLFMFGHSMGGLISFNYGILHPGKLQGQIFSGAALARPVGTEYIPTFLFKLLNVVLKRLRIRPKLSGKTTRNMAVRKISDGDSLVLRYATLGFFYQFACRGVAFAQEKAGRYQLPCLILHGTGDRLVPYQASQRIFAEIFSRDKTLKLYEGLYHELIHEPEREEVLADIVDWLERRV

SEQ ID NO: 9856 - protein, 667 aa, Desulfitobacterium hafniense
NKKREQLEPFIHESEGKKMTSNEGITISDDENTLTAGERGPTLIEDFLSREKLAHFDRERIPERVVHARGYGAHGEFQPYESLADLTMADFLQDPNKKTPLFVRFSQVVGSKGCNETNRDVRGFSIKFYTDEGNFDLIAINMPVFFIQDAIKFPDLIHAVKPEPDNEYPQGQTDHNTFWDFMANNKETAHMSLWIASNRAFPKSFRTMEGFGVHTFRLVNKDGKSHFVKFHIKPLLGVHSLIWDEAQRLGSDADFHRRDLWENIEIGNYPEYEMAIQVIKEEDEFAYDFDLLDPTKLWPEEEIPLRRIGKIILNRNVENAFAETEQSAFHPGNIVRGIDFSNDPLLQGRLFSYTDAQQARLGPNHQQLPINRPVCPFANNQRDGASRLVIDRGKVAYHRNGLANNSPYTVPGTQGGFVTYPSTVEGHKVRSTAPSFKDHYSQAKMFWNSMSEVEKRQIIGAYCFELGKCGPFVRQEWVDVLAHISTELAKSVSKELGTTVPADVEESPVTKSSPALSLHNTIFVPDTLRVAVFLAQGFDGPGVSKVLETLAEAKLRVVIVHDTLGKVSGTEGVTYEVHDSFLTGSPLVYDGILIVGSGNITPYFTYTAQKFTTDIYNHFKPIGIIQKGDAVLEPLGLLADEGIVTDSGPDFAGRFIKAMAKQRFWNR

SEQ ID NO: 9857 - protein, 509 aa, Desulfitobacterium hafniense
MTVGDFLTLNSARYPDKIALVCKDKRLTYQELNCRVNALAHALLDLGIGKGDKIGYLFPNSMEIVELFFAIAKIGAIAVPLNHRLVAREIKCLLDSVECDVFVYSRLYDGPVSEVKGSFRTVKHIIRLGEPAPGEYSFEKLLEHKDTSEPDIAVDSGDLFRIQFTGGTTGRSKGVMRTHEADLFQTIGVMTSNKMGASPDEVVLTQSPLHHQGGITWMLCVMVTGAQFVICDGFDPVEILRQIEQERVTYMLLLPPSTYLRLIDAPVFRDYDVSSVKVVHTSAGGTSPAIIQKMAEAFPNCEVYYGWGQTETGAGTVHRITREMALHHPEKTQSIGRPMPFFQLRIVDEAGKDVPLGEVGEGIAKGPAIFSGYYKQPELTDGTIADGWTRTGDMMRQDEEGLYYMVDRKKDMIKTGGENVFAQEVEAVIRKHPAVLDCSVIGVPDQTFGEAVMAVVKLRAGYTAAAADIQEHCKRDLSSYKKPRYVEFLDEFPVDSAGKIQKFKLRKKY

SEQ ID NO: 9858 - protein, 390 aa, Desulfitobacterium hafniense
WLVFLSLALLFFAALGMLGNTNGLYLTPVSQEMGWSRTDASWYLTIYMLTMALTQPIASRLLYKVNSKVLLFISMTLVCAATGAASQFQTVMAWNISGVLMGLGYSVIMYLTLPVIISNWFSKKTGMVLGIALAIGTLGSAIANPVAGMLITEYGWRTARLAMSIAAWVIAVPGILLFVNFKPADVGLKPYGYEEGATGQAKAAISLKGVSAADSLKSPALYMVMFIACAVVLYSSMNTQIPGYASSIGLATAFGAYAMTILNLANMGGKIFWGWLTDRKGFLPSMVAALSCGIAGVLIILAGGSNVTIFYAGLVFFGICFSSLTVMLPLIVKGIFGEKDYGKIYANVTLVQQLMAASAAIIYGRIFDITQSFVFAWQMNIVTLAIAIVM

SEQ ID NO: 9859 - protein, 384 aa, Desulfitobacterium hafniense
LMDFRLTEEQELLLESLREVMARDCTEDYMKECYEKGEHPTKFVQALMDNGFGMLGVPEEHGGTPVDNLTMMLVAEEITKNGGPHFVFGQALSIADMLHFGSEEQIADTMAVVQRGGVAFVLGFTEPQAGSDSSAAATTYTRRNGKVYINGHKTFMSGALRAPYMLCLARNSEEAGNADKRNAFSMWWVPMNAPGIKIEKLEKIGWHMQDTCEVYLEDVEVEEKDLVGVEGNGFMQVLYNFEMERLLMAASVLGMAECAFEDAVRYANQRVQFGKTIGSFQLIQEKITFMKAKIENMKNMVYKCAWEVDNGLPVQISSAIAKLYCAQAANEVIDDALQIMGGIGYTKDARISRLWLDARVFRIGGGTDEIMIHAAGRAILKHYK

SEQ ID NO: 9860 - protein, 245 aa, Desulfitobacterium hafniense
QNDGIAYVIINKPERRNAMDADLMVKMVQVLEQLDQDTDVRVIILKGQGDHFSSGGDLKAGVGGEPTVENSRAALQKFIFAARKIQEMEKPVIAMVKGYAVGGGMSLAMVCDIVFASEDAKFSSNFLKVGITPEMGAMLLMPMMMGAQRAKELWFTGRVIDAAEAKELGFVNRVYTAEEIENATRNFAADLAQMPALPVRITKRITNSTLFNLLNSVMEAELQSTPFCTQTEEHKSLIEAFKNRK

SEQ ID NO: 9861 - protein, 425 aa, Desulfitobacterium hafniense
EDIVCVSAVRTPFGKFGGSMKDIDVYELGAIAMSKAMAKISLDPALIDEVWWGNGDTSSTKDPFTPVVARQTMLKAGISPETPSITYDQACTSALSTVKYGARSIKLGEAQMVMTGGSTSFSTVPFLLRDIRWEGKKHSSFLVEDPIIPLGYKDYAPVAVDSGNVAVEYGVSRQEQDELALASHVKYGQAWERGFFKGEMEPLEITKKDKKGKVLSAQLLAKDEQYRPEISMENLARLKPIFDNPTCTAGNAPGMNDGAAAQIITTREHAEQLGLPILYTLVGISAIALQPRIMPVSPAFAIKKCLDEAKLTIDDLKVIEINEAFACVPLVSLKLLANERFLTSDYKAMVKEASAQPILDHDPERYLKLKEKLNPNGSAIAVGHPNTASGARLMMTAAYQLQETGGGYAACAICGGLTQGAGAII

SEQ ID NO: 9862 - protein, 361 aa, Desulfitobacterium hafniense
FRYFMPTEIYFGEDVVLKHQEVFKTIGSKALIVTGRSSAKNNGSYDEVTKALSETGVEYILFDEVEQNPSLETIEKAGAIGKANKADFVIGIGGGSPMDAAKAIAVFIKNPEITKDNIFSGQKLASIPVVVVATTAGTGSEVTQYSIITSNKERTKKNLGQRIFPKVAFLDCKYTYDLPYDITVNTALDAFTHLVEGYLSSKSTPMSDIYGEKGFELFKDCFDRLLNNELDKEFRRKMMLASTLAGMLISQSGTSLPHGMGYALTYHKGLPHGLANSILTMEYLKSFQDQRKIKKMLSILQLDDLTELEGIFKKLLKVRIEIAEEEIREYAKNFMANKDKLKNHPEAVELEDIVGIYYRSL

SEQ ID NO: 9863 - protein, 422 aa, Desulfitobacterium hafniense
IKSVKARQVFDSRANPTVEVDITLKDETVGRGIVPSGASTGLFEAVELRDGEETFDGKGVSKAIHHVNEQLAPLLLDIDVRDQKAIDSRLIEIDGTPNKSRLGANAILGCSMAACWAGANYYKVPLYRYLGGSAANKLPVPMVQIIGGGAHADNAIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEEKTLTKEEMVGMLSDWVDKYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVF

SEQ ID NO: 9864 - protein, 276 aa, Desulfitobacterium hafniense
VGLIINKDTHVIVQGGTGKQGSYHVKAMLEYGTKVVAGVTPGRGGNQVGGLPVYDTVREAKERHKIDASLIMVPAPFVLSAAIEAIDAGVPLIVIVTEHIPVKDTMKINALAQEKGCRLLGPNTIGVINCREKVKIGIMPGFLYGSGRIGLISRSGTLSHETASNLMFKGLGVSTVIGIGGDQIIGTDFVDALKDFKEDQDTEAVVMLGEIGGNREEKAAEYLQSCDYGKPVFCFIAGRNAPPGKKMGHAGAIIQGSAGTVQSKEDKLRQAGVRIA

SEQ ID NO: 9865 - protein, 360 aa, Desulfitobacterium hafniense
MYLYEYEAKEVFSKYGIPLGQNGIATNPAEAGMICAGIGKPVVVKAQVMAGGRGKAGLILPAADPEAAAKAAAQILGKEHHGEQVKKLLIEEQIEIAREVYASITMDFTEGKPVMMVSAQGGMEIESLAAANPELLIKEHIDPWREVFGHRLRDLWRRAGFRGGQVVELENILGRLVRVFLETDALTAEINPLVMTQEGKIIAADAKLILDDEASFRSEIIRNASRPEINPLEKRAGDLNVTYVSIEEGGDIGIIAGGAGLSMATMDAVYGIGAKPAAFIDLGGGISRERMKESLLLMTETPNLRGIIINVFGGINNCLTMAAGLADFLDEKPTDVKIVVKMRGHEQEEGWRILERYGIP

SEQ ID NO: 9866 - protein, 528 aa, Desulfitobacterium hafniense
DVLVVGGGSAGTMAALEARKTSQEVALVDKGGIYRSGCGAAGNDHFLAVLESGPDWDTPEVFLQWYKRLTQGLSDIKIADKVFVRRIKSLVKELEEMGIPMKDPGHKEYIRTRSFAQPGDYFINFDGRALKPMISKRAEQAGVKLYAQIAITDLLVKKGKAVGAVGFHIRTGDFYVFQAKVVVLATGNATRMYENPSGMAFNTWHSPYNTGTAQAMTLRAGGEVKNLEFVNYTITPKNFSASALNAVVGMGGHLVNAKGERYVFTYHEKGEQGPRWAMPWGTYIEEQEGRGPCYFDVRHLSEKDKKHLLEHLLPVDKNTFMDYCEQKGIDPGVDLMEIQISEGQHPAFLGSVSGIFVDECCRTTLPGLFAGGACAVGIGSLAGSMCFGQSAGAEAAQYALQNRKGAEPSPEQIAELKQTVYAPYQSRGDYTYQEAEDKLRQIMSDYLSINRSAEGLKTGWQELNKLQETFGLVKAENGHDLMRIHELRDLLLISKGIAFGALTRTESRFGLSHYRRDYPETRAEWHKS

SEQ ID NO: 9867 - protein, 285 aa, Desulfitobacterium hafniense
MIPPNGLREREDFKAVLAEAHVWVVGINKVYAEDLEAAPNLKLIIKHGTGVDSIDLKAAAARGITVANAPGTNANSVADLAFGFMLSLARQIVSADKRTRDGFWGTVMGKDVYGKTLGVLGLGQIGKGVIRRASGFDMNILGYDLVHHSQFEKEYRVRAATLEEIMSEADYISVHLPLLESTKNIIDRSLLEKMRPTAFLINTSRGGVVDETALYDLLKEKRIAGAALDVFATEPPRQSPFFELDNVIVAPHMGAYTEGAMGAVSEILAESIVRVLAGKEPLSVI

SEQ ID NO: 9868 - protein, 240 aa, Desulfitobacterium hafniense
RVAVITGGAKGIGEAIVRKFYGEEAKVAVLDVDAAGARQLALELDPSGEKVIGLGCNVVSREGVKAAFAEIMAKFGTVDILVNNAGITRDAIFHKMTEQQWDDVMAVNGKGLFNCTQEAWLIMREKKYGKICNLSSTNSSGEAGQANYSFTKAGTIAFTKSLAREGGRYNINVNCVRPGVIDTEMMRAVPEQALEDYINKTAFKRMGQPSEVADVIAYLCSEESSFVTGEEILVAGGYIY

SEQ ID NO: 9869 - protein, 391 aa, Desulfitobacterium hafniense
LQDVVIVSAVRTPIASFGGALQGYGAVNLGALVIREAVQRAGIQGKQVDEVIMGNVLQAGLGQNPARQAALKAGLPVETTAQTINVVCGSGLKAVIAAAQAIRAGDAEIVAAGGMESMSDAAFLLDQARWGQRMGHGTLVDSMIKDGLWCAFNEYHMGITAENVAEKYGISRREQDEFAAWSQAKAVAAMEKGRFKEEIVPVAIPQRKGEPVIFDRDEYPRAGTTVETLAKLKPAFKKDGTVTAGNASGINDAAAACVLMSKEKAAALGIPYLAAIKGYGMAGVDPAIMGVGPVNAVKKALQKAGIALDELDLIEANEAFAAQALAVTKELGFPGEKVNVNGGAIALGHPIGASGTRILVTLVHEMKKRRDKLGLATLCIGGGQGIALVVE

SEQ ID NO: 9870 - protein, 497 aa, Desulfitobacterium hafniense
MSATLVETRFGLVEGIREGGVSIWKGIPYAAPPLHSLRFRPPREPGAWAGVREAKEFGPAALQGESPSMKFLGDSPLHKREDCLYLNIWSPGADRKRRPVLVWIHGGSFMYGSGSSHLYNGKSFAEQGDVVVVTLNYRLGVFGFLHLSDIGGEAYRGSGNCGLLDQVAALTWVRENIEAFGGDPHNVTIFGESAGAVSVGNLLAMPLARGLFHKAILQSGTARCKVTLEAAVKMTEQLLAQLQIDRQNLSELADLPAEKIIEASGILPRRAFGPVGDGIVIAEHPEKVLYAGLAKDIPVLVGTNAHENKLFTYFDPAWKDMDESEIKVFLERTFGSSWAAGSHSAAQADALNQALSKALNQASNQAGYEDAMTHYVFTYPAIYFSEGQAKHGAPVWMYRFDYASKALGGEAKAFHGLEIPFVWNTLLAQETEELTGKDPCRFQLAGLMHRAWIAFARHGDPNIPGLPDWPPYDEEIRATMLFNTHNEVVNDPDGRQR

SEQ ID NO: 9871 - protein, 725 aa, Desulfitobacterium hafniense
  unsure (1)..(725): unsure at all Xaa locations
CHGVGCGLRIFVKDGELQKVEGDPDHPITKGRLCVRCLTMKEYFYHPDRIKYPMKRVGQRGENKWQRITWDEAYDIIVENYQACAEKWGVNSVSVWSGTGREACRYQTPLCLDVFGSKTIVHPNSGWSCLVPRMAVMSWILGSAYVEYDYANGLPLRYDDPRWEPPKYMLVWGRDPLRCNADGLWGHSMIELMKRGTKLISVDPRANWLATRAEYHLQLRPGTDAALALALLHAVIKTGKYDKEFVEKWCYGFEELAERANQYNPEWAEGITGVAAADIYAVAECLVQKPSSACIGLAIDQNPNCIQIGHALYSIFAITGNLDIPGGLFMGQPTFFAGDVNNDPNQKSEEAEAEFEGIGYKEFPAIPMIVNTTHPDCTLDTLETGRPYPIKFAFIQSTNFLASSIVVQPKRWYEAMRKLDFIVASDIFMNPTIAGLADLVLPISTSLEHDGIVMNSMASQPGQYGALVKIIEDFGETKSDLEILLDLHHRLHPDSQDPRWKDTDSYLSHDMAPMPGVDITFPELKERVIAQYELEYRKYEKGLLRPDGQPGVNTPTGMIELYSTMLEALDEDPLPYYMEPKFSAVSRPDIAGDYPMIMTTGARRFTSFHSEHRQIRTLREIHPWPTAEINPKTAAAKGITEGSWIYVENPWSKAKLYAHLTPIVKENVVSIDHGWWYPERGPEKMFDVWECNINNLIPNKENGKLGFGTHFKSMPCTIYRADXGK

SEQ ID NO: 9872 - protein, 676 aa, Desulfitobacterium hafniense
KTFRNVCPRNCYDTCAQISYVEDGVLKKVEGDPKSTYTNGKLCLKGYNYTRRVYSPDRIKYPMKQTPRGSGNWERISWDEAMNTIAGKILDLKKRYGSTLPICMNKYSGNFGITHYGIEGTMSSIGYTTRAIGTPCWPAGIDSQTYDFGTIVNNDPEDFVNANYIILWGSNCAWTGVHSLPFITKAQERGAKVVAIDPVLTSTASKADLYIQINTSTDGALALGMARYILDHDLVDWDYVQANSIGFAEWADYVKKNITLDWAAEKTGIPKEIIIQLAHEYATAKPASIWVGYGMQRHTNGGQNVRIIDALGLMTGNIGKSGGGINYAHLETWGFNYHAMVMPAPEGSVGMAGPDGTHTDRSVNMNNFAADVQALTDPPVKMLWIAARNPVSQDPDTHDIIKMFNSMELVVTVDSFFNKTVEQSDIVLPATTHFEDWDVMASYWHHWVGVNQRAIDPMYESKSDVEIAMALSKAMNALEPGSCTYPTEGDPEEWTAREFNDGVYNMLGITDYKELLAGPRKAKFSPAAWADGKFRTPSGKFEVHSERAAQNGLPAIPIWVEEMKAPAQYPIRFMTPHPQHGIHSQFQNLDWMMAANPEPLLEIHPELAARHGIAEGDQVRVYNDLGEVTIKAHLTRTTSPDVIVSYEAWYKDSPFNVNYTVKAIPADMGKLATGMD

SEQ ID NO: 9873 - protein, 614 aa, Desulfitobacterium hafniense
MDTLHHHICPRNCYDTCSIISTTRHGRLASIEGNPAHSYTRGKLCPKVMDEIHKVYSPQRIRYPLRQRKRFSGQWERITWDEALETISRKILDLKDKYGTTLPLAHNKYSGNFGILHNALEAFLTGLGPTTRAVGSPCWSAGVEAQVFDFGAFFCSDPLDMEKAKLIWIWGANPAWNAAHQMPIIFRAMDQGAKVICLDTHFSATAARVHQFVRVNPGTDGLLALGLAKIIVDHQLTDPELPDYSLGYNEFIDYLKAEIDLRKCSAVTGVSLETMKELALEYGAVKPACIWAGFGLQRYTNGGQNLRAIDALGALTGNIGRPGGGVQYGHFETWRFAGPLAHSQCGHAQDRELDINQFPQLALAADPPVKMLWIASRNPFQQDGNHAGWQKLSETLELIVVSDLFHTRSSAAADLFLPVTTHYEHWDLHASYWHYYIGINEPAVEPVGEARSDLQIAWDLSKRLNQSSPGSSAFPTEGSEKEWVLGAIGPEMLAILGIDSAEELLKGPRRVNYPGTAWQGRQFQTPSGKYEFYAEKAQEWGLPPLPVYRPPRQAPPETPLRLLTPHHLSGLNSQVYLYSEESDSLLKARLHPKTAEGYGLNRGDKAILWNRGGS

SEQ ID NO: 9874 - protein, 1138 aa, Desulfitobacterium hafniense
LTPNARVILEKRYLKQENGEVAESPEDMLYRVASIIAQVEETFGKTKKEVKELAKSFYEMMAKLEFMPNSPTLMNAGRDLGQLSACFVLPVEDSMEEIFDAIKSAAIIHKSGGGTGFSFSRLRPKNSTVRSTGGVASGPVSFMKVFNAATEAVKQGGTRRGANMGILRVDHPDIREFITCKEDNKEITNFNISVGITEEFMKAVQEKRHYNLIDPHTKEADGQLYAPEVFQLIVDHAWRNGEPGIIFLDRLNRDNPTPQLGEIEATNPCVTGDTWVLTEEGAAQVRDLLGSQVKLALNGEYHETSKEGFFATGVKQVLTLKTQQGYELKVTADHLVRVASDMTRYKVTQEWKPAGELKPGDTIVLSNNRSIQWQGKGTKEEGYLLGLLLGDGTLKEEGAVISVWGEGEEAKSMMEAAEKAAFSLTHRQDFQGFQKEISERHEHRMRFAALRDLAQQYGILPGSKAITQELEKTGQDFYQGLLRGLYDTDGTVTGTQEKGVSVRLWQTDLAGLKVVQRMLQRLGIISTLYEERKPAGQKLMPDGQGGSKEYPVQAGHELVISQDNIEIFAEKVGFSNSKKAQLLAEKLNVYQRSLNRERFVDNIVACVPGDAEEVFDAQVPGINAFDANGIYVHNCGEQPLLPNEACNLGSINLKLMVTEKNGKVVVDWERLGQITRLATRFLDNVIEANTYPLPSIEEMVKGNRKIGLGVMGFADMLILLQTSYASEDAVEYAEKVMNFIQTEARLESQRLAEERGTFPNYQGSIYDGVRPLRNATLTTIAPTGTISMICGASSGVEPLFAVAYTKTVMDGTPLIEVNPIFQSLAEDYGFNSPELMRKIAEKGTVLGFPEVPNWVQEVFVTAQEIEPEWHIRIQAAFQKYTDNAVSKTINFANEATHEDIAKAYELAHELNCKGLTVYRDGSREEQVLSTGITKKAEEKAEEAKTQVSIPKVPFIPEVNTVLPRPRPTTTTGVTEKIRIGCGNLYVSVMADEKGICEIFTNTGRAGGCSSQSEATARLISIALRSGISVDAIIEQVKGIRCPACIRREGVNVTSCPDAIARVIKEYVELGKGKVNSVKVTSQPAVEEKPVQSKSASITNPQKTRATVAEGNACPECGMSINHESGCVVCTHCGYSKCG

SEQ ID NO: 9875 - protein, 1079 aa, Desulfitobacterium hafniense
  unsure (1)..(1079): unsure at all Xaa locations
CSHVVAFRTEKNLKMAVLTHLAKMPLGYFDRNPSGKLRKIIDDNSFQTQTFIAHQLPDLVGAQVTMAASLVLMLLFDWRVGLPLLLLFGVGFFLQGSLNGKESMKFMQSYQDALETMNHEAVEYIRGISVVKVFGQTVHSFSKFNAAIQSYRDDALAFTMSCKKGMVAFNSIVNSSFLVLVPAALLIGLVSPDLPGFMQSFLFYLIFSPACAVMLNKIMYMTSYKMQAEESMRRIDGILSAEPQREAARPQTAGGHEISFADVTFRYEGTDHPAVSHLSFIAKPGTTTALVGHSGSGKSTTASLIPRFYDVQEGVIKIGGVDIREMASEDLMRKVAFVFQNPRLFKDTLLANIRAARPEATREEALQAAHLAQCDDILAKLPQGIDTVVGSRGVYLSGGETQRIAIARAILKDAPIVLLDEATAYADPESEQQIQQAFKGLTKGKTVVMIAHRLSTVRDAGQIVVMKQGGIVEKGTHDGLVAQGGEYARMWDNYQKSTQWHIGGEVRSCXRACLPXAIREQRIXTKDRRHYPKQYSPDSSGQPADPGGHELLNGMGGETAGLQRTVSLMPLYGVLTVVLFVMVFATQWLQYNKTYTVAYQESANRRIVLAEKLRKLPLSFFGQKNLADLTATIMGDCTALERVFANAIPQLLGTVFMFILTVLGLVILDWRLGLCIALPVPVAALVVIAARKAQQKAERANLDAKRTAYDGVQEYLETIGELKACSREKEYLEGLEQKLDQVVRCSFRNELAPGAATTAAQFILRFGLVAVLLVGGYLVAKGSLSIPMFILFLLFAGRIYDPFTSCFMMLAEVFSSLVSVGRMKQIDATPEQTGDPVCNNQGYDLEFDQVVFSYNDEPVLRGISFVAKQGEITALVGPSGSGKSTVSRLAARFWDADSGRITLGGVDITKVEPETLFRNFAIVFQDVMLFDDTVMENIRLGRREATDEEVRAAARAAQCEEFIEGLPEGYRTNIGENGSALSGGERQRISIARALLKDAPVVLLDEATASMDAESETLVQEALSVLLENKTVMVIAHRMRTVANADKIVVLDNGHIREQGTPAQLINQGGLYAHLVSLQ

SEQ ID NO: 9876 - protein, 2773 aa, Desulfitobacterium hafniense
  unsure (1)..(2773): unsure at all Xaa locations
RNCLXKKVREFMTGNLKESLESFYAAKVWEDITLGKALSAWSETYGDNIALTEADRQVTYRELETAARRMAAGWQRRGFGRGDKIVLQLPNSIEFVVSAFALFKLGVIPVMALPAQRKTEIKGIIEKSGAKGYVIKEKYLGFDYKSLAREIRREIETDLAVIVIGRSDEFIAYEDLGEGPELRDEPEIGSGEVGLFLLSGGTTGIPKLIPRRHADYLYVAQKTAERCRLDQESVYLAALPVAHNFPLGCPGLLGTLSVGGRVVICAVASPDEIIPLIEEEGVTITGLVPALAHMCIEFLELDGECDISSLKVIQVGGAVLDSYLAARIEKAFACTLQQIFGIAEGLICCTDLADREEIRYHTQGKPISAYDEILIVDEKGQEVPEGEYGELTVRGPYTIYGYYNLEEVNQSCLSDQGYFKTGDKARWQDGNLQVAGRLKEMINRAGEKITPSELEELLLRHEDIEDVQVVGVEDQELGERICVFIMAQNKGLTLNALRNYLVGQQVASYKLPDQLVYLEAWPLTNVGKIDRNQLRVLGTQRGNQEVFHEDKNPRTAAMEFVGQKVRDLLAAEQIAADSNLIEEGLSSLMIMQIAGGLRKYKLRISFAALIEKPTLRDWAELINKAKLKEAGQVPEGAVERVVEEAVEEAAGEAAAAERAVERTAGEPGGQFPLTDVQYAYWVGRNDDQPLGGVGCHAYLEFHGQSIDPLRLKLAWNALQRHHPMLRAKFFPNGRQAIMPSPYSEEIEVFELGGLAPDELQEELLSLRSARSHRKLKVEEGEVAGLALALLPDGTGRLFLDVDLLVADVLSLSLIIRDLAEAYLGKRLGEPPEYTFQDYIRGREGEAENQEREEDKRFWEGKLQAMDWEGLRMPLQTKPELISKTRFSRRQAIVGREDWQRIRQTAARYQSTPSMILLTAYALVLERWCSQGSFFINIPLFNRDLEDGRISAMVADFTNLLLVEFMKKPQETFLMTMERVKSTFLENVSHSGYSGVRVQRDHFGKMGGTGFVAPVVFACNIDYPLETPLSRRAFGGVGYMVSQTPQVWLDFQTYVRDEELMLCWDAVDELFPEGLVDDMFGALQDLIQGLAQHDDWNQGFDVLPPRQKAQRAGELADLLPLSPPPKTLLSGFLSHVRQNPDSIALIDGRTQGSITYGELYRRALAVAGLLVRKGVQPGDYMGILLPRGCGQIYAILGILMAGGVYVPIGISQPEGRRQKLYRQIGLKGIITHGETIPSGHPDHEGILVVELEEGMGKGGLEEGMGKGGPGVGTDKGGLEKPVMASPQDSAYVIMTSGSTGSPKGVEISHEGAVNTIEDINGKFGISARDSVLMVSAIDFDLSVYDLFGMLSEGGRVIVLDEENYKDPDVWLRLMQHYSLLVWNSVPVLFDMLVTMAERREAPLDLRLVMLSGDWIGLDLPRRFYELNRNATVVALGGATEASIWSNYQVVPERLPSDWITIPYGQPLKNQIYKVMDKWARVCPNYVAGELWIGGAGVAKGYKGDEELTGQKFKTDTIRWYKTGDSGRMWEDGTIELLGRLDNQIKIKGYRIETGEVESALMKLPGVANAVVCLSEENEDKVLAAYLVAKEKVKAEEKRYAEVEGVKEALAACLPHYMIPAVYVWAGELPLTVNGKPDKRQISELLKNRWQKTSFSPPEGALEGQIAKVWQEVLHKKELSRHDNFFKLGGDSLKAVEIVTKAGAVLKLPLTLSIQTLFRCPTLREFALEIAKLGSGYEEEIIXRSSCXVRGGCRQXRLKKEXRNSVTKGLFYGLKGLPXNSKHRRVWLRKRXEAFXKKTNRGLSSTWRGISRLLWARNRAGRFNKFPLTDIQNSYVVGRNKHYELGGVACHGYLEIEFEEILDIERLETAWNKVIQKHDMLRAIVYDVGYQIVQETVPLVRIPAIDLRGGGNDKGREALRKSLAHKQYPLGQWPMCDVAVSIDEEKSVVHFSVDMLIADFSSMNIILNDLEHFYRNPEEPISYPTLYRDSVMYQNDRKMLNPQERQAAEAYWEQKLPSLGEAPELPVIKKTGLTEHTFSQKKLFLERERWQGFCERAKDAQITPSVLVMAALAEVTALWSSSHKFSINTTIFNRPPLAEDIHQVVGDFTDVIVSSIDLDFSIPFSQRAQAIQKDLWTDLEHSALSGVEVLRKMTKERKKNIIIPVVFTSTAGIAGKEDATVRRSIRYKISQTPQVYLDCQVADENGGAKINWDVRDGVFEEPVISDMFESFSRLISSLCEPEQQVLADYFPVELPLGTREVRNITNSTAREYPPRMMEEGFLHALRHYPNKTALITDREEFTYASFSRYVKTVVDLLKEQDVRPGDRVGISIDKNQWQIAAVMAVLLVKGTYVPIDVHQPSARQEKIIKGAGIKVLLIQDEDYSSQKGHPAREGCSAQGGCPPWEGCTTINLQGVSLGNEPLDVFTSDPDDSGSGGPGSAAPGSVALGSASSGPDYDRPAYIIFTSGTTGEPKGVVISHRAAMNTIMDVNHRYGIDESDVFLCLANLSFDLSVYDIFGCFAAGGTLVMPASSQIRDPKYLYDLILLNRISVWNSVPAQMQMVVNYLESVESMKKKTSLSKVFLSGDWIPVNLPERIGAMFPQARVVSMGGATEASIWSIYYDIAKGEVFGKSVPYGKPMANQRFYVLNGEGRPCPDYVEGNLYIAGDGLSLGYLNDEKLNGEKYGRLPATGERIYRTGDRGYYRRDGNIMFRGREAGDEQIKIHGHRIELAEIRTALTDYPLIDSALALAVGTPPDELKISAVMTPKRRSEQQDI

SEQ ID NO: 9877 - protein, 248 aa, Desulfitobacterium hafniense
VEKQDSGIATLVLNKPQRRNAIDPGMMEQLAGILESLDQDEAVKVIILKGEGEHFCSGGDLKAGAGTTPTIENSRASLKKYCRVVQIIQQMEKPVIAMVRGYAVGGGMSLALACDLLMASESAKFSSNFLKVGIVPEMGALLFLPQTIGLYRAKELWFTGRVVEAREAWQMGFVNHVFPDAEIEEATMSLAQGLAGMPSLPMKITKRITNSTINQLLNAVMEAELQSSPFCAQTEEHKAYKAALRNNK

SEQ ID NO: 9878 - protein, 378 aa, Desulfitobacterium hafniense
  unsure (1)..(378): unsure at all Xaa locations
KXRTGIIAGKPXRTDGAGMPGRLCQKMRXRRAVPGGIRQSSGRQRLRLTGGSGRIRRHPGGSPDSSAGQRRNSQKRRVLSMSLPKLFSWTICSPTAPKNRRRSPCIMXNRDRSRFASALPEPQAGSDTSAIQTTYTRRNGKVYLNGHKTFISGALTNPYLLCMARNCDETDKTKAFTMWWVPMSAPGIKVEQLHKIGWHMLETCEIYLENVEVEEKDIVGQEGHGFLQLMKNFETERLLMAATILGMAECAFEDAVRYANQRVQFGKPIGTFQLIQEKITYMALKIENMRNLIYKTAWEKENGISTQITSALTKLYCAQSGNEIIDDALQIMGGIGYTNDCRISRLWRDARNYRIGGGTDQVMIHIAGRNILKKYRXR

SEQ ID NO: 9879 - protein, 510 aa, Desulfitobacterium hafniense
LHIGFLLTLNANRYPQKTAIVCNRQRISYAQLNRRVNKLAHGLLELGVTKGDKVAYLLPNGLRIVELYYAVQKIGAVSVAINYRLASPEIGCLLEQADCQVFVYHELFDDKVRQVKENVKTISLMIRVGEQPIQGEYAFEALTDHDHEEEPDILIGEEDLCRIQFTGGTTGRSKGVMRTQRQEIFQVIGITTALELGGPDRVMLTQSPLCHQAGLSWLNVAIGAGNTLIVCDRFEPEKILRQIQEESVTNVMLLPPSSYHRIFALPSLAEYDLSSVKSVHSSAGGTSPEIVRKLYKVFPNCVVRCGYGLTETGGVGTTFVLTREVLENNPELTKSVGKEMSFLELRLVDESGREVPVGETGECIARGPSVMTGYYNQPELTEEVIKEGWVYTGDLLRKDEKGYYYFMDRKKDMIKSGGENVFAQEVEGVIRTHSAVDDCAVIGVPDPRFGEAVMAVIKTKPGQAVTGEGIQEHCKKYLAGYKKPRLVEFVDEFPVDQAGKIQKYKLRATF

SEQ ID NO: 9880 - protein, 353 aa, Desulfitobacterium hafniense
NFIDLSANINPFGPPQGVWEALQKGVANIIHYPDPNYRRLRGKMAEYYALNAEEILLGNGAGELIFLILHGLRPRKVLIPQPAFSEYERAALACGAEVNKLILGVKGWGELSFQNEESHREWEQALAENELVFINSPHNPTGSALSKQQFEVILNLALKHQTWVVLDESFVDFLEDESRWSGKGYLRRYPNLLVLYSLTKFYAIPGLRLGAVFGAAKLLGRLQDQRDPWAVNSLAEEAGLAALADAEYGKRVRRLLQESKESFYRSFAEGRKGKKYWGLRLYSSKVNFALIQVLEAEDSGTDRDDAGKGKKNLIQELGKQGILVRDCGNFAGLEGNYIRVAIKDQESMNSLLA

SEQ ID NO: 9881 - protein, 589 aa, Desulfitobacterium hafniense
LLILLLLNAFVFPHLLKRQVTQVDYGSFLSYLESGTISEVEVQDNQIAFMTKDSTGKETIFVTGAMADPELVNRLKAAGVDKYSQVIPKENSPLMNILLTWILPMILLFGLWMLLGNLMQRKMGGGMNAMTFGKSNAKIYVQAQTGKTFADVAGQDEAKEALTEIVDFLHDPSRYAAIGADLPKGALLVGPPGTGKTLLAKAVAGEAKVPFFSISGSEFVEMFVGMGAAKVRDLFKQANEKAPCIVFIDEIDTIGKKRDGGSFGGGNDEREQTLNQLLSEMDGFDGKKGVVILAATNRPESLDKALLRPGRFDRRIPVELPDLAGREAILRVHGQKVKMDSPIDFKAIARATAGASGAELANIINEGALRAVRCGRSRVNQSDLEESVEVVIAGYQRKGAVISHREKEIIAFHEIGHALVATKQTDSAPVHKITIIPRTSGALGYTMQVEEDERVLMSKEEAFNKITTFTGGRAAEELIFGTYTSGASNDIEQATKIARAMVTRLGMSKNFDMMALETVNNPYLGGDTSLMCSPETAARIDEEILSIIKSAHKKAFEILKENIEKLHELARYLLEKETITGEEFMAVLS

SEQ ID NO: 9882 - protein, 683 aa, Desulfitobacterium hafniense
MEFSRRNFLKTCAISAAMMTVGCTSQTKTIQVDPPEPAPSAPKQIDVDQWVKSVCRYCGTGCGVLIGVKDGKVAAVKGDPDNEGNKGLLCAKGYYLPQVITHSERVTKPLIRKNGKLEPCTWDEAMELVTAKFKESIANNGPDSVAFYGSGQQLAEEGYVANKLFKGAIGTNNIDGNPRLCMASAVGGFTTTFGADEPMGCLEDFEHANVFFIIGSNIAEAHPVLFGRLTDKKKKDPDTKIIIADPRRHRSHEIADISLQFVPGTDMALLHAMAYVIIEEGMADEEFIAKHTSFSNGKEAITFAAYKEFLKEFTPEKAEKVTGLPAAQIQEVARLFGEKGKNTMSMWTMGINQRVAGVWANNLIHNLHLLTGKICKPGSTPFSLTGQPSACGSVRETGALSHLLPGHRVIANEKHRKEVAELWGVPADRISPQAGLHTMELFKACGDGRVKCLYVMCTNPAHSLPNVNAYQEGFEKVFLVVAEAFHPTATTKYADVVLPAAFWCEKEGVYGNTDRRTQHLAKAINPPGEAKPDLDILLDLAQRLGYGELFPFKTPEDVWNEYLKCTTGTHMELATYPALREAHGIQWPVKDHQGNKGAVRRYVAPEDPYVKEGIDFYSAKDHKAVIFARPYLGPAEVVDEEYPYYLTTGRILEHWHTLTMTGKCPTLMRAVPKQYVELNPQDA

SEQ ID NO: 9883 - protein, 158 aa, Desulfitobacterium hafniense
KLRFAEINDAPLILELIRELADYEKMAHEVVATEEVLIESLFERKMAEVVIGEYKNAPVAFALFFHNFSTFLGRPGIYLEDLYVKPDMRGKGIGKMMLAFLAKLALERNCGRLEWWCLDWNEPSIQFYKQLGAVPMAEWTVYRVHDEALAELAVKFDG

SEQ ID NO: 9884 - protein, 177 aa, Desulfitobacterium hafniense
MKKVYLVRHGDIGLGRNKRYIGIQDLSLSEEGREQAFSLKERLREVPLDRIYCSALSRSRETAAIITEAHSLSLTVLPELHEIGMGEWEGRLFSEIQERFPAEYRLRGEDIVHHRPPGGESFLQCSRRVIPLFESIVRSDAQTSLIVGHAGVNRVILCHALGLPLQELFSFKQSYGC

SEQ ID NO: 9885 - protein, 619 aa, Desulfitobacterium hafniense
SDKVKTSICCLCNGGCGLKVHISPEGTIKAIYGDPDNPYNKGKICPKPIEIIENLRGPERVQYPMMKVNGEFVRISWEEAIDTIAKKYKEFSDNFGTGSVIGITSKIGGSFSKFALKIFGEIAGFANYGTGPICFSSEEKVRKEMFGKAAASAPLHDVIYSKLVLNVGNNCAQTKAGQFHWLQEGQKHGAKIITIDTRYTETAQLSDQFIQVNPGTDAALGMALLHLVIKHKHYDEAFVRDQVNGFAELAQAVEDFTAEKAAAITGVPEKVIEELAYELGTKKPAIMWPGRGIVMVNNGEQALMAFESLFAILGNVGKPGAGVVSHINGYGQPADLIKPEHVVKPSFKLPADKVIEGMETGQIKMIYIAGNPCANWPESARMKKALGKLDFVVSHTLTLDDSACLAHIVIPATHWLEEAGMQPGIHRVMQWRDKAVEPYGESKPAAEVFKLLAAKMGLPTEYFADTPEEAWDMERRHIAGISAITVAKMQEKPGGVHYPYPEGGEESHRLYSKGFNTPSKKVELLRGKGSVLHYKDPLQSPGNEGLSIEDYPYFISSVKVAAHYHTQCQYSRLAREFEKPYVEVHPQTALKLGVKDGEAIRIETPTGAISLPAKLTYSV

SEQ ID NO: 9886 - protein, 425 aa, Desulfitobacterium hafniense
RKINVNKVIDEAKFNRYFLIIFVLLLLALIFDGYDMGIYGVTLPSVMKELNLNATQTGLLASAGMFGMMFGALLFGMLSDVIGRKKTIIIGIFVYSVFNGIVAFIHSASIFAVVRFIAGMGMGALTPVVISLLSEYTPRSRRTLLLTMVMVGIPLGQLVASLAGVAFLESIGWRVLYLATLIALIMIAFVVWNVPESMKFYVPRGETKTIKKVLAKANPDFEQTEEDVYELSIVNQQKASLGSLFKSGYAKNTIYIWIAFFCNLYLFFGISTWLPKLMTMLGYPLKSSVMFLAIFLLGGVLTTPFVGMLGDKYGYKKVMPVLYAMSAVLVSLLSFQMSTFIFYTLLFLAGCAVTLVQSMTLAAAPDFYPIAFRGTAMGWGSAVSRLGSAVAPTVVGVLLTANLPVRGVFLTFIIPAVIACIAILL

SEQ ID NO: 9887 - protein, 713 aa, Desulfitobacterium hafniense
GCGMILTVKEGRLIKVEGDPEHPITNGRLCVRCLTLPEYTHHPQRVIYPMKRLGAKGENKWQRISWDEAWDTIVDKINYFKENHGAESIVVFGGTGREACLYYYPLGFASIGTPNVCYPQSGWSCYGPRCAITDYILGAGYPEIDFAGHFEDRYNHPGWKAPEYLMLWGKEPLKSNPDGFFGHSVIDMMKLGTKIIMVDPRISWLATRAEHVLQLRPGSDTALALGLLHVIIKEELYDHDFVENWCYGWDEFVERVMEYPPEKVSEITWVPAEKIYEVARVFAKAKPASLGWGLAVDQNPNGVQLGHALLAMIAITGNLDVPGGVTIGPPASLMGKWRVESRSNLSEELWNKRIGAEQWPAVSTALATTHPDETLNTLETGKPYKLRMGWFNSSNFITPTNSAQPDRWYRALQSLEFSVVQDTFMTPTAMAFADIFLPLPTFAEHDGVVLTHYGRNAVFAGAMNKALTVGETKSDLEVCFELGKRLNPKAWPWDNVSDFFTEQLKPDTGFGFEELREKGLYQPGYTYKKHEKGLLRFDGEPGFNTVTGMVELCSTLFESWGDDALPYHEEPPYSPYSTPELAKEYPLTLTTGARKYTSFHSEHRQLKTLREIDPNPEMEIHPETAAELGIIEGDWVVIENMFGKARMVAHLTEAIHPKVVHATHGWWFPEKEAAEPSLFGVWESNINTLMPHQHNGKLGFGDTFKSILCKVYR

SEQ ID NO: 9888 - protein, 398 aa, Desulfitobacterium hafniense
VVFGGFLTQIILMCGVQFVPILMAPIKQSLELSNTSAGTIVSVFGLCYAGCSFIWGYLADRAGARTAVSLAGLVLGIAVILFGLLADSFLKAVLIIALVGFGAAGVYSATIPKLIGAWFHPSKRGRAMSTITAGGVLTGAAFGIVLPQLAKAYGWQTAAVILGVLAIICTVVIYLVVRNKPSEKGLIPVGTPADQVVKAAPAMKDAGFKDVLKMKVTWHVSSMFIFWQVAYMTATAFVAVSFVNAGFTAVQGGLAVTIYNLCQLIGQQIWGPLSDRLERKTVICIAGIWWTAATLGYMFIYGSTLNAMYILIGVMGVGMGMVPVILASFSDYFPTEVGGSGAGVVSTMGLVGRFFGPMLAGYAADATGSITGAFGVGAAAMLLASLVAFSLPSLKKQA

SEQ ID NO: 9889 - protein, 358 aa, Desulfitobacterium hafniense
LVLENGKIFRGESFGAGGEIQGEVVFNTGMTGYQEVLTDPSYKGQMVCMTYPLIGNYGINSLDNQSPQIQVQGFIVKEAARNPHHWQLEKNISRALAQAGVVGIKGIDTRALTRIIREHGVLRGMITTELGELDQKALELKNWEIPQDAVAQVSTRETYKLPPLGKTDSRKPFHVVVMDFGIKSSILRAMQEEGYALTVVPYSASAQEIIALKPDGVFLSNGPGDPKDVAVGIKTIGGFVNKLPVFGICLGHQLLTLALGGDTYKLKYGHRGGNQPVQDLRTKKVHITSQNHGYAVAEGSLADTLLEVTHLNLNDQTVEGVRHKELPVFSVQYHPEAGPGPNDSLYLFKEFSTLMTEW

SEQ ID NO: 9890 - protein, 1056 aa, Desulfitobacterium hafniense
MPLNPAWKKVLVIGSGPIVIGQAAEFDYAGTQACKALREVGIEVILVNSNPATIMTDEQMADRIYLEPLLPQNLEGILAQERPDALLPTLGGQTGLNLAMKLQEEGILERYGVALIGCNAETIYKAEDREAFKETMLEIGEPLAESAIVTSLEEGLAFTARRGYPVIVRPAYTLGGTGGGFAKNEKELLEVLHRGLQASPIHQCLLERSVAGWKEIEYEVMRDAMDNCITVCNMENIDPVGIHTGDSIVVAPSQTLTDGEYQMLRSSSLKIIRALGVNGGCNVQFALDPESREYVVIEVNPRVSRSSALASKATGYPIAKMAALLAVGFTLPELRNPVTGHTSACFEPALDYVVVKFPRWPFDKFPAADNHLGTQMKATGEVMAIDRTLEGALLKAVRSLEIGAVGLRIADSGRWTEMEIEHKLAQADHERFFAIAEAFRRDWTILEVQMLTKIDPFFLNKLKELVLLERRLGSEPLTLELLRSAKSQGFSDQAIGRLRGVTQEEIRQERCRYGLKPVYKTVDTCAAEFYSSTPYYYSTYEEEDEVAVHSGPKVIVLGSGPIRIGQGIEFDYCSVHALWALQELGIESIMINNNPETVSTDFDTGDKLYFEPLTLEDVLHIIEKEEADGVLVQFGGQTAINLASPLQKAGVRILGSQVDAIDKAEDRERFAQLLLELGIPQSEGCAATSVSQARAIAGELGFPVLVRPSYVIGGRAMQVVEDLAELEGYLTRAITLSPEHPILVDRYLEGKEVEVDAIADGEITVIPGIMEHIERAGVHSGDSLAVYPTQSLTPAEIQQIQDYTCRIAKGMEVRGLLNIQFVVVNGKVYVIEVNPRASRTVPILSKVTGIPLVALAVRVAMGEKLADLGYAHGLAPEIPFVVVKAPVFSFEKLTQVETSLGPEMKSTGEVLGMDVNFGHALAKAFAASHVPLPDKGDILVAVAEKDRPEAIAMTRELSRLGFGVKATGNTAKALLFCGVPLEEVREASTELKEAVRRQEFSFVLSTPSKGDSEERTGYLLRRLAAEHRVPCLTSMDTAQAVVRALKEIRNHTAPQT

SEQ ID NO: 9891 - protein, 617 aa, Desulfitobacterium hafniense
TQEEMYLFNCGEFYYSYRKLGAHFLEHKGRWGTYFAVWAPQARQVSVVGDFNGWCGMNHSLQKWEEQGIWTLFIPGLPTGEIYKYEILNSSGESVLKADPYAFFSEVRPHTASVIYSLEDYAWGDQAWLAQRKTRNPKVLPLSSYEIHLGSWRRTEDGRFLNYAQLVTVLIPYVKSLGYTHIEILPLMEHPYDGSWGYQITGFYACTSRYGTPHDLMYLIDQCHQAGIGVILDWVPGHFCMDAHGLGKFDGSPLYEREVHEQWGTYKFDYSRSEVRSFLISNAVFWLDVFHVDGLRVDGVSSMLYLDYGKEKGAWQPNRYGGRENLEAVGFIKQLNATLHGLYPDALLIAEEATDWQGVTGPLDQEGLGFTFKWNMGWMNDTLRYIGLDFNERRSFHQLLTFPMMYAYAESYILPLSHDEVVHGKKSLLDKMPGDYGQKFAGLRGLTTYFMTSPGKKLLFMGGEIPQFIEWREDRELDWFLMDYELHRKYHGFVQQLNGLYLREKALWEIDGDWTGFEWIDVHNHEQGVIVFCRKGKSFQDRLVVLINFQPYNYERYRIGVEMAKGYREILNTDSTDFGGWGMTNPGLLKVEGVPWHGREFSLEIRVPALGAMILKP

SEQ ID NO: 9892 - protein, 806 aa, Desulfitobacterium hafniense
MFSDKNGFKDAYLEKFAEIKGKSIEEGTLWDKYHTLVVLLREEISLSRAFINYADPKNRPAKQVYYFSMEFLIGKLLHNYLINIGIQDIVAEGLEELNIDLQELLAQECDAGLGNGGLGRLAACFLDSMAFLGIAGHGNGIRYKYGLFEQKIVNGYQTEVADHWLKNGYPWEVRKPDKSVVIKYKGKVRVENIDDRLVFHHENYEPVLAVPYDIPIVSYENPFLVNNLRLWSAEPLSSELDLALFNQGNFTQALSNKSEVEAISYILYPEDSNLAGRELRLKQEYFFVAAGLATIVRNYKKNHGSLRDFSQGVSIHINDTHPALCIPELMRILIDEEGMDWEESWNITVDAISYTNHTIMPEALEKWPLDLFRNLLPRITMIIEEIDRRFKEKLLRRFFNSEELFRSTPIIKEGQIYMANLAMIGSHSVNGVAKLHTEILKKHVFKDFHRIFGYKFTNLTNGVNHRRFLLTANPLLSELITEGIGPGWKTNAGELAELHRFKEDSAFLDRLAQVKYQNKLRLAEIIAMGQGIQIDPHSLYDVHVKRIHAYKRQLLNVLKVMDLYNRLLADPGSVQGTYTFIFGGKAAPGYHYAKSIIKLIHVIADKINQEPRIKEQLKVVFMENFNVSSAERIYPAADLSEQISTAGKEASGTGNMKFMMNGALTIGTLDGANVEIREAVGEDHIFIFGLTAEEILAHNLNRTYRSWDEYHANPCLENILEQLISKQFMENDWEFRTVYDSLLLYNDEFFVLKDFAAYMKTFGEAADRYAAQEQWLRSSLHNIAESGVFSTDRTIREYAHQVWRVR

SEQ ID NO: 9893 - protein, 351 aa, Desulfitobacterium hafniense
KKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSCHKQKHAEVTLSAIAVPWEEASRFGVMVTDAGGRIIRFEEKPPRPESNLASMGVYIFNWDVLKEALLEDERDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIV

SEQ ID NO: 9894 - protein, 367 aa, Desulfitobacterium hafniense
IGMIFGNLNSSALQGLDPNRPIGTVPFGGRYRLLDFALSSMVNSGIHTVGLITPQQYRPMLDHLGAGRDWSLDRKSGGLFFLPGVIHSLNHTVHFSLQDIAVNIDFLEKDCAKNIIISSSDQVFNLDFRPVLEEHEQAQADITLVYNQSVHPPEGSERIYLRMNAHKKVTAMSKSKEVAGLQSPWNYFIDILIIRRELLLQMLRGYGSIGTIELSEVIAHHLDIINVQGYFCGGYVGRIRSVQDYFLNNMALLQEEVRRDLFINTRPIRTKIRDNPPTKYGKQAQVKNSLISSGCTLEGKVENTILSRGVVIEEGCEVRNCIIMSKCVIGKHSVLENLIMDKFVEINEGSVLKGQPNKLMVIPKKAV

SEQ ID NO: 9895 - protein, 466 aa, Desulfitobacterium hafniense
MKVLFAITEAEPFVKTGGLGEVGRYLPLALQEQGVEIRVILPQYSSIPRNYLQKMKTIKEFTVPLAWRNQYCGLKELKYEGIHYYFLDNEYYFRRSRCYGDGDEGEQYAYFSRAVLESVRYLPEFKPDIIHCHDWHTALVPLFLKAFYAQDTLYYNIKTLFTIHNLKYQGIFPREVREDVLGLSGELSSSAQLEFYGGVNFMKAGIMHSDQVTTVSPTYAREIQHPYFGEGLHGVIQGRKDSLLGILNGVPRPWPSPTLADKRANRMKLQEQLNFTNNEEIPILSMISRLVEQKGLDLLLHVLDEILALDIRLVVLGTGDAHYEERLQRFAEGYPGKLRVILGYQEELAHRIYAGADIFLMPSRFEPCGIAQMIAMSYGTIPIVRETGGLKDTVRPYSPISGEGNGFTFTDYNAHELLYAIQKAVEMFRNQKDTWQKLQENALSSDFSWNRSAARYRDVYESLYYS

SEQ ID NO: 9896 - protein, 599 aa, Desulfitobacterium hafniense
HNSHDPFFRSPFGAVPCGGLLRLRLLMQPEDSSGAGSPVQECFLRLWVQDREERLPMLRVEEPILWEINREGTVTGEEAITGEGVLTGEGVVYEVEYPLPHEPGIIWYYFIFRAGGETCFYGNNQEELGGVGELRSSEPPGYQITVYRPMALPGWYTQGIMYQIYVDRFFNGDEQGKVLNPRPRSLIHGDWSDTPFYIKNEKGEVLRWDFFGGNLAGVIKKLPYLKELGVSILYLNPIFDSSSNHKYDTGDYLTLDPMYGDEEIFAQLIKEAQSLGIAIILDGVFSHTGDDSIYFNRYGRYPGLGAYQSPDSPYYSWYQCHGEGQEKEYSCWWGVSTLPEVWEMEPSYREFIIHSPQGVLQSWMKRGIKGWRLDVADELPDEFIQEFRQMMKTMDPEGVLIGEVWEDPTHKFSYGKLRQYFWGEELDATMNYPLRNIFLQYFLGQIDAGQAHKRIMNLYENYPRENFFGQMNLIGSHDRARILTLLGEAPPPEQLSAVEQEQYRLPAPARDLAVQRLKLLTLLQMSFPGVPCLYYGDEAGCEGYPDPYNRGTYPWGREDQEILQWFKRVLRYRREYEVLRQGEFSSWFEGKEIYVLQRK

SEQ ID NO: 9897 - protein, 517 aa, Desulfitobacterium hafniense
WKRFKEYLYYDQELELLLDISRMNFSAEFLTELAEPMRDAYHQLQLLEKGALANPDEGRMVGHYWLRNPDLAPTEEIAQDIKETLKEILDFAEQIHSGRLQGEKGNPFRNILLVGVGGSILGPRFVADALASSRDKMKAFFIDNGDPDGIDRVLSRIGEELPATLCLIISKSGGTIETRNGMLEVRRAYEEAGLSFPDHAVAITQRGSQLDKLSQKEGWLRAFPMWDWVGGRTSLLSAVGLLSLALQGIDVAGLLQGAKDCDGRTRRPDTLANPGALLALMWYYSTQGQGGKQMVVLPYKDRLELFTKYLQQLIMESLGKEKNLQGETVHQGITVYGNKGSSDQHSYLQQLLEGPDNFFVTFIEVLKDRQGSSAYMEENSTSGEYLQAFLLGTREALTQKGRESLTITVKEVNAYTIGVLIALFERAVSIYALLVGINAYHQPAVEMGKKAAGQAIQLKNNIVECLKKHPDKRFSVHEIALAIGEEAHQEMVFKLLLHLTTNPEHGVNMAAGHPLPE

SEQ ID NO: 9898 - protein, 355 aa, Desulfitobacterium hafniense
SNLRVLVISAAFGAGHIKAAEAVIEAIWAKRPNTEIYHADFGAFLNKAFHLVIKTAYIDMIKYTPKLWGEFYYRTSDIPSDSLFQRFLNGLGRQEFISYIHSVQPDLIVCTYPTIAGVLAQLKEKRILTVPLAAVVTDYAIHNQWVHQGVDLYLVGSQEVADGLAQRGINPGCLKVTGIPVSPKFEIKLDREELARKFGLDPGQPTILVMGGAYGVLDNATGICRLIMQNKLPVQLLIVCGRDKRLYSTLEPLVRKAENRVLLFEFVENVEELMTVSDLMITKAGGLTVSEALTKQLPMVIYKPIPGQEKANSEFLRRVGTGKIAATEGELLQILTHLLENPEEIKLMSHAAAKL

SEQ ID NO: 9899 - protein, 289 aa, Desulfitobacterium hafniense
TLTVSTDHGTNATVGLSFEVTTAPTYTIIADPVTKDFGSLTIGYSAPAAQTVTITNTGNSSVMLTQPTSTNYTIGALSTTTLAANGTATFTITPKTGLAIGNHDETLTVSTDHGTNATVGLSFEVTTAPTYTITADPVTKDFGSLTIGYSAPAAQTVTITNTGNSSVMLTQPTSTNYTIGTLSTTTLAANGTATFTVAPKAGLAVGNYNETLTVSTDHGTNATVELSFEVTAVPYTVTFNPNGGTVSEASRSVASGTAVGALPTPTRSGSYSFDGWYTAASGGTQISAS

SEQ ID NO: 9900 - protein, 178 aa, Desulfitobacterium hafniense
MLKGAIAQRYAQALFELAVQENLDGIEAELQELVQCVEQNAEVAHVLYHPHISLSEKKDLMNKIFAGELSVTVRNFLNLLIDRRRQNYLLEIARVFARLADEARNIVEAKVASAIPLSETQEQRLHQELARMTGKNVRMVKEVRPELIGGVMIQIGDRVMDGTVAFKLQRIRQSLSHA

SEQ ID NO: 9901 - protein, 500 aa, Desulfitobacterium hafniense
MNLRPEEISSIIKQQIERYDSAVEVVDVGTVIQVGDGIARVHGLEKAMSGELLEFPGGIYGMAMNLEEDNIGCIILGKFTEIREGDQVKRTGRIVEVPVGEAMIGRVVNALGQPIDGKGEIKTDKFRPIENIAPGVVYRKSVHEPLQTGLKSIDAIVPIGRGQRELIIGDRQTGKTAVAVDTIINQKGKDVICIYVAVGQKASTVAGVVKTLADHGAMDYSIVVSATASEPAPMLYIAPYSGCAMGEEFMYNGKHVLIIYDDLTKQAAAYRELSLLLKRPPGREAYPGDVFYLHSRLLERAAKLSPDLGSGSMTALPIIETQAGDVSAYIPTNVISITDGQIFLETDLFNAGFRPAINVGISVSRVGGSAQIKAMKQVAGQLRLDLAQYRELAAFAQFGSDLDKITQMRLTRGERMMEILKQKQYEPMVVEEQVVVLYAAVKGFLDDIPVDKIKSFEEEYLRTMRTTKADLLAKIRTEKALNDELNAEIEKAITEVKEGF

SEQ ID NO: 9902 - protein, 281 aa, Desulfitobacterium hafniense
VASARDIRRRIRGVRNMQQITKAMKMVAASKLRKAQEKVIAARPYARQLQEVLARLAQDQADVTHPLLMERPVQRVGYIIITSDRGLCGGYNTNLIRMTNSSIAEETHDVRLVAVGRKGRDFYRRGKIETIAEFVGLGDNPSYGQAKEIAQEVIGLYESGELDEVYLLYNEFVSAISQRPTRIKLLPIEKPKQVSNTEYIFEPSAEEILTTLLPKYVETQVFRTLLEGKASEMGAKMTAMGAATDNAKEAIERLTLQLNRARQAAITTEISEIVGGASALE

SEQ ID NO: 9903 - protein, 463 aa, Desulfitobacterium hafniense
VNIGKIVQIMGAVVDVEFASEALPEIYSAVKVTVPEKKIDLTLEVAQHLGNNTVRCVAMSSTDGLQRGMAALNTGAPITVPVGPATLGRIFNVLGKAIDNGEEVHTDTSYPIHRPAPAFVDQDPSTVMLETGIKVIDLLAPYSKGGKIGLFGGAGVGKTVLIQELINNIAMEHGGLSVFAGVGERTREGNDLWNEMRESGVIDKMAMVFGQMNEPPGARLRVGLTGLTMAEYFRDVQNQDVLLFIDNIFRFTQAGSEVSALLGRMPSAVGYQPTLATEMGALQERITSTRNGSITSVQAIYVPADDLTDPAPATAFAHLDATTVLNRAISEKGIYPAVDPLDSNSRILSPQILGEEHYKVARDVQQILQKYKELQDIIAILGMDELSEDEKLVVSRARRIERFLSQPFHVAEVFTGSPGKYVPIKETIRGFKEIVEGKHDNLPEAAFHMVGTIEEAIEKAKAL

SEQ ID NO: 9904 - protein, 414 aa, Desulfitobacterium hafniense
LSKIIVAGGSSLEGKITVSGAKNAVLPLIAASLLSPEPIRIDDAPHLLDVDVMCQVIGAFGASVRREGSQLYINTPEITSLEAPHDLVSQMRASIVTMGPVLARTGRVRISHPGGCAIGSRPINWHLKGLEALGAEIRMDHGYLDVSATKLRGARIYLDFPSVGATENIMMAAVGAEGTTFIENAAQEPEIIDLANFLNQMGGKVRGAGTSVIRIEGVQELHGANHTVIPDRIEAGSYLLMAAAAGGDIFVQNVIADHLKPLLAKIEEAGVYFREEDDGIRVVGEGVYNAVDIKTQVHPGFPTDLQAPFLAFLTRANGTGVVTETVFENRFMHVDELKRMGAEIKIEGRSAIIQGNSNLTAAPVTATDLRAGAALILAALTADGETEIQGVHHIDRGYEYVVEKLTGIGAQIRR

SEQ ID NO: 9905 - protein, 729 aa, Desulfitobacterium hafniense
MGKSLVLTEKPSVGRDIAKLLGCNQKGNGCFIGSRYIVTWALGHLVTLADPEAYGEKYKQWRLEDLPMLPKDMELVVIKETSKQYAAVKQLLRQPDVEELIIATDAGREGELVARWIIGKAGWKKPIKRLWISSQTDKAIREGFNNLKPGKAYESLYAAAECRAQADWYVGLNVTRALTCKYNAQLSAGRVQTPTLALVVEREKEIQNFVPKGYWTINARVQGFSLSWQDKGNGQNRMFDQRKAEQLVQKLRGHKGQVAEIKKEAKREQPPQAYDLTELQRDANRKYGFSAKQTSSIMQQLYEQHKLVTYPRTDSRYLSEDIVPTLPERLKTIAVGPYSELARRVLRTKITPTKRLVDNSKVTDHHAIIPTEQTVFLNKLSPEEAKIYDLIVRRFIAVLSPAFEYEQTTVKVEIQGELFTAKGKIVKQKGWRSVYEGREAADEEADHEEQEQNLPDLQPKQTLEVLDLKLLPGKTKPPKRYTEATLLSAMEHPGQRVNDEALRETLEKTSGLGTPATRADIIEKLFSSFYMERNGKEIVPTSKGIQLIGLVPSELKSPELTAKWEQQLSEISKGREDRQRFIQGIKSYATQLVSEVSGSGRTYRHDNMTRAKCPECGKFLLQVKGKRGEMLVCQDRECGYRQGLSVQSNARCPQCHKKMKLQGEGEHKIFTCACGYREKLSAFNKRREQEGSKGSYNKREVNHYLQKQEKDAPLNTALADALAKLNLPK

SEQ ID NO: 9906 - protein, 176 aa, Desulfitobacterium hafniense
RYGMVIDLRKCVGCNACTVSCKIENNVPDGKYRTWVKEMEKGTYPQVSRHRLPRLCNHCDNAPCESACPVRATYRTEDGTILIDYDRCIGCKYCMAACPYDARFVNPVRRTAEKCTFCYHRVQMGLLPACVTTCVGGARIFGDLHDPNSLVSRLIANNPVQILKPEMNTQPMIYYI

SEQ ID NO: 9907 - protein, 458 aa, Desulfitobacterium hafniense
EEMIELKQVSFAYGNGERDSGLEDIELKVEEGEFLLLCGGSGCGKTTLTRLLNGLIPNFYGGVLKGQVWVGGLDVAKAPLYETAGKVGSVFQNPRSQFFNMDTTGELAFGCENMGLPLKEICARVERIALELGLEPLLDRNIFALSGGEKQKIACGAVAALGPQVYVLDEPSSNLDALAIEELRALLTKLKAQGKTVIIAEHRLYYLRELVDRVIYMKKGRIQQEYSGQEFRALPRGELDAMGLRSLSLEGLLEGAPVHLPRTEGAIALSGFSFAYPRGGRSLDIRETSFPQGAVVAVTGHNGAGKSTLARCLCGLEKKCRGRMGMQGESLGRKERLKRSYMVMQDVNHQLFTESVLDEVLISMGHPDVKQGEEILKGLDLLQFKERHPMSLSGGQKQRVAIASAIASRRELILFDEPTSGLDLLHMQGVARSLSQLAGIGKSVLVVTHDPEFILSCC

SEQ ID NO: 9908 - protein, 1080 aa, Desulfitobacterium hafniense
  unsure (1)..(1080): unsure at all Xaa locations
SHRSAYQILENIRLGATERLMSAPLGEVLSQRAGKMKNIVVDRVETIELPLAHMIPEGISNFLFPLAIFIYLVFIDWRMALASLICVPLGAIVYGIMMRNFNSQYAAYMEASNHVNSIIVEYVEGIQVIKAFNQSTESYEKFAGAVSSFREFTLAWFQSTWKLMNLGNAILPSTLWEFCPWECSFISRGSLTPAELTLSMILSLSMVAPVTWFTVAVNEWKAVQYAVKDVNELLELPSLPDTACPVQLASFDVELKDVSFAYKESKGDVLRGINLQIPEGSYTALVGPSGGGKSTIARLIARFWDVGKGSITIGGTDIRKIPLAQLSQLVSFVTQDNFLFNCSLLENIRLGQPTASDEEVHAAARAAQCEEFISRLEKGWATPAGEAGGKLSGGERQRIAIARAILKNAPIVILDEATAFTDPENEDKLQRSLAVLTKGKTLLVIAHRLSTIKNADQIFVLQEGRVVAGGTQQELLEKCALYQDMWRAHTGARAWAANAAGRGKXPMLKTMRRLIAWTETRKNRLYWGFFWSFLATLFTAMPVMAAAYVLNLMLEDQAGRFELTPIWALYLLIFMVFMILGRFFFSYLRAVFQESVAYEVTAEERMSIGNLLKRVSLGFFDRNTTGELVGAVTTDLSFVEMFAMKMIDSVIGGYVSALAMILCVAFYSWEVAVISVLGILLSALALGLMGFFSRRNAPVHQKAQNEIIAATLEYIRGIPVVKAYGKEGVSVESIRRAYGKHRQINVKIEQEYVPCNCLHLLALKSASVVIVAMSAFQAVQGSLPIPVFLMLAVFSFMIFNHVEQINNATHVLQVIGPTLDKLEKIKEAEFIDEKGEDKVLDNYTIEMADVVFAYEQRRILDGVSLTVPQNTTTAIVGPSGSGKTTICNLIARFYDVDSGSIRIGGTDVRELTCDSLLSNISMVFQNVYLFQDTIVNNIRFGKPDATMAEVTEAARQARCHDFISALPEGYNTMVGEGGSSLSGGRKTRISIARAILKNAPIVILDEATASVDPENEHFIQGALSALTQGKTIIVIAHRMPTIEHADQILVLDEGRIIQKGTYKELVAQEGLFRRFITIRR

SEQ ID NO: 9909 - protein, 257 aa, Desulfitobacterium hafniense
MKVVILAGGYGTRISEESHLKPKPMIEIGERPILWHIMKLYSRYRFNDFVICLGYKGHMIKEYFANYFLHGSDVTFDLANNTTCTHSSAEVEPWKVTLANTGLDTQTGGRLKRIKKYIGEETFLFTYGDGVADINIEELVAFHKSHGKLATVTAVQPSGRYGVLGLNEDASVLEFIEKPKTLDAWINGGFFVLEPEVFDYIDGDGTAFEGEPLTKLAEAGQIMAYHHSGFWRCMDTQRDRVILENLWASGQAPWKVW

SEQ ID NO: 9910 - protein, 212 aa, Desulfitobacterium hafniense
  unsure (1)..(212): unsure at all Xaa locations
ITSDKCYENREWVYGYRETDPLGGYDPYSASKGCTELVVSVFRNSFFNSGVSLAMVGAGNVIGGGDWAEDRLLPDFVRAVVEDQPIRIRNPHATRPWXHVLEPLSGYLLLGALLSAEPEKYSGAWNFGPRDTDVLAVEEIFKLAIAEWGAGRIEKETVRQLHEATLLKLDISKAEVYLNWHPVFSCREAIERTVAWYKRHYKEPSGNMFSFT

SEQ ID NO: 9911 - protein, 183 aa, Desulfitobacterium hafniense
IMSQYGFYFDMTSCIGCRTCQVSCKDKNDLNVGTIFRQVKAFETGSYPKPGIFHYSGTCNHCENPKCVEGCPTQALHKLENGIVDHDKAKCIGCRYCTWNCPYGVPQFIPELGQISKCNMCKDLIEAGENPVCVDACPMRALEWGDLEELKAKHGDSVQELPFLPAAAVTKPALLIQAKNNAK

SEQ ID NO: 9912 - protein, 219 aa, Desulfitobacterium hafniense
NEHIALNNISLSLAQGEFVTLIGSNGAGKSTLFNAIGGTFWLNRGRIFLEEENITYLAEHKRAAMIGRLFQDPLKGTAPDMTIEENLALAYNRQGRNGLRLGVHPQDVKIFREKIAQLDMGLENRLRTKVGLLSGGQRQALSLLMSTIAGPRLLLLDEHTAALDPAAAEKIMAITRDIVSQEGITTMMITHNIQTALTTGSRTIMLDQGKIILDLAGEE

SEQ ID NO: 9913 - protein, 1199 aa, Desulfitobacterium hafniense
  unsure (1)..(1199): unsure at all Xaa locations
NFSXPELITXTNSKKSCSLKGEISVMSSAGKQKTGTARLLELAGTKKPLIIGAGVLSALASHCELCALYRYLSDCEGSLNRFAGSGGPEQALMIRYGWLAFGGVVGNILLYFGALSCSHLAAFGTLYELKVNFATHLAKVPLGFHVMIGSGKLRKITDDNIEKVEGFIAHQLPDLVAAFVAPVVMIVILLAVDWRLGLAALAGVIVAFLIQMSVYGNEGSKAMMKKYQASLEDMNNASVEYVRGISVVKAFRQTVYSFRRLHDTIKAYTSMVIPYTLSWQNSFSAFVALVNNIYLFVVPVGIFIGMRTTDYIGFLSNFIFYLIFVQSVATILMKIMYVNGNAMKIIGGVEAMDRVLAEPELPQPANPQTVTQYDVNFGDVVFSYDKDKKTEALSGVSFVAKQGQITAIVGPSGGGKSTIAHLIPRFFDVSGGQITIGGVDVRQMNSHYLMEKVTFVFQDVFLFKQSVMDNIRMGNPQASDQEVREAAQAAQCHDFIMKLPQGYDTVIGTRGVHLSGGEKQRIAIARAIVKDAPIVVLDEATAFADPENEHLIQKAFERLMKDKTVIMIAHRLSTVQGADKIVVVEEGKVCEEGTHEELLARGGKYAAMWKTYMDTASWTMSQEEVFAHAXITSRLYADRXRLQGSEKGHCRLHPEQFFYDAFFIVMIQMIIELIKPLSGGEVAWTKMWMLLGAGILAALLIFLSLRNDYKKTYIVSYLESENTRVTLAEQIRKLPMSFFNDKDISEVTTHLMDDVATSEHVLSHVVPQIAANAISVTVICVMMAFYDWRMALAIFITVPLAFAIIFISRRFYGKLHKKHLEAKMAAAGQVQEYIEGIKVIRACNLDGEKFSALEKALRTMKKLAIAMEFGTGVFVTGAQVVLQAGIGLTVLVGTTLLTGGQIEFVPMLLYMLVVVRIYGPIVTELALLPEFLYHRIAVKRMQKLMSIQPMEGNKELELKDFTINFEKVDFQYNREGEGAIHNMTTTIPAGGITALVGPSGSGKSTVSKLIARFWDVSGGRITVGGVDVRTLDPEHLMSYMSFVFQDVVLFNDTVYNNIRIGNMKASREEVLAAAQAARCDEFISRMPEGYDTLLGENGSTLSGGERQRLSIARALLKDAPIVMLDEATASLDPESEAAIQQAISRLIRGKTVIVIAHRLRTIRNADKIIVLDQGRVAEEGTHESLLEKNGLYKKLFNIQ

SEQ ID NO: 9914 - protein, 729 aa, Desulfitobacterium hafniense
TAPGCHNSCGILYYLKDGKVAKVEGDHTHPFNRGKTCMRCLNLPEIMYHPERLKYPMKRVGERGENKWERISWDEAYALVKEKSSQYTKEFGAESIATINGTGRNICIQSSALNYGGFHSPNISLAFLSGSCCYIPRMLAAAKACGARTIIDTAAQHPVGYEHPEFEVPEVIVNWAKNGLACNADGTLGHWIVDLMKQGTKLIVIDPSLTWLASRADVWLRIRPGTDTALALGMANIIIQEGLYDKEFCDLWSYGFEEFAARCAEYPVEKVADICWCPKEKIIEAARLYGKAKPASIEWGLPLDQCKNGMAASHAVHHLRALTGNLDVPGGDLLIRHTNALDSQMNSLIEYVPKEDLENKRLGANVSPFTVGHQGATAQPDAILRAIETGDPYAIKMIVLFGTNPISNMAAEAPRVREALKKVDFVMSLDYYMTPTNIACADLVLPIAMSAERNAASHNFVPLKIESKFTQYYDAKSDDQITAELGHVLDPEGGFKNIKTDIDFVNAYLRQWAEPSEGDLTFDDVVNGPNLGYVYDDWNATYYKYKKGLLRADGQPGFNTPTGRYEFYVTAYAAWGKFDPLPAHEEPPESPYSTPQLFEQYPLIFTAGHRSYEFFHSEGRNQPTMREFHPWPLCELHPDTAAKYGLAEGDWVWMENQRGKCKQKLKLNPSLDLRQCRAEHGWWYPERAGAEPSLYGTFDSNPNNLIPQYQFGPTAYGAPYKTQLCKVYK

SEQ ID NO: 9915 - protein, 730 aa, Desulfitobacterium hafniense
EYTVTRTCQWSGPGCHQGCSVLFYTKDNKLIKVEGDPNSNINNGRLCMRCFAVPEATYHPTRIIHPQKRVGERGENKWEQITWDEAYDIIESKVRKIWEEYTPKSIVTCFGTGRNATWQSPVLSLVGYKSPNIGGGFLSGDSCYAPRLMAMHTFLGGSFIADLGQLFEQQYDHPEWEPPKYIVLWGCNPIMSNSDGFFGHWVVDAMKLGSKLITVDPRLTWLAAKSEVWLQIRPGTDCAVAMGILNYMINEGVYDREFVDKWCYGFEELKEAVKDMTPARAAEIAWTSEEKIIDIAKKLGTTKPWAMQWGVPIDQAKHGVATSQAIVSIMALSGNIDIPGSSVLWTPAISNPMSEPAMMHNVSPDISKDRFGDEFPIRKYGFINQHMTDSMLAAIETGKPYPVRMLHIMSTNTFANMGAEAKRVYDAMKSVDFIVVADLFMTPTAVACADIFLPVAMSPERWGLRGWWNPLRTITKVIDGGDVKSDEEIALDLVKRLNPEDAPWADVPELLNYVLTDLQSATYKGTFDELKKLGPSGYYTEVHYRKYENGLLRPDGQPGFNTPTGRIELKATMFEDFDLPAVTYWAEPTESPVSTPELMKDYPFVLTTGQRCYEFFHSEHRQLESMREFHPDPITEINPEDAAALGIKDGDWVYLENKHGKAKLKARLHPGMLKGVVNAEHGWWFPEREAAEPSLYGVFESNANCLTTQFDYGPTSYGAPYKNQICKVYK

SEQ ID NO: 9916 - protein, 434 aa, Desulfitobacterium hafniense
SAPTYFDDMKLTSSHKRMLWLAAICYMFDQMDVGTFAYAAPVLVKTWGLTMEQIAQVNSYGFVGMFLGAIFGGWIADKIGRKKTIILCVAIFSLGSLGNALAFNFHTLAITRFFTGLGVIGMLVVAMVYIAEMMPSEHRGRYQALTMACGTIAIPVGAAFARWVVPLSTESWRYIFVLGGTSILLLPFCFIVFKESPRWLVSKGRITEAEKVIREITGREVDLSSEVPEKIKKSSSLSTLKLILSKEYLKRTIILVIITDGVVLGAQMLGGFYPAILQEYAGFQLTLVLSIMALSWWGIPFGDLSASLVSDKGGRKGPLALFSIINGMTFVVCGFFPTPAVIIAAVFLSRVFGGGSVSILYTYLAESYPTHIRSTAVGLIMGQVRILSAVIVLIVPPILATYGWLGVHLVNAGIIIVTAIVALIFGQKTSKRTL

SEQ ID NO: 9917 - protein, 729 aa, Desulfitobacterium hafniense
  unsure (1)..(729): unsure at all Xaa locations
RXRRMSERKVVPTNCRFCGYQCGLLATVENGKVRKVQPDSSRYPHNAGIMRGCKRWPLISEVMEHPQRINYPLKRVGERGSGRWERISWEQALDEIAAKLAGLKEEFGPEVLATSIGGPHTTFWPLHRFLALFGSPNNMGIGQICWNPGIWANTLTYGWPVDMELDPEGTECAILWGVNPSQSDNSLFWHTVQEFKRRGKPLIVVDPRLTGTAQEAQLWLPVRPGTDAVLALGLLHVIVQEKLYAEEFVQNWCHGFERLCDHLIPYTPAYVEEVTGVKAEDVVKAARLYGKSTPACLYSGRGIDQLGLNSFPTHRALAILRAITGNLDVPGASHLSEMPDFIPELELELSEPYAATSPRSVSQEKLLLQSYQGYAKVREQTMKHKKRLPMRYLTSAHPHRVWKAMLTGEPYPIRSMIVMASNPLLTQADTQLVYRALKSLDLLVVLELFETPTSMLADYVLPSAGVLERPLLETKAGVANIAYGGDQAVGPYYERRPDYDFWRELGLRLGQEKAWPWQTYREALEYSLSPLGTTWDDFSGSGLYYQDNEYLKYEEPDGQGKPQGFATVSGKVEIYSELLREMGADPLPSPRALPQGNADFSLMLMSGARFQPYYASSYHQLEKLRRLHPEPIAEMSPVTGEKLGIEEGSLVDVETERGKARFRTRFVPMCDHVVSVEYGWWYPEMKASEPELGGIWLANANLLTSGDFDASDPLVGTWTYNGIPCRVAK

SEQ ID NO: 9918 - protein, 181 aa, Desulfitobacterium hafniense
MARYAMVIDTRKCTGCQSCTVACRVNNELPIDMIYNPVMTHGPLGKFPHVRMVHIPSLCMHCGNSPCVDACPTGASQQREDGIVWVEENKCVGCKACVMACPYGARVSNGAKGTVQKCNFCKDDRVDQGKVPWCVQTCHQKARIFGDIEDQDSEVFKLVNKTKTTGRLLEELGTEPFVYYL

SEQ ID NO: 9919 - protein, 729 aa, Desulfitobacterium hafniense
VKKACCYFCHQNCGCLVYVKDGKILHFEGDTEYPTNSGGLCCRGNVNLIHLDHEARVNFPLKRKGERGSGEWERITWEQAIDEIGTKLAEIRQHYGAEAVATAGGTSRTDDWARRRFMNLFGSPNGFHNAHLCWIPTFMIETAVYGWSPFEIDLGSSRCLVLWGQNPAISTLPEMSGVSGLKANGLKVIVIDPRYTETAAKADLWIPVRPGSDLALALAWINVIIYEGLADYDFVYEYCQGFDELTAHVEEFTPEWAEPLTGVSADLIREGARMYAMNKPGNIQWGTALDQIGKPAGATQHARAILRAITGNLDCPGADLLTGPSLEFVTDEEMELNEFLTEEQRAKQLGSDKFKLVTWPGYGRIAEIAKKYWGKAPTAEWMCEAHPPTVFNAILTGEPYPVKALLVSATNPVNSYGESQKVLAALKAVDFMVTCDYWLTPTAMLSDYVLPMAGSFERPTITSTYGCSDFLMCSQRAIQPMYERHSDFEFWRDLGIRLGQKEHWPWETLEDAYFYRIKDLGYGVESYDEFVEYYRFHFPEREYFKYKEKGGFGTPSGKVEIYSSVLEELGYPPLPPYIAPVENEVDYPELAKEYPLILTTGAGVMPFHHSEHFNIKELRFIRHEPHMEINPDTAAEYGIQEGDWVWVETRRGRIKQKASLTEGIRPGTVFTERGWWYPERDLRNPELGGCLESNTNVLTSTADEDCDPLSGSWANRGLLCKVYKVSSSD

SEQ ID NO: 9920 - protein, 216 aa, magnetite-containing magnetic coccus
VALITGGARRIGKAIVHHLHAHGYRVAVHAHQSGHELHAFLTELERRRPSSTLALLGDLHENAVPETLIARCAGHFGRLDVLINNASNFYPTPLGEVTPAQWDDLFAINAKAPFFLAQAATPLLRKHRGAIINLTDLHGTQPLRQHAVYTAAKAALEMLTRSLALELAPQVRVNAIAPGAILWPTQGIAEAAKQALLARTPLARTGTVEEIAEAVL

SEQ ID NO: 9921 - protein, 201 aa, magnetite-containing magnetic coccus
MIQYLNVFFYDIYPYICATVFFLGSWLRYDYGQYTWRASSSQMLDKRGMVIWSNLFHIGILGIFFGHLFGMLTPHWMYAWFLPIAVKQQMAMVLGGVCGVLTLIGGAGLLWRRLTNQRVRATSTAPDIIIMSILLIQCLLGLSTIPFSAQYPDGSEMMKLVGWAQGIVTFRGGSSEMLSGVAFVFRVHLVLGMTIFLLFPF

SEQ ID NO: 9922 - protein, 303 aa, magnetite-containing magnetic coccus
  unsure (1)..(303): unsure at all Xaa locations
KIXXCCVNDLTPQASLAHCLKYDSVMGVLNAEVSATEKGVSVDGKEITVFEERDPAKLPWGELGVDYVVESTGLFRKRETAGAHLKGGAKRVIISAPAGGDIPTFVMGVNENDYNPATDDIVSNASCTTNCLAPMAKVIDDKFGIERGLMTTVHAYTNDQALLDQPHSDLRRARAAALSMIPTKTGAAAAIGLVMPNMKGRFDGLAVRVPTPNVSLVDAVMEVRAETTAEEVNAALKAATTRFLGYFDAPLVSIDMQGDPRSSIVDGGCTRVNGKQIKVMSWYDNEWGYSNRVLDLILHMASK

SEQ ID NO: 9923 - protein, 347 aa, magnetite-containing magnetic coccus
RTLRVAILGATGYTGGELIRLLHRHPGAELSFVSSERFAGQSIAKVYTHLQAVGHLICQPMDAKKACEAADFIFCALPHVTSMEVVPELLQRGAKVVDLSADFRLKSAETYAHWYGTQHLAPELLPQAAYGLPELFRESIKGANLVANPGCYPTSVQLPLFPLLQEGMIDPALVIADSKSGVSGAGRSPAQGTLFAELSEGFKAYKVEAHRHIPEMEQNLALAAGKEIKIRFTPHLLPQSRGILSTCYLRPTSGVNAQRVRDTLMTRYRDEPFVTVLPHGDMPATSDVRGSNACHMGVTEDLRSGWLIIVSVIDNLVKGASGAAVQNFNLMTGWDETTALDSLPMFP

SEQ ID NO: 9924 - protein, 429 aa, magnetite-containing magnetic coccus
FASLNLVKPLLNALTQAGYTTPTPIQAQAIPHLLAGRDLLGIAQTGTGKTAAFALPILNKLSQIKGRPAPNAPRALILTPTRELASQIGNSIAVYGKHVPTTHTVVFGGVGKQPQIRALSRGVDILVATPGRLLDLMGERHVRLDQIQVFVLDEADRMLDMGFIHDIRRIIKVIPAKRHTLLFSATMPKDIAELAEGLLTNPAKVEVTPESTTVERITQKVLFVDKQNKRSLLKNVLEHESIEQVLVFTRTKHGANRVAEYLDKHRIASAAIHGNKSQSAREKALDGFRKGKLKVLVATDIAARGIDVAGISHVINFDLPNESESYVHRIGRTARAGRDGNAISFCDAEERGYLLDIEKTIRQTVPVDIDHEFHCEVVANAAPIKPSRKRSSGHGAGGGNPHGGGHRRGNPSTASKPRQHSGRRTPSSK

SEQ ID NO: 9925 - protein, 420 aa, magnetite-containing magnetic coccus
SLVVLGLLFALFLTPVHAAPQVTRVVLPNQFHGVLVESHSNPMVEVCLYIRAGSVMDPQGQEGTAYMLGWLINEGAGQQDSTQFQQAMDNYGITLNGTASRDYLKVTMRALSKDMVYAFELLGAAINQPRLDQEPIERAKREMVASFEQNREDADVRVEERLEALLLGQHPYGRRVEGDPESITKISREGLRRFHAQAMRGPNMVLSVAGDMRPEQFMALVHQHFGGLSADPGPFGATIPTVASPVPQPWQVEHVEMDKAQSVIAVGWPGPNRQHPDYYAITVLDHILGGSGFGSRLTERLREEQGLTYSVYSYFSPWEGQGIWQVAMATKPENVPHAVSEIRTILSQLAKDGVQEDALKRAKENLLGGFPIALDTLGKLASTWGLIGYYKRGWDYLDQWPKRIERVTQEDIQRVARSFF

SEQ ID NO: 9926 - protein, 245 aa, magnetite-containing magnetic coccus
MKDRVAMVSGGAGGIGTEIVRSLHAQGYKVASTCTVMECARVQQWKKERELEHVEVVMVEVDVRNYESCLKGVEEVESRLGPIDVLVNNAGITKDGVMKKMSPEQWQSVIDVNLTGTWNMTKAVLDGMLERQYGRIINISSVNGQKGQFGQVNYAAAKAGMHGITMSLAQEVARKGITVNTVSPGYIGTDMVMAIDEEIRNKIIATIPVGRLGKPEEIARLVTFLAAEESGFMTGADFSINGGMY

SEQ ID NO: 9927 - protein, 342 aa, magnetite-containing magnetic coccus
  unsure (1)..(342): unsure at all Xaa locations
GLKPCHVQVVHLGGCLVIFLXEHSPAMTLNKVCGSGLQAVALGRAXKAGVQCCGDAQLILAGGQENMSASTHVLPSLRHGQSMGDWKAVDTMIKDGLWDAFNDYHMGNTAENIAEQYGFSREAQDAFAAASQQKTEAAQKDNRFAEEIIPISIPQRKKEPIIFDTDEFPRHGTTAESLAGLRPAFKKDGTVTAGNASGINDGAAAVLVMSASKAKALGLSPMAKVVAYASAGVDPKVMGTGPIPAVSKCLEKAGWKVSDLDLIEANEAFAAQAMSVNKDLGFDLSKVNVNGGAIALGHPIGASGARVLVTLLHEMKRRGAQKGLATLCIGGGMGVALAVESL

SEQ ID NO: 9928 - protein, 632 aa, magnetite-containing magnetic coccus
  unsure (1)..(632): unsure at all Xaa locations
EVREFQTEVSQLLDLMIHALYSNKEIFLRELISNASDANDKLRFAGLSDDSLFEGDSELTIKLEFDKEAGTFSIMDNGIGMSRDEVISNIGTIAKSGTKEFFKSLTGDQQRDAHLIGQFGVGFYSSFIVADKVTLETRKAGAGAEQGVRWISAGDGSYTLENMEKAERGTRITLHMREDEKEFLDAWRLRSIVRKFSDHVTWPVKMLEELPPAPPAKEGEEPEPPKTPEWETVNKASALWTLSKNDITEDEYKEFYKHVGHDFEDPMEWVHARMEGRMEYTLLLYIPGRAPFDLWDRDRRGGLKLFVRRVFIMDTSEELLPRYLRFVRGVIDSADLPLNVSREILQQNRQVEAIKKGLVHKVLGMLEEMLKNDPEKYATFWKEFGMVLKEGMIEDFANKERIAKLCRFSTTHDGERVPKIALADYVERMKEGQEAIYYVXPXRGALXACXNSSPHLXRSSRKKGIEVLLLSDRVDEWTVTHLTEFDGKPLQAITKGELDLSKFAGGEEEAKDEEAEKAQEEALKPITERMAKVLEGQVKEVRLSHRLTESPACLVGDAHDMSATLERLSRAVRGAXPXXKAYFGDHPSHALLKRYREADDRXSVGDVDPMCCTSQALFAVGGAYXIDPSQFV

SEQ ID NO: 9929 - protein, 145 aa, magnetite-containing magnetic coccus
TDPISLQEIMSFLPHRYPFLLIDRIVEVEQGKRILAIKNVSFNEPHFQGHFPDHPVMPGVLILEAMAQAGALLAGYTDPDSVRGQLVYFMAIDKARFRKPVLPGHQLNIEMTLLKRRREVWRFGGKAMVDGEVACEAEVMAMTRK

SEQ ID NO: 9930 - protein, 465 aa, magnetite-containing magnetic coccus
  unsure (1)..(465): unsure at all Xaa locations
MRTRFAPSPTGFLHVGGARTALFCHLQARHVGGTTVLRIEDTDRERSNQALVDAILDGLHWLGLDPDEGPLFQSDHTQRHTDMALKLLEEGKAYKCYCTKQELDDMRAAQQARKEKPRYDGRCRHRSEPPSDQPYVIRFKTPLEGEVVWPDMVQGTIHIANKELDDLILLRSDGSPTYNLAVVVDDHDMEITHVIRGEDHTSNTPRQIHLFQALGWDVPSYAHIPLLHGEDGSKLSKRHGAVSVLQFREEGFLASALNNYLVRMGWSHGEKEEFTMDEMVALFDVNNVGRSAAIFNTSKLLWLNGVHIRQSGPEQLRGELMWHLQRLGVDNPNPNFIDQIIPGMQERVKTMLEMAQMAMFYFKAPTEYAETAVAKHLHADILPAYAALLEKLHTVTADEWDNGGLERAFKVVMAETGAKMGNIGQPVRIAITGSDIAPRISDILQLVGRHESXRRIEVLLSFIQA

SEQ ID NO: 9931 - protein, 276 aa, magnetite-containing magnetic coccus
  unsure (1)..(276): unsure at all Xaa locations
MALKNFKPTSDGKRHQVAINYSELSNEGPERSLLAPLKRTGGRNNNGRMTVRHQGGGHKRRYRIIDFKRNKFDVPAKVARIEYDPNRTAFIALLHYADGEKSYILAPQRLQVGDTVVSAKTLDNVDVKPGNCMPLRVMPIGTIIHNVELKPGKGGQVARSAGNYIQLMGKEGKYAQLKMPSGEMRLVXLECMATVGMVSNPDNSNTKIGKAGRTRWMGKRPSVRGVVMNPVDHPHGGGEGRTSGGRHPVTPXGVPTKGKKTRSKTKASDRLIMRRR

SEQ ID NO: 9932 - protein, 394 aa, magnetite-containing magnetic coccus
LKQSEQALLQAKELAESANRAKSDFLATMSHDIRTPMNAVLGMVELLGESSLDPEQSHYLKIIRRAGSTLLSLINDILDLSKIEAGQLKLELDDFTLAETVEHVMDILRHKASEKGLQLQTHLHIPPQQRVRGDAQRLRQILLNLLGNAVKFTQQGSVSLTLQQQPDGQYSFQVADTGPGIAPHRQKIIFEPFVQEESGTHRHFGGSGLGLSICHKLVTAMRGTLWLKSQLGHGSIFYFTLPLATAMEPAPDEVSPQSVLHAPVSLTQLVNKRLLVVDDAEDNRNLIQAFLKSCQMQIQMAEDGEQAVRLCQEQRFDLILMDIQMPIMNGLEATRLIRQHEQMQHKSRTPIIALSAHAMLDVNNDALAAGCDLHLSKPIAKKRLLEALCHQLCP

SEQ ID NO: 9933 - protein, 240 aa, magnetite-containing magnetic coccus
PFLSVNGIFLMEKLPDLATLKYNEQGLIPAIAQQYDTGEVLMMAWMNQTSLAETLSTGVACYWSRSRNRFWRKGESSGQVQTVKAVRLDCDKDTLLLLVDQQGVACHTGRHNCFYLEAQDGSWKTITDLRLTLRSCTENEQSKPPRSTVDILEQVYQVIQQRKSAPDPEASYVAKLFHKGDDAILKKVGEEATELVLAIKGRAARNEVAHEAADLIFHTLVGLAIMNIPPTEVMNVLSSR

SEQ ID NO: 9934 - protein, 260 aa, magnetite-containing magnetic coccus
  unsure (1)..(260): unsure at all Xaa locations
MMAKRIIPCLDVKAGRVVKGVQFEGLVDAGDPVEAAKRYDEEGADELTFLDITATHEDRGIMEDVVRRTAEQVFIPLTVGGGIRTNDDIRRMLVAGADKCSINSAAVKRPEFVREAAEQFGSQCVVVAIDAKCVEHDKHGRPIRWEIFTHGGRQPTGIDALEWAHRMESFGSGEILLTSMDKDGTKSGYALEMTRAISDAVTIPVIASGGVGEPKHLLEGLRQGGADAVLAASIFHFREYTIPQVKRYLRDNHIAVRLXR

SEQ ID NO: 9935 - protein, 540 aa, magnetite-containing magnetic coccus
TQLPQWQALQTHLEENRSVQMRDLFDQDSQRFSRFSLQQGELLFDYSKNRITAETMARLLDLARAQDVEGWRDRMFAGEAINETEGRAVLHVALRNRSGRPIRVAGEDVMPAINQVLQQMRQFSEAVRSGAWKGQSGQAITDVVNIGIGGSDLGPVMVCEALKPYHQPGLSVHFVSNVDGTHMAETLKGLNAETTLFIVASKTFTTQETLTNAHTARDWLVAQLGEAAVRKHFVALSTNAEAVSAFGIDTDNMFAFWNWVGGRYSLWSAIGLPIAIAVGFEGFMALHDGAYAMDEHFRTAPLASNMPVIKALIGIWNHNFLGAESFAVLPYDQYLHRLAAYLQQADMESNGKYVTRDGARVDYTTGPVLFGEPGTNGQHSFYQLIHQSTRLVPADFIAAAHTHNPVGDHHAKLLSNFFAQTEALMTGKTAAQVRQELEAAGLHGAALEALVPHKVFDGNRPTNSILVRQFTPYTLGQLIALYEHTIHVQGMVWGINPYDQWGVELGKQLAKKILPELTTPGEVHSHDGSTNGLINHYKAW

SEQ ID NO: 9936 - protein, 453 aa, magnetite-containing magnetic coccus
KKWFFIAMLVGALMIWVMPLPEGLTEQGRIVLTMTVVATTLFVTEPVPLPTVALLIVVGQVLLLKHNSSDVARTLMSDSVLFIMGSLMLAVAVVKQKLDKRIALFIIRFTGTKTSRIAFGISVMSGLLASFVGEHTVAAMMLPVGIALITLTSDDPAKVRNLAAVLLFSIAYGCSVAGVGTPSGGARNAIMIGYWSDFYGIVIDYVKWMLYAYPMFLLQLPFVTMILLFTFRPEFDDLTPAVEKLKAQVEAEGPLKQRHFVSIALFFLILYGWVGLSEGVGMGTIAVLGASAFLVGGLVKWEDLNNGVNWGVVLLYAAAISLGVQMKDSGAAEWVATSFLEMLTPFGADKGMGLWLAVSALTTGVTNTMSNGAAVAVLGPIVLNMAAAAQESPVVIGFITAISSAFAYLTVVGTPACTIVYASGYLKTSDFLNVGWRMAVMSTLLMLLFASLY

SEQ ID NO: 9937 - protein, 310 aa, magnetite-containing magnetic coccus
MAQAETAILLVQLGTPDQPTEEAVRRYLRQFLSDRRVVDMNRLLWWPLLHGIILRSRPSKSAKLYKKIWRDDKTSPLLHYTRALQQEMARRFQGRHSSGVRVDFAMRYGNPGLRCKVGSLVREGVRRLLIVPLFPQYAGATVASVMDEVMRPMHIHRLMPTLRVMTPYYAQDAYIDALVASLEGVDLSEPDHRLLLSYHGLPKRHVDEGDPYENHCQTTTLLLTEELDLRHDQWMMSYQSRFGSEPWLEPNTDMLFKTLPSQGIKKLTVMCPGFAADCLETLEEISETGRQTFLKAGGSHFNYIPCLNDE

SEQ ID NO: 9938 - protein, 620 aa, magnetite-containing magnetic coccus
VVLLDIAEPGQSAKPHEARPEDMRRVVGIDLGTTYSLVAAIDQENKPGCIPLPEGGFAIPSVVHYGADGGVLVGHAARELAVSHPHATVISAKRFMGRGLEDVQGEGKRTPYRLEAGEGGMVRMDTGVGKVSPVEVSAEILSYLKAQAEQALGGALYGAVITVPAYFDDAQRQATKDAGRLAGLEVMRLVNEPTAAALAYGLEAGKEGMYAVYDLGGGTFDISILKLSKGVFQVMSTGGDSALGGDDFDHALGDLFLREMGVEQPSAEQQQQVMRSARLAKEALTDAEQVEVVIGDYGRTLSKAEFEGAIDALVKRTGLPCRRALKDAGVKPGALQGVVLVGGSTRVPKVRAYVAELFQREPLSDLDPDKVVALGAALQADLLAGNRRGEDLLLLDVTPLSLGVETMGGLMEKIIPRNSPTPTARAQEFTTFKDNQTAMVIQVVQGEREMAAENRSLARFELRGIPPMVAGAARIRVTYQVDADGLLTVSAEEMTTGVKQTVEVKPAYGLSDAEIEGMLRDALSHGEADMEARRLSEARVEVDRVLNALDAALAKDVDLLSEAEVQGIKAAVEQLVGVAAGTDATAINQGIEALDKATTFFAQRRMDRGVRQVMTGQSLD

SEQ ID NO: 9939 - protein, 701 aa, magnetite-containing magnetic coccus
QKPDSGLLCVMLLARFHQIPSSRDGLRHEHGQPGESFGHLEVLKALKALGLKAKAVKSAKKRLNKLPLPAIIPSAKEGGFQILAKAEGGKVLLHDPTEAKPEVMDTEVFLEQWDGSVILAATRGKDPTGGKFDITWFIPAVIRYRKLFSEVLYASFFLQVFALISPLFFQVIIDKVLVHRGLTTLDVLALGMLVVALFEMFLGGLRTYLLSHTTNRIDVELGAKLYRHLMNLPMSFFGSRRVGDSVARVRELENIRNFITGSAMTVAIDIPFTFVFVAVMFWYSPTLTYVVVGAIPFYILLSVFVSPILRKRVEEKFARGAENQSFLVESVTGVQTVKASALEPQMGRRWDEQLAAYVHTSFRVTNLGNWASQIAGLINKITTLLILWFGAHLVIDGSLTVGQLVAINMLSGRVSGPILRLVQLWQDYQQAGVSIRRLGDILNTPSEATSDPSRAALPNLKGRVTLERINFRYDPESPEVIRELSLDIRPGEVIGIVGPSGSGKSTVTKLVQRLYTPERGRVLVDGVDLGQVDPAWLRRQVGVVLQENFLFKRSVRENIAIGDPGIPMERVIAAAKLAGAEEFISELKQGYETELDEHGGNLSGGQRQRIAIARALVSDPRILIFDEATSALDYESEKIIQENMRSICQGRTVIIIAHRLSAVRGCNRIMVMDKGVIMEEGGYAELLQKKGWFARMHYHQS

SEQ ID NO: 9940 - protein, 645 aa, magnetite-containing magnetic coccus
LAVPVTLQGERVGLFYLRVDLKHYWSMLWQDLYLTLLFLLLAVSAAYVIAQRMHRFITTPIQALAAVAQQVSREQDYAARAPQIHTRDELQLLVEGFNGMLDEIGRQDDALRQHRDSLEAQVALRTTELTVLNGELATARDQALESVRLKSEFLATMSHEISTPMNGVVGMLELLDEKTLSPQQQEYVEIAKHSAEALLAIINDILDFSKVEAGHLVLESIPFQPLMEMEEVVALLAPRAQDKGVALVTEAQWQVLPGQVVGDPLRFRQVLTNLIGNAIKFTQQGEVVVALGWQAGQGTAGVLHFSVKDTGVGIDADTQKKLFQVFTQADGSTTRRFGGSGLGLAISRQLIELQGGQIGVESDLGQGAHFFFSVPMLAAAAPILEPYMESGLADPNRPVWLLERHEAAATALQALLHALGLSSQRLDGLSAILTLGKEPPPLVLINLNDSARPDVLSWLLAHPQVCSRYEIALMGWATSLQEARHHLGESVHYLPKPVRLGEITRLLQQRIRAVPDAPAQPLPLRGQLLVVEDNPVNQKVALAMLSGMGVSVQIVSSGAEALQWLQKQAFDLVLMDLHMPTMNGIETCRQLRQWEQQQGRQSVAVVALTASQDLVEQQHCLDAGMADFLSKPLSVEQLYQALARW

SEQ ID NO: 9941 - protein, 465 aa, magnetite-containing magnetic coccus
AMEPEPVEKTLHAAMQLILDFLQENQNSTLRIVDFLPPQQLAEQFDLTIQQQGLANHQALIPLLHAYLQHSVKTGHPQFCNQLFAGFNFPAFLGEVFTALTNTSMYTYEVAPLATLMERFLIEKMGKLAGFTNHDGIFSSGGSNSNLIAMLCARQQRFPHIKQLGNSNAPPLVCLVSDQAHYSFQRGAMVLGMGLDNLVKVASDPQGRMQPAALEAAILHAKAAGKQPFMVAATAGTTVLGAFDPLPQLHAIARQHGLWFHVDGAFGASVLLSQRWRHHLDGCHLADSLTWDAHKMMNIPLISSVILVREPGLLREACGSEGGHYLFHEHDYDVDQFELGRKSLACGRRVDAMKLWLAWRYYGDLGYAARIDHLFELTAYAKDCILAHPKLTLMVEPQSVTLCFRYQPDKTVDLDAFTVRLRDRLVRSGDSLVNYSLLQQGVAIRMVFVNGDMQTSDFDHFLERL

SEQ ID NO: 9942 - protein, 432 aa, magnetite-containing magnetic coccus
LRVGVMGYGTVGRGVVRMLLDHADLLEARTGCAVTLRYIADHNTESDRGVVLPETVTLLNDAHKMIESEDVDVICELIGGTGIAKTLVLKALQQGKHVVTANKALIATHGNELIAAADASGVELMFEASTAGTIPIIKSLREALAGNEIREIYGILNGTCNYILTEMREKGLPFETVLADAQQKGYAEADPTFDVDGIDAAHKLTILASIAFGMPLSFDAVSVEGIRHVSAVDIAWATEMGYRIKLLGIAKRCDGKVQLRVQPVLVEEESMLGAVEGVFNAVFVNSDFAGSTMYYGRGAGEEPTASAVVSDLIDIARNVQAGAKMPRIYPLGQPTAQLSMPTMCPVEEMRDAYYLRLSVLDRPGVLADITAILKEHRVSIDAIVQKERSPVEHVPLVIVTHEVTERQILDTVAAIEKMDSVSDKPRMIRIED

SEQ ID NO: 9943 - protein, 387 aa, magnetite-containing magnetic coccus
FHRIKRLPPYVFAVVNELKYKARNRGEDIIDFGMGNPDQPTPKHITDKLIEAVQDGRNHRYSLSRGIGGLRRAVCAYYKRRFGVDLDPESEAIVTIGSKEGLSSLAMAITEPGMNVIVPSPTYPIHEYSFLIAGAHIQRVKISRDNDFIEDMKVAVRNHWPRAQVLVVNFPSNPTAQVVELDFYQKVIDFAKEHNIWVISDVAYAEICFDGYKAPSILQIPGAKDIAVEFYSLSKTYNMPGWRVGFCVGNPHLIKALSRIKSYLDYGMFQPIQIAATVALNGPQDCVAEINEIYRQRRNVLIDGLARAGWAIERPKASMFVWAEIPDEFKAMGSLEFSKLLLKEAKVAVSPGVGFGVYGDDHVRIALIENEHRTRQALRSMRRFLSA

SEQ ID NO: 9944 - protein, 267 aa, magnetite-containing magnetic coccus
MEQDFYRRLNVPSSATPLQIRDAYRRLARQFHPDVSPIPQAEDLFKALGEAYEVLRDPQKRAQYDRTQGSYIWPNTRQSPPKSGTPAGKPHHVEAKLIVPLEVAYRGEIHQVRLNLRELGGDRLIQVQIPRGVVHGDRIRVYNQVRANPLKGISGGDILFNVETPPHPHFQLEGYDLYSSLTLSPWEAALGEPVQFKSLGGTIRVHIPAGSSSGQLIRIRGRGFPKPGFGQCGDLYLRLNIALPKQLNNAEKRLYRKLAKKSDFNPR

SEQ ID NO: 9945 - protein, 343 aa, magnetite-containing magnetic coccus
LRSRIIGTGSYLPERRLTNDELAAMVETTSSWIEERTGIQERRIAAPGEMTSDLAVKAAEQALQAAGIAAWELDLILVATTTPDLIFPSTATIVQKRLGADKTRIPAFDIQAVCTGFIYALTTADQFIRAGSAKRVLVIGAETFSRIINWQDRGTCILFGDGAGAVVLEAHEAVDQGILSTHIYADGSYLDLLRCTTGVSDGGSRVPGGDAQPQSTDARGVQAMLEGFGYVTMRGNEVFKRAVMALEQIVDETLEANNLSKSDVDWLVPHQANIRIINSTAKRLGMSMDQVVVTVERHGNTSAASVPLALDEAVRDGRIKPGQLVLMEAFGGGFTWGSVLVRW

SEQ ID NO: 9946 - protein, 801 aa, magnetite-containing magnetic coccus
QAIHRHVVTTLGNDVFPPRKETYYKGLAYAVRDRLMERWVMAQRDFYDQKAKRVYYLSMEYLPGRFLMNYITNLELEQEVEAAIKDMPFTLQALEEEEWDAGLGNGGLGRLASCFMDSMATLKIPGYGYGLRYDYGIFFQKIVNGYQVEKSDNWIRNGFPWEIKRTGFLYDVNFYGRSQAYIDSVGETRYRWVDTQQVHAMACDIMIPGYGTKHVNNMRLWESVSDEAFSLTHFNDGDYTGAMQAKVREESITKVLYPSDEKAEGRELRLKQQYFMVAATLHDIFRRFKKKHGQEFQKLPDQVAIQLNDTHPSIAVAEFMRRLLDEEMVGWDQAWEIAVKTFAYTNHTVLPEALETWPVELLGRLLPRHLEIIYEINHRFLEMLRQDFPHRPDLQNKLSIIKEGPTRLVRMAHLAIIGSHAVNGVAELHSRIIRESLFRDFNTIYPDRLTNVTNGITPRRWLRQANPELSQLISQAIGDAWIADLDQLKRLIPLADDAAFQQQWIAVKRIKKQQLSAYIQRKLKFSPNPDALFDVQVKRIHEYKRQLLTIMHGIALYRRLLINPQLDMVPRTIILAGKAAPAYHLAKNIIKLANAVAEQINNNPICQGKLSMAFLPNYCISQAEKVIPGADLSEQISTAGMEASGTGNMKFALNGALTIGTLDGANVEIMEEVGAENIFIFGLTSEEVEQWREGGLYNPRWYVERDEELRGVLQMISSDTFCPGQPGLFEPIRASLLERGDYYMVIADFRAYLDRQQEVAETYRNTGEWARRSILNTANMGKFSSDRAIREYARNIWDVEP

SEQ ID NO: 9947 - protein, 916 aa, magnetite-containing magnetic coccus
HTTCYMCACRCGVRITLRDGEIRHIQGNPEHPLNKGVICAKGSSGVMKQLSPARLLNPLKRKEGSERGNPEFEVISWDEAFDLMEKRLGAIRSTDPKKFAMFTGRDQMQALTGMFAKNFGTPNFAAHGGFCSVNMATGMIYTMGGSFWEFGGPDLERAKLFVMIGTAEDHHSNPLKREIGHFKSHGGRMISVNPVRTGYSAVADQWIGIKPGTDAALFMAIINILIKEGLYDKEFLREFSNAAELVILDEGPEQGMLLRSGAEKPAGCFDPEDRMWYDRNSKKIVPMRTEGANPAFLGEYTTEDGKKVKPSFQLLMEQAESCTPEWAAEITGIPAETIRNLAIEMGVVARDERFELPIAWTDAWGRKHEKVTGVPVAFHAMRGLAAHSNGFQTIRGLAIIMSLLGTIDRPGGFRHRAPFPRPVPPGPKNCTTPEEVQPNTPLPHAPVGWPANPEELFLTAEGGPVRIDKAFSWEHPLSAHGLMQNVITNAWRGDPYTIDTLFLFMANMAWNSSMHTSDVRQMLTDKDSNGQYKIPFLIVADAYHSETVAFADLVLPDTTYLERYDVMSMLDRPISEFEGPVDACRVPIMPRKGDSKPFQDVLIELGSRLKFPAFTHADGSRKFEDYKDFITNFELVPGIGFLSGWRGKDGDKVMRGEPNPDQWKRYEENGCYHFNKLPESMHFMRNWNREYLDWAKENNLMGFSDPINIHLYSEILQTFRLAAQGKRPGRQPPDHLRSRVEKYFDPLPFYHPPLEDLLVDTKTYPYNALTQRPMAMYHSWDSQNAWLRQIHTYNYLYMSPQVGRDNGFDDGDWVDVESMHGKIRCMARFTEAVEPGTVWTWNAIGKSAGAWGLSKDAYESKRGFLLNHVISEELPAHEAGEHVSNSDPVTGQAAWFDVRVKITKAEDCEPVSQPQF

SEQ ID NO: 9948 - protein, 221 aa, magnetite-containing magnetic coccus
MTQLALVIDLNICVGCHACVTSCKSWNTSGWAGPLTDVNPYGEDPHGTFFNRVQTFEAGTFPDTETIHFPKSCLHCEDAPCVPVCPTEASYKREEDGIVLVDYDKCIGCKYCSWNCPYGMREFDPGEKVMKKCTLCVDRIYDVKLPEAERKPTCVMACPAGARVFGDIHDPASKASQQIRENGGFQLMPELGTQPANHYLPRRRNHAHFNEADVTRLDNPM

SEQ ID NO: 9949 - protein, 716 aa, magnetite-containing magnetic coccus
SQEIHLLLEGIHCAACVWLNEKVLSNLPGVIEARVNFSTHRALLRWRRDVLPLSEVIEAVRRIGYKAEPYDPESGESSHRKRDRDLLLRMTVAGFGAGNVMLIAVALYAGYFSGIEAQYKNFLHLISLLIATPVVFFAGWPFLRGAVNGLRAWRLTMDLPIALGAIITYSYSVYVTLRMEGEVYFDSVTMFLFILLTGRYLESVARRKAAGATERLISLEPRTAVVLRGGEEVTVALREVAIGEHVVVRPGMQIPLDGCIIDGVSAVDESMLTGESMPIPKKAGDRVPGGAINLDGGFTMRVTRVGQDSAIARIIRMVERAQASRPPIQTLADRVASWFVAVILLLASASFAFWMWFDPSQALENTVALLIITCPCALGLATPAAIVVATGVASRNGLLIKGGEVLERLAKVSQVVLDKTGTLTTGKPKVTALLPQPGVTAQQLLSCAASLERLSEHPLAAAIVAAAKAQELTILQEGVTLKNYPGLGVVGRWASTTAVIGRVGFVQEYAGIELPMEDAEQAVTRVAVVENGLFLGWIELADDLKSDAYHAVSRIHEMGMSTLLLSGDHAAVVKRVRQQVGAQGGIGGVLPGDKEQQIAALQADGSVVAMIGDGINDAPAMARADVAVAVANASDISMETADVVLLNPRLETAVDAMALSRATMRVIKQNLLFSLAYNGIVIPLAMAGLVLPIVAAVTMPVSSLIVVGNALRLNRM

SEQ ID NO: 9950 - protein, 633 aa, magnetite-containing magnetic coccus
  unsure (1)..(633): unsure at all Xaa locations
MNKRTIRDIDIKGKRVFMRVDFNVPLNEDGTVRSDKRIQGALPTIRYAIEQGAKVILASHLGRPSGDKFEPEFSLKPAGEALAALLGQPVKLAPDCVGAEVEAMVAAMQDGDVVLLENVRFHKGETKADVELSKGFAKLADVVVNDAFGTAHRAHSSNVGITEFVRPAVAGFLMADEMDYFDKVLGAPERPVMAILGGAKISGKIDVIEALLDKMDKIIIGGGMSFTFFKAMGYEIGNSLCEDEMLPVAEKTLAKAKEKGVSLILPVDCVAADAFREDANTQICSVEALPAGWMGLDIGPESVKLFAKALEGVKTVIWNGPMGVFEMAPFASGTNHLAHLLAESDCLSVIGGGDTAAAVKQAGVAKQLSYISTGGGASLELMEGKQLPGITSLDDKXSSIMVKRAGQDPLALALKNRGXAHLYRPAXACFYKRAGCVAPLDYPILGTESETMRRALIAGNWKLNGTTQAATALATAVRDGVAANKPDCDVLVCPTFTVLSAVQGVVAGSGVDLGAQNMAVASSGAFTGEISGEMLKDVGCSYVILGHSERRTLFGETNEQVAQKVASAYRDGLTPILCVGETLEQREAEQTMQVLEQQLLACLPVLPADAAKQQQLVVAYEPVWAIGTGKVAS

SEQ ID NO: 9951 - protein, 695 aa, magnetite-containing magnetic coccus
MILYLCEKPSQGRDIGRVLGATSRHEGYVAGAGVCVTWCIGHLMEMVAPDGYRPEWKSWRLDTLPIIPQQWQLELTARGRKQFKVIQGLLKGVTEVVLATDADREGETIGREVLERCQYRGKISRLWLSALDDASIRKALGNLLPGEQTEPLYQAGLGRSRADWMVGMNLTRAYTLLGRQGGYAGVLSVGRVQTPTLKLVVDRDRLIENFKPVDYFEIFALHRVHSGTFIAKWVPPPKPCDAEGHCLDRTLAETVIHKVQGHSGTITKAETKRVKEPPPLPLELSTLQQEASRRWGMGAKQTLEIAQSLYEKHKAVTYPRTDCRYLPSNQFKEAPAVLQGLTTNDASLTPLVEGADAQLRSKAWNDKKITAHHAIIPTAAKINIDALSREEALLYDLIRRHYLAQFYPPFEYDRTVIDTQVAMETFHATGRVELIPGWKRVLAANQEKKEGDEDEQTLPVVRSGEAATIEGAELKQKQTKPPNRYTEGTLIQAMKSVGKLVEDARLRKILRETSGIGTEATRAAILETLIKRNLLAKQGKKSLVSMPAGRLLVDALPHSVTDPATTAVWEQTLDDIAHGGGSLETFLAKSELWLNKLIHNVHQRQQLGLNPFRGLPPSTSHTDPAQPTPRRQRRSKAEVTPTPNAAPLCPQCGGPMLQRKSPQGAFWSCAEQATCTGTRPGSPLAAHSPLMQPNP

SEQ ID NO: 9952 - protein, 581 aa, magnetite-containing magnetic coccus
SRRLDAEQKLRLSERHFRTLVQALPGTFYKCAPDPLCTMYSLGDNIAELTGYAADSFIENHERSFSSVVHAEDWPRVREALDQALAQGVVYHLEYRVNHTDGKPRWVMDRGQAVYDEAGRAEVLYGVLLDMTERKQYEQRLESARQQADAGNRAKSEFLAVMSHEIRTPLNAIMGMGDLLGETALSPVQRHYLSISQHAGETLVELIEDILDLSRIEVGELELEPAPFEVEALVEEVCEVVTSSAHDKGLILLMRIDPLLPPVLIGDKKRLRQILFNLLFNAVKFTKHGEVMLDIRHDAARSAAGAVLLQVRDTGVGMAEEMIERVFEPFTQGDSTITRQYGGSGLGLTICKRLVSKMGGDIQLESALGRGTTATVQLVLPVGRHGMVAAVRQQVPLHGANLLLVDDNANNREIYTELLQQEGARVVGCATGETAMQQVSEANFDLAVLDFHMPSEDGLTLAGRIQEMVPNMPLLMLSSDQQPAAAARANSMGVTFLLKPVKRQLLRQTIAQLMQSGKGVKDAPVLGQGVESGPQKGLKILLAEDVPENALLIEAYLEETGHQISVVGDGQQAFERFQEEP

SEQ ID NO: 9953 - protein, 321 aa, magnetite-containing magnetic coccus
EAFAAFTIVPALVMTLISFRFVYEGYLARSAAFEVLFLAICFVGGALFVAWHYGRALHRDCTALTEALQQVTQGHFGVRVDSSRADELGSMAQGLNEMGQGLLLRERIRDAFGRFVNPQVADAFIQRFSQGEQAIQMGGERKEITIMMADLRQFTPLSESLPPEALTELLNSYLSVMVQVIQQHGGMIDKFIGDAILALFGLGHHDQPAQLQAVLAAQAMQVALADFNEKQRAKGAPTLNNGIGLHHGEVVAGYIGSTDRLEFTVIGHNVNMAARIESMTKAPNPSLLFSQSVADAVAHTLPVRQVTIATLKGISEPIPLY

SEQ ID NO: 9954 - protein, 704 aa, magnetite-containing magnetic coccus
CGICPAGCWVRVHYAGETMVAVEPRPDHPLGMICRIGRKSPNIVYDPQRLQTPLKRVGPKGSYAFEPISWDEAMATIASRLQQTKAQHGAEATAIYTGRGSFDMAMCDLFQPADVAVSSASSVLFPFGSPNTLGVGALCYVSFAMIAPHVTFGEMLISLETDLPQSELIVLWGANPATDSPPMAHGQILAAKQRGAEVLVIDPRRSESCVEADAQWYPIRPGTDGALALGMIHVLIEEELYDENFVKNWTLGFEELAQYVQHFHPDVVAEITGVPAEQVRNIARKIANAAGACPVMYTGLEYSDSGVQAIRAVFTLWALAGQLDVPGGLLIRMKENQFPQNRTHLIKNPGADKALGRDRFPVYSAYRGESHAIALPQSVLQGTPYKVRDLIVLGGSLITSWPDPELWKRTLNALEFLVVIDRYHTADSAYADIVLPATTLYECRSFMRYGPMFAIREKLVPPVGEARNDFLILAELAQRLGYGHLYPQTEAAILERALEGSGFTLEQVQAAGGVVQLESQMMQYKKWEKGRLREDGKPGFATPSGKFEIASSLLVEHGYDALPVYTEPQEGPLARPDLARHFPLVLNTGARTYYDFRSQHHGVKGLAEQQPDPRVTMNHEDAAQRGIQNGDWVWVSSPRGEVKYRARVTDAIVKGSVDANMGGGGPVGPAPWQACNVNALTDPEHYDPISGFPIYKTLLCQIRK

SEQ ID NO: 9955 - protein, 687 aa, magnetite-containing magnetic coccus
KTTCYQCDMNCAFDVHYQADGSLERLTGPSCPRGAVQMEMQTHPERLRTPLKRVGPRGGMNFEPIGWDEALEICASQLDAIRQRDGAEACAFFSGYTKEARPHLQRLAHLFGSPNYMTESGCCFTATLVSEQLTYGYRLKTSSLQEAPETRCRLIWSTNPVHSVLPYGEHPIIRPKPGVKTIVVDPRYTETAQRADLHLPIRPGTDGALALAIHNQLFANGWADEAFLAKWANGIEAFKAYVRAFTPARASEICWVPEADIKQAAQWYATHGPAQLVLSATSTTQHSNGFQNHRAVILLAATAGYVDIPGGNRFFIDKVVPKGIDLFKELIHTLPPRVGQKRFPVWSNRYPAAHSMLLGEAIEKGDPTPIRGLFALGINPIMWPNTDRFMRALEKLDFFCMVDFFHTPGSVLADLILPAATSLEREALITASSCQYRGVVQHRRVVTPPQGEARPDAQIVLDLGCKLGMAEQFWHGDLHASIEEQAQGLTPHLWQRVQQEPGGLTVFGTAVMDDDVDEVTEKLYEVRGFPTPSGKIEFDAEELRQAGYDGLPTYKEPVESPLATPALAQAYPLVLTTGGRSVAYTHSQQRRFASLLARDPLPRVQIHSHEAAKRAIAHGDTVTLSSPRGAITMVAQVDDTIRPGIAHAYHGWAQANVNRLTEDDLSLDPISGFPAFKSSLCQIAKAD

SEQ ID NO: 9956 - protein, 284 aa, magnetite-containing magnetic coccus
EPAPLIYAAPAKLNLTLRVVGRRADGYHLLETVMAYFPLQDTLQFSLDRGGGIHLSCEPAVTASVADNLVYRAAERLKTGFGVEQGVAIQLRKQIPHGAGLGGGSSDCATTLLALNRLWGLQLSAAELAEIGLGLGADVPIFLYQRAALAQGIGERLSPMPALPAWHLVVVNPGVALSTVAVFKAHAAQVGGCYTPPGAAQAWLDGGIQHAHQLHNDLQQAAVQLCPQVGSVLEALLEQGADGVCMSGSGTTCFGVFDDEVNAVNAAQTLRQNNAQWLVIEGKM

SEQ ID NO: 9957 - protein, 308 aa, magnetite-containing magnetic coccus
MRIFSGTANPELAERISDYLGTTLGEVTVRRFSDGEIFVQIDENVRGRDVFIIQPTSAPTNANLMELLIMVDALRRASAGHITAVIPYYGYARQDRKEAGRTPITAKLVADLLHAAGVQRTLTLDLHAGQIQGFFNMPVDNLYASPVLLEAIRAKGLDNVVVVSPDVGGVVRARGYAKRLNVDLAIIDKRRPAPNQAEIHHIIGEIAGKNCLIVDDMVDTAGTMCAAANALLEQGANSVYAACTHGVLSGPAIERIEKSAISHFMITDTIRLSERGLACEKIEVYTVANLLGEAIRRISDAESVSSLF

SEQ ID NO: 9958 - protein, 470 aa, magnetite-containing magnetic coccus
KKAYVAGQWVETGTQLKVYNPYNDQLVDTVAQCGPHEIDRALDGAVDALEQTSRMQPYERAACLAKIRDGIAARGAEFARVLSLENGKTLAESTLEVARAVATFDIAVGEATRIYGEAYDLGINPMGSGRRALVRKYPIGVVSAIAPFNFPINLAVHKIAPALAVGCPVVLKPASLTPLTALMMAEVVEASGWPKQAFSVVPCNRSAGQMLVEDERIKLLSFTGSPEVGWKMKSEAGKKKVVLELGGNAGLIIDHNVKDWDHLIQRAILGAFYQCGQVCISVQRIFVHQDVMGEFRARFAKAAQALVIGDPLDAKTTLGPVIDRANVERLQGWIQEALDQGAALVTGNTIADVGAGNSMTATILEEVDAGCRINADEAFGPVVTLTPVQSMDEAFHLVNNSRFGLQCGLFTQDFATVMRALDQLEVGGVIHNDVPSFRVDSMPYGGVKDSGLGREGVKYAMEDMLEPRVL

SEQ ID NO: 9959 - protein, 317 aa, magnetite-containing magnetic coccus
RPRRLRTTPAIRAMVRENHLRAVDLIYPIFIVPGQQIRKPVVSMPGVSQLSIDQAIEVCQHAYDLGVGGVILFGIPDHKDAAGSESFAEQGILQQAIHAIKAAVPDLYLIADVCMCEYTDHAHCGILVDGQVDNDRTLSVLQRIAVSYADAGIDMVAPSGMMDGMVRHIRLGLDAKGYTQIPIMSYAIKYASAFYGPFRDAAENTPSSGDRRGYQMDPANRREAIKEAEQDILEGADILMVKPGLPYLDIVRDLRNHTNRPTAVYNVSGEYAMIKAAAMNGWIDEQGTVLEMLLGFKRAGADMILTYHALDAARWLQ

SEQ ID NO: 9960 - protein, 518 aa, magnetite-containing magnetic coccus
RRFVSDFLILGGGSTGLDLALRLAEHGKVLVLTKAPIGDCNSMMAQGGIAAVLDEDDSTILHYEDTMTAGAGLCNPQSVRLVVENGARMIQHLIDLGTPFDKTDNNSYHLTREGGHSRRRVIHAADATGRAVMLSLIKQAQAHPNIEVLPNQIAIDLITAHKLGHFLPGKKDRCYGCYALDTEADVIRTYQARFTILASGGAGKVYLYTSNPDTATGDGIAMAYRAGCRVSNMEFIQFHPTCLYHPQAKSFLVSEAVRGEGGHLLLADGTRFMERHHPLLELAPRDIVARAIDYEMKRTGEPCVHLDISHKGADFIKAHFPTIYEKCLEFGIDMTQEPIPVVPAAHYTCGGVVTGLQGATDIESLYAIGEVASTGLHGANRLASNSLLECLVFSESAYNDIVSKMFGEDRPVLSRLPLWDSYEAGSCEEEILIAHDWQEIRRFMWDYVGIVRSNQRLARARRRIEMVMQEINEYYWNCKVSQNLIELRNLALVAHLIIRSSQHRKESRGLHYTTDYPE

SEQ ID NO: 9961 - protein, 760 aa, magnetite-containing magnetic coccus
MISKHLETSLNKALQLAHARRHQFATLEHLLLALLDNPEVVDILIPCGCDMQQLNMELAEHLEQHIPLSADAAPSIADITPTIAFQRVIQRAVQQVQSSGRDMVTGAYVLVAMFNEKDAHAVYFLAKQNINKLDVQSMIAHGGESEATGAGEHGHAHEGSAAGAGNKEKDDPLAAYTVNLNIRAQEGKIDPLIGRENEIRRTLQILCRRRKNNPLYVGDAGVGKTHLAEGLALKIVNGEVPEILADAEVFSLDMGSLLAGTKYRGDFESRLKNVLRALKERPKSVLFIDEIHTVIGAGATSGSTMDASNLLKPMLQNGELRCIGSTTFEEYRTIFEQDRALARRFQKVDVLEPSLEETIKILKGLKIRFEDHHGVRFTNQALQTAAELSARHINDRKHPDSAIDVIDEAGAASQLLPLSKRKKSIGVKEIEQVVALMARIPTRSVSKDDRQVLRNLDKNLRLSLFGQDGAIDKTCEAIKLNRSGLGNPEKPIGSFLFAGPTGVGKTELARLLAAEMGVELIRFDMSEYMERHAVSRLIGAPPGYVGFEQGGLLTDAVTKNPHSVLLLDEIEKAHPDVFNILLQVMDHGKLTDNNGRQADFRNVVLIMTTNAGASDLERASVGFVTQTHVGDDMKAINQTFAPEFRNRLDAIIPFVQLNRETILRVVDKFLVRLETQLEEKGVALFVDDSARHLLAKKGYDKKHGARPMERAIQQELRKPLSDELLFGKLVHGGAVHVSAVEAANELAILVEDSHEVEKAE

SEQ ID NO: 9962 - protein, 766 aa, magnetite-containing magnetic coccus
  unsure (1)..(766): unsure at all Xaa locations
IALIDQRERALRWAKEAAEQAAQAKSEFLANMSHEIRTPMNAITGLTGLCLKTDLNSKQRDYLTKVEGAARSLLRIVDDILDFSKVEAGCLVLEETDFELESVFDHLSTMISQKAHEKGLEVVYGVPRSVPTYLRGDPLRLSQILINLASNAVKFTEEGDIVVQVAVDRYLEEQVVLHFSVRDSGMGMSQPQLERLFHSFTQADSSTTRRFGGTGLGLTISKRLVEMMQGKIWVESSLGQGSAFHFTACFRYDPERALAPCMLTWALQDKRALLVDNNPTSRGFLREMIASFSLKVQLACGLDEGMQKCHQARDEGHPFDVVVLNFSAEQDSATGLAVLQDLQRLGGDEALRRTLVIVPVTQEALIRAADRLDVGVLQFKPIYPAALQSGLTAILCPPTGXRWGCPETNPTMHMDLHGLHLLLVEDNEVNQLVASEIIKGAGAEVSIAKHGQEALDLVQVSRFDAVLMDLQMPVMDGYEATRLIRAQPGLHDLPIIALSANVMKDQVRRCYEAGMNDHLPKPVDPNVLFRLLATHLGLESKLELREDPPDQEQLVQQSLQGFPAHPAGVALSQALFYADGRVALMCKLMQRFKQEQHDVVARIRQQLELGALADAQRLAHTLKGAAGTLGATLLQEKAKQLELSIRQKQESSPRDSLASFAVLEDMEAALALVLRSLTQILASPGALAYLESETMPGDGAAYDWQEQLEHLQKLIEDYNAEAEDLVARMLVASPPAPLIEPLSEVMQAVSGFDFALAEVRMQQVRQ

SEQ ID NO: 9963 - protein, 624 aa, magnetite-containing magnetic coccus
  unsure (1)..(624): unsure at all Xaa locations
VCGVNFIKNMRFRSIKSGIVLREPQSQLIIAPSQRLLNVCNQAPRVGAFGVAAXPTNALYYPPVSTQQRLKRNFSWPTIQDASSPSGMTYRDAGVDIDAGNRLVSMIKRSVASTHRPEVRSDLGGFGALFDLDTRKYQDPVLVSATDGVGTKLKLAFLTGKHDTVGIDLVAMSVNDLVVQGAEPLFFLDYFACGKLSPETAATVVEGIATGCRAAGCALIGGETAEMPGFYTEGEYDLAGFAVGAVDKHKIIDGRHISPGDAIIGLASSGPHSNGYSLIRKLVLGQSGPGLEADFNGKPLGEVLLTPTHIYVLPLLELAKTHAIHGLVHITGGGFWENIPRILPDATGALLKRSCWQQPEVFNLLQKLGNIAEDEMLRTFNCGLGMLVIVPATQADSALAQLRAAGEQAELVGEITSCKEGDARVVILXAGQAFRIGVLISGSGSNLQALIDGVKSGFIPAEIALVISNKADAYGLTRAREAGIETRVVDHKTFEGRSPFEHELIRALDDAGVELVCLAGFMRVLTPLFVRHYLGRLINIHPSLLPAFAGLHVQQRAIDAGVRFSGCTVHFVEEEVDAGPIIAQAVVPVLPSDRAEDLAKRILTQEHRLYPWAVKLFVEGRTQV

SEQ ID NO: 9964 - protein, 359 aa, magnetite-containing magnetic coccus
ETLSLDLGDRSYEIVIGENVLASLGARLKPMLKGRQIGLVTNETVAPLYAETVIRSLEEAGFQVTLVILPDGERYKNWETLNLIFDALIGAKFERQGAIVALGGGVVGDMAGYAAASLLRGVPYVQVPTTLLAQVDSSVGGKTGINHPLGKNLIGAFYQPKLVLMDLATLHTLPKRELLAGLAEVIKYGIIWDEALFQQLEEQLEPLLALDYGVLAKVVHRCCVIKAEVVAKDERETGVRALLNLGHTFGHAIENLAGYGENLHGEAVGMGMMMAAHMAYLRGMVDAALVARVRALIVRAGLPEFPAQRQPLAAYLDAMGRDKKVVAGKMRFVLPTGMGAAVVVDDVTDASLAQVLAPY

SEQ ID NO: 9965 - protein, 695 aa, magnetite-containing magnetic coccus
  unsure (1)..(695): unsure at all Xaa locations
SLMSAQTLFEKIWNAHLIRTDEDGTSLIYIDRHLVHEVTSPQAFEGLRLAGRKVRHPEATFAVPDHNVPTKDLAGGIKDPVSKLQVDTLASNCQAFGITEFGVGDLRQGVVHVMAPEQGISLPGFTMVCGDSHTATHGAFGALAFGIGTSEVEHVLATQTLMQKKPKTMLIQVEGELPAGSTAKDIILYIIGNIGTAGGTGYVLEFGGSAIQALSMEGRMTVCNMAIEAGARAGMVAVDEKTIAYVQGRPYAPKGEAWEKAVAQWQTLKSDEGAPFDAVVTLDARNIAPQVTWGTSPELVAPVDGCVPNPTDEPNGVKRGAMEKALAYMGLQAGTPMTEIAVDKVFIGSCTNSRIEDLRAAAVAVAGKKVAASIKLALVVPGTGLVKQQAEQEGLDKIFMEAGFEWREPGCSMCLAMNNDVLEPGERCASTSNRNFEGRQGKDSRTHLVSPAMAAAAAIAGHFVDIRNGKASGIAEVKPXERTRFPMEAFNTVTAIVAPLDRANVDTDAIIPKQFLKSIKRSGFGPNLFDEWRYLDQGQPGKSNEGRPLNKDFVLNLPRYAGARILLARDNFGCGSSREHAPWALQDFGFRVIIAPSFADIFFNNCFKNGILPIVQEASVVDSLFAEVAAQPGYQLTVDLPAQRITTPSGRSIAFEVDPFRKHCLIHGLDDIGLTLQHVADIQAYESKHKGQAPW

SEQ ID NO: 9966 - protein, 335 aa, magnetite-containing magnetic coccus
YDVAVVGASGNVGREMLKILEERNFPVGKVYALASERSAGSTIPFKGGELVVENLENFDFSKVEIGLFSPGASVSKVHAPRAAAAGCVVVDNTSFFRMDPDVPLVVPEVNPEAIGGYKKKGIIANPNCSTIQMMVALKPIHDLGTIERVVVSTYQAVSGAGKDAMDELFEQTRAKYVETLEVPPKKFPKEIAFNLIPQIDLFLENGYTKEEMKMVNETKKILDPSIAVTATCVRVGVFNGHSESVNVQTKHKVTAAQAREALQKMDGVVVVDDPSQGHYITPAEASGKDATYVSRIREDESHENCLNFWCVSDNLRKGAALNAVQIAEVLIRDYL

SEQ ID NO: 9967 - protein, 211 aa, magnetite-containing magnetic coccus
FSGKRPGVLVVHEWWGLNSYAKSRARQLARMGYIAFAADMYGEGHVTEHAKEAKGWMQQVTANVEGWRRRADLALEQLKAAPQVDTTRLAAVGYCFGGGTVMQMAYGGSDLLGVASFHGPLPPAEKKDYAKIKAKIFVAHGDADTFVPLERLEAFRIGLNEAGADWQLLRYGGAVHSFTNPAADGSWMPTVKYDAKADHRSWAAFTHFLDE

SEQ ID NO: 9968 - protein, 443 aa, magnetite-containing magnetic coccus
RKFFGTDGIRGMANIHPMTPDLVLKLGRAAGHVFRVGDKRHTVIIGKDTRLSGYMFESALLAGLTSMGIHCLQVGPLPTPAIAFLTRALRADAGIMISASHNPFHDNGIKFFGPNGMKLPDELELEIERVLLSDEDLPMPTPHHLGRAHRIDDALGRYIEFAKTSFPKDLRLDGLRVVVDCAHGAAYKVAPAVLWELGAEVVTLGNHPNGTNINDGVGSLYPQEMVKRVQEVRADVGIAFDGDADRVVICDERGEILDGDVILAMSALEMKRKGVLRGDGVVATVMSNLGLERALAAEGLTLARTKVGDRYVLEHMLAHGFNLGGEQSGHLIFLDHNTTGDGLISALSVLALMTTQAQPLSKLANVMQRVPQVLQNVTIARGSDPMDDSRVVAAIAEAEAQLGTRGRILVRKSGTEPKVRVMVEGDDTAHITALASGVCEAIK

SEQ ID NO: 9969 - protein, 354 aa, magnetite-containing magnetic coccus
MPLVSMRQLLDHAAENSYGLPAFNVNNMEQVRAIMRAADETDSPVILQASAGARKYAGEAFLRHQILAALELYPHIPICMHQDHGQSPAICQAAIRSNFSSVMMDGSLREDGKTPSDWDYNVATTAKVVEFSHAIGVSVEGELGVLGSLETGMAGEEDGVGAEGKMEKDALLTDPEEAARFVKETHVDALAIAIGTSHGAYKFTRKPTGDILAIGRIAEINARIPNTHLVMHGSSSVPQELLAIINEFGGEIPETYGVPVEEIVRGIQHGVRKINVDTDLRLAMTGAIRKYFHKNPSAFDPRGYNRPAEDAAYAVCKARYEAFGAAGNASKIKVITMEDMAKRYASGELDPKVN

SEQ ID NO: 9970 - protein, 428 aa, magnetite-containing magnetic coccus
MSSIVEIHGREVIDSRGNPTVEVDVYTEDGGFGRAAVPSGASTGSREAVELRDGDKSRFLGKGVRKAVDAVNTVLAEVVLGMEVADQKGIDAAMIALDGTHNKSRLGANAILGISMAVAKAAADECDLPLYRYLGGTNTSLLPVPMMNIINGGAHADNNVDIQEFMIMPVAATSCTEAIRMGAEVFHSLKKVLKSKGLNTAVGDEGGFAPNLGSNEEALKVIVEAIEAAGYKPGEDIKLALDCASSEFYNKETGNYDLTGEGRVLTKQELVAFYEDLVAKYPIISIEDGFDESDWDGWKLMTEALGNKIQLVGDDLFVTNSKILAEGISKGIANSILVKVNQIGTLTETFEAVEMAQRAGYTAVISHRSGETEDATIADIAVALNAGQIKTGSMSRSDRIAKYNQLIRIEEELGGMARFEGMKVFYNL

SEQ ID NO: 9971 - protein, 417 aa, magnetite-containing magnetic coccus
MDKILVRGGNTLKGTIPISGAKNACLPELAATLLTEDTVTLRNVPHLRDVTTMLELLGQHGAAITIDEKLGVSIDCKSIQNTMAPYDLVRTMRASVLVMGPLVARCGHAEISLPGGCAIGSRPINLHLRGLEMMGAHVTLEDGYVRIKAGRLKGAHIVFDLVTVTGTENLLMAATLADGITILDNAAAEPEVVDLANLLMAMGAKIDGAGTRTITIEGVKNLHGTSHDILPDRIETGTFMVAAAVTGGDITMTGTYPALLEAHIAKMREAGCQIDEMDRAIRVRAEAGTLRAVDITTLPHPGFPTDLQAQMMVLLTVAKGAAQIKETIFENRFMHVSELQRMGADITVQGNTAIVRGVPQLRGAPVMATDLRASASLVLAGLCAEGETLISRVYHIDRGYERIEEKLKALGADIQRL

SEQ ID NO: 9972 - protein, 376 aa, magnetite-containing magnetic coccus
AESSNRTKSMFLAAMSHEIRTPLHAINGLAELLEREELNQDQKHYVHIIYRAGSRLLALINDILDFSRLEAGRIELESLVVEVRPLVHETMEMLSFKAKDKGLALQWTLEPQVPQWMMSDPTRLGQVLVNLVGNAIKFTQSGEVALEISVAEQQLCVMVRDTGLGIAEDKQQIIFEPFSQSDITISRRFGGTGLGLSITKQIVALMGGTISVQSRLGEGSRFYVRLPLKEVAAGDLLAAQQATQEVEVITLPTLNILLAEDTLENRVLFRAFLKHCPWAIDEAKDGAEALIKFTTGHYDLVLMDVEMPIMDGYAATQAIRAWERAQQRVATPILALTAHALSEYRQQSINAGCNGHVVKPLGKRDLIEAIRQAVTP

SEQ ID NO: 9973 - protein, 751 aa, magnetite-containing magnetic coccus
LRTALEEREKALQCAEQANLAKSDFLANMSHEIRTPLNAIINLSYLILQTPLTSKQSNYLEKIESAGRTLLGVINDILDYSKIEAGHLVLDHVAFQLDDVISNVANIAIARKEDKDLDLLYHVTPSTPTQMMGDPMRLGAVLINLTNNAIKFTEHGEVVIRVDAKQQREQHYLLHFSVQDTGIGISAEQQKRLFQSFSQADSSISRRYGGTGLGLAISKKLVELMGGTLSLQSVVGQGTTFEFTIPLQAVEIKPDEVPSATSLNGVRVLVVDDNATAREILEEQLNAFHMEVCSVASGEAALDVLHHEPRPELILLDDQMTGLSGVETVRRLRGQINLARIPEVLMLSDHGREKVRQEAEALGITHFMCKPISPSVLLETLLEVRGECLPRKQRSRRPLIHPELRDGLSAIAGARVLLVEDNAINQEIAIELLGYAGVAVTPAASGQSALDLLNSEAPFDLVLMDIQMSDMDGYATTRQLRQDPRFKTLPVVAMTAHAMVSDREKALQLGMQDHIPKPIEPEQLFAALVQWIKPRQANQQPLNLSPQAPRPLEEMVLPELTGVDVQAGLARVGGNAELLRKLLVRFAQENSAITQKISNLATENPAQAGELIHSFKGVAGNLGMPQVAKSARAVELALKGSESLDAALHGLTRVLDPILKGLSKLDTTLEEAYSEAQPLEPARVLSRIEEMSAMLEQDFAVAQHVQGQLQTLLQQSRYAHKFQQVVAAMDEFDTDRVQALLTEIAGQLSQP

SEQ ID NO: 9974 - protein, 411 aa, magnetite-containing magnetic coccus
LSGTIRPAADKSISHRSVIFGALAEGETHVKGMLEGEDVLRTITAFRTMGISIERCNEGEYRIQGQGLDGLKEPDDVLDMGNSGTAMRLLCGLLASQPFHSILTGDHSLRSRPMGRVVQPLTKMGARIRGRDGGRLAPLAIEGTELVPITYNSPIASAQVKSAIILAGLNTAGETTIIEPAVSRDHTERMLIAFGAEVTRDGNQVTIEGWPNLQGQEIEVPADISAAAFPMVAALITPGSDIILENVGMNPTRTGILDLLLAMGGNIQRLNEREVGGEPVADLQVRYSQLQGIEIDPTVVPRAIDEFPVFFVAAALAQGQTLVQGAEELRVKESDRITAMANGLKALGAIIEERPDGALITGNPDGLAGGASVDSFTDHRIAMSLLVAGLRCKESVLVQRCDNINTSFPSF

SEQ ID NO: 9975 - protein, 410 aa, magnetite-containing magnetic coccus
LIVLKFGGTSVGSIERIRNVARMAMAEQQAGNQVVVAVSAMSGETNRLVGLVEDLTQFYNKREYDVVVSAGEQISIGLLATAIESMGQKAKSYLGWQVRFITDGSHSKARIKEVEAFRIQADLDAGAIVIVAGFQGVDSHNNITTLGRGGSDTSAVALAAALKADRCDIYTDVDGVYTTDPRIVTKARKMDRISYDEMLELASLGAKVLQTRSVELAKKYSVPVRVLSSLEPGSGTMLTKEEDTMESVVVSGLAYDKNEAKITILGVPDKPGVAANLLGRLGDANINIDMIVQNVSPAGDATDMTFTVPKADFPQAMKVMEDAVKDVGARQLQGNSDIAKISAVGVGMRSHSGIAQKMFKALADEGINILMISTSEIKISVVIEEKYTELAVRALHDAFELEKDPSDRIN

SEQ ID NO: 9976 - protein, 541 aa, magnetite-containing magnetic coccus
IQTKITTPFDDQKPGTSGLRKKVKVFQQPNYLENFVQSIFDTLEEFQGKTLVLGGDGRYHNREAIHTILHMAAANGFGKVLVGRGGVLSTPAVSHLIRKYDAFGGIVLSASHNPAGPDGDFGIKYNVSNGGPAPESITNAIFTHSKAITQYRIWSDTEVDLDYLGDSEIGNMVVRVIDPVYDYAQLMEELFDFEAIRALLKGGFRILFDAMHAVTGPYAREILENRLGAPAGTVLNGVVKDDFGGGHPDPNLTYAADLVARMWADDAPDFGAASDGDGDRNMILGRKFFVTPSDSLAVLAENGTCAPGYARGIVGVARSMPTSQSVDRVAEKKNFACFETPTGWKFFGSLLDAGKATLCGEESFGTGSDHVREKDGLWAVLFWLNILAHRKTSVEAVVKDLWAIYGRTYYARHDYEDVDSAAASTLMSELRANFATLTGQVHEGLTIKLADEFGYTDPVNGESTIKQGVRILFVDGSRIVFRLSGTGTSGATLRIYLERFEPNPSLQHKDAQEALADLIRIADTLAGIKQHTGRQAPTVIT

SEQ ID NO: 9977 - protein, 302 aa, magnetite-containing magnetic coccus
QSPIAVEVAGIAMRTPLVLLSGCVAFGEELLTLEGFDFKAIGAICLKGTTLEPKRGNPPHRLAETPCGMLNAIGLQNPGARAVVDEILPRLCAQIDTPLIANISGSTTEQYGEIARIFDQSPVAAIEINISCPNVKEGGIAFGSDPDMAAAVVEEVRRATTKPIITKLSPNVTDITTVAKRAIEAGSDALSVINTLMGMAIDLKKRRPVLGNLQGGLSGPAVKPVALLKVWQTYQLARQHQIPIIGQGGIASADDVLEFFLVGASATGLCTSLFKDPLLPMRIAQALHQGVAEQGVTNIAQL

SEQ ID NO: 9978 - protein, 476 aa, magnetite-containing magnetic coccus
EFTELPIPEPVLAGIRDCGFTQCTPIQALTLPLALAGKDVAGQAQTGTGKTAAFLIGALSHLVTHPRKHGKPAGQSLPRILAVAPTRELVAQIESDAKLLNAHTQFKLHCVYGGVDYEKQKRILMEEDVEILVGTPGRLIDYFKQNAYGLKGVEVLIVDEADRMFDMGFIDDLRYMLRRLPHYSERLSMLFSATLSYRAQEMSYEYMNMPEVLSTTVDVKTAERVEQKLYHVSGDEKIALLVGLLRDILQHEGIDLSQPAMLELDDNGDEIVEPNGAMLSGDEPSTESEPFVPHPDDLDTEDAARAAEAALANAQKTPPGRSMVFVNTKRAGERVERWLKANGIQAGYLSGDVPQMKRLKVLKRFQDGEYPVLIATDVAGRGLHIDGVTHVINYDLPDNAEDYVHRIGRTARAGNRGDAIALVDEEGAYSLEAVQAYIGMTIPIVWAEDDLFADLVRPPPRPRSERDMRRTGGGRS

SEQ ID NO: 9979 - protein, 542 aa, magnetite-containing magnetic coccus
EQLLQEQTRVLMQREEELTASRLKADQANQAKSEFLANMSHEIRTPMNAIIGMADLLLETELNKDQRRYVQIFARAGASLLELINDVLDLSKVEADRLELEHRPFDLWALVEGAVEIFTLRTQEKGVKLDFELSARAPRYVISDQKRLRQILVNLLGNAVKFTQSGQIQLWVDVRDCEDAGGWLYFRVQDSGIGMSKAQQKSIFEPFVQADASVTRQHGGTGLGLAICKKLVELLSGDIWLESELGQGSRFHFTARFTHTALVAESERAFTSAKLHGRHVLLLGSQPQNRVLLESVLRRAGCQITTVTHQAQLAGHLLEPPAGLRPFHAVLVDCYNSMARVHQQIASVRANGSVMPMVLLVGEARQEDIQIAADLGVLLLERPVSHGRLLEALGATMEQGEAALLSSSLSPTAAIEMLKQVPLKILLTEDSVDNAVLFKAYLKQYPLEITHAANGAEALTLFEQHHYDLVFMDLQMPVMDGYSATRAMRFFEKQQRRPPTPILALTAYALSGDADKSRDVGCDAHLVKPIKKLELLSSIAQY

SEQ ID NO: 9980 - protein, 297 aa, magnetite-containing magnetic coccus
ALLVEGLVKRYKGGITALDGVDLRVEPGEVFAILGPNGAGKSTLINIVAQITTATAGAVAVFGTALQQDPLATKRLVGITPQEIALDPFFTVREVLVNHAGYYGFRDASAHVERLLERLGLAEHAHKRTRQLSGGMKRRLTVAKSLVHQPPLIILDEPTAGVDVALRRDLWAFVSELHQEGVTVILTTHYLEEAQALAGRVAIINHGRVVRCAPMSQLLNSFGGRRAAIQWQGGVAKPAQLPVGMQWDVAGEALSGTVDEQALPQLLAWAAEHGHGVRDLRLEPPRLEDVYLQLTAE

SEQ ID NO: 9981 - protein, 201 aa, magnetite-containing magnetic coccus
KKITMVAPQEALPGRGIPMPVEDQHWVLKTPMRGPWPGMQQLLVGMGCFWGAERRFWQQPGVHMTAVGYAAGYTPNPTYEEVCANKTGHNEVVLVVYDPQQTDLERLLRLFWEAHNPTQGMQQGNDVGTQYRSGIYLAHEAELALALATRDAYQQRLSGAGLGTITTEILPMPPFYYAEAYHQQYLAKNPGGYCGLGGTGV

SEQ ID NO: 9982 - protein, 412 aa, magnetite-containing magnetic coccus
SSSILHCSFCGKSQNEARKLIAGPSVFICDECVDLCMEIIREDKSDQLEKKRGGVPTPMEIKSTLDDYVIGQDNAKRTLAVAVYNHYKRLESNDTSADVEISKSNVLMIGPTGSGKTLLAQTLARLLDVPFTITDATTLTEAGYVGEDVENIILRLLQAADNDVEKAQRGIVFIDEIDKISRKSDNPSITRDVSGEGVQQALLKIIEGTVASVPPQGGRKHPQQEYLQVDTTNILVICGGAFNGLEKVIEKRSSKHHGIGFGATVRKNSKEESVNVLLKELEPEDLLAFGLIPEFVGRLPVVATLEELSKEALVRILTEPKNALVKQYQKLLEMENVKLTFTDGALEALAQRAIERKTGARGLRALLESTLLDIMFEIPSKQGVREVVINREVVEKQIEPLLIYAEEALEAN

SEQ ID NO: 9983 - protein, 776 aa, magnetite-containing magnetic coccus
VRMPVLPLRDIVVFPHMIVPLFVGRDRSIRALDAVTATNEEDRRILLVTQKEASTDTPSEEELYTMGVEGSILQILKLPDGTVKVLVEGLRRMRVRRYIQSEPHFEAEAVPLQPASYSDAEARALMRSVITQFEQYGKLNKKVPPEVLMTLQSIEDPVRLANTAASHLTLKVSDKQQLLEVDGVVDQLEQLYLLLEREIEVIQVEKRIRGRVKKQMEKSHRDYYLNEQMKAIQKELGDEGSEKDEITELTEKIEAAGMPAEVKKKADGELKKLKQMSPMSAEATVVRTYIDWLVSLPWNKESELKHDLTEAETILEEDHDGLKKVKERILEYLAVQKKVGKMKGPILCLVGPPGVGKTSLAKSIARATGREYVRISLGGVRDEAEIRGHRRTYIGSMPGKIIQSMKRAGTRNPLFLLDEIDKVGSDYRGDPSSALLEVLDPEQNVAFSDHYMEVDYNLSNVMFITTANSLNIARPLLDRMEVIRLAGYTEDEKLRIATRYLIPRQMEEHGLTEQELSISSGTITDIIRYYTRESGVRNLEREVGALCRKAARILLTEENRKKVTITAQSLEKYLGTRRFRFGIAEEADIVGVTTGLAWTEVGGEILTIEATHLEGKGSFTITGKLGDVMQESVQAAMTCARSMAEGWGIKGEFFQKRDFHIHVPEGATPKDGPSAGIALCTTLVSCMTGIAVCKDVAMTGEITLRGRVLIIGGLKEKLLAAHRAGIRRVLIPEDNVKDLKEIPQSILKDLEIHPVRHVSEVLKLALVRMPEQVDVV

SEQ ID NO: 9984 - protein, 384 aa, magnetite-containing magnetic coccus
KLLKYVGFPTSKVLGPEASAGELQSMIDEAGGLLVKPIFKGGVGKKGKAGLLGIAKDVQTALKEKERLYFAEHQHGNAYAKAEGVTFESFVEAKYEVYFSITDSTKYRAPTVTITHHGGVDIEELPPEKIATVPFDPLTGFKGFVVSNALTRLGAPNEIISPLVQNLPKLWDLYHNYGMTTLELNPIRMMPDASGRLVPVACDFKCSFDGDDPNVERLNLPTDLDMADYSNFEMEVNQLRTYQGQSDVYVINDQGSITAMTFGGGANALVTEQLGDRATISSDFGGNPPYQKMYDISRITMKYWIKQSNVFFIIGGKANNTDIFETFRGMADALREYFGEYGPTPLYVVVGRGGPNLIRGMGYLKDTLDALGLPYRFFGYDSAM

SEQ ID NO: 9985 - protein, 278 aa, magnetite-containing magnetic coccus
KGVSEFPYYVGIHSLAEMATKEDRVCVLNILGGESKSVTPISHAYSGGNIVCGTQPGRSGSTLKTPAGDIPVYSNVLEAVEAGHVFNAAVVYVPPSGVKDAVIEAVRVSPNLKKVVILTEKVAVKDARIIRAYCQMRGVDVLGANCLGVADAHNKVRIGGALGGANPEESLIPGSVSIFSNSGNFTTTIAVYLATAGWGTTTSVSSGKDVYIHYAAPEYTYAMHNDDRTKAAVFYVEPGGYYEHDLVFKKPVVACVVGRWKAKLTRSCGHAGAIAGSG

SEQ ID NO: 9986 - protein, 423 aa, magnetite-containing magnetic coccus
NVVIVGTQWGDEGKGKIVDLLTEQADMVVRFQGGHNAGHTLVVDGKKYILHLIPSGIIRPGKQCAIGNGVVLDPAALLAEMAKLAEVGVAISPENLKIADRTNLILPYHNALDQAREKKKGEEKKIGTTGRGIGPCYEDKSARRGIRLVDLYNPALFEEKLRENLDLVNFLLKNYYHEEGFQLADIRDDYLRMGDQLAPYCEDLAPWLEQAQAEGKNILFEGAQGALLDVDFGTYPFVTSSTTNASGACSGSGVAPGKLDYVLGIVKAYTTRVGSGPFPTELECADGQYLAKKGHEFGATTGRPRRCGWFDAVVVRHSARVSGLNGICITKLDVMDGMSEVRLCTGYRIDGKETAYVPADTAKLDRVEPIYETMPGWRESTVGCKNWQDLPAAAQAYLNRLVQVVGVPISILSTGPDRSETLI

SEQ ID NO: 9987 - protein, 408 aa, magnetite-containing magnetic coccus
RQSLILVLAGGRGSRLKNLTDTEAKPAVPFAGKFRIIDFALSNCVNSGMRRVGVLTQYRAHNLIQHVQRGWGSFRAEFDEFVEVWPAQQQTAAESWYSGTADAVYQNIDLIESHHPKYVVILGGDHIYKQDYSVMLDHHITSGAQVTVACLEVPVAEAREFGVMDVDEQDQIVKFLEKPQTPPELPNRPGWALASMGIYIFDHELLVEQLERDALLEDSSHDFGKDLIPYLVPKVKVMAHRFSHSCVGLDGKKEPYWRDVGTLDAYWEANMDLTHVTPELDLYDPKWPIWTYQVQRPAAKFVFNDDSRRGYAVDSLVSAGCVVSGSAVERSLLFTDVRVNSYSFVSDSVILSHADIGRKCTLIKCIVGPNTVIPDGMVIGKDPQLDAQRFYRTEGGVTLVTQEHIDKL

SEQ ID NO: 9988 - protein, 473 aa, magnetite-containing magnetic coccus
MRVLFVTSEIYPLIKTGGLGDVAAALPAALIEQGVDIRVLVPGYPSVLEGMQRQGDAIVLGEVFGHGDARLIPGRLPDSDVFLWALDIPTLYNRPGNPYLSHDGRDWGDNAIRFAALSRVAALIAEAGGFLGWRPDVLHANDWQAGLASAYLHFSGNRHCKSIITVHNIQFQGNFPARVVHEVGLPASAMHVYGAEFYGQFSFLKAGLFYSNWLTTVSPTYANEICTPAYSFGMDGLLQDRVHQLHGILNGIDYHAWNPETDPLIPHPYSRDTLENKLLNKRALQQEMGLLVEDDRPLFGLVSRLTEQKGIDLILEAIPAVLSAGAQLVVLGSGHRAFEDQLRQLAAQNPLQVAVHIGYDEIHSHRIQAGVDILLVPSRFEPCGLTQLYAMRYGTLPLVRRTGGLADSVTPIHSENHGTGFLFDRPDTISLLTVMLQAMGCLRNPTLWRNAQQRAMSMDFGWRKSARAYMHLY

SEQ ID NO: 9989 - protein, 813 aa, magnetite-containing magnetic coccus
HDRPDWNATFIKEKLVNYMVHDVGKDPDIASERDWYYAVVYFVRGVLSERRIRQNRYLRDEKGRRVYYLSMEYLIGRNLMRTVLDLDLNILLREALSEFEQDLDTIVACEVDAALGNGGLGRLAACILDSIANQSFPGMGYGIRYEFGMFSQSIEEGMQVEHPEHWLRHGNPWEFEQPNVKYRVRFNGKILCFKDADGNDTCQWVDTKDVVALAFDVPLSGHKTPSITNLRLWSARATRDFDLSYFNEGNYVEAVKDKAVSENLSKVLYPNDSTLRGQELRLKQEYFFVSSSLQDIMERFKLENGDIRQFPKRVVIHLNDTHPSLAVPELLRLFCDEYGLEFDEAWDLCRQTFTYTNHTLLPEALETWPIAIMEHVLPRHLQILYKINHQHLKEVKHRYPGNSTILSRMSLIDDVSKRVRMAHVCIVGSYSVNGVAELHSRLMQAGMFKDFKEMRPGVFTNVTNGIDQHRWLNMSNPGLSALIKESIGDKWVSDLPALVELAPLADDAGFRRQFHDIKRANKVRLAQLVARKTGVELDPSSMFDVQVKRIHEYKRQLLNLMHVVTRYIRIRDGVENDMVPRSVIIGGKAAPGYHIAKQIIRLINDVASTINNDPAIKGLLKLVFLPNYNVSKAEIIMPGSELSEQISTPGMEASGTGNMKFALNGALTIGTLDGANIEILEEVGDDNIFIFGMTADEAHDLRAGGYDPTLYFEKNAELRRVLEMIRDGFFCPDDPGRYSDLYNNLLFGGDHFLLLADYEAYIACQKQVEATYSNQDRWNRMAVLNTANMGKFSIDRTVRTYAENVWKVKPMQL

SEQ ID NO: 9990 - protein, 488 aa, magnetite-containing magnetic coccus
MKILMVASECAPVAKVGGLGDVVHGLSRELHQRGHDVAVILPKYDCMRYDHIWDLAISYENLWVPWNGGVINCTIWFGHVDGLASYFIEPHAEEQFFNRGTYYGFWDDAHRFGFFSRAALEFMLKANLRPDIIHTHDWQTALIPVMLYEIYESLGLDRQRVCHTIHNFKHQGTTGRDLLYATGLHRADYFGDVHCMGDDFTPGAINHTKGAITYANFVTTVSPKHAFEARHSDQGYGLGHTLYRFQDKFGGILNGLDYDTWNPMTDPYLRVHYDRDTLERKSDNKQALRERLMLQQVYKPMVAYVGRLDTQKGVHLIRHALFRTLEMGGQFVLLGAASERGINDDFWHLKNDLNDNPDCHLEIGFDEALAHQIYAGVDLFVVPSLFEPCGLTQMIALRYGTVPVVRQVGGLADTVFDWNHSDLPLSKRNGFVFEEASFAGLESALDRGIALWKQDPHGFQMLMQAGMRYDYSWRLPVEHYLNIYRYIR

SEQ ID NO: 9991 - protein, 701 aa, magnetite-containing magnetic coccus
VWPGNPFPLGATWDGRGVNFAIFSEHAERVELCLFGPDGFRETARISLSEYTNQVWHGYLPDVRPGQLYGYRVYGPYQPEHGHRFNHNKLLLDPYAKLLNGQLQWHEALFGYRYDDPLGDLSFSDLDSAPYVPKCVVVDTAFTWGGEQPPNVNWLDSIIYEMHVRGFTMQHPKVPQNQRGTFAGLCAPEVISYLQDLGISSVELLPVHASVDEWHLAQKGLSNYWGYNTLAFFVANPRFASGPDAIREFKTMVQVFHEAGIEVLLDVVYNHTAEGNHEGPTLSFKGIDNKAYYKLEPGYNRYYRDFTGCGNSFNLRHPKVLQLVMDSLRYWAGEMHVDGFRFDLTTTLAREADGHFDRHSGFLDAIAQDPLLSRKKMIAEAWDIGDGGYQVGNFPPGWGEWNDRYRDAIRRYWKGDKGMAGELASRLTGSSDIFNHNGRRPWSSINFVTAHDGFTLRDLVSYNHKHNSDNLEDNRDGRDANDSWNCGVEGASEEPAIRILRLRQMRNFLTSLLLSQGLPMLVAGDERGRSQNGNNNPYCQDNDISWVNWDEHDEEAKELLSFTRFLIKLRREHGVFHRHSFFNGQKITGLEVKDVVWLRPDGREMERCDWDNVHTLCLGMLLSGEAGEKFLSRYGDAQVDDTFLLLLNSHHEPLPFHLPEVEDGSGWTRLLDTMERGGGCDEPQPGIVNSYQMGGRSAVLF

SEQ ID NO: 9992 - protein, 702 aa, magnetite-containing magnetic coccus
QLQLASAEARVASETKNLFLANMSHEVRTPLNAIIGMSRLAQDLREEHVRQDYLVKIHGASQSLLAIINDLLDFSKLEAGKLALERTPFQIDEVIANINAILGHKAVQKELSIRYYVDADVPNHVVGDPLRLGQVLINLMGNAVKFTDQGYIALRVEQVAHSEHRLRLRFSVKDSGVGISPSAVAGLFQAFTQADNSITRRFGGTGLGLVISRELVKVMGGDIHVESELGVGSRFFFEAEFVPIDEGLHAKTEQPWQGRGAVVVDADRDEQNYLKHILERCGLGCHCYSDPTLLLSEAFARLDPAPHYLFIRESSLSSSALEHLSHHLRHHGVVKPMKQILLCRRQGGDERSGWHSPLMDKMLVEPLHAQQLRRLLAQLEGIETQEGGGLNDGVSAARLRRIQGARVLLVEDNALNQQVAVAFLEQAGMEVAVAENGLRCIEMAEQSHYDLVFMDIQMPVMDGLEATRQLRQRSALAKLPIIAMTAQAMPSERECSMVAGLDDYLTKPVSPEAIQQMLVRWISPRHPAKVRTQMVEPAVMPVKVVEPTLPFKASPGLGDTPTQRLQEDAHEEVAAGRAEDLARFDTITQMDVSVGLSRTGNSAKLYEQLLRGFLERYLDAPLRLDAMQSKQAWAEIGDLAHAIKGVASYMAAEALVHAAQAMDQAVKQESTHRFEEIAGMLNHELKLVLADLQVWRSGQPPQ

SEQ ID NO: 9993 - protein, 422 aa, magnetite-containing magnetic coccus
YETDVLVIGAGGAGVTAAIEAAKRGLDVLIATKLRAGDSNTIMAEGGIQGADQECDSPLQHYLDVLGGGHFSNDPELAEALCQDGPEALAWLEELGMLFDKYPTGRMRVRHGGGTSRKRLHSSGDMTGLEMMRVLWDECRNLANVQVMEFSPIVELLTDDDGRVVGAIIERLTHNNEVRVIQAKSVILATGGLGRLHLQSFPTSNHYGATADGLVLTYRAGLPFRDLQHNQYHPSGIAFPEQKAGLLITEKFRGLGAQLVNRFGDEFVYSLEPRDVTTAAIIRECSEFSHGATTPSGNVGVWLDIPMIDDLHGKGTIEREFPGRFSEFSRHGIDLTKVPVLVYPTLHYQNGGVRIRGDGATGLPGLYAAGEVTGGVHGKNRLMGNALLELIVFGLRAGRAAAEFALSTNPGGAAGLSHIESY

SEQ ID NO: 9994 - protein, 382 aa, magnetite-containing magnetic coccus
MNIHEYQAKEIIAKFGVNVPRGRVAYTPQEAEMAAKELDSEVFVVKAQIHAGGRGKAGGVKVVKTTDAVREEASRMLGLTLVTHQTGPEGKEVKRLYVEEGCDIARELYLGIVIDRATSRVTFMASTEGGMEIEEVAEKSPEKILREVVDPAVGLVAFQARNLAFGLGLEGKQINKAVQLMSGLYNAFMETDASLMEINPLVITGAGDVIALDCKMNFDANALYRQKAIEELRDFDEENPKEIEASKHELNYIALDGNIGCMVNGAGLAMATMDIIKIKGGAPANFLDVGGGATTERVTEAFKLILSDENVKAVLVNIFGGIMRCDVIANGVVEAAKQVNLNVPLIVRLEGTNVEKGKEILANSGLPIISADNLDDAATKAV

SEQ ID NO: 9995 - protein, 289 aa, magnetite-containing magnetic coccus
MSIFIDKNTKVICQGFTGANGTFHSEQAIAYGTQMVGGVTPGKGGSTHLGLPVFNTVAEAVAATGATATVIYVPPPFAADAIMEAAAADLDLAICITEGIPVLDMMKVKRYLEGRKTRLVGPNCPGVITPDACKIGIMPGHIHKRGSVGVVSRSGTLTYEAVAQTTAIGLGQSTCVGIGGDPINGTNFIDCLERFNEDDETEVVVMIGEIGGTAEEEAAAWIKAHMKKPVVGFIAGSTAPPGKRMGHAGAIISGGKGTAAEKFAALEAAGVFIAQSPSAIGETVKKALG

SEQ ID NO: 9996 - protein, 648 aa, magnetite-containing magnetic coccus
MLHLEKVEKRYGATIILSGTDLVIHPGEKVGLIGLNGMGKTTLFRIIEEVEPLDGGRLDRHPPHMRIGVLRQELTPAHRSILQETLGGLPQLVALNNEREALHSKMVEHPEHDAYHQWVMRLGEVDHALEDLDAYSAEARAGAILLGLGFSTADLEKPLDAFSGGWRMRVALAQLLFSAPDLMLLDEPTNHLDLESVAWLERYLAGLSGAYMLISHDRDFLQRTTRVTVELEDGKLTRYKGSFDAYMNWKIEQAELLSKQAAKQADKLEAMQRFISRFRAKATKAKQVQSRVKQMEKLEAQKVELPGQGRSAPVIRLPDPPPCASQVMKIDKMSMAYGSTQVFKNCQLEISKGSRIGLLGPNGRGKSTLLKLLCGALQPTAGVVMPGDRVKPGFFAQHALESLRLGDTILESAREVAPPGTTETQLRTVLGGLLFSGQRVEKLVSVLSGGEKARLALARLFLSGANFLLLDEPTNHLDMPSRAALEEALESYQGTFVLVSHDRSLLESVCDRYVAIAQDQLHPLGEDLDHYLEHFVLQETASQPNGVQDKTTARALSKESKREAAQIRNALHQRTKPLRSQLNQCEKNIQQLEADKTRIDATLTDSSLYEEGQKERLKNLLESSTQTEQALSKAWALWETLSMEIETL

SEQ ID NO: 9997 - protein, 201 aa, magnetite-containing magnetic coccus
AVKIKICGITSLADAWAAHDAGADAMGLVFYPGSPRAVTPQQVAQWRGDLPPFMTVVGLFVNATAQWIASTTALCSLDRIQLHGDESPAQCRAWGARAIRAIRVAEAADLHDLARWPVGALLLDAKIKGSYGGTGACFDWQLLGQAELPKPWILAGGLDPDNVEAAVRQVQPYGVDVSSGVESAPGKKDHNKMHRFVAAVR

SEQ ID NO: 9998 - protein, 400 aa, magnetite-containing magnetic coccus
LARMLDLLQAMGNPQRRLGPVVHVAGTNGKGSVIAFFGAILRQAGRSVAAYTSPHLVTIHERIQYNGVPVEDALLRYYAQQVLALPQSQQATFFERLTATAFAVMAHWQASDPSLVVVLETGLGGRLDATNVVQPVLTAITAMGLDHQSYLGTSMAQIAQEKAGILKAGVPAVLAPAQDEALAVLVQQAQQVGAPVQVAGQDYRWGQNNEGAGWWYSDGVGQLMLPEPGLLGAHQYHNGAQAVAMVRQLVAQGWSVPSSAYAAGLTAVRWPGRLERVGDAPEVWLDGAHNPAGAQVCADFFRQYGRVDVMLFALMADKDVAGMLEPWLELVKTVVVVEPVGGRSMAAEGLAQAWRAVGVTAETAPSTEQGWQLARKKAGHAGKILVSGSLYLVGEVKKLL

SEQ ID NO: 9999 - protein, 836 aa, magnetite-containing magnetic coccus
VKLSRREYIKAHAIAAAAAAAGMPVAAPTEAHATTLGGDIRWDKAPCRFCGTGCSILVGTKDNRIVATQGDPDAPVNRGLNCIKGYFLSKIPYGKDRLTKPLLRKTAGKYDKNGDFQEVSWDEAFDVMADHFKKAIKKGLDAGKMPPVGMFGSGQWTVWEGYAASKLMKAGFRSNHLDPNARHCMASAVAGFIRTFGIDEPMGCYDDLEHADTFVLWGSNMAEMHPILWSRLTNTRLTKPNAKVVVLSTYQHRCFDLADLGIVFNPQSDLAIANFIANYVIEKGRYNKAFIEKHVNFRLGNTDIGYGLRPTDEREKSAKNNKNRKDTIGSQPISFEEYAAFVKTYDVAKASQISGVPERQLIELAELYADPDRKIMSLWTMGMNQHTRGTWQNNLVYNLHLLTGKISEPGNSPFSLTGQPSACGTAREVGTFSHRLPADMVVANKAHRDICEKHWLLPEGTIPEKVGFHAVLQNRKLKDGELNAYWVMCNNNMQAAANINEEALPGYRNPDNFIVVSDPYPTVTAQAADLILPTAMWVEKEGAYGNAERRTQFWRQQIPPPGEAKSDVWQLMEFSKRFKVEEVWPAELIAKQPELKGKTLFEVLYANGQVNKYPLSETAEGFDNNESTDFGFYVQKGLFEEYAHFGRGHAHDLADFDSYHQARGLRWPVVDGKETLWRFREGYDPYVPKGEGVRFYGKPDGKAWIFALPYEPPAEEPDAEYDMWLCTGRVLEHWHSGSMTRRVPELYRAMPDAMVYMHPNDAAKRGLKRGMSARLITRRGEVIARVETRGRNRVPEGLIFIPWFDASRLVNKLTLDATCPISKETDYKKCAVKVLK

SEQ ID NO: 10000 - protein, 475 aa, magnetite-containing magnetic coccus
VLGFAEITTLKKVQADLLLAKEQAEEATRAKSAFLANMSHEIRTPMNSVIGFSHLALKTNLDKQQSDYLNKILFSARSLLGLIGDILDFSKIEAGKLTVESLPFTLDEMLDSVAALNANRAEEKGLDLIFSHSSNLPQALIGDPLRLGQVLTNLVSNAVKFTTEGHVQVLVEPLHQQEQELLLKFSVIDSGMGMSSEQVSLLFTPFTQVDVSHTRRFGGTGLGLAICRNLVEMMGGSISVRSQEQVGSHFEFTICCGVQMAQSESHLIHGAKERMVFVQEAGVVRRAIEQNLLGFGVKVEMVDDAEGLLALLKQAYAHPVALVIIGWQAYEAGVVERLKRRLQQQPHKPKVLVLAPSFKVASLNAGAAHYGVDGVIPKACSPLKLANSVERLLQGLPLLIEQSELVQEGAPPQWLQGGRVLLVEDNPINQQVAQELLEQCGLQVSIAQDGVKAVAAVERERFDLILMDIQMPEMD

SEQ ID NO: 10001 - protein, 868 aa, magnetite-containing magnetic coccus
AYRPPHFLVEQVTLTFELDPSATRVEALTHFKRHPDAPTDAPLQLHGEELQPELLEIVGQQERPHYHIENDRLTLTPPAESFTLRCVTRIAPDKNSALDGLYISGGMFCTQCEAEGFRKITYYPDRPDVMAKFRVTLIAEAQQYPILLSNGDKVATADLGDGRHSATYEDPYPKPSYLFALVAGDLALLEDHYTTAEGRKVTLQLYSEHHSIDQCGHAMQALKKAMQWEESRYGLSYDLNTYMIVAVGNFNMGAMENKGLNIFNTKYVLAAPHVATDAEYEAVEGVIAHEYFHNWTGNRITCRDWFQLSLKEGLTVYRDQSFSADIVSGSVQRIQDVRLLRNHQFPEDAGPTAHPVQPESYIEINNFYTSTIYNKGAEVIRMLETLLGWPIFRQGMDLYVARHDGQAATVEQFICCMEDASGRDLGQFRLWYVQAGTPELTFNSLYYPESQRYVLNVTQVCPPTPGQLSKAPMHIPIRMALLDPDGQPQSLKLVDGEQVLGAETVLELTTGEATYTFEGVSKAPTPSLMRGFSAPVKWDAALDREALAFLWANDNDPFNRWESGQILAVETILDMVGLTQQNGELPDLPESFAHAFETIIKDGKSEPALLALSLSLPTTGYIMDRMDKADPHLVYRVRQHVRQAVASRFRPLFLSLYGRHYSDEPYHYSPANAGARALKNLALDYLLENPEPTVLALAHKQFHQADNITDWLGAYGPLLRCGSPSSSELTHILYTRCKDSANALDKWFSTQVTMVAGPEALSLAKALTQHPDFSWSTPNKVRAVVGSFSGANPTAFHAIDGSGYGFLQEVIAQLDEKNPQLAARLCTYFTRWRRMVPELSQPMQNALQRLLDTPNLSNDTYEIVSKSL

SEQ ID NO: 10002 - protein, 311 aa, magnetite-containing magnetic coccus
MGKVAFLFPGQGSQAVGMGQALHGADASCAALFEEANTVLGEDLRGLMFDGPEADLTLTRNTQPALVVTAMAAYTLLRQQSDLQADFVAGHSLGEYAAICAEGGLSFADAIRLTRMRGDAMQKAVPVEVGAMAAMLNMEAALVEEVCQAASQALGQVCVPANYNTPAQIVISGDKAAVEHAVALAKEPGAKRCVMLSVSAPFHCPLMQPAADAMAQALAQTPMQDLSIPLVANVNAGITTDAETVRQQLVAQVCGSVRWEASIRAMIAQGVDRFVEIGTGKVLTGMLKRIDGSVRGVAVNGPEDMAALAEL

SEQ ID NO: 10003 - protein, 245 aa, magnetite-containing magnetic coccus
SMQNRVAIVTGSTAGIGQEAAKLLAKRGCRVVITGTRETKIMETVEAIRAEGGVAAGVAANIGVDADLDKLVAFAQEQFGEVEILVNNAGITRDNLFMRMKDEEWDEVMALNLTSVFKLSKRVIRAMMKGRYGRIVNVTSVVGFSGNAGQANYTAAKAGLVGFTKSLAQEVATRGITVNGVAPGFIQTAMTDKLNEKTQEAILAQIPMGKMGSVEDIAAAIAFLASDEARYITGETIHVNGGMYM

SEQ ID NO: 10004 - protein, 76 aa, magnetite-containing magnetic coccus
MSDIAERVKKIVAEQMGVDLDKVTDDAKFVEDLGADSLDNVELVMAFEEEFGCEIPDETAEKITSVSDAIKYIGEN

SEQ ID NO: 10005 - protein, 409 aa, magnetite-containing magnetic coccus
RVVITGVGLVTPLGVGNDVTWSRLIAGESGIGLLTSFDTEEYSCKIGGEIKDFNPEQWIEKKEVKKMDRFIHYGLAASQLAWEDSGLEAPDEEASYRYGAIVGSGIGGLIAIQNQAIALKEKGPRRISPFFIPMSLINLVSGQLAIKYGLRGPNHAVVTACATGTHAIGDAYRIVQRGEADVMVAGGAEAAICELGIGGFAAARALSTRNDDPTRASRPWDKGRDGFVQSDGAGVVVVESMEHAKARGARIYAEVVGYGMSGDAYHITAPHPSGDGAARCMAAALKDAQMDPSGIGYINAHGTSTPQGDVIETKAVKKIFGESGAKKVMVSSTKSMTGHLLGAAGGIEAIFTAKALHEGVIPPTINLDDPDPECDLDFVPHTARQEQVEAALSNSFGFGGTNATLVLKR

SEQ ID NO: 10006 - protein, 145 aa, magnetite-containing magnetic coccus
YGRVCASEVDFIPVRARTGLLFQDADDQLFSPTVAEDIAFGPLNLGKSPQQAAAIVEEVLAQLQMSGYETRITHHLSGGEKRMVALATVLAMQPDVLLLDEPTNALDEAAEARLVALLQGLPQALVVISHDRRFLAQVTQRRVVL

SEQ ID NO: 10007 - protein, 375 aa, magnetite-containing magnetic coccus
YDVAVVGGGIHGAGVAQIAAHAGWSCVVLEQAHVAAGTSSRSSKLIHGGLRYLQQMQFGLVRECLQERTRLLHVAPQLVRLIPFYLPVYQHASRPPWMIRAGLTLYAMLAGRNPGGHYERLPQSQWDTLGGLRQSGLKQLFCYYDAQTDDRALTVAVMASAQSYGAQLWCATTLQQLHRLPQGYRLSGQRGAVTFTIQARVVVNVAGPWIGTVAAKCQPPLELPPFAQVQGAHLSLPNWHPPGAFTLQSPLDGRVFFVLPWQGGALLGSTETPFDGDPAQAACTPQEQAYLLESAHPFFPQADMTVGASFAGIRVLPKGDANRASREALLPVDDPTKPRLVTLIGGKLTSYHPTARAIIKRLQGALPPANTAGDP

SEQ ID NO: 10008 - protein, 576 aa, magnetite-containing magnetic coccus
  unsure (1)..(576): unsure at all Xaa locations
LEAAKRSAETASKAKSRFLSTMSHEIRTPMTAILGVAELMSGTHLDRVQREHVSIIRRSGDALLELIDDILVISQNEGAQEGEKQVVFDVDHLLESVMDMASYRATEKGIKLLSHVAALVPVRVMGDPVRLRQVLINLVGNAIKFSEKGEVVIQVRPGPRNGPERSDYRFSVSDNGIGIPMEKREAIFDAFSQVDETESRRFGGTGLGLTICRRLVNLMGGQLELLFSEPGVGSTFAFDIPLQPAMEQANPANLEYDHTTLKERRVVVFSRGKNLRTMVQEMLTPEGVHCTAVSNHDELVQLMEVVHDVERDGQGPLCDMLLLDAEKPFANMDVVSYASELKKRKIFRNLHFVILGLDPGQKERFALCQAGINYVSPPLKRRVILKTLAELFVEPGYRHLDDACRNLMHATHKRELKEGGALRILLAEDDPDSSYVIQNFLKDTLCHLEVVTDGQQALQRFQEGMTDPLGAAMEFDLVIMDTQMPVMDGYTAVHRIRSWERIQQRAPVKILAISAHSGQEGRLTSLRNGCDDHLNKPLTQRDLARPHXRTVSPSAKNRLIKRSSPPSLASLGFVYP

SEQ ID NO: 10009 - protein, 252 aa, magnetite-containing magnetic coccus
IPLEVTPLPAWEDNYIWCFPTEPGAVAVVDPGQAEPVTDYLQQHGLRLSHILLTHHHGDHIDGVAPLQRKHHARVLGSALDAHRLPPLDEALRGGQTFCLGPHQVDTYHTPGHTSGHLCYHIADCLFAGDTLFSYGCGRLFEGTPQQMWQSLLILRALPETTRLCCAHEYTLTNLRFARSLPGQQEPLAAPWQRAQQTRQLGKPTLPSRLAEEKQYNPFLRCDDTQFRTAVGQQAASAEACFAYIRQLRNHF

SEQ ID NO: 10010 - protein, 234 aa, magnetite-containing magnetic coccus
ERVALVTGGSSQLGQAIVQALMEQNYRVALVCFESDATAMIQRYPMQEAKIQSFTCDLRNPEAIETLVGQVVRHFGQLDVVVHNAARFEPDHEENPSWQSLENLFKVNVMGPLWLSLKAAPWMRSGPAGGGHIIQIGDIWGERPLLGYSGYSSSKAALHMAGRSLARELAPEIRVNTIAPGAVFPQGEDDRAYQVLLSNTPLAAEAGPLGVITALNYLLATPFVTGQVLHVDGG

SEQ ID NO: 10011 - protein, 196 aa, magnetite-containing magnetic coccus
VLVTKQAPDFNATAVMADNSFQEISMSDYKGQYVVLFFYPLDFTFVCPSELIAFDHRLGEFEKRNVQVLGCSIDSHFSHLAWKNTEINNGGIGQVKYPLIADLNKQIARDYDVLFNDAIALRGSFLIDKEGKVRHQVVNDLPLGRNIDEMLRMIDALQFTEAHGEVCPAGWKSGDAGMQGSTEGVAKYLAANADKL

SEQ ID NO: 10012 - protein, 424 aa, magnetite-containing magnetic coccus
  unsure (1)..(424): unsure at all Xaa locations
ANRAKSTFLATMSHEIRTPLNTILGMGQLLEETDLTEMQHWCVNILGNSGRALLTLINDILDLSKIEEGHLSLEHTPFDLHQLLQEVEELFTFSALAKGITLRGHFSESLPQWVMGDPTRLRQVLLNLLGNAIKFTKQGFVELSAQTMAEDEICFSVFDSGPGIAKERQQEIFLPFTQADSSTTRKYGGSGLGLTISRRLVKLMHGQIQLESRLGKGSRFYFSLNLPQAPTERIPPPSLPATTVVHSSPQRALTILVADDSDDNRILIEAFLKKSPYKLVMASNGLEALEEFKKQPFDLVLTDIQMPIMDGYEAIRQIRQWESSQKMTTRTPIIALTAHVMKEEAEQIEQAGGDLHLSKPIQKKRLLEVIQTLTHDNRLSVRXSISHLARHLAGXASCSEIDSXPVKKEANLCPNKPRRXVNVL

SEQ ID NO: 10013 - protein, 722 aa, magnetite-containing magnetic coccus
QLGQGKVTVTPIHYPHADEMGRMIDSTQRLMQSMQALTDQANAIALGNYAQRVKILSQYDVLGNAINNMSFALQLNEQQQRQREWHNENLNRLTHDLSGDLTPETLAQQAITLIGEAIQAGRGGLYIYDDQTQPHKPLLLVGRYMFTQHDEGQQRFSMNEGTVGQAAAQKKPILLECLTPPADQLSSGVANFSARNSYTLPLLYEDRLQGVLEVATLNPLNTQHRQFLDAACQIIAATLFTSLQRERIANLLVLSKAATQRAEAQSHQLQLANAQLEEQQQQLQQQTEELQQSNTQMEHQQQLLQQQAEELRINNEALQHSQHELNQRAIQLEEASQFKSDFLANMSHELRTPLNAIILISNLMSRDETGRLDQESIERTRVIYNAGNDLLRLINDILDLSKVEAGRMEVHLETVHSQELVEELEPLFRDSAQEKKIELRFDDQLQGCFTSDHQKVVQILRNLLSNAIKFTAQGSVILRLAKSDHPQYPIRLSVTDTGIGISKDKMPYIFEAFRQMDGSISRQYGGTGLGLAITHRFATLLKGEVELHSEEGKGSQFTLLLPLAHPHENTEHGQTEPNAPLSETNGPTAEPTLMPPLPSRFLLKGRPKILVIDDDLLFVENISYINQAQGLDTLSAHDGREGLRVAKSHHPVGIILDLGLPDMRGEEVLEQLKRSPELRHIPVYIISAKDKQRALVDQGAIGFLQKPVNDAQIATAQRTLLQ

SEQ ID NO: 10014 - protein, 547 aa, magnetite-containing magnetic coccus
MAAKEVKFGEAARAKMLNGVNILANAVKVTLGPKGRNVVLDKSWGAPRMTKDGVSVAKEIELEDKFENMGAQMVREVSSKTADVAGDGTTTATVLAQAIIREGMKAVAAGMNPMDLKRGIDLAVEAVVVGLKGISREVANSQEIAQVGAISANSDKVVGDMIAEAMDKVGKEGVITVEEAKGLETTLDVVEGMQFDRGYLSPYFVTNADKMLVQMENPLILLVEKKISNLQQILQILEGAVQSSRPLMIIAEDVEGEALATLVVNKLRGGLKVCAVKAPGFGDRRKAMMEDIATLTGGVLVSEDVGVKLENVTMDMLGMAKSIVVTKEDTTIIDGAGDHEAIKARVNQIRAQIEETSSDYDREKLQERLAKLAGGVAVIKVGGATEVEVKERKDRVDDALHATRAAVEEGIVPGGGVALLRAREASLTNLQGANHDQQVGINIVTRALEEPLRIIASNAGAEGSVVVNRVVETKETNFGFNAATGVYEDLVASGVIDPAKVVRHALQAAASVAGLMITTEAMVAELPKDEPAMPGGDMGGMGGMGGM

SEQ ID NO: 10015 - protein, 96 aa, magnetite-containing magnetic coccus
SINFRPLHDRVVVKRTESDAKTAGGIIIPDTAKEKPVQGEVLAVGSGVVNDAGNVRPLEVKVGDKVLFSKYGGTEVRIDGEELLIMRESDIVGILG

SEQ ID NO: 10016 - protein, 289 aa, magnetite-containing magnetic coccus
KGIVLAGGSGTRLHPVTIPISKQLLPIYDKPMIYYPLTTLMLAGIRDILIISTPQDTPRFEQLLGDGSNWGVSLSYAVQPSPDGLAQAFIIAEDFLDRQPCTMILGDNIFFGHDLSQVLQRVALRQQGATVFAYAVSDPERYGVVHFDSQGRALGIEEKPAKPKSRYAVTGLYCYDQHVVEYARALRPSPRGELEITDLNNRYLAEGSLSVERLGRGYAWLDTGTHDSLLRAATFVETLDKRQGVKIACPEEVSFRMGWIDQAQLRALAQPYLKNGYGQYLLRVCEEPD

SEQ ID NO: 10017 - protein, 340 aa, magnetite-containing magnetic coccus
KVLVTGGAGFIGSELVRQLVTQAECSVVMVDLLTYSGNLASLAPVAARPNYRFVQADICDRGAMSQLFVQEQPDAVVHLAAESHVDRSIDGPLTFVQTNVMGTAVLLESARAYWVQTAPAKQQTFRFLHVSTDEVYGALGEQGLFTEQTPYAPSSPYSASKAASDHLVRAWYTTYGLPTLITNCSNNYGPYQFPEKLIPLMILNALAGKPLPVYGQGSNVRDWLYVADHARALRQVLAQGQVGQTYNIGGGAERSNLTVVQTLCTLLDELQPREKPYASLIAFVQDRPGHDFRYAIDASKISEQLGWQPTVSFEQGLRETVKWYLQHPQWVEQIRGVAEQ

SEQ ID NO: 10018 - protein, 396 aa, magnetite-containing magnetic coccus
ELPAIAGFRAAATACGIKKNETLDLTLVAMQAGTSVAGVYTKNRIVSPTVTLCRDRLKEREARALLVNSGNANVSNGPQGMLDALSNGKTVADQLGVEDRQVFISSTGVIGAALPVHKINAAIPGLVENLQPGNWLQAARGIMTTDTFAKVAVRHSQIDGTPITMVGMAKGSGMIHPNMATMLAYLFTDAAVSSELLQTLLNRAVQLSFNSITVDGDCSTNDTLMLFASGAAPHTPLADEDDPRLAPFAEMLNDLAMELAQWIVRDGEGASKFVTVQVRGAQDETAARQVAMKVATSSLVKTAFAGSDPNWGRICMAVGSAGIAIEEDLIDIFLGDVQIVNRGQRDAAYTEEQGQAVMNEAEIGITIDLNQGEAQATIWTCDLTHDYVSINADYRS

SEQ ID NO: 10019 - protein, 719 aa, magnetite-containing magnetic coccus
LDPQQIQELQSGFSADPFAVLGRHDQPDGQVAVTVLSPRTERLFLTNIGQEMTRIPDSDLFHWCGDGRALPYHYRLRRVDAHGSQTEFHDPYSMPPMIGDLDRHLFNEGTHHHAGQFLGAHRMEVEGIRGVCFAVWAPNAQRVSVVGDFNQWDGRIHPMRLHQDSGIWEIFIPALKRGEHYKYEIRTTNGALLLKSDPYGHAHQLRPENASIITEPSNYPWHDEVWMRARSRFNWQKKPISIYEVHLGSWLDAATDPFPNYRELGKRLARYCSEMGFTHVELMPINEHPFDGSWGYQSTGYFAVTSRFGDGDDFRAMVDQLHGANIGVILDWVPAHFPKDAHGLGQFDGTALYEHQDPRLGEHQDWDTLIFNFGRLEVKSFLISSALHMLTRYHLDGLRVDAVASMLYLDYSREDWLPNKYGGRENLEAITFLRELNQAVHHDCPGVLMIAEESTAWPQVTRPPELGGLGFNMKWNMGWMNDTLSYFSKDPIHRKYHHDNLTFSLYYAFSENFTLPFSHDEVVHGKASMLGKMPGDEWQRFANLRLLYTYMFTHPGKKLLFMGCEFGQSQEWNFSQALPWELLEHTFHKGLQQLVKDLNLLYCKETALHERDFTPDGFQWIDCHDSDQSIISFQRKSSEGEVVVLLNFTPIPRDNYRIGVPRPGLYKEIFNADSGHYGGSNYGNGMSQLLTEPYPWMNQLQSLVLNVPPMAGIILRCEQ

SEQ ID NO: 10020 - protein, 411 aa, magnetite-containing magnetic coccus
SMKLGINGMGRIGKLTLWQHIAKQSFDEIVVNVGRDVGRGLEDLAQVIRKDSTYGSLASYLYGFRGGEPITAIDNDAGTMLIHGVPVTFLRRARNPKDIPWGEHGVGLVVDCTGAFVDPTVPADDPRGALRGHLEAGAEKVLLSAPFKIKNKELSMPEDAITCVMGINNEQYDPSQHRLISAASCTTTCLSYMMKPMLEHFGVQRILSASMVTIHAATSSQMVLDAVPKAGATDLRKNRAVMNNIILTTTGAAKALAEVIPQVAEIGFMAESVRIPTNSGSLVILTLNLQSEAEGEPINRQAVNAIYREASQGLYRDHLVFSEAQNVSSDIIGFPKAATVIESRETHTRTAYSHVDLSRLPGLSSEIKAQLQVTRLDVPVTQAVVYGWYDNEFGSYTNMLGNLTEHVGQQL

SEQ ID NO: 10021 - protein, 496 aa, magnetite-containing magnetic coccus
LGNKGYNLARLVVNGAPVPAGTILTTEFFRCHRLIHDHPPAWQDFMARLRAEMAALEQQTGLGFADPQRPLLVSVRSGALISMPGMMQTIHNVGINETIVAGLSQQSGNAFFAWDTYRRFIQSWCMAHDVERGVFSDIMRSFKQQYGVKKKGQFSAEQMRQLAFAYRDAARGLAITLPEEPWQQLLAAIELVLASWHGEKAHHYRAIMDLSDAWGTAVVIQKMIYGNLLQSMITEETDGAACPRVLSGTGVLFTAHPYRKLTQVMLWGDYTPGNQGEDIVGGLVSTWPISMEQCYSDHRDPQQALEHRFPLIYQGLLELAKTLIYTRDWNHQEIEFTFDGPTVEHLHILQTRNMITRESLHSVVSGFKLHGSLKEHLIGQGIGVHGGALCGRAAFNLEQIETLRQTYPSDPLILIRYDTVSDDIKEISQSQGLLTARGGQTSHAAIVAASLQKTCVVGCESMRVWELQGYCKLDGVTVKLGDAIAIDGHNGHVLRG

SEQ ID NO: 10022 - protein, 466 aa, magnetite-containing magnetic coccus
SDTFDLVVIGGGPGGYVAAIRAAQLGLKTACIDKRPTLGGTCLNVGCIPSKALLQSSHQLETAQHAMAAHGVEIKGVKANLTTMMQRKQEVVQGLTQGIAFLFKKNKVTHLMGSGTIVDSSHVQVTAADGSVQTLTTENILIASGSEVATLPGLEIDEKHIISSTGALALDKVPKKMVVIGAGVIGLELGSVWRRLGAEVTVVEFLDGILPGMDGEIRKTAQRTLSKQGMHFKLGTKVTAASVLKNGVKLTMEPVKGGEAEERQADVVLVAVGRRPYTQGLGLENIGVTLDERGFIPVDHDRQTTCAGVFAIGDVIGGAMLAHKAEEEGSAVAEALAGQVAHVNYDAIPAVVYTHPEIASVGQSEESLTAAGIPYKVGKFPFMANSRARAIGDAEGFVKILAHATSDAILGAHIIGPAAGDLIAEIVLAMECDISAEDIARTCHAHPGLGEAVKEAALAVDKRAIH

SEQ ID NO: 10023 - protein, 443 aa, magnetite-containing magnetic coccus
TEIKVPTLGESVTEATVVQWLKQVGDAVAVDEPLVELETDKVTVEMPSPVAGVITEIYAGVDADVEVGAVLCVVDAQGSARVAVPAKPAAEPAPAPAVATAATPAPAVATPAPTVPVAPPSGGAALSPAVRKLLAEHGLDATQIPATGSGGRLTKGDVLAYLEQPKPAPTAAPTPAPTAAPTPAPTPTPAPAPMATPALAPAAQLPPAVEGPREERVKMSRLRQRIAQRLKEAQNTAAMLTTFNEVDMTAVMALRSQYKEVFEKRNHARLGFMSFFVKAAISALQEFPAVNAEIQGNEIVFKNYYDIGVAVGSPQGLVVPVLRGADAMSLAGIESTIAGMGKRARDGQLSMEEMSGGTFTITNGGIFGSLLSTPILNTPQSAILGMHKIQQRAMVMPDGSIQARPMMYLALSYDHRIVDGKEAVSFLVRIKDCIEDPARILLN

SEQ ID NO: 10024 - protein, 956 aa, magnetite-containing magnetic coccus
LDALLNGTNALYISELYARYLDNPHAVDATWATTFGELTEDETPEIFKEIRGASWSKLESGILGKPLERDPDSQTRHAHFVQGVTQVAGTEPEQIRRATLDAIRALMMIRTYRVRGHLIANFDPLGLEAREHHPELDPANYGFAEEDMDRPIFIDYVLGLETATLRQIVRLLKETYCGTIGVEFMHIQEPEEKAWVQRRIESIRNRTHFTLKGKRTILQRLSESEGFETFLQLKYTGTKRFGLDGGESLIPAIEQILKRGTQLGLKEVVIGMAHRGRLNVLANIMRKPYAAIMHEFQGGSNKPDDVQGSGDVRYHLGASADRVFDDKKVHLSLTANPSHLELVNPVVLGKVRAKQLQRGDTSQQQVMGLIMHGDAAFAGQGLVPESLALSGLKGYQTGGTIHLIVNNQIGFTTNPRNSRSSPYPSDVAKMIQAPIFHVNGDDPEAVVHAARIAIEYRQAFSKDVVIDMWCYRRHGHNEGDEPSFTQPIMYRAIANHPTTRQVYAQKLEREGVLKEGEGEQIYKEFHNELETSFQEAQYFLPTSADWLDGMWKGVSNLRGEEEMHQHKTCVPERTLREVGKALYTPPQDFAVHRKIIRQLRSKEQMFESGEGFDWATGEALAFGTLLVEGIPVRLSGQDCGRGTFSQRHSVLIDQNDESRYEPLNHIRSLQADYEVIDSPLAEASVLGFEYGYASADPHALVLWEAQFGDFVNGAQMIIDQFISSGESKWLRLNGMVMLLPHGFEGQGPEHSSARPERFLQLCAEDNLQVCNLTTPANYFHALRRQNHRNFRKPLVIFTPKSLLRHKLCVSKLEAFISGSSFQRVYDEVDTLVADEAVKRVVLCSGKVYYELLQTRREQGSNDVAIVRIEQLYPWPRNALFKVLQRYANAEIVWCQEEPANMGYWSFLFQRLIHLLEDLQSKQRLPIYAGRGASASPASGLASKHLQEQTHLVHEAL

SEQ ID NO: 10025 - protein, 545 aa, magnetite-containing magnetic coccus
IKEDISQMKEDQERLAHAKESADLANRAKSSFLANMSHEIRTPINAIVGMCHLAQRMTVEPKLRDYLGHIQVAADTLLGIINDILDVSKIEAGKLHFEDIPFKLDELISRVMRLQGLKAQDKNVELVIDLEPQVPQTVVGDPLRISQILTNLVNNAVKFTEQGEVVLSVKLQGVFDGRVTLYFEVRDSGIGMEDAQLQRLFTPFQQGDDSMTRRYGGTGLGLSICQNLVKMMGGHLQVESRLSEGSRFYFTVSLPIHQAPALERVDQTSLNLRVLVVDDNQTVREVLQRMLKSFGYWVDLAAEGPTGVALVESALQQGQPYDLILMDWHMPQMDGLQASEQIRHLQGVRAQRTPVMIMAAAYGQEDSHTAVSEPGFAGFLEKPTTPANLFGAIMIGLHGAPQEAPSGDAGWGYTVPDLSGYRVLLVEDHPINQALAREMLSLAKLQVITADHGQHALDLLQEASVDLIFMDIQMPVMDGFSATQAIRADPRWQHIPIIAMTAHAMADDRQKCLDGGMNDHLGKPIDPPLLFAKITQWLGPQQRGR

SEQ ID NO: 10026 - protein, 259 aa, magnetite-containing magnetic coccus
QYPPLWSARPIEEQVEPPLVKLPIESYEAEIFSPPTPLPQSAVALDKGEPFNTNGPISLKPLVTKVDPSFHDQVMPPVVNPVERPHPTPAPVNALPSSASLPAPVNALPSSASLPAPVNDLPSSASLPAPVNALPSSASLPAPVNALPSGGQPAAPIRIMVQPNQGLPHPLTMRQQPIERVASVKPVVRPTAIEQASKKSVEMPELPPIKRVEMEQEPIWPASLVEHKRVPEPKHRSTYRAITAKAVPRPHGITPPYGK

SEQ ID NO: 10027 - protein, 421 aa, magnetite-containing magnetic coccus
LETLAIHGGFSPDPTTKAVAVPIYQTTSYAFDNTQHGADLFDLKVPGNIYTRIMNPTTDVLEKRVAAMEGGIAALAFASGMAAITAAIQTICRCGDNIVSVSELYGGSYNLFAHTLPQQGIEVRMAKSDDFAAIAAHVDDKTRAIFCESIGNPAGNVADISRLAEIAHSAGVPLIVDNTVPTPCLCRPIEFGADIVIHALTKFMGGHGTSIGGIVVDSGKFPWAEHGERFPMMVTPDASYHGVVYTEAFGAAAYIGRCRVVPLRNMGAAISPFNAFQILQGIETLPLRMERHCENTERVASYLSSHPQVSWVRYAALPDSPARSLADQYMGGKASSILCFGIKGGREAGAKFIDALQLIVRLVNIGDAKSLACHPATTTHRQLNDAELVNAGVSADLIRLAIGIEHIDDILADVSQALEAA

SEQ ID NO: 10028 - protein, 407 aa, magnetite-containing magnetic coccus
AVEGLAHDVTERHRAEFELLTAKEQAEAANRTKSEFLAMMSHEIRTPMNSILGMAELLSESPLTPEQQGYLKIQRRAGHGLLELINDILDLSKLEAGRIELYIQPFNLPELLQSVVDLLENLARERGLALRLERMEEIPTLCQGDRARLRQIMVNLVGNAIKFTHDGSVKISVEKSSDDATNLLFHVIDSGIGIAEKDQSSVFQRFTQIDSSNSRFYGGSGLGLAITHHLVELMGGKIWLKSALGEGSCFTFTLPLPPVQIDEPALAATHDEEAPMVATESCCATKPLRILLAEDSPDNELLIRIFLRDSPHSLCCVKNGLEAYQQVQKENFDLILMDIQMPVMGGDEAIIKIRAWEQSQQCDPTIIIALTAHAMSEHQKHYLTLGFDAFLSKPINKKTLLNALAQY

SEQ ID NO: 10029 - protein, 192 aa, magnetite-containing magnetic coccus
ATESRTTGETKIQVTLNLDGSGKAQVDTGVGFLDHMLDQIARHGGMDLEIEACGDQHIDDHHTVEDVGITMGQAFRQAIGDRRGITRFGHAYVPLDEALSRVVVDLSNRPSLSWRVKFPTQKVGNFDTELFKEWFAAFAQQGGITMHVESLYGENSHHIAESCFKALARALRSACAVDATLGGVAPSTKGTL

SEQ ID NO: 10030 - protein, 891 aa, magnetite-containing magnetic coccus
VSIADATGNITYVNEKFCLVSGYAESELLGNNHRVLSSGHHGATFFQEMWHTIEQGNVWHGELKNRAKEGGFFWVASTIVPFLDSQGKPYQYISIRTDITQRKRVEEQHEKQKIFLQGITDAMGEGLFAVDREGACIFINKQAERMLGWSAEEIHLKKMQGLIHASTRIADAYQWPALRSMDEAAPARSEDEHFINRSGQMFPVSMVAVPLEEGERIVGSVVVFQDISVRKQQEQVLQGAVRAADQANRAKSDFLANMSHEIRTPMNAILGMSHLAIRTSNDPRQRAYLQKIHGAAQSLLHIINDILDFAKVEAGKMEMEMVPFNLDEVLDTLATLTSVKADEKGLALIFRRHLDLPQRVVGDALRLNQILLNLTGNAVKFTEQGSVVVNVEKVQQQGDQIVLRFSVQDTGIGMDESQIQQLFVAFEQADSSITRRYGGRGLGLAICKQLVNLMAGELSVQSTPEVGSCFTFTVPFTVVQEQVVDAIVPQGIRGRVVLLADGSALARRVVAEMLKHMGCDVLEAEQVEQLLTALQAKIGPDMVLLDSSMVDAQGAHAYAAIRQADAGGACPVLVMHTHGDREQVLAWMAKDKQLGHVQKPLTPSRLLEGMVQLLVDEGRVTGLSGETDVIARYKPLLTGANILLVEDNGVNQEVAFELLSMVGVEVTVADNGSQALSFLEQASFDLVLMDIQMPVMDGYAATQAIRQNMSLTLPIIAMTATVMEADQARALAVGMNGHVSKPIEPHKLYEMLLRWLPSKGEPSRAVARLRLPGDETEPDVTLPEQLPGINIPLGVQRLVGNKSLYLTLLQRFYQDQKEIMVQIREGLARKDFNTCMMQAHTLKGVAVSLGALPLAACAGVLETACKQRDERATTQALIPLAQSLSEVMAGL

SEQ ID NO: 10031 - protein, 268 aa, magnetite-containing magnetic coccus
SQPPIAFLGGGNMASAIIAGLHKVGYPAAKLRVGEPNATQREALIRQFAIQGHAHNPDAVAEAAFVVVAVKPNLVAQVLRDVAPQLAPTAVVLSIAAGVDLTTMAAALPAGQPIIRAMPNTPALVGQGMTVLCPNGHVDAEQLAQAQRLLESVGQVAVVKQESLMDGVTALSGSGPAYLFLIAEALSDGGVACGLPRALADQLAVQTLLGSATLLRESGEHPGVLKNRVTSPGGTTIAGLGVLERQGVRGALMAAVEAAWNRSKALGQ

SEQ ID NO: 10032 - protein, 302 aa, magnetite-containing magnetic coccus
  unsure (1)..(302): unsure at all Xaa locations
VITRFAPSPTGYLHLGHAYSAWCAFDFAQRHGGRFLLRIEDIDTVRCRPEYTEAIFADLAWLGFYWPEPVRQQSQHMVTYGDALVQLQDLGLLYPCFCTRKSIQQEIANANRAPHGPDGPLYPGRCRALSMAERMERLHEGQSHALRLDVGRALELLGGVPLHWVDGEQGVEITATPEIFGDVVLARKESPTSYHLAVTLDDHVQGISHVVRGEDLRQATHLHRLLQALLGLRTPIYHHHPLLTDEQGKRYAKRDKSLTLRALRAEGVSAEAIMQRVRSGATLLAXPMFNSLLXKILKYRIL

SEQ ID NO: 10033 - protein, 386 aa, magnetite-containing magnetic coccus
LTRLDAVHEGTILSTCNRVEIYMASRDPDAAAGQTSQWIARDHALDPADVTPHLYTKAESEAVRHGFCVASSLDSMVLGEAQILGQMKQAYQDALSAGSTGVVLNRFFQHAFLTAKRVRTETSIAENSVSVASAAVDLAKRIFGDLSGHSCLLIGAGEMCELAARHLVTHGVKEVLVTNRTFSRAVDLAQQFDGHAFPIEALAENLHRADIVISSTGSTVYMVGPDMVKQALKSRRQRPIFLIDIAVPRDLDPEIGQVDSAFLYDMDDLNKIVNDNRQDRAEAAQAAMQIIEGETPLFIQWLDTLDVVPTIKQMRRKAEAAKDQLLQKHLAGWDLSDTDRQRVENLARQLVNKLMHDPTERLRSLTNEHDGDRYIDAARKLYKLDD

SEQ ID NO: 10034 - protein, 323 aa, magnetite-containing magnetic coccus
ADPIRVAVTGAAGQIAYSLLVRLASGQLFGKDRKVELKLLEIPQAMGPLEGVMMELQDCAFPTLAKVEAFDNPEQAFDGINWCLMVGSRPRGPGMERSDLIKINGPIFVNQGKALNRAAQDVRAVVVGNPCNTNCMIAAHNSDVPHERFSAMMRLDQNRAKYLLASKAGAQVIDVTNVVIWGNHSNNQVPDFEFAKIGGKPVPEVIADAAWLENAFMPTVQNRGAAVIKARGASSAASAANAALDHVRSLITPTPAGDTFCAAVMANGAYGVDAGLIAGMPLTSTGHGDWSIVEGVPMSPFIKGKFDAVLDELRREREMVKDL

SEQ ID NO: 10035 - protein, 246 aa, magnetite-containing magnetic coccus
MDTTGCRALVTGAGRRIGAAIALALGEAGMDVAVHYSGSAQGAEQSCAALAKMGRRACAFQADLSDWAQAEALLPRVVAQMGPVRVLVNSAAIFERSDLVDQSQAQWRRHMAINLEAPMLLMQHFARQWQSDQPPDGAGRIVNILDRRVLAPPPGHLAYNAAKGALWSLTRVAARELAPHITVNGVGPGPILPAAGEPLEQFAKVIAATPMQRSGTPQEVADAVLYFIQNGFVTGQMICIDGGEHL

SEQ ID NO: 10036 - protein, 373 aa, magnetite-containing magnetic coccus
QAKQSAERANRAKSEFLATLSHEIRTPLNGMIGLLTALQASRLDAKQQEQVGLISRSSNLLLDLLNDILDFSKIEAGELVLEQIPFSPLQLVEDVCACLSERAQGKGVGLRLETHGWIPPGLKGDAVRIRQIMLNLTNNAIKFTQQGEVVLHLWGLEQQPVPLPSWVSMRFGVVDSGVGIAAKDMGRIFDPFCQADRVLDRRYKGTGLGLSICKRLVEAMGGEIWAESQEGQGSSFRFTLTLALVEHLPGQAMGRELVHEVLPMRILLVEDDPVNQMVAVELLESAGHKVEVADNGASGLVKAQECSYDLVLMDIRMPGMDGITATRMLRAFEQAEGRERVPVLGLTADTLKETLLACREAGMDDVLTKPVRV

SEQ ID NO: 10037 - protein, 460 aa, magnetite-containing magnetic coccus
PSHMFREYDVRGIAHSELSEEVVKHWGALFAERIRDAYKGKKFMPHVVVGRDGRLSSPALANALMAGLAEAGARVSDVGLLPTPGLYYASHALHADGAIMVTGSHNPAEYNGMKMMLGGLSFFGQDIQDLAQRLMLGERPMPRMGGSVSRVELRRDYINRLVADYRPGRPLKVVLDCGNGAAGAVAKELLQALPGIEGEVLFAEVDGTFPNHHPDPTVPANLEDLKNRVLAWGADLGIAFDGDGDRIGAIDGDGRVIWGDRLMILFAREILAEHPGASILGDVKCSQQLFDAVAEAGGKPIMWKTGHSLVKSKMRQSGALLAGEMSGHLFFADRYYGYDDALYAAVRLISLLAAEPTSLAARLSSLPKVYATPELRIECADSRKFRVMDRIKRQVLDGGLGEVSDLDGVRVKQPGGWWLVRVSNTQPALVARVEADSLERLQEMATALAKMLEGENVVFP

SEQ ID NO: 10038 - protein, 438 aa, magnetite-containing magnetic coccus
MRITMIGTGYVGLVSGACFSEFGVDVTCVDKDVSKIERLNKGEIPIFEPGLDQLVVRNKDAGRLHFTTDTNTAVANSDVVFIAVGTPERRGDGAADLRYVFDAARDVARAMQGFTVVVTKSTVPVGTGARVAEIIRETKPDADFAMASNPEFLREGSAIEDFMRPDRVVVGVDSDRPVALLKELYRPLYLIETPILFTNIATAELTKYAGNAFLATKIMFINQIANLCEKVGADVHDVAKGMGLDRRIGRKFLHPGPGYGGSCFPKDTAALANTARDHNTPMTIVENVIEANKWQKQRMITKIRDAMQGKLRGKTIGVLGLTFKPNTDDMRDSSSLTILPALAGDGARIQAFDPEGMHEAKRMMPELHYCDDAYSACQGADAVVILTEWNQFRNLDLDRIKAGMQTDSEGLYPFFDLRNIYVPADMRAQGFAYVGVGR

SEQ ID NO: 10039 - protein, 276 aa, magnetite-containing magnetic coccus
MMKVRKAVFPVAGLGTRFLPATKVVPKEMLSVVDTPLIQYAVEEAWDAGIEEVILITGRGKSLLMDQFDHMYELEDTLRRQGKEVLLSVSHEPIPFPGTVVATRQQDPLGLGHAVWCARYLVGDEPFAVILPDDLVHAQKPVLKQMVERFEELQSSIVAVMEVAPDQTNKYGILDSEPEQNGVWRIKGLVEKPDPSVSPSNLAIIGRYILTPEIFCLLESIPRGAGGEIQLTDAMAALLKHQSIYGMRFEGTRFDCGDKAGFQMASLALSMERPEL

SEQ ID NO: 10040 - protein, 593 aa, magnetite-containing magnetic coccus
IRHLLPHYQRYRRAFVWGFLLLIATNASAALIPYLMKLAIDTLQRGEGMTDVKTYALLLALLAVLTALLRIRARTHVFRIGREVERDMRNLYHAQLQDLEAPLFDHARTGDLVSRGIGDITALRMFMGPGFLQLTNASLVYILVLPAMLWLNPWLTLMALLPLPFVVIAARQLTKRLYRYSRMVADRFGGLTAFVQESVAGMGVIRTYAREDAWNQRFYEETDKLYATQQDHARLQGMFQPLMLFSGGLGAWIILAVGGPGVVQGNLTVGDFVAFTGYLTLMIQPTVALGWILTVMQRGLAAIDRLSEVLDITPSNADHPQQALHPEPTTPYAIEIRHLNFFYQQDRRIAPRSKEAAPSHAVTTAAGDGTEPAAVQTLHDITLTVPHGHFVGLAGRIGSGKSTLLRCLSRTYPIPQGSLFLDGVDLAHVPEAQLRQHLTMTPQESLLFSRPLLENLLYGQPDEDEACAWEAARNAAFDEEVEGMPQGMETLIGERGITLSGGQRQRAALARALVVNPRILLLDDIFSSVDARTEAHILNALLDRPDRPTMVMVCQRVAALHRADTIYLMDQGRICETGNHQSLMQSSSLYQAL

SEQ ID NO: 10041 - protein, 579 aa, magnetite-containing magnetic coccus
TRYGAFLDLHLLRRFFRYAKPHTRWVLLALAILPLNTLIQLGQPLLLRQAVDEHLIPGTLDGFAGLLVALGVLLLLQALAGYGMSVVNATLGQRVVRDLRRDLFGHLLRLDASYFNKHASGRTTNRVTNDVEAVSQMVSAGLIHLIGDVVLLTGILISMALLAPTLSLTLVVALPLIVGGTLLAAKKSRLAQRENRLMLARMASRLTEEIEGQQEVRLFHRQQRNHAEFEQQNQVYFTSSLVSNTWEAFQFSFIDALSTVVIAALFWIGASMSSADGVTIGTLVAFIDYVRRVFQPVRDLSGKFTTMQAAMTALERIFGLLDSKPQITDAQVNHAFTLPARPRLVMQEVGFAYGEQPILKNLSLTVEPGEQVAVVGPTGAGKSTLIKLLNRTYEPQQGIIQLGGQDLQNIPMATLRRTVGVVPQETFLFSGTIAENIHLRDPSIPQAAVEEAAHKTGAMAFIADLPEGLNTRLTERGGNLSSGQRQLLGITRAFVFNPALLILDEATSSVDTISERLIQNALQELMVGRTAIVIAHRLNTIIGADRVIVMHGGEIIQGGSHQTLVTQPGLYRKLCELQF

SEQ ID NO: 10042 - protein, 458 aa, magnetite-containing magnetic coccus
DLIVIGAGPGGYPAAIRAAQLGLSVLCIEKSPHPGGTCLNAGCIPTKALLASTHLYTQIRDQADLHGIEITTMQVNLARMQGRKERVVSQLRSGILGLFKKYGVTLLHDEAIVSGPGQITLAASGETLQAKAILLATGGQPRRPASMPVDGQVVITSEQAIALTRVPEHLIVIGSGAVGLELASIWVRLGAQVSVIEAQPEILPGWDATVARTAKRSLRQQGITFLTDHRVETVVRSGSRAAVTCLNSKGETLMLDGDQVLVAVGRQAQLCVAGIQNLELQQDEQGRLWVDAHYATSLAGLYAVGDLIAGPQLAHRATAEGLRVADYLAGRPLSPMGPIPSVVYTDPELAMVGLTEQQAKVAGYAVKCGQFPFMASGRARAQEQTEGLIKLVMDQTTGQLLGAHVVGGAGAEHLQLAMAAMLTQDRGQLLERLVMPHPSFGEALHEAWLVATQKPIHI

SEQ ID NO: 10043 - protein, 867 aa, magnetite-containing magnetic coccus
SSPKQTPMIAQYLSIKAAHPETLLFFRMGDFYELFFDDAKQAAEALNIALTSRGKSEGEPIPMAGIPVHARQTYLNKLIEAGFKVAICEQMEPPGASKGPVRREVVRTVTPGTLTEESLLSPRENNYLVSYLPAAKRHPHALAALDLSTGEFFALTLEREDQVAAELSRLEPAELLIPDNWEPEPWLKGWKRCLSRRGSWSFDGKEGARVLLEHFQVTSLESFGVADSPPCLGVCGALLHYCRETQKEALSHITGLSRLHQQEGMVLDETCRRNLELNYNLKDGSRKSSLLGVMDRCITPMGSRLLAQWINRPLQSLDAIATRQESVSWLRENLVAYQDLRERLRMVHDLERFLSRIALRRASPRDLGGLRQTLQCLPQLYAILTPADGHSLAVPSLLRILADHFNGHEALTKQLEQQLADELPLNLKEGETIRLGFDQTLDTLRSLSRDGKSYLTKLEVEEREKTGIPSLKIKYHRSFGYSMEVTKTHLDKVPPRYIQRQTMTNGVRYVTEELKEYEEQLLTAEERMLEREQLLFEALAEQVARQAETLQASARAIATLDVLANFAHIAEERNYCRPLLHEGAVIEINQGRHPVVEQFSDTPFVANDIRLDNRQRTGLITGPNMAGKSTLMRQVALIVLLAHTGACVPAGSAKIGRVDRIFTRVGASDDLAGGRSTFMVEMTETAHILHHASERSLVILDEIGRGTSTYDGLSIAWAVAEHIHTQCQARTLFATHYHELTQLESQLDGVFNLTVEVKEWKDQILFLHTIVRGAADRSYGIHVAQLAGLPRAVTRRAREVLADLEEHAVHHPDSMGQGHAPASQPYQLTLFEDAPPSPALLELKRVDPDELTPKEALEALYRLKELL

SEQ ID NO: 10044 - protein, 142 aa, magnetite-containing magnetic coccus
RILVLNGPNLNMLGKREASLYGHETLADVEVLCAAKAAQLGAQLAFYQSNYEGALVERIQQAREDADLIVINPAAYTHTSVAIRDALLAAEKPVVEIHISNIHKREPFRHHSYVSDIALGQVVGLGIRGYAYAMEAGITHLE

SEQ ID NO: 10045 - protein, 444 aa, magnetite-containing magnetic coccus
MFKKVLIANRGEIALRVHRACKELGIQTVAIHSTADADSMHVKVADESVCVGPPSSMDSYLNISSIMAAAEVSDAEAIHPGYGFLSENPEFAEIVKASGLTFIGPEPEVIRLMGNKVQARKTMIAAGVPVVQGSEGAVNSEEDALRIAREIGFPVIIKAVGGGGGRGMKVVHAEAGLIRAYTVARNEARQFFRNDAIYIEKYLEAPRHVEIQIMCDRHGNAVHLGERDCSLQRRHQKILEEAPSPAVSPEERHRLGTLAAKAAHAVGYEGAGTFEFLYDKGNFYFLEMNTRIQVEHPVTEMVTGMDLVKEQIRIAANLPMSFTQEDIVMRGHSIECRINAEDSETFLPSPGLITEYHAPGGGGVRVDSNCYTGYRIPPHYDSMIGKLIVHGRNREEAVTRMRRALDEYIICGISTTIPLHQRIMQDATFISGTYDLHFLERFLG

SEQ ID NO: 10046 - protein, 151 aa, magnetite-containing magnetic coccus
IDRAHIALRVAELGVQIRGDMVGKDPVFLVVLKGGFVFAADLMRALDHTVPVAFTNARPCAHLPIFSREDEDLLRGKDIWVVDALLDQGHSAMRLMQGLQPLQPTSIQFAVLLHKTVERAEKIPVRYVGFEVPDTRLVGYGLDENQQFRGM

SEQ ID NO: 10047 - protein, 323 aa, magnetite-containing magnetic coccus
KIDVFGIGNALVDQVYAVEESFLTQIGEEKGRMSLVDPQRQAELSRALASTPALRACGGSAANSLIALTQLGGSAFHACRVAEDETGHFFAQDLTANGVQHQLHTLPAGSSGSCMVFITPDAERTMCTFLGASADLQPEDVPDAILTTAQWCYVEGYLVTAPNTLAAALKGLQQARANGVKTALSFSDVNMVKFFRDGFSQMLGESGVDLIFCNAEEALAFAETDDMAQATAALKKQSRTFVITLGAEGALLWDGQQEIQVAGQPAKAIDTNGAGDMFAGAFFYGITQGWDFTKAAQLACRCCAVLVTHAGARLPKSRTQEIL

SEQ ID NO: 10048 - protein, 413 aa, magnetite-containing magnetic coccus
HSQLELKRHRERLEKQVRMRTAELELATREAELRKDEAEAGNRAKSEFLAIMSHEIRTPLNAILGTHELLSESALSSEQQRLMEISRNAGELLLNLVNETLDLAKIEAGKLDLEYTIFDLPRLVEEITQIKRVAAEHKGVRLESEMALEVPRFVMGDPDRLRQILVNLLSNAIKFTNSGTVSLQMSRGVADRTFFKVSDTGVGIAAHSMEKIFHPFTQADTSTTRKFGGTGLGLTICKHLCEAMGGDIQVESQVGVGSTFSVNLPLPRAESSMDEPSAPEEVIVEQVQAPLRILAVDDAEDNRKLVQAFLAKSGHHLDLCEDGAQALDRFKREHYDLVLMDLLMPVLDGYGATRKIRQWEQQQHRLPTPIIALTALSVRRDLDKALACGCDFYLTKPFRKHQLLDAIYRIHGM

SEQ ID NO: 10049 - protein, 714 aa, magnetite-containing magnetic coccus
  unsure (1)..(714): unsure at all Xaa locations
LIIDGKEISVQPGTTIMEAAKKLGVYIPHFCYHPKLSVAGNCRMCLVEVVKMPRPVVACAMPVGDGMEVKTHSDMVMAARQGVMEFLLINHPLDCPVCDQGGACDLQDLAMKYGPDRSRYIEIKRQPNNLDLGPIIETEMDRCIHCTRCIRFSTEIAGVEEMGATGRGDHMLVGTYVSKALSSELVGNLAQVCPVGALNDKPFHFKARSWEMSSGDGICTHCSVGCQVRVDHLDGEVKRVVARECDEINETWLCDRGRFSYDGLSVGRLTQPTIRGEEGVQEVSWAEAMTRAAELIKAGEGDAVAGIASEEQTVAEELYAFQDFMRNVVGSPHLDHRIRQRDFSGDAVALTRADLMMNTSLEALEEADGILLVGSNSRYDVPLLNLRLRKAARKGAKVMAINPCEKDLALPGLHTLVTLPGEEPGVLSQILAALKGKGAGEAAQVAAMLKAAEKPVILLGDFAINHPAAETLRRTVVAILEKLGKLDDSWNGYNRVSARAAAVTAQDMGVVPHRGAGYAIVGKRGKNAHEILQGAAEGSIKVLFVLGADLEREAADPKLARAALEKADVIYLGAFSNSTSEAATVVLPGLTPWEKSSTVTNAEGRAQRMEAMVPAPGEAKEDWRVLRKLSDWFSTPLSYTTTESLRQALEEHRPTLXRRALGVXGFDPSCDHKPVTTGLAVTEWLAPPSAKGLRLSLELPFYHSDAMVRGAKVM

SEQ ID NO: 10050 - protein, 260 aa, magnetite-containing magnetic coccus
MGLMKGKRGIIFGVANDRSIAWSIAEVCKREGAEIGITYLGEAMAKRVVPLGEKLGAAFTLSCDATDDAEIQAVIDASAEIWDGIDFIVHSVAYAKKEELKGKFYDTSKEGFQLAMTASVYTLISICRIAEPRLTDGAGILTMSYLGAERVMPHYNVMGVAKAALEASVRYLAVDMGQRGIRVNGISAGPIRTLAAAGISDFKEILNWNRDNAPMRRNISQQEVGESSLLFLSDMGSGVTGEIMHVDAGYHVVGMRAVDE

SEQ ID NO: 10051 - protein, 233 aa, magnetite-containing magnetic coccus
ETAMAGSQIGTLFQVATFGESHGLALGGVVDGCPAGLELSEADLQGDLNRRRPGQSRFTTQRQERDEVKILSGVFEGRTTGTPIGFIIENEDQRSKDYSEIKDKFRPGHADFTYWSKYGNRDYRGGGRSSARETAIRVAAGAIAKKLLRQAEGVTVRGALTGMGPVVIEPSRWDWAEVERNHFFSPDAGSVGEFEAYLEGIRKAGNSVGAFLEVHAEGVPIGLGEPVFDRLDA

SEQ ID NO: 10052 - protein, 507 aa, magnetite-containing magnetic coccus
VNLDLPTPKLYEQIIARGEGQIAHGGSVVVETGIYTGRSAKDKFIVEEPTSQADVDWGTVNRPVSQENYEKVRGRLMAFLQGRELFVQDVRVGADPQFQRRVRVVNIKAWQNLFARNLFITPETMENEVVPPDFTVIACPDFKADPELDGTRSEAFIYMNIAQREIIIGGTAYAGEMKKSIFSIMNYLLPKQAVFPMHCSANIGTQDDVAIFFGLSGTGKTTLSTDPKRRMIGDDEHGWSDKGVFNFEGGCYAKTIRLNAVAEPVIHNCTQTFGTVLENVVMDEESRTLDLDDDRKTENTRAAYPLSSVGNIKADGMGGHPSHVILLTADAFGVLPPVSRLTSEQAMYHFISGYTAKLAGTERGVKEPQATFSSCFGGPFMVHHPTVYAEMLGKRLSETGAKCWLVNTGWTAGPYGEGHRMPIRETRAIIDSILANELNDVATHEDPVFGLAVPTAIDGVETVRLTPRDTWKDGAAFDAKAKDLARQFNENFANFADRVSDAIKGAG

SEQ ID NO: 10053 - protein, 517 aa, magnetite-containing magnetic coccus
LGVGKGDRVLVYLPMIAEVIPVMLSCVRIGAIHSVVFGGFASTALASRIDDAAPKLIITVDAGIRGGKVVPYKPLLQESLNQISVTRPKVLLINRNLDPNLKMEKGDLDFTTELAKHKDAVVEPEWLPSSHPSYILYTSGTTGKAKGVQRDTGGHAVAMRASMKHIYGVEPGQVMFAGSDVGWVVGHSYIVYAPLLTGATTVVYEGLPIRPDPGVWWSLVEKYKVNCLFTSPTAIRLLKKSGEEWIWKYDLSSLESMFLAGEPLDRETHRWVTSALKHAPVVDNYWQTETGWPILTNFKGMGLMETKFGSPCRPAYGFDVVLIDDLTQQPAEPNTKGSLMIRPPLPPGCLSTVWGDDERFVQTYFSRMREPIYATFDSAVYDDDGYYYIMGRDDDVINVAGHRLGTREIEEALCSHPAVAEAASIGIKDELRGQAISCFVVLTTGAEPPSEADLKNHVASQLGPVARPHFVRVVTALPKTRSGKVLRRAIVAINEGRDPGDLPTIEDASALDKIKEA

SEQ ID NO: 10054 - protein, 355 aa, magnetite-containing magnetic coccus
IYDLKHLGEDVTVLSLGESFFEMEMDDFSQLDLEKINHYSDSQGIPALRKKLAHYYQSRYRVTVNPDQELIISVGAKSLIYMAMLATLEPGDDVLIWEPAWLSYPEQAKLVHAKPRFIPYDLPVEQLDTLFTDKTRMVVLCNPNNPSGRVYNRAELQRIHTTCAQAGAWLLVDEVYSDFVLDEPFVSLGELVPDFNHLIIINSLSKNLGISGWRIGYAIGPEPLIAALLRINQHVITCTGTPLLHYCNHYFDKLVNRALPQVEAVMHRRKRIKGMLQELGLDEMAGSATFYHFVHLGDYPGNAFAFAAQLLLDHHISVVPGYAYGENVDRFIRISIGWESEERIWLALQSIKNVI

SEQ ID NO: 10055 - protein, 489 aa, magnetite-containing magnetic coccus
LNQLVAHYPQRHALIDAVHEQRHSYQGLAILIQRLQATLESWQIGAGEVVVSLLPNSVEQLSLFLAALYSGRHFAPLSPQCTAIELAHWLKVTQAKVCLLTTLSSPAQQQAVREAGVTLQLVALDGQFEWAQTEQRSVKAEPQGGSRLYLHTSGTKGEPKALVIDANTLWQAGQAFVALHPALHGGMRFFNIMPMSYLGGLFNLGLIPLVHGGSIVVAPPFSGRTLMTFWHDVKRFGVEALWLVPTVARGLLALYRPGKDERTTPRQTGIQYAFVGTAAITPEEKQRFEACFGIPLLENYGLSETTFLTSEQPGQAQLRSLGSVGSVLPYVTLKLDHGPAEQPRPIRVRTPYAFVGYLGQDGEIRSPLDDEGYLHTDDLGLLDANGQLVLRGRTGDFIKKGGYFVSLVEIEALATTCPGVLEAVAVATVSELYGDDYNLFIRCDGSMTEAPEAHFRQWMAERLVRYKWPCRIQVVEAFPRTESGKIQKR

SEQ ID NO: 10056 - protein, 556 aa, magnetite-containing magnetic coccus
  unsure (1)..(556): unsure at all Xaa locations
VGADITHLKMIQQELTLARDAANAANRAKSAFLAVMSHEIRTPMNSILGMTDLLMEHALDAEQRHALQAIARAGDALMIIINDILDLSKIEADRLELELVETDLDNLMANLGDMLTLRAQEKGVKLSLLREEQLSPYRWCDQVRLRQILVNLIGNAIKFTHQGSIEVKLSKGPGNRIRFSVSDSGIGIDLQQQEAIFESFNQGDSSVTRRYGGTGLGLSISQRLVKLMGGVLKVYSRPGKGSTFFFTIPMAPVPHLGRHLTHIQNWEQFHLLLVEPVGTTSTIGQLLTPLGMQVSHLHELTHISQVVAQLDPIDLLLINLDSVEDETLNQSLQQVHDHPASARLPLLLLLPEPDHTRFEMVKGIGGHCLAKPVRRQGLIDAMELVIGAKHATQEAKIAGEIKGLKILIAEDSDDNILLLQSYLKGSDHQLTIVRNGLEALQQVEQHHFDLVLMDVQMPVMDGLEATRKIRLMEQQQGARQPLPIVTLTAHAMLEDKRRSVEAGCTDHLTKPIKKQVLLKAIAKLMQSVAAXKRGNLXGVTTLSVRLELGXGMAMGK

SEQ ID NO: 10057 - protein, 540 aa, magnetite-containing magnetic coccus
IGWNRIRILKAQQAQKQVEHELDLSRVAAQAKNTFFAQVSHEIRGPLNAILGYVVMLRQTELKAQQLHLLEHLGSASHALLTLLNDILDYSRMEAQKLTLAPQPTHLPTLLKRMEESFAPRIAKKGLHFSLSMAKDLPAWANLDPVRMEQVITNLLDNAYKFTLQGHITLEARLESDASTPPRLTIIVSDSGIGMDTSQEQSLFEAFNQADPSIARSYGGSGLGLAICRHILSLMEGDIAMESTPNQGSRFTLRIPYCPVSETEIDTLHTSPAVAQAPKEPRHPLATHHSGCHILLVEDNPLNTHVLQLFFEEAGLVVWHAENGQSALDQLAQHPVDLVMMDVEMPVMDGLSCTRRLRRNYPTLPVIGMTAHSDAGIRQACLEIGMNELIFKPMDWAQLFELLHHWLPTTTSPRPTIPLQPPTPDAASTKKLPALEGIDVTIGLQRVVGRETLYLHLLETFAKDHQQTQSLLRSALLNSDHVGFRSQLHGLKTSADYIGAIPLAHQAETLYQLLGKTWNGSSKIEANTLIGNLEKLLEGL

SEQ ID NO: 10058 - protein, 855 aa, magnetite-containing magnetic coccus
MKQEQLTSKSAEALNSAVGLAAERNHQFVEPEHLLLAMLEQKDGVIPALLIKMNTPLPALQQATSVAVENLPRVHGGGAAQTLPSRRLQSLWQDAEREAATLRDDYTSTEHFLLAMTEHKEGALPSLLRPFTITRTRVLEALKTVRSGQRVTSKEPEGTFQALEKYARDLTALAKSGKLDPVIGRDEEIRRTIQVLSRRTKNNPVLIGEPGVGKTAIVEGLALRMERGDVPESLKGVRVVALDMGALVAGAKYRGEFEERLKAVIKEVQEAQGKIILFIDEMHTIVGAGQSEGAMDAGNLLKPALARGDLHCVGATTLDEYRKHVEKDPALERRFQPVQVREPSVEATISILRGIKDKYELHHGVRITDAAIVAAATLAHRYISDRFLPDKAIDLVDEAAARIRMEITSKPQVLDSLDRQILQLQIEQSALSKEKDSASRERLTKLEAELADLKENAHAMTIRWEQERLNIKQVGILKETLESTRLQLEQAERSGNLEKAGELRYGTLPKLEQELQKAQELAAQSRENPLLKELVDEEEIATVVARWTGIPVARMLEGEKDKLLKMEERLGHQVVGQERALQAIARAVRRARAGLQDNNRPIGSFFFLGPTGVGKTELSKALAQFLFNDESAMVRLDMSEYMEKHTVARLIGAPPGYVGYEEGGQLTEQVRRRPYSVVLLDEVEKAHPDLFNTLLQVLDEGRLTDGHGRTVDFRNTVLIMTSNIGSHLMAEGGPTAQVEHRVMELLKQTFRPEFLNRLDEIIPFHALQREHMGAIVDIQLKRLHKLLDKLNIRLELEPAARAALAEEGYDPIYGARPLKRVMQRLVQDPLAEAMLSGHLHEGDRVVIHFDGEQFV

SEQ ID NO: 10059 - protein, 424 aa, magnetite-containing magnetic coccus
MQPVYVIDGMRTPFLKTTGGPNPFSAADLGVQAGRALLMRQPFHADALDEVILGCVSPAADEVNIARVVALRLGCAVRTPAWTVQRNCGSGMQALDTAVRRIGRGEAALILAGGVEAMSRAPLQFNSRYSRWMGQLVRSRTPLAKLRTLLGWRPGFMAPVITLLKGLTDPTTGLSMGQTAENLAYRFGIERESMDAYAVRSHQRAAAAWEEGRMAAEVTPLYDAQGQIYAQDDGIRPDSQEEKLAKLKPAFEPPHGRITAGNSAQITDGAALLLLASEAMVEHYQLTPLGKLYPAQWVGLAPEQMGLGPAHAIAPLLQELEWDMSAIDLWEINEAFAAQVMACSEALADGDYCAQMLGVDHALGHMNPARLNVDGGAVSLGHPVGASGARIVLHLLHALGQRHLKRGIAALCIGGGQGGAMLVE

SEQ ID NO: 10060 - protein, 560 aa, magnetite-containing magnetic coccus
VSGRPRVSPIGQFAEDRAPRWEPHTWQQAARQAAQWQAALRNERLKQGSRVAICMPNRMEWVLFDVAAMSLGLVVVPLYPHDRPEAMVYILKDAGVKLLLVEDERQLQSLKPHLAQLRQLKRVVVLQGHCSESCGDCVAAGDWLPQGKQTWLRVAGATDPHGLATLVYTSGTTGPPKGVMLSHRNLLSNASAALARIRAYTDDRFLSFLPLSHALERTAGCYLPMMAGCEVAFSRGIPYLSEDLAVMQPTVLISVPRIFERIHGEVQAKLQHAPEWKVRLFQHTVESGWDHFEHQQGRRGLHLKGLLWPLVKPLVAHKLLKKLGGRLRLAVSGGAALDPHISRFFLGLGLPLVQGYGLTETAPVVSVNTPGDNEPSSVGQPLPGVQVRIDAQGELCVKGASVMSGYWHNPRATRRVIDQEGWYHTGDKGELDAAGHIKVVGRLKEILVTATGRKIPPGDVEGAILADPLFAQVLVVGEGYPYLAALVVLNSEIAQGVTLDEMALVARMNDRLHRFPRYAEIMRAATVAPWTVENGLLTPTLKVKRTAVIQQYQDVIAQLY

SEQ ID NO: 10061 - protein, 420 aa, magnetite-containing magnetic coccus
NPKIAIIGLGYVGLPLAVAFGKKYPTVGFDIRSQRITQLQQGQDTTLECSSVELAQASQLSFTADLQEIAHCNTYIVTVPTPIDNYRRPDLSPLISASETVGKVLKAGDVVIYESTVYPGATEEVCVPILAKHSGLVFNETFFAGYSPERINPGDKVHRLETITKVTSGSTAEAAQWVDQLYQSIIQAGTHLTSCIRVAEAAKVIENTQRDVNIGLINELALLFNRLEIDTLEVLQAAGTKWNFLPFRPGLVGGHCIGVDPYYLTHKAQEIGYHPDMILAGRRVNDSMGTYVASEVIKLMTRKHLCVASSTILILGLTFKENCPDLRNTRVVDIAQELLEYGAEVAIYDPWVDAQEAHHEYGLNLLTEVPHAHYDAVILAVPHRQFIEAGIEWVQALRKEISVFYDLKSLFAKEQSDQRL

SEQ ID NO: 10062 - protein, 541 aa, magnetite-containing magnetic coccus
LQTVANEVGKFVQRRRSEIALRIASDEALKANRAKSDFLAVMSHEIRTPMNAIMGMTELLEETELTTIQRNYLSICRSSGQNLLQLINDILDISKVEAGRMEVAVAPFHLHRIIHDANQVILFRAQEKGLNQIVYIDPAVPTILLGDQARIRQILINFLGNSVKFTQSGTIATLVTTRAHANKEDQLVIHVVDTGIGIEQSEQEAIFKAFHQVDSSNQRQQGGTGLGLAICLKLVALMQGSVSLSSRAGKGSTFTLTLPLTVAPAEQIQSLKVERGLTGYHMVIWHTHPISTLYIEEMFKERGAKVRSCNQSMTLANCAIQGDAVLATTDMMIIHYHEEDKTNPLELINTIRSEQSLHEIPVLVYGRCYDPALLKQLNQLGVRFLPESLMQDVLCEQIVTELSKRPRSAVTSGQGGTLPMHILLVDDSPDNIFLIQAFLKKTSYQISTVYNGKEAVEYVMQADTPPDLILMDIQMPIMDGYAATRQIRLLEQQQGQSRIPIIALTAHAMAEEAEKLKAAGCDLHMAKPVSKRILLEVLGRY

SEQ ID NO: 10063 - protein, 417 aa, magnetite-containing magnetic coccus
FHRLGWVKKVVGLLIEGNGPAVSIGQMCDVVRENGEVVKAEVVGFRDKSVLLMPLGSIKGIFPGSRIISQGRAEQVPVGPQLLGRVIGPMGEALDGHALPHLDDHVPLHAAPINPMLRRKIEEPLDLGVRAVNSLLTVGRGQRLGIFAGTGVGKSTLLGMMARYTAADINVIALIGERGREVVEFIEDELGPEGMARSIVIVATSDQPPLLRLRAAYMATAIAEFFRAQQKDVLLLMDSITRFAMAQREVGLATGEPPTSRGYPPSTFMLLPRLLERGGRDQGRGSITSIYTVLMEGDDIQDPIVDAVRGILDGHIVLSRDLAAANHYPAIDVNGSLSRLMEGLSEKAHKRAAGQLREILATYVKAEDMINIGAYVAGSNPRIDRAIRFIEPIRTFLKQSVEEPSTLEESIAQLESL

SEQ ID NO: 10064 - protein, 234 aa, magnetite-containing magnetic coccus
LLENRIALVTGAGSGIGKAIAEGYAAAGATVLLLGRTQKKLENVYDAITQAGGKATIVPMDLETGLGAIPELVKNTYERYGRLDILVNNAALLGTLSPLANYRPQEWEQVMRVNVTAPFFLMREFIPLLTQSDDASIINLSSGVGHQGRAFWGAYAASKAALINLSETLAQELEKSPIRVNTVNPGATATTMRAKAFPGEDPTTLPSAQAILPVFLYLASQQSKDVRGEHLNAR

SEQ ID NO: 10065 - protein, 635 aa, magnetite-containing magnetic coccus
IHHTTCPLDCPSACALEVTLQQGQLKGIKGDAQHPFTQGVICGKVARYGAVQNGPRITQPMKRVGPKGLGHFEPISWDEAMQTVVAQLQSRISRYGAETVWPYWYGGSMGLLQRKALERLTHRAGFSRMKGTICSFVGVSGWQAGVGTFYGPSAEDMAASSDLVILWGINAVSTHINLMNFVKKARARGARLVVVDPYRNRTAKLADEHLNPRPGTDGALAAAMMHVLLAEGLANRDYLARMSDFDGEVEAHLSHKTPEWAAHITGLSAETIRAFARQYGQAAAPYIRMGLGMSRQNNGAVNIHAVSCLPAMVGAWEKPGGGAMMMSHGAFGVNIQAITAPHLVDGTPSRELDMSRLGAVLGDAQLAPPVTAMLIMSVNPAVTAPDLGAVYRGLTRDDLFTVVHEQVMSDTAKFADILLPATTFLEHEDLYSSYGQYTLQHAEALLPPPGACRCNHDWVNDLAQRLGFTEEVFQRNLSETVAQVLADPSCPPVSSGRSVGTMLPPMRQIATTATALVTPMGKFHFRPAWGNTAMPALPDHWAVNRRDLPSDRAYPLDFMTPPAHAVLNSTFTLSADHEQKLGEPTLMINPVDAAERGIVEGDWVVAYNALAFLRFKAHVSEDVRPGLTLCESNFA

SEQ ID NO: 10066 - protein, 93 aa, magnetite-containing magnetic coccus
QITPHQLAEMLAHKPPPLLIDVRTAAEFNTDGRIEHAILVPLSDLSRRAPEMFKQYPGREVAVICRSGNRSIMGSVGLKKAGFAKVYNVTGGM

SEQ ID NO: 10067 - protein, 177 aa, magnetite-containing magnetic coccus
LASERRHLDEAKLMVLGDRGTGKSSLVARLLDGRFVADMHPTEGVSLRTWRFSDGQRRLRLNLWDFSGADHYFAAHPYFITPQGLILLVMDGAEPEPERRLARWMRIIRSLAGRQASVALICHRADRFPLELDWNEIRQRYPSIKVAVRRASSMTGEGIESVQQAITKLLDTFEPAQ

SEQ ID NO: 10068 - protein, 757 aa, magnetite-containing magnetic coccus
VGTFTDITARKDMEAALHDAKVEAESASRAKSRFLANMSHEIRTPMNAILGLSSLALEQAKEARQRDFLEKINHSGHFLMGLLNDILDLSKIEAERMDLESQPFRLDELLKQLAANVLPAMRNKAVEVHFFIASGTPLALVGDALRLGQVLHNLLSNAMKFTHEGEVRITLTAEPYVQLTDHYLFTFEVKDSGIGIPAEVQPKLFESFIQADSSTTRQYGGSGLGLAICRRLMEMMHGKITLQSSLGQGSTFTCRLPLQIQSCTVTCCPMPEDAFKGQRLLVVSNSGSLPESIQFSMGSLDLQLRHTVDPEAMAALVAQGFYPDVVLLDDNCGDSTQLVNAISQFTLMMTEQKKPTILMTTVHQDSTLLERLSAAGMDGVLDKPLLPMALYDVLMRLLHTGSLNMGGLESVSSRDHAAHLAGLHVLLVEDHDLNMEVAKAILERVGIRVITAQHGGEALALLEQTEGAAFDAILMDLQMPVMDGFETTRVIRSKTAWAQPPIIALTANAFSQDRERALQVGMNDHITKPIAPGLLYAALERWIDRKDRAIGHLDLLSQAEEVVVFPPLQGWQQQQVLIRFEGDEALVRRLLDRLVEECHRLLSHVEPLLTQQAWPELLASVHGFKGITGNLGLEILQKNASIMEQGLCKERVVASQVAQHWHILAGSIRDFVGTYGQWQQQCMEGDKGHGKRDEQGKGDDILQELLELLAGRQMGARDHYKRHRRVLMAWLGESKAAALEKAMAELDFVTAEKVLLS

SEQ ID NO: 10069 - protein, 799 aa, magnetite-containing magnetic coccus
MQLPIEGMSCAACSSRLQRRLESMPGVTQASVNLATASARIEGVVTLEGLEKLVKQTGFSVPRITQTFQLEGLSCASCVTKVEQAVAKLSGVERVAANLATGALLVTLIPDYVSQTTIQQAVQGVGYSLLASQEGEVESRAQTMQQREIRQLQHRLVVGALLVLVNMAMMHGWLPGVATLDEGWRNLLQGVCMTPVVLWSGWGFHRGAWQVLKHGSANMNTLVSVGSLSAYVASVGIALVPQWWSQAGQGGHLYFDTAGMIIVLILIGRWLEARAKGKTAGAIQALLALTPQTALRVQEDGGTETIAAAQVRVGDRLLVHPGAAVPSDGVVEVGEPYLHEAMLTGEPLPVQKGLGDEVSGGTLNGAVPFTMRASRVGGDTALARIIAMVRQAQGAKPPIARLADRIAGVFVPIILALATLVLLVWWLLLGAPFTHSLTHFIAVMIVACPCALGLATPTSVMVGTGRAARLGMLMRGGDVLERAQQVNAVIFDKTGTLTCGTPVLVNHQGAAALLAGVMAVEAQSEHPIAQALVKGLGEAGVVPAAASKVKSLTGYGMQGQVGEETLLLGRSILLEQRGVGLDPTLMAQAAMWAEQGQSVIHVAWQGQHAGLLSVADAVKAESAAGVAALQARGCAVYMVTGDNAKAAQVVAAQLGIAASHVRADTLPDGKAQVVAELQGQGLVVAMVGDGINDAPALARADVGIALGSGTDVAMESADIILMGGDVQGVARAIALSAAVLVNIRQNLFWAFGYNALLIPIAAGVLVPWGVMLEPAWAAAAMGLSSVTVVSNALRLGRLR

SEQ ID NO: 10070 - protein, 260 aa, magnetite-containing magnetic coccus
LIRLQGVCKQYGALSALQGVNLTVARGEVVGFLGPNGAGKTTTMSILAGLLAPTEGVVQVAGVDMLRHPQQAKPHIGFLPEQPPLYKEMTVQAYLSHLARLRGVAARQCREAVSQVMAQCGLNPVAGRVLGHLSKGYQQRAGIAQALVHRPEVVILDEPTSGLDPLQIQEICLLIRSLGQQHAVLLSTHILSEVRMTCDRVVLIHQGKIQLDTSMADLEQHLQAPQVVQVSLANDPGQAVLAALPGVAHVEACAGGWRIT

SEQ ID NO: 10071 - protein, 535 aa, magnetite-containing magnetic coccus
  unsure (1)..(535): unsure at all Xaa locations
LRMGTGQFRREVLERTVALHKNNRQLALAKREAEEANAAKSRFLATMSHEIRTPMNAIVGMADLLKDTPLDREQARFVATFQRAGDQLMDLLNDILDLSKVQSGQIHIEVVETDIRTLLDDLSAMMVAKARVKQVDLLFNPHPNLPARVGVDPLRLRQVMINLLGNAIKFTANGEVELRAYFTSSSEVPYGLGFEISDTGIGIDETRLKAIFEAFTQADLSVTRQFGGTGLGLTISRHLVALMGGDIQVESTIGQGSRFWFEIPIDEPVQRQPLSILEPRPVLYLNGMSPNHAEVLRHQLLHHCEEIRYSHGEGELGAQLMEAAPGSVVWLESGHDPTGAFRLLESLRGQYGKRGFHWIVAGWESVEKCLEQANFLGSHYIQKPHSMGQVLQLLMDVLGMQRGGIGAEGXMDLQTPITILLAEDSPDNVLLVERFLKKTAYRLDVVGNGREALESVKKHHYDLILMDIQMPEMDGLSATRTLRSWEREQGTPRTPVLALTAHAFREDREASIEAGCDGHLTKPFKKDELLKTIQR

SEQ ID NO: 10072 - protein, 112 aa, magnetite-containing magnetic coccus
DAALCRRITHWLDDHFRRAPRGVDFPVRPAGTVFQQKVWREISRVGPGQTITYGELAKRLNSSARAVGVAAGQNPIPVVIPCHRVVGAKELGGYSGHGGLHTKRTLLSLEGA

SEQ ID NO: 10073 - protein, 1215 aa, magnetite-containing magnetic coccus
VGSDANVSITGAGDIALGVITAKGDDVTLVSAGKITDNNGAANNVTADILNVTGPNGVEGLETSITQLSSTGSTDIVNAGAMAITKASLEGGSSSFIAESLTILDMAGDTATIANNTSLTLQTTTGNIVFLDTNDTIVAQGSGTVTINAGTTDKSGAVAIIGNITTANQNISITADSHITIGLLNAGIGDVSVSSDYGVVLDGNSTAVNVIARNFSLSGTTPTVRQAELHTTNSIANAHAHDSEVAAKLTLLEANTAAMDIMSTAESTANYSLTLASSAYDTAQAEVDRLAPIENGLKITTYVLDGVSIALSTAASAIEVAAGAAQAIPFSGDAGSEAAAAVTGLAANVAGIAAYAIGIAHSEIAGQLDDAEDLAFNKDAEMYAAKSTLTDAIANHQAYKEATSISQAAYDAAVIERNHNWQVARQAVLAEDASSTAGTLALPFGIQISGQLDVNAVNSDVVLAITGPAVLNSMSATKTAGTGIMSITATDNISVVGALVADDYIRLETTGQIINGNAGHSLTASKFVGVAGTGIGASGGLNTSVTTMAASTTTGDVTVTNNKALTLGTVDGVSGITTAGNIVIAATSPLTVSNNVTTSGGTVALTAGNSANSGDDFTLSANTTISAASTVTLTAGDNVAVESGAQITGTTVTITANNTGDGEADGVNGGATIAGNINASSLVLSGGGVNHSGTITSAGSVNISATSTAASSVNGITLGSVTAGGQIDVVSSNKLVMNQNVTTTSGAVVLTAGDSSASGDDLTLAAGKTISSGDNTITLTSGDNMSIGAAAQITGTTLVLAANHEGAGVADGVSGSMVLAGNLSGQTVTISGAGLTHTGSITSNSTVSVNVNSAATSAISGISLAAVTAGGQIDVTSSHALTLTQNVQSTGGPITITAGLQTTSVDNLTVDAGVTVQSSAGVAFSAGDSMTFGLGSQVTGTGITLIADKAGDGDGDGVSGSINLYGNVNGSSVDVSAAGFRQTGTITSSGDVDIAVVSTLSSPYNGIALGTISAAGHSVKISATGTATAGIADNNGAATNVTAADLAMVANGGVGASADALETQVSNLAATGGSGGVTISNSGDLSLTTVEGVTSFSAADGALSLVTTGNLLISDGFVQGAGLTVTLQATGGNINETNSGAAADVVGNIITLTTTGLGNGVGDVANRLELNAQVLNVTTDKGDVYLHDTAGGVAVGLITTGTTEGTRVDMMVSNG

SEQ ID NO: 10074 - protein, 982 aa, magnetite-containing magnetic coccus
VSITDRDGFITYINEPFSLITGYSELEIVGGKHRLLHSGVHDHAFYRDLWGTISSGKAWKGELCNRAKNGKLFWVSTAIVPFMNEAGQVERYISIQTDITQRREIERELENNNYLSDMALRLSNSGYWHLLLEDEGYYISSERKALIMGDPPHPGFRYHIQDDWLANIRKTDPAMAEQVFANFTQSIATGQDIHFSYPYVRPVDGRTIWLETAGYVERDETGKPYRVYGVTQDITTRRAAEREILRAKEIAEEATQAKSDFLANMSHEIRTPMNAIIGMSYLALQTELSRKQQDYINKIHNAANALLGIINDILDFSKIEAGKLDMENLPFLLSDTLESLTNLIAVKAREKGLELLIAMDPAVPDGLIGDDLRLGQILVNLVNNAVKFTDTGEIVVRVKQVEANDREVMLQFSISDSGIGMTEAQVAKLFNSFSQADASTTRKYGGTGLGLTISKKLTEMMHGKIWVESTPGVGSTFLFTARFGLSTHPAKSKLKLTGDLQGLRVLIVDDSATSREIFEQLAISLGFDAHLAASASEALLAIYRAEAADTPYQLVYTDWKMPGMDGVELTHRLKTATDLQHPPKIIMVTAYDRDEMLRRLGSNTVDGFLTKPATCSSLMEAAMLVFGLEARTDLENGGELLGLEELQSRAGARILLVEDNEINQQVATELLEMAHLEVAVASNGQIGVEMVRAEPFDLVLMDMQMPVMDGYTAARTIRQEARFQTLPILAMTANAMAGDREKCLAAGMNDHVAKPIDPKELFTALAKWIEPRQQPLPTTTKLAVVDDAQEQLPELPGIDTRNGILRMGGRVASYKKLLSKFILNQANSIVEIEQALEAADIKLATRLAHTVKGIAGTIGADLLQTRAAEIETTLNKGDTAQALAQCPAAQAALQETIAVIQQALPSTAATPQPQAYEALPLPPDFILQLETVIAQAEQFSGEAIERLETLLPTAQGNPCAHSLKNAYQAMAEYDFEKAIAEI

SEQ ID NO: 10075 - protein, 216 aa, magnetite-containing magnetic coccus
LLTARNLCADRGGRRVLEGIDLSIGAGEVVTIIGPNGAGKSTLLKVLLGVEPYSEGQVIRKANLCVGYVPQRMPVDAILPMTVQRMLRLAKEVDETAMLAVLEETGVAHVLHAPLQGLSGGEFQRVLLARAMLRNPQLLVLDEPVQGVDYSGEVALYQLIGALRKRHGCGVLLVSHDLHMVMRDTDRVVCLNRHICCTGTPDHVSGHPEFARLFGD

SEQ ID NO: 10076 - protein, 398 aa, magnetite-containing magnetic coccus
QDITARKRMELALQEQKEQAEAANRAKSTFLAVMSHEIRTPMNAILGMAELLRESDLTSRQHWCVETLNRSGESLLSLINDILDLSKIEAERLTLEHVVFDLVQLVGDVCSLFGYEAQSKGLALKHHIAPTLPRYVVGDPIRLRQIMMNLVGNAVKFTKQGHVSVELNPLADGRLSFVIRDTGIGVSVEQQRNIFKPFTQADSSITREHGGTGLGLTICMRLVALMGGEMQLESTLGEGSCFHFELELPAAPPGAESVVGTPRTLADVASALRLESAAHHNDPILVVDDAEDNRMLVNVFLKKTRYTLVMAENGLEAVNAFKQQPFALVLMDIQMPLMDGYEATRQIRQWEQQKGSGRTPIIALTAHALSEESQQILEAGCDIHLTKPIRKSKLLEVL

SEQ ID NO: 10077 - protein, 166 aa, magnetite-containing magnetic coccus
LITEAKIQRRVQALAKEIIARMGQEPVMVALLKGSFLFAADLLREMGRQGAKPKLDFLAVSSYGSGTQSTGQVQVQLAIKEPLQGRDVLLVDDILDTGNTFAHVIELLKAQGAQQVLTCTLLNKQARRQQPVVADFIGFEVPDAFVVGYGIDWDNHFRELPYVGVI

SEQ ID NO: 10078 - protein, 283 aa, magnetite-containing magnetic coccus
KGSLQDSTIELFKQAGWTIVNRSRNYFPSIDDPEIKPALIKPQEMAPYCADGTLDVGLTGYDWILEQDCEDKVHELGVLDYSKSSSHGCRWVVAVSNDSPVQKIEDLHGKVVSTELIKTTKRLFAERGVQADIRYSWGATEAKVVEGLVDAVVEITETGSTIRAHGLRIIEDLLHTNTRMIANPAAMQDPWKRAKIEQLYLMLNASLKAHHKSMLKLNVADINLDAVCALLPSLHAPTVNPLKALGWSAVETVVDRDQIRDLVPKLVGAGAEGIVEYDLKKVV

SEQ ID NO: 10079 - protein, 589 aa, magnetite-containing magnetic coccus
LGITELALRDAHQSLFATRMRLEDMLPIAPKMDEVGFWSIEAWGGATFDSCIRFLGEDPWERLRALKKAMPKTPLQMLFRGQNILGYRHYADDVVEKFVERCAVNGIDVFRIFDAMNDTRNLETAIKATKKVGKHAQGTLSYTISDVHTVDMWVDMAKKLEDMGSDSICIKDMAGLLKPYVATELVTKLKAAVKVPIAMQCHATTGLSTATIVKAAEAGIDMVDSATASMSMTYGHSATESVVAIMEGSERDTGLDLVKLEEISAYFREVRKKYAKFEGSLKGVDSRILLAQVPGGMLTNMENQLKEQGCADKLDAVLEEIPRVRKDLGTIALVTPTSQIVGSQAVFNVLMGERYKTITKEARGILRGEYGATPAPVNKELQARCLEAGEEPITCRPADLLQPEMDSLTAELKQKAAESGITLAKDVIDDVLTYALFPAVGLKFLENRNNPAAFEPKPWEEAAPVAAPAAAPATAPTATEAYTVVVNGTAYNVQVGPQGQVASVAPSAAAAPVAAAPAAGGEPIKAPLAGSISKIHVSTGQHVNSGDVVLIMEAMKMETEVRSPLSGTVSSINCKEGNVVNVGDILITL

SEQ ID NO: 10080 - protein, 344 aa, magnetite-containing magnetic coccus
QALELAAQRIYQFHSWQLPQMGIQEFMDASGTLLGQRVQAVKKAGLYVPGGLASYPSSVLMNAIPAKVAGVETLIMVVPTPDNQVNPAILAAARLAGVDKIFRIGGAQAVAAMAYGTQQVPAVDMIVGPGNIYVATAKRQVYGQVGIDMIAGPSEILVIADNQNDPKWIAADLLSQAEHDRDAQSILVTDDATFAEQVRLAIAEQLSHLSRSQIARQSIMERGGIIVVKDLDEGAKIASRVAPEHLELAVADPRTLMHKIDHAGAIFMGRHTPEPIGDYVAGPNHVLPTNGTARFSSPLGVHNFIKRSSLIGCTARSFASIGPAASALAGSEGLTAHKLSVDLR

SEQ ID NO: 10081 - protein, 442 aa, magnetite-containing magnetic coccus
FRMRTKQGGWCWILARGKVVARTADGQPHRMVGAHQDISQRKQLEADLLAAKTEAEQANQAKSRFLANMSHEIRTPMNTILGMGEILLNAPNLTPKQHRYLSISQRAGDTLLGLINDILDLSKIEAGELHLEHTLFALHDELKSLITMLRPMARDKGLSMQCVIDPQLPTHVHGDPQRFRQIVLNLLSNALKFTDQGSITLHAKPIETGRLQFTVSDTGIGMPEQVITKIFRPFVQAEANTTRRFGGTGLGLSICRQLVTMMHGEIYANSQVGEGSQFIFEIELPAANSETVKQERLSPPTKQNIPMRLLLVDDMEDNRLLVKAFLEGTPHQIVEAEDGLDALEKSQQSQFDLILMDGMMPKMDGLEATRRIRARESEHNLTPVTIVALTANAMPQDVADSLAAGSDYHMAKPIRRAKLLQLLASIANERRLFSHEEVKQTT

SEQ ID NO: 10082 - protein, 435 aa, magnetite-containing magnetic coccus
LARGKQDIEIPGRGRSDEIGAMAMAADVFKVKAHELANASRYKSEFLANMSHELRTPLNSLLILAKMLSNNEEGNLSEDQVESAQVIYESGRDLLHLINDILDLSKVEAGRMDLYVESRPLQALPQMLERTFKPVAQQKSLAFHWSIADDLPKELATDWPKAEQVVRNFLSNAFKFTESGHVTVAIHKPQAHRIFMNSDLTHKNALMISVTDSGIGIAEDKRELIFEAFRQADGTTSRAYGGTGLGLTISRKFAALLGGEIQVESAPGKGSCFTLILPLESPNLEHQAGRGEQMEPENPLSPSEQVEAITHFRSHTTTLLVVDDDRRNVFALKKMLEDRVGLVLSAYNGKQALDVLSQHPEVDLVFMDIMMPEMDGYAAIEAIRRQPHLQHLPILALTARAMPGDRELCLSHGANGYLSKPVESDALFQALITWL

SEQ ID NO: 10083 - protein, 522 aa, magnetite-containing magnetic coccus
NNSVDDIKPCFPLFGEPEYRENMKNKQDKYEERESMEKLEETFQWTTSAEYKELNFQREAVTINPAKACQPLGAVLCSLGFKGTLPYVHGSQGCVAYFRTYFNRHFKEPVACVSDSMTEDAAVFGGHKNMDAGLKNALALYKPEMIAVSTTCMAEVIGDDLHSFITNAKVKGHVPQDLPVPSAHTPSFVGSHTTGWDGMLEGIIRYFTLDKHESAVVGSNGKINLVPGFETYLGNYRILKRYMEEMDVPYTLLSDPSEVLDTPADGEYRMYVGGTELEDVKDTPNAIDTLLLQPWSLTKTKKYLKDTWQQPISEINPPMGLKWTDEYLMKVSQLSGKPIPASIELERGRLVDMMTDSHSWLHGKRFSLYGDPDFVMGLTNFLLELGAEPVHVMSNNANKRWGKAMSKILKSSPYGQETEVHVGTDLWHFRSLVFDRKPDFMIGNSYGKFIQRDTKHKGLEHEVKLIRLGFPIFDRHHLHRMTTLGYEGAMYILTTLVNAVLEDLDSKTTGYGETDYNYDLVR

SEQ ID NO: 10084 - protein, 253 aa, magnetite-containing magnetic coccus
IKTMRDAMIARILDLMATDERLFFLSADMGAPLLDTLRESYPKRFINVGIAEQNLINVAAGLAMEGCCVYTLAIAPFYLRAFEQIRNNLSIAARFNPLNVNMMGIGGGVSYDISGPSHHALEDLATLRSLPDVAVISPADWLAASQLPDFAQTAPYPKYIRLDGKGHEPVTTQPMVWRQGFQTLQQGARAALLTTGFMTQKGQKLVAELGEADIGHIDLFQFTRDLDEQALAQTLRGYGRLVTLHEGYLGRGG

SEQ ID NO: 10085 - protein, 762 aa, magnetite-containing magnetic coccus
  unsure (1)..(762): unsure at all Xaa locations
HTPHHPVGGSTAHSGLYLAGLWFAAALGAATGCPVATSFXVHCPPRTTAXVTLTEGDEISHLAIAIAAMSRSIGEYHRHLQTQRNRFETLLAANPDLISLKNRVGIYQVVNPAFCHFLGLPKEAILGQDDARLFTPHQAARIRQADQWVLSSGAPSAQEEEAVGPDNLPLWLHVIRTPITQATGEVSGILTTVRNISARRMAEEALRTAHEGLEQEVAQRTQALRESETRLRIVTENLPAVVWMSDPLLTSMHFVSPAYEQIWGKSRESLLQDPQSLWTSIHPSDRSFVLKRILNSNGQPWEAEYRILHPDGTTRWIREQGAAFRDTHKQILFLIGCAFDVTPLKETERALSTAKQEAESANHAKSAFLATMSHEIRTPLNGITGMIELLQRSALSVEQRQQVETISKCSVVLMDILNDILDLSKIEAGQLVLERAPFSPTQLLLNLLEVMQPQARNKELDLQLNMDEKLPSTMLGDATRLRQVALNLIGNAIKFTPRGWVKISLLVHERIDDIVWVELAVQDQGIGIADEKLVHLFNPFTQADSSITRNYGGTGLGLAISKRLVEAMAGAISVTSIEGKGTHFRVTLPMQVAHTPLPADAFAPQETLALRPLQMLLVEDETVNQQVVCALLEDEGHHVDVANHGEEAVLMCQQRAYQVILMDLRMPKMDGLSATEQIRQQGMNQQTPIIALTADVLKSTLDRCLEVGMQQVLTKPIRLVQLNHALAHIGLPMAPPRPPAQALSEPAPEATESASPQSLRKI

SEQ ID NO: 10086 - protein, 162 aa, magnetite-containing magnetic coccus
NRSRFRHEAELLARLHHPGIIPLEESFDALGTSYLVMPYVAGENLHQRIRRRPLHEGELHALLVALAQGLIAVHEAGYCHLDIKPNNVLLQQDGSPVLIDFGAAWHQKELERGRADPLFTRDYSPYELFTKQHVGCHSDLYSLGALAYRLLTGHAPVCSQIR

SEQ ID NO: 10087 - protein, 376 aa, magnetite-containing magnetic coccus
QALQDAQAADRVKSEFYATMSHEIRTPMNVVLGMSDILLETVQEPEQRQQLARLQQAGSALLELINNILDISRIEEKRLTLHMAPMDLRSLVEDLLGFFQLPYHEKGIALVSEWEQGLATHILGDSGRLRQVLTNLLGNALKFTERGQVVVVVRRDPEDATYLRIEVRDSGIGLHADQLLHIFDKFTQAESGLTRRYGGSGLGLAICKQLVVLMGGRIWVESEDGVGSCFIFTLPYQEVTELERRQMQDEAAEWSVDVPRKVLLVEDSVDNQQLIVAYLKASPYQVSIAQNGAEGVAMAKQDAYDLILMDMQMPVLDGYAATRSIRQWERQQGREPVPIVALTAHALEGDLEKSIEAGCSLHLTKPIRKAQLLNQL

SEQ ID NO: 10088 - protein, 331 aa, magnetite-containing magnetic coccus
MAQQTNEALARLRSLVEQDLQRTNEVILEQLNSPVELITQVGDHLLNSGGKRLRPILTLVTAKLFGYQKADVHALLAAVVEFIHTATLLHDDVVDKSNTRRGQATANSVWGNKAPILVGDFLFSRSFQIMVEHGDLRVLRIVSDCCAIISEGEVMQLVASNDLATDEERYLDVIRHKTASLFASASQLGAVVADQSDEIAQRMYDYGMMLGTAYQVVDDLLDYSAETEKLGKNVGDDFQEGKITLPVIHAFRSGDAEEQAFWRRCLEDEEQDESSFDHARALIAKHGSLDYTMSQARALIVKAKAALAPLPESAERQALMDLADLSVDREY

SEQ ID NO: 10089 - protein, 390 aa, magnetite-containing magnetic coccus
KKARKAARQLAWLDSGSKNATLHAMADALIACKKILQVENEKDLEAGEKNGLTDAMLDRLRLTDQVIASMAEGIRQVAALPDPIGEINHMRRLANQLQVGKMRVPLGVIGIIYESRPNVTADAAALCVKSGNAVILRGGSEAFHSNRAIAAALAQGMEKGRVPSDAVQVVSTTDRAAVSALLKADQYVDIIIPRGGKGLIQRVMDEATIPVIKHLDGICHTYIDADADPAKAIDITFNGKMQRTGVCNATETLLIHEKVAKTILPALAKRLNQADCVLRGCPETIRLVGEVAPVIPATEEDWDTEYLAAILAIRVVKNLEEAMDHIDAHSSRHTEVIVTENHATAMRFVREVDASAVMVNASSRFNDGFQFGLGAEMGISTDKLHVRGPV

SEQ ID NO: 10090 - protein, 519 aa, magnetite-containing magnetic coccus
LELATRIEENADGVALTVMGGARQASKRLAMPVGTRVTVRNLFFNTPARLKFLKADRTEANQIMELMQRFAIAYPHVGFKLSLNGKEVQHYRAVADESAYVERLGAVLGAEFIPNCMEINSGDAQMRVRGWVGLPTLNRGSASAMHLFVNGRWVRDKVVTAAVREAYRDLMPRERFPLTALFVQVDPEEVDVNVHPAKAEVRFRHGQSVYGLLRRTLAEVLHGMGARCYQASEAPLQSAEEPPEYGADLGKQRLAEPVQLPAAVSQPERWRPSYPPAGEGVPRAAAVANWSPQRQGALPLQSRDSYSPAPGQPRPTAPHHEAAMDHGPLGQAVAQLHNLYIVAQSEQGMVLIDQHAAHERIVYERMKGAWARKEKVETQMLLMPEVLQLSEVEAERMSHWRSTLQQLGIAVEPFGQNAFVIREVPALLARGQIAPLVRDVVEQLEQVGQESALSEAQDAVLASMACHGSVRSGRALTREEMNALLREMERTPHTGQCNHGRPTHVRLSLADLERLFERR

SEQ ID NO: 10091 - protein, 247 aa, magnetite-containing magnetic coccus
CSRPSILRGGLPAWTRWRRCVMNDTATPLLEAHNLTRGFQTEGGTVEVLKGVDLSLARGDMVALLGQSGAGKSTLIQILGTLDRPTTGSVRMTGVDLFKLSRSQLARWRNENIAFVYQQHRLLPEFSALENVMLPLLIRRMGQAPASKQAQQVLERVGLAHRQSHRPGQLSGGEQQRVAIARALVGGPKLLLADEPTGNLDTHTADGIFDLLLALNAEQQLTQLIVTHNPDLAARMGRRVRMQDGQI

SEQ ID NO: 10092 - protein, 483 aa, magnetite-containing magnetic coccus
VQSYLYAYLQGHSPRYFQENFAGKLGQKIKQAGQSALPLLNILLHDGVRIITILAMGTVMLWEMWPAMSLTLLGWSVGFLGVALFYARRCQALSYAFSDEVSTSAGRLIDTITNIELVRAFSRQLFERRQLAGFLAREQQASERVRWFLIIMNSVLYTITLFFQVLLLAMVVHRVVKGELGVGDFVLVFSLITIVVNNVWNLSQRMLEFYEQLGILAEALAMVGQPHEIQDAPQAQPLQVTQGEVVFERLHFNHGDGHGVFHGLDLTIKAGEKVGLVGPSGAGKSTLVKLLRRQYDPQQGRICIDGQDIAQVTLCSLNDAIAEVPQLPGMLHRSIGDNLLYARLDAQPQELVDAAAQAHCMAFIGRRAGGMATLVGELGVQLSGGEKQRIAIARAFLKNAPILILDEATSSLDSQTEHLIQTSLWQLMEGRTVIAIAHRLSTLTALDRIIYLEQGEIVEMGTHRELLAKQGAYWRLWERQSGG

SEQ ID NO: 10093 - protein, 636 aa, magnetite-containing magnetic coccus
AKEIADAANQAKSDFLANMSHEIRTPMNAIIGMSHLALQTDLNGRQRNYITKVKRSAEALLGIINDILDFSKIEAGKLTMEFIDFRLEDVLDNLSNLVGLKAEEKGLELHFSLPPGLHTALKGDPLRLGQVLINLGNNAVKFTAHGDVVVKVQQLERTTERIKLYFSVKDSGIGMTPEQKGLLFKSFSQADASTTRKFGGTGLGLAISKRLVEMMEGEIDVDSVPEQGSDFHFSAWFGLGEVRGEETLRVERDLANLHLLVVDDNSTAREILAEMAQSFGFRVDTAESGAAALAKVEAAAALNDPVQVVLMDWKMPDMDGLQTARAMQHNDDLQELPMVIMVTAYGREEAVQAATGVELKGFLTKPVSPSTLLDAVMGALGREGVSGRRAHERQVEESEAIILLRGAKVLLVEDNEINQELALELLANAGILAKLAENGVEALQALQREPFDGVLMDVQMPIMDGYTATREIRKQAAFKDLPVIAMTANVMAADLEKAKAAGMQAHVSKPIDVREMFTTMAQWIKPSGLVVEPVLAVTTAEPVDVGEGDAFPTSLPGIHLQEGLARSGGDVSLYRRLLGKFRENQAAALVRMQGHLQQGEREDAVRQIHTLKGVSGTLGARDLFEAAKALEANLKA

SEQ ID NO: 10094 - protein, 376 aa, magnetite-containing magnetic coccus
LQQAMRQAQQASQAKSEFLAAMSHEIRTPMNTVIGMTELLLETPLSEEQQRYVRSLRSSGTALLDVINAILDLTRIESGRLELTEERYDLHELMRETCEVMGYAAAKKKLEMVLEMNPNTPNYLVGDAPRLRQILINLVGNAIKFTEVGQVCVRVWLDEAVERLRIEVEDSGIGIPKEHINTIFDMFAQADSSMARRFGGSGLGLTISQRLAQLMGGRLAVQSQVQKGSCFTLSMPCQIGEEPAQEVVTETQSLTRQTLRILLAEDSVDNQNLIQAYLSRTSHELIYAINGEEAERYVKSGQPVDLILMDIQMPLVDGYTATRRIRAWEQQQGRPAVPIVALTAHALKEDEMRSLEAGCDAHLTKPIGKKQLLQVL

SEQ ID NO: 10095 - protein, 622 aa, magnetite-containing magnetic coccus
ELDKTYQRLKKSLYTSNRMAKLEATIMHTVMDGLITMDSSGKVLSFNHAAEGIFGYAAAEVVGEQITMLMPEPYRSQHDDYVQRYLQGAAPRVIGSAGRHVTAQRKDGALLPIRLSVNEMVFEGERLFVGLVADVSERLQEERALIEAKEQAEAANMAKSRFLAVMSHEVRTPMNGILGMLGLLNDRRLDGQQQEWLATAQESAESMLTLLNDILDFSKIEAGHLELEQSAFSPEQILKGVHDLFLPRATAKGITLELEQGANLPAWVQGDPGRLRQVLMNLVSNGIKFTHQGGVTMRVAQQAKREDSLLLQFEVQDSGIGIPPQQLTQLFQPFNQLDPSYSRKYGGSGLGLAICRHLVDLMGGEIRLESPPSGGSRFTFTARFGYAHAPQDEVLDNSEQEVQLHGVRVLLAEDSPTNQMVAVAMLARVGCHVDVAVNGLEVLEALTRAPYDLILMDLAMPEMDGWQAIARIRGMNAPLRDIPIIALTANAYPEVRAQCLAAGAQDFITKPIQRNILLNGILALVTQAQQTGQQGVGAKRCHSNAPIRDEKVLERLAEDTHCSLLPRILEVFIDEADARLQAISTALDNEAWQTVALEVHPLKSSAATFGAARLAACAMQLD

SEQ ID NO: 10096 - protein, 1014 aa, magnetite-containing magnetic coccus
  unsure (1)..(1014): unsure at all Xaa locations
TQKTPPTSLYQNEPYRAXILIVDDRPANSMALRVSLSKLDVQIIEAPSGNDALGLMVEHDFALMLLDVNMPGMDGYEVAKIARSWEQTKDIPIIFMTAIHHDDAHRATGYQLGAADYIDKPVDTTILLSKVKVFVDLYRSRQKLLEANRQLRESISLRRGVEEQLRMTQFAIDRLGDMVFLISPQGKIVYVNEKACQKLQYEKEQLLQLSIEQIGCGHIETSWKEHWLKLKSYQTLTFQSHLRTKNSIQFPVEIQSNYVKTSSHEYNYAFIRDITDRVHQEERLRLLSRAVEYGPASIVITDAEGHIQYVNPKFEKITGYGAEEVIGNKPSLLKSGQTEPAIYDALWDSISRGHEWRGELINKRKDGSLYWEMAHISPVLSKTSGKITHFVGIKEDITSLKETEAHLELTQKKAEAASLAKSEFLATMSHEIRTPMNAILGMTELLGETQLSIEQRGFLSVCRSAGENLLQIINDILDISKVESGGLELQHVPFNLRRIVYDAGEVIRFRSHEKGLHQLIFIDESVPEWLLGDPARIRQILINFLGNAIKFTEAGTIATVVSTTAGKGSQVEIVFRVIDTGIGIPESKQSVVFDAFKQLDSSTQRRYGGTGLGLTISKKLADLMGGQLGLKSQEGHGSTFTLSLRLSRSTGPSKSSAQPAPIFAGMHILIWHTHPIKRMNIEETLIRYGATLHHCSEVDPFLRCAQANHAATPIDLLFIHFDHADVDVLSEIKRLRAVSPWEKIPVLIYGRCHDRSLPAKMLQQGVNFLPEPVFPDVLLDELCRITQKSQQPEVDSKPSRASLRVLLVDDSEDNLLLASTFLKSTPHIVQTATNGKQAVERFTQTSPRFDLILMDIQMPEMDGFQATAAIRAWEKAHKKPPCPIIALTAFAMSDDESKCLSAGFTGYVSKPISKARLLEAMEACTAAKAPTQAEGTSGLKRALAHGNPQHMREXAPPXPGLFFCTPSDMEQIPMLIQLSTVIGGHALRDVIEFLAHNQPLALQNINNLPIHQQN

SEQ ID NO: 10097 - protein, 442 aa, magnetite-containing magnetic coccus
WQPDSWRKFNALQQPEWPNQDELQQVCKNLSSYPPLVFAGEVRSLSGHLKRVANGKAFLLQGGDCAESFGEFNANAIRDKLKILLQMAVILTYGGGRPIVKVGRIAGQFAKPRSSPTETQGDQTLPSFRGEMVNDPDFSESSRNPEPNRLERVYFQSASTLNLLRAFTSGGFADLHSLNNWTRDFVSNSPQGKRYAEIADKLTDALKFMDTVGINSTNTPVLHEVEYFTSHEALILDYEQALTREDSLTNEYYCCSAHMLWIGERTRQLDGAHVEFLRGVKNPIGVKLGPSATAEDALRLCDALNPQNIPGRLTFITRFGHNKVEENLPKLIRSIKQAGRSVIWSCDPMHGNTFTASSGYKTRNVDHVMSEIRSFFAVHKAEGTCPGGVHFELTGDAVTECVGGSHQVTEAHLPERYETTCDPRLNATQSLDIAFLITETLQ

SEQ ID NO: 10098 - protein, 366 aa, magnetite-containing magnetic coccus
LKEPSMSRVYNFSAGPAVLPLSVLEQAQAEMLDYQGTGMSVMEMSHRSAAYMAIIAEAEALVRELMGVPTNYKVLFQQGGATGQFTMVPMNLLTDRSQKAAYVHTGSWSKKAMSEAKKQCDNVVMVASSEASNFNYIPDQGDWQPFADAAYLHVTNNNTIFGTEYHWTPESGDVPLVGDMSSNILSRPVDVSKYGIIYAGAQKNLGPSGVTLVIVREDLLGRRSNLPVMLDYKVQAESESMHNTPPTYAIYILGLVLKWVKAQGGVAGMEAQNIAKAALLYKAIDEMAFYSCPTQVESRSRMNVPFILSDDRLNESFLSEAKKADLVTLKGHRSVGGMRASLYNAMPLAGVEALVAFMGDFAKRHG

SEQ ID NO: 10099 - protein, 357 aa, magnetite-containing magnetic coccus
LKKRALITGVTGQDGAYLAEFLLQKGYEVHGIKRRASLYNTERVDHLYQDPQVASRDFVLHYGDLSDSTNLIRIIQTTQPDEIYNLAAQSHVAVSFETPEYTANVDALGTLRILEAIRILGLEKKSRFYQASTSELFGKVQEIPQKETTPFYPRSPYAVAKLYAYWITVNYREAYGIFGCNGILFNHESPKRGGTFVTRKITRAMCRIKLGMQDCLYLGNMNAKRDWGHAKDYVEMQWLMLQQDEPVDYVIATGEQYSVRAFVEAVGKELEMSIRWQGEGIDEVGIDETSGKTVVRVNPRYFRPTEVETLLGDPSKARRELGWQPRITFQELVEEMVAEDLKLAQRDQLVQQGGYEV

SEQ ID NO: 10100 - protein, 466 aa, magnetite-containing magnetic coccus
RRAKIVATLGPACSSVEQITRLIEAGLDVARLNMSHGDHKAHLELIHNVREASRIAKREVALLCDLQGPKIRVGHLDEPLRLEKGQQWAIIPEGSHPPKLKCDGIIPCTYAGLAKDAVPGCRILFDDGYLQARAIGTEEGALLVNIEHGGLLKSHKGINMPDASISAPSLTTKDQQDLFFGVKHDVDYVALSFVRSAKCVQNVKFMLHRRKIYKPIIAKIERPEAIRNIDEIIKVVDGIMIARGDMAVEIGNHRVPSVQRQIIQKCRAKGKPVITATQMLESMIQNPSPTRAEASDVANAIWDGTDAVMLSAETSVGVDPINTVLTMGRIVEEAERNPRGPRLDAESHSISSASMMAAARVAEQVSARWIIALTVTGSSALSLARFRPEVPVLGAARTQGGVRRMNLYWGITPRLFNYSIEEREDIEPEVIQWMREQSMLQVGEKIVVVKGGGLLSNHSTSSSIRV

SEQ ID NO: 10101 - protein, 397 aa, magnetite-containing magnetic coccus
AEQALSQAVEQAQRADRAKGIFLATMSHEIRTPLHGIIGTSRQLNRMPLDRQVAHKAQVIEQASQALLGILNDVLDFSKIDTEQLVLEEVVFDLPRMLQELYAVVHSQAEEKGLQLHLQLQEPLPRACRGDQTRLRQILNNLLSNAIKFTQQGEVTLQVALTGETDPAPWVAFAVADTGIGIDEAHLERLFEPFKQMDESINRRFGGTGLGLAISAKLAEAMGGSIRAKRRTEGGSLFTLMIPLRQVPIEQLPKPAQSHMEAADAMPGLKILLAEDDPINQEVAIGILQEDGHQVHCANNGQQAYEMAQQQAYDLILMDLRMPIMDGLQATTKIRAAHTGLNHATPIFALTADVLKDSLQACRTAGMDEVLTKPIHLQHLRYMLERVQPQHLSPPQE

SEQ ID NO: 10102 - protein, 314 aa, magnetite-containing magnetic coccus
MKTALICGVTGQDGAWLALLLLSKGYRVVGTSRDAQIATLTKLDLLGVRERIELRSMTPTDFRSVVQTLIQVEPDEIYNLSGQSSVGLSFQQPVETLESISQGTLNLLESMRMINKSIRFYNAGSSECFGDTGDLAADELTPFRPRSPYAVAKSASVWSVSNYREGYAMYACSGILFNHESWLRPARFVTSKVIKTVNRIAQGSGEQLQLGNMDISRDWGWAPEYVEAMWRILQQEKPEDFIIATGYTASLQEFVALAFAAHNLDWRDHTRSDASLLRETDIRISRANPQKARERLGWQATLTMPDVVARMVEA

SEQ ID NO: 10103 - protein, 579 aa, magnetite-containing magnetic coccus
  unsure (1)..(579): unsure at all Xaa locations
IRRLLRLIWPFRWYVITALLCMGVMAATNGAIAFMVKPLVDDVFMQKDASLVTLIPIVVMGIFIVRAVVFFLQSYLMQSLGFKIVRLLQVRLYKKILHLDMERFNTESTGSFISRMIFDIDQLKRVVSTALADITRELLTVTFLFGVVVYRAAELAWVSVVGVPLAVYLIYLFGRKMRTISRRQQELMEDVTSHLEETIAGVKVVKAYCMEGYEHGVFRRISQRVLKNNLRSAFINAISKPSIDLVAGIAISLVVLTSAHAILDGKTTPGTLFSFLTALMMAYSPLKRITMLYNGLQAGLAAAQRVFERLDQYPAIQNVPEAGKLQPLTKALRFENIGFRYQSSEGPVLRGINLHIGVGEKVALVGQSGCGKSTLANLVPRFYEPQQGAILFDGVDIRSVTMRSLRQQIAMVTQENVLFNDTIRNNVAYGKLRASDEEIWAALEAANAKSFVEQLPEGLDAMIGNKGAKLSGGQRQRIAIARALLKSASVLILDEATSALDSESEQLVQEALDRLMDRYTTLVIAHRLSTIRNADRIVVMHEGAVAEMGTHDSLLAQGGLYAKLCEIQFDTQTAKEXAV

SEQ ID NO: 10104 - protein, 184 aa, magnetite-containing magnetic coccus
ALCLDLDGTLADSLPVMRAIYGAFLAHFGVQGCETEFQRLNGPPLREICAILQQTYGLPGSVEALQQRYSDLLKEAPQQILAADGAEQVLQRANQAGWQVWVVTSSSRSHALAWLQQVGLSGWIAGVVGGDDVQHGKPHAEPYLRALALSGAVPQHCLAVEDSVQGATAALAAGVKTLLLAKQI

SEQ ID NO: 10105 - protein, 389 aa, magnetite-containing magnetic coccus
SDKVSSIMSTYGRYPVAFERGEGVRLWDTNGRVYLDFLSGIGVNNLGHSHPTVVKAVQEQVAKLTHTCNLYRIPNQEALAARLVATCFADQVFFSNSGADANEAAIKLVRKYMKDRGQPGRYEIITATNSFHGRTMATLTATGQEKVQSGFEPLVPGFRYVPYNDMEAMEKAVGPYTAAIMVEPIQGESGVRVPDADYLNQLRALCDRKDILLVLDEVQSGMGRTGKMWAYQWSDIEPDIMTSAKALASGVPMGACLARRGVAAAFAPGSHGSTFGGNPLSAAAALATLDVMLAPDFLPTVQARGDYFMNALRQLAQGRRMVKQIRGRGLMVAMELNAPGEEVASIALSRGLLINCCMGTVLRFLPPLVVSEQEIDQGLAILGEVLSDL

SEQ ID NO: 10106 - protein, 305 aa, magnetite-containing magnetic coccus
RDLLSLFDLRDEEFTVLFQRATTLKRKLERHEPVHSLDGRTLAMLFEKSSTRTRVSFEAGMFQLGGKALFLSSRDIQLGRGEGVKDSARVLSRYVDGIMVRTFDHANVEIMAEYASVPVINGLTDTLHPCQVLADIFTFEEKRGSLKGKRVAWVGDGNNMANTWIQAAVRYGFHLTLACPLGYEPDGDILSAARKELAEREVDASLTLVRDPRQGVDRAHLVTTDVWTSMGQEGESDTRKAVFAAYQVDSGLMAAADAEALFMHCLPAHRGEEVTAAVLEGSQSVVWDEAENRLHVQKAILEFLM

SEQ ID NO: 10107 - protein, 401 aa, magnetite-containing magnetic coccus
DKVVLAYSGGLDTSIILKWLQDEYQCEVVAFCADLGQAEELEPARAKAEKFGVKEIYIDDLKEEFVRDFVFPMYRANTLYEGVYHLGTSIARPLIAKRQIEIANATGAQAVSHGATGKGNDQVRFELGYYALRPDIRVIAPWREWDLTSRDKLFAYAEKHGIPVPTDKRGEVPYSMDRNLLHISFEGKALEDPWVEPDEEMFVLSVSPEKAPDQATYVELTFRQGDLVAIDDQEMSPATLLAKLNQLGGRNGIGRLDLVENRYVGMKSRGVYETPGGTILGVAHRAMESLTLDREVAHMKDELMPRYAKLIYNGYWFSPERAMLQTMIDASQTFVNGKVRVKLYKGNVVVVGRQSENSLFDPAIATFEDDKGAYNQADADGFIKLNALRMRIAAMLRNGPK

SEQ ID NO: 10108 - protein, 461 aa, magnetite-containing magnetic coccus
  unsure (1)..(461): unsure at all Xaa locations
MGKLWGGRFSEPTNAFVEAFSASIDYDARLYRHDIRGSIAHCAMLGRQGIIPQADAERIIQGLQQVRGEIDRGEMHYSNALEDIHMHVESRLTEIIGPVAGKLHTARSRNDQVATDFRLYLRDELDAIVQAIRTLQGGLVMLAEQHAHVIMPGFTHMQSAQPVTFGHHMMAYYEMLKRDYGRFSDMRPRLNRMPLGSAALAGTTFPLDRESVARELEFDGLCENSLDAVSDRDFAIEMMAACATLMMHLSRFSEELILWSAPAYRFIRLPDAFCTGSSIMPQKKNPDVPELVRGKVGRVYGALTSVLTLMKGLPLAYNRDMQEDKEAVFDAVDTVRACLRVFGDMVPGIQPQVATLRGAAGAGFATATDLADYLVRKQIPFREAHEIVGTIVRMAEQQGVDLDGLTLADLQSVDGRIESDVTAILSVESSVNARQAIGGTAVATVRTAIAMAKQELALXSC

SEQ ID NO: 10109 - protein, 414 aa, magnetite-containing magnetic coccus
MDYFHYQDDQLFCEEVALEQIAQAVGTPFYCYSERTLLHHLQVFQQAFASQDSLICYSVKANSNLAVLDALAKQGAGFDIVSGGELERVRRVGCPGERVVFSGVGKSRAEIQAALAYGVRMFNVESIPELQRIQEVALAMDVAAPVTLRINPDVDPKTHPYISTGLKRNKFGIPFGEAVAVYQQAAQMSHVQVVGLDCHIGSQLTQLSPFVDALKRVMVLIQALKGHGIEIKNLDLGGGLGIPYEDGDTPPSPAELAAALLEQLDGMPVTVILEPGRAIVGNAGVLVTRVEYVKKGEQRHFVITDAGMNDLLRPAIYNAYHGVIPLQRKFDREEQVVDVVGPICETGDFFARDRYLSEVYQGELLAVRSAGAYGFVMSSNYNTRPRVAEVLVRGDRYAVVRKRESVAQLLENES

SEQ ID NO: 10110 - protein, 266 aa, magnetite-containing magnetic coccus
FIKMHGLGNDFVVLDHLESPRELSPQEARFWADRRRGVGCDQVVQLLPGVEGGDAQMRIYNPDGSRAEMCGNAMRCVGLYLHEQRGMAAALAVETLAGIMRPQVTSALAITVDMGRPQWAGRAIPLDQDGEMIDAPLEVGGQSYRMTALSMGNPHGVVRVADAEGFELAKVGPLVEHHALFPNRINFEVVQVLSRSRIRMRVWERGAGITPACGTGACAAAVACMRQGWVERDCTVVLDGGELQIVWLESDRVMMSGPATEVFRGE

SEQ ID NO: 10111 - protein, 850 aa, magnetite-containing magnetic coccus
EIEAKQKELEAKRQAEEEAARQKAEQEAARQKQEAEAARRKAEQEAARQKQEAEAARRKAEEEAARAAAAAPAAPVAAPAEAAPAVPVAVAEPVVVAQPAPEAPAPVVEEEMVEAKPLPAAAPAAPSAPVRLLHQPVEEEPKRKLSKAQREEMARRKTEDLVSKRLNQLEELREQKRKEDARKEAEVALAKKEKPVVAATAAAAAEVVAGRTPREDSAGEPFSAGRRKNKKYQDNEDRLQQPRGKSRRRKPFKSEMQAPAPVYREVTIPETITVGELANRMAVKSSEVIKLLFAQGMLVTINQTLDQDTAVLVVEEMGHKPKSVSESAAIEAELDAGEDAAEDMETRPPVITVMGHVDHGKTSLLDAIRSTDVTSREHGGITQHIGAYQVTLASGDKITFLDTPGHSAFTAMRARGAQVTDIVVLVVAADDGVMPQTVEAINHAKSAKVPIVVAVNKIDKPGSNPDRVMQQLSDHGLVPEAWGGDTIFVHVSAKSGEGISTLEEMLLLQAEMLNLQSNPTKKRARGTIIEANLDRGRGAVATCLVQNGTLRVGDICVVGNEWCRVRALNDDRGNQVSEASPSMPVEIIGLSGVPQAGDDLVAVNDERRAREIAQFRQQKDKEAIQAKQQPATRLEDMFEHIEQGEVEELNVVLKADVQGSVEAVAEALRKIKHEQIEVRVIHTGVGGINESDVMLAVASGAITVGFNVRADAKARDLAKREQIDLRFYNVIYDLVDDISLALEGRLAPTVREKVLGHAQVREVFRITKIGNVCGCLVTDGIIQRNGKLRILRQNVVVYEGPVSALKRFKDDVKEVREGFECGISIEKFNDVKVDDVLECYVEEQVKQTLS

SEQ ID NO: 10112 - protein, 176 aa, magnetite-containing magnetic coccus
  unsure (1)..(176): unsure at all Xaa locations
IAKRYATALAELASELNILDSIRDELAHFQALLAESPEMHEMMVSPTVSKESQHKLISTYLEYAKPNDLTANFLRLLIDKHRMALLNDVATAIVRVVDERAGRIQVKVETPKALTPSLVAKLEKSLADVTGKEVSLEISEKPELLGGLVIRMGSVMLDDSLRTQLHRLKEIMKGXG

SEQ ID NO: 10113 - protein, 502 aa, magnetite-containing magnetic coccus
AEISGILKKQIAEYGKEAEVSEVGEVIAVGDGIARAYGLDNVMAGEMVEFEDGTQGMALNLEEDNVGIVIFGEGLAIKEGTTVKRTGRIVDVPVGKGLLGRVTDGLGNPIDDKGPLETTERRLAEVKAPGIIPRKSVHEPLHTGIKALDGLVPIGRGQRELIIGDRQTGKTAVAIDTIINQKRTHETDSPVYCIYVAIGQKRSTVAQVVQTLEENGAMAYTTVVAATASDPAPMQFLSAYTGCAMGEYYRDNGMHALIVYDDLSKQATAYRQMSLILRRPPGREAYPGDVFYIHSRLLERAAKMNDEHGGGSLTALPIIETQDGDVSAYIPTNVISITDGQIFLETDLFYSGIRPAISVGLSVSRVGGSAQVKATKQVAGTLRLDLAQYREMAAFAQFGSDLDATTQKLLHRGKRLMELLKQAQYAPLSMEEQVVSIFAGTRGFLDVVDADAVVKAELELLKQMHAKHSDLLDTIRTSGKLDADTETKLGVAITAIIKEFLA

SEQ ID NO: 10114 - protein, 290 aa, magnetite-containing magnetic coccus
MANLKALKVRIGSVKNTRQITKAMKMVAAAKLRKATEQAESARPYSKRMSRMMHSLAPAAAGRDNAPELLVGRGDVKKVNLVVYTADRGLCGSFNSVVIRATRARIAELEKQGFQVMLTFIGRKAYDVLKRSHGHLVRKVYTEMSRHMSFAYVEKNIVKELIKDFHEGQFDACYLVFNQFKSAMSQELTWAQSIPQPIDTEGASTQTGYQFEPVEEELLEELLPRNLAVQVFQALAESEASEHGSRMTAMDNAVRNAGDMVKKLQTKYNRSRQAAITTELIEIISGAESL

SEQ ID NO: 10115 - protein, 465 aa, magnetite-containing magnetic coccus
TGKVVQVVGPVVDVRFEGELPNILNALHMVRNGERLVLEVATHMGEGTVRAIAMDSTDGVVRGMEVTDTGDTIRVPVGRQTLGRILNVVGEPQDEKGPVETTETLPIHRPAPAFAQQATSAEILETGIKVIDLLAPYAKGGKVGLFGGAGVGKTVLIMELINNVAQEHGGYSVFAGVGERTREGNDLYHEMAESGVIDPNSWENSKAALIYGQMNEPPGARARVALTGLTVAEYFRDLGGQDVLFFVDNIFRFTQAGAEVSALLGRIPSAVGYQPTLGTDMGALQERITTTKTGSITSVQAVYVPADDLTDPAPATTFSHLDATTVLNRAISEMGIYPAVDPLDSTSRVLDPKVVGEEHYHTAREVQRILQTYKSLQDIIAILGMDELSEEDKLVVNRARKIQRFLSQPFHVAEVFTGTKGVYVPVKKTVQGFKELCEGKYDNVPEAAFYMVSDIDAALAKAEKL

SEQ ID NO: 10116 - protein, 610 aa, magnetite-containing magnetic coccus
MCGIIGVIGERNATPILIEGLRRLEYRGYDSAGIAVAYQGKLLLARAEGKLVNLENELAHTPRTGFLGIGHTRWATHGPPTIHNAHPHRSESVAVVHNGIIENYQELREELMAHGVTFVSETDTEVIPHLIEMAMRADPHAPAEEAVRRAICKLQGAFALGILIQGKEDMLIAARRGSPLIIGLGDGENFIGSDATPLVPYTRRMIYLHDDDMAVLTKDAVRLMDMEGAAVSRPIKVTQVRDDVTEKWPYRHYMQKEIYEQPTAIGETLKELIHPAYRTISIRQNSAGLDLATIEDITIVACGTSWHAGLVAKYWIEQLAHVPVQVDIASEYRYRASPMRKNGLMIVISQSGETADTLAAMRYAKQGGLQVLGVVNVPESSIDREADATLHTYAGPEIGVASTKAFTTQLTALACFALAMAKAKGVLDAKQEQGYVDELLQLPAKVEQVLIHDASLEAIARELMHANGFLFLGRGTCFPIALEGALKLKEISYIHAEGYAAGEMKHGPIALIDEDLPVVVVAPQNSLFDKVVSNVEEVKARGGRVLMITTQGQAAGRIPADYTIPVVPCGEFVAPILYVIPLQMLAYHIAVLKGTDVDQPRNLAKSVTVE

SEQ ID NO: 10117 - protein, 399 aa, magnetite-containing magnetic coccus
MNPEMARLNPYPFEKLAVLFEGITPNGALSPLNISIGEPKHPTPAFVTQRMMEALQDGDMAKYPTTRGERALRESMAAWLTRRFELQAGSVDPDRHVLSANGTREAIFSVALAVVDRAKGGVVLTPNPFYQIYEGACFMAGVEPVHIDATEETHLRPPFTQLDAELLARTQMVYLCSPSNPTGAVHPLEELQELIRLADTYDFVICADECYSEIWYDAPPPGLLQACAAMGRHDFARCLVFHSLSKRSNMPGARTGFIAGDAQLLDHYFKLRTYTGCATPPFIQKAAIAAWDDEQHVEENRRAYRAKLEESMAILSPVLPVTRPEASFYLWLKVPGGGALFARTLYEKYNVVVLPGGYLGRQGAHGNPADGYIRIALVATLEQNREAMHRIAQCAQEMI

SEQ ID NO: 10118 - protein, 418 aa, magnetite-containing magnetic coccus
WHPFTQAQTAPDPIPMASARGATLTSVDGRTFIDLNASWWVTTHGHAHPAIAAAIAQQAQTLEQVIFAGFTHAPAVNLATRLSETLGGDLDRVFFSDDGSTAVEVALKMAAQYHINQGTPRHRFVAFRGGYHGDTVGAMSMGQGSGFFDAFQAMLFHVDLLDYPATWLGDPTPELREALVLSQLDDYLATHGPQCGALLMEPLVQGAAGMRMARAGFVQQVMERCRAAGVLVILDEVMTGFGRTGTLFAFQQCGDYPDIICLSKGLTAGFMPMSVTVVREPIYQAFMGEGFERALAHGHSFTANPLGCVAALASLELFEQEGSLARIGQIAALHQQRLEPLQKHAKAVRPRVCGSIGAIDLRVADGGYGAEIGPKLKAFFIEKGLLMRPLGNTVYLLPPYCVSDAQLHQGWDAIEEAL

SEQ ID NO: 10119 - protein, 386 aa, magnetite-containing magnetic coccus
YRAFCQSREAAGQWRQLHAVQPLPRGRVLRDGVELINFSSNNYMGLADHPLLKQRAMAWTEQWGTGAQASRLVCGDLEPFARIEARLVAGKGCEAALVLNAGYQANSSVIPALLDKRVLGGEPLVFSDRLNHASMHHGVQLAGVRQLRYRHGDLDHLERLLKRHAGEKVAKFILSETVFSMDGDRIDVGGLIALKQRYGAFLYLDEAHATGVLGPDGFGLAAAYPGQVDLVMGTFSKGLGGFGAYVTCSHALRAYLINRAGGFIYSTALPPGVLGAMDAALELLPQMGEVRARVLAGAQRVRAALRAAGLDTGNSSTPIIPVMVGDEQRTLALSEGLRAEGLLGIAIRPPTVPEGTSRLRLSLSAAHSDEDWSLLAAAVPRCLREI

SEQ ID NO: 10120 - protein, 456 aa, magnetite-containing magnetic coccus
ILIIGGGISGLSTAWFLHKKGEKVILLESRDRVGGNIRTSRNPEGYLIEHGPNSTLQKPGDEEDALGRIITDMALESELQEANPLAARRFVMKGGQLHVLPTSPPGFIKTPLFSLSAKLRLCLEPFIGKSEQEESIAQFVIRRLGQEFLDYAIEPFVSGVYAGDPKQLSVRAAVAKIYALEAKYGSLIKGAIALGKIRKAAGMPRGRMISFETGMETLPATIANRLPHQSIHTNAQVTALCQHGAAWQVSWQQGGQHGGEPHSIIASQVVLATPASVSAQLLRPLSPQAADLLESIRYAPVDSVALGYAKQDINHSLDGFGFLIPRKEQVTTLGGLFSTTLFPGRAPQDKALLTCFIGGMTNPSITQWSEEKVVTQVDQDMMAALGIQHGAEYVHLTRYTHAIAQYEQGHLQRVGDIDRALAGYKGLHLRANWRDGVSVSDCVLNGEKSAQKILAG

SEQ ID NO: 10121 - protein, 347 aa, magnetite-containing magnetic coccus
RFIQACFRQPVDRTPIWLMRQAGRYLPEYRKTRAQAGDFMALCKNTELATEVTMQPIRRYGLDAAILFSDILVIPEAMGMDVRFATGEGPLLDPPVRVHGDIEKLIHTDPEDSLDYVMRAVASIRKALNEEIPLIGFSGSPWTLATYMVEGGSSKTFGLVKGMLYDAPESMHLLLDKLADMVAAYLNAQIRHGAQAVQIFDTWGGVLSQPTFREFSLRSMKAVVDRLDRTNSAGERIPVILFAKGCNAMVEDIAQSGCDVVGLDWTSEIGPLRERIGHKVALQGNMDPALLYASPERIAQGAREVLQAFGPHPGHIFNLGHGMAPDMSPDHVEALVRAVKEEGLKIH

SEQ ID NO: 10122 - protein, 278 aa, magnetite-containing magnetic coccus
NINGETGLLAVIGGPVSHSLSPKMHNLALRHCQLNYCYVALPVKPHNLVRAVQGFAAMGMRGFNATIPHKENLLPLMHTLSEEASHIGAVNTVVIDDDGKMTGHNTDAYGFITGLKEAWRSDLSGLTAIMLGSGGAARAILYGLIQAKAARVIIANRTIERAQALIEAMQPYAPNTQLMVAPTQADQLPLESCDLLINTTSMGLKGETIPYIDLARLPHHAFVSDIVYGAHPTPLLRATAQHQLGGQDGLPMLIHQGAKAFELWTGHSMPVELVEHTL

SEQ ID NO: 10123 - protein, 764 aa, magnetite-containing magnetic coccus
ELHSAKDEAQQANRAKSDFLANMSHEIRTPMNAIIGMSHLALKTDLNAKQRDYVGKIHDSALLLLGIINDILDFSKIEAGKLSMESVAFYLDDVLSNVANLVSMKVEEKGLEISFQVDRGVPLHLVGDPLRLGQILINLVNNAVKFTEQGNIVVAITAELDCESHVVVQFQVRDSGIGMTKQQIDRLFQAFSQADSSTTRRYGGSGLGLSICKRLVGMMDGDIWVESQPGRGSQFTFTAQLVSQRQDRRRFRLPSMHLVGLRVLVVDDNPVVRQILVESLAIFSFCVEALATVEEVIEALGQAIARGEPYGLVVLAGRFGGKGGVALAGEINRCYPQLTLPKMVLVGASERDDVVAMAGAQLVELFVTKPITQTILFEGVLEVLGYVVQAQQHAGGRDRTREKRVLSGCQILLVEDNEINQQVACELLQGEGVTVVVANSGQQAVDRVLSGERFDAVLMDIQMPGMDGYEATQVIRKQPQFSDLPIIAMTANAMAGDRERCLAAGMNDHIGKPIQPKLLFETLGRYVIKGDGVVEAGNKGILLPPIELTPLDGSVTTPLPPPVLPAAVGRAAMISPRAGAVPERLDGVDMEKGLVHVGGNEALYVKILKEIGERYKDVVVEIQGLFAARHFAQAIQLVHTYKGLTGTIGAMALSQSAAQLEEALKAGAYERLPQLLGDFSQLAERLNVALLPMVGVANVQALPSGAEQAGLEEGLLALGALIRDGDAEALDRVKQLRGMAAGQVYQPLMAQLESELDEYEFERA

SEQ ID NO: 10124 - protein, 385 aa, magnetite-containing magnetic coccus
LKQAQEASRQAMEQAERANRAKSEFLATMSHEIRTPMNVVVGMSDILLESLPNPQAQKHIQLIQKAGTTLLDLINDILDLSKIEAGQLELEHAVFNPILLIEDTIAIFQMQAKLKGLTLTSSMTGHIPHALMGDRARLRQILVNLLGNAIKFTEKGSVEVQAGYANQQFWYAVVDSGVGIGSDSLLRIFDKFTQADSGVARRFGGSGLGLAICKNLMELMGGTIETQSTLGQGSRFYCAIPAPIADHLLPSDVVTKEPITAALPALTILLVDDSEDNRILVRTYLKQSQHKLDEAVDGAQAVKMAIEKRYHLIFMDIQMPIMDGYRATAEIRAHEQQQGLSPTPILALTAHALSADVEKSLAAGCNEHLTKPIRKKDLLRVVNHF

SEQ ID NO: 10125 - protein, 624 aa, magnetite-containing magnetic coccus
QSAPATAWTIEESMELYRTQGWGLGYVHVDAEGDLTITPGSQPHIESISLPKLVDDVEAMGFQGPMLIRFGGILQDRITRLNRAFTESRSRLNYAGHYQGVYPVKVNQDRHVVSEVVASGTPMGLEVGSKPELVLAMAYMDRTPLIICNGYKDRDYIELALRATGLGFPIFVVVDRLEELAPIIDLAKSLNVSPNLGLRARLLTEGVGKWSESAGGFSKFGLTAGEILLAVNQLEREGLKESLKLLHMHQGSQISLLDVVRQSAQEIVRFYLELRKMGCPIEYVDVGGGLGVDYEGLSSSAPCSVNYSLGQYADALLGVFAERCREAGAPEPNVVTESGRALTAPHAVLVVEVMGWSEPVGRDPAPETIPEQAPEVQTLHTLAMEFDKERADLIWEQALMLFESIKQGFVLGRLDLTARSIAERVMVHLGRLVHEAKGQDPKPESRLQGYVSERYLTNFSMFQSLPDAWAIGQLFPIMPLQRLHEEPAAEAILQDLTCDSDGQVKRFIGVQGENATLPVHHPGPTERYRLGFFLVGAYQEILGDYHNLFGDTHVVEVGLKADGSMAKPVVRRGQRSVDVLKAVSYEPSELYDAVGRLARGACKDDRAAQFIEAYARLVKGCPYL

SEQ ID NO: 10126 - protein, 254 aa, magnetite-containing magnetic coccus
MRIATWNVNSMNVRQEHVAQWLAEDPCDLLCLQELKMVSEKFPAERFKSLGWHLLANGQKTYNGVAVLSRFPLEERDVVLDLPGVDPAQKRLMAVTVNGVRVVNCYVPNGSEVGSDKYHYKLDWLAKLQSFVQAQLASYPQLVVLGDYNIAPDDRDVHDVSFWAGKILVSPPERSAYQALCGLGLTDAFRHLQPEGGYFSWWDYRLGSFQRNMGVRIDHLLSSPALTAKLTHCHIDREPRGWERPSDHAPVIAT

SEQ ID NO: 10127 - protein, 539 aa, magnetite-containing magnetic coccus
  unsure (1)..(539): unsure at all Xaa locations
IFDITDRKQMEHTLHQNRTRLQAAVVASRAGTFYYTIENDQNSWDARMLEIYGLEASQFDNNYAAWVRCIHPEDQHSTEQAFFRALSASYHTQTYDIEHRIVRPDGSIHHLRTQAWIQRDSQGKAEQVSGLVFDITEQKEVETTLRLAREQAESANRAKSDFLAAMSHEIRTPMNAVIGMGEVLLETKLDQEQRHYIETLQHAGEALLDLINAILDLSKIESGRMELVEQDFDLHKMVVETCQLFQVQCRKQGIELNLNWEESNPTYIHGDQARIRQILFNLIGNAVKFTDEGSVTVEIRSIEQEKTLLFKITDSGIGIPADKQETIFQKFSQADSSLSRRHGGSGLGLTICRHLVEHMKGRIWVDSEEGQGSCFSFTLPCRPTAPKAEIISNPHDAQQKQSKKARILLVEDSKDNQILIRTYLKREPHSLVVAWDGEEALTRFNEDGPFDLIFMDMQMPIMDGYAATAHIRALEQARHLTATPIVALTAHALQGDEQRSLQAGCNAHLTKPIRKAHLLAAIRDHANPSXVTPEPRSNP

SEQ ID NO: 10128 - protein, 414 aa, magnetite-containing magnetic coccus
KAAIAQEKLNREILIEKESQIIAAEILNKEKSLFIANISHEIRTPLNAIIGLGELLQEEITDFEHKRQLNILTSAGDNLLLLINDILHLSKIESGSMLIEENIFSLQNLLNNTVGMFEQGASKKGLYLKVEVKNALPSFVKGDIHRLRQVLFNLLGNAVKFTSCGGVTLTVSALENDRLSFSVSDTGIGIPSSLQEKIFLPFQQADSSITRKFGGTGLGLAITQSLIVQMQGNLSVESHEGTGSTFTFDLPLPETDPPQNHLLNSSSDNSIASPAVDRRQWERQKICADSTANKPAKRILLVDDSEDNRSLIQAYLRRYPHALTTAENGKEALTLVKEKHFDIIFMDIQMPVMDGLSATRAIRAWELTQQSNRNVPIIALTAHVMLEDEKKSIDAGCNFHLTKPIKKARLIDII

SEQ ID NO: 10129 - protein, 380 aa, magnetite-containing magnetic coccus
EETELALRVAKERAEAASQAKSEFLAMMSHEIRTPMNAILGITELLQEQPSKKEQLEFLTVQAKAGQALLTLINDILELSRLEAGREQLQTAPFDLYELLRSVSTLLEPSAKHKGLSVHLEIAEGLSPNWIGDERRLRQVLINLVGNGIKFTNRGSIWISAQPMANGLEIRVKDSGAGINPRHHDKIFERFHQVDSTATRKHGGTGLGLAITKKLMDLMGGEIRMESQPDQGSCFTLALPLSEAPCALPAAEEAALPPLDVTAPLRALKILLVEDSADNALLIRSFLKSTPYHLEIVEDGQQALDRLQDSNFDLVLMDMQMPVMDGYTATSQIRLREALDELPPSIIIALTAHALKGDREKCLKAGCDDFLTKPIRKKQL

SEQ ID NO: 10130 - protein, 1074 aa, magnetite-containing magnetic coccus
MPKRTDLKKIMLIGSGPIVIGQACEFDYSGAQACKALKEEGYEVVLVNSNPATIMTDPELADRTYVEPITLASVTRIIAKERPDAILPTMGGQTALNMALNLADAGVLEQYNVELIGASRDAISKAEDRERFKQAMDDIGLEMPKSGFAHSMEEAWEIQTEVGYPTIIRPSFTLGGTGGGIAYNSEEFEEIIRRGLAASPTTEVLVEESVLGWKEFEMEVVRDRLDNAIIVCSIENFDPMGVHTGDSITVAPAQTLTDKEYQILRDVSIAVLREIGVDTGGSNVQFAIHPENGRLVVIEMNPRVSRSSALASKATGFPIAKVAAKLAIGYTLPEIMNDITGVTPASFEPTIDYVVTKIPRFTFEKFPQASALLTTQMKSVGEAMAIGRTFKESLQKALRSMEIGLDGFGEILDVADESWEAVLEERLHNPGPDRILYVAEAFRQGKDLEWLNRVTAIDPWFLDQIQQIVEAEASIRGVSFENISIPRLRELKEMGFSDARLARLTQTSDTAVRTSRLTHGVVPVFKRVDTCGAEFASQTAYLYATYEQVCEAAPSSRKKIMILGGGPNRIGQGIEFDYCCVHAAFALRDVDYETIMVNCNPETVSTDYDTSDRLYFEPLTFEDVMTIVDIEKPDGVIVQFGGQTPLKLAKRLEAAGVPIIGTTPEAIDVAEDRERFQVLLQKLGLRQPPNGIARSEQEAIREAEAIGFPVVVRPSYVLGGRAMEIVHDVKDLERYMRTAVQASPDHPVLIDHFLRDAIEIDVDCIADGKTAVVAGIMEHIEEAGVHSGDSACSLPPYSVGLDLINEIERQTKMLAAALEVKGLMNIQFAIQKGAVYILEVNPRASRTVPFVSKATGVPFAKLAARVMAGESLQELGLTHSPKLGHVAVKEAVFPFEKFMNVDPVLGPEMKSTGEVMGLADTFGAAFAKAQEGAGVYLPMAGKCANQRIFISVKDEDKHAIVMPAKRLVEMGYKLSATSGTARFLEGEGVPVETVNKVTEGRPHIVDQMKSNEVALVFNTTQDKRALEDSFPIRRTALMSKIPYFTTVAGMRAAVSAMEAMRAGDFSCKALQDYY

SEQ ID NO: 10131 - protein, 374 aa, magnetite-containing magnetic coccus
  unsure (1)..(374): unsure at all Xaa locations
RAVLVLEDGTRFDGRSLGAQTEQVGEVCFNTSMTGYQEIMSDPSYAGQIVTMTYTQIGNVGINPEDMESRRPWIRGFIVKESARRFSSWRAQESLSVFLTRHNIPAIEGIDTRALVSHLRDKGAMRGVLSTLDFNTENLIAKAKSFPGLAGMDLTGEVSCQTPYPWQQGLWDLEQGYRQIESGSNRKRVTVMDFGVKHNILRGLVQAGCDLTVVPTDTPAEKILAGNPDGIFLSNGPGDPDAVKHGVRTIRALLETKIPIFGICLGHQMLCLALGAQTLKMKFGHRGGNHPVQNLSTGVVEVTSQNHGFVVSDSALPDTLEVTHRSLFDGSVEGVRMKDKPVFSVQYHPEASPGPHDAHYLFKQFADLMRXSKG

SEQ ID NO: 10132 - protein, 322 aa, magnetite-containing magnetic coccus
MNTIAVMTSGGDAPGMNSAIRAVVRTAIGAEMEVLGIRRGYSGLLEGDLIPMDAASVGNILQKGGTVLGTSRCAEFLKPEIRQEAANILRRKHVDGLVVIGGNGSFNGAYQLHQEHDIPVVGVPGTIDNDIQGTHYTIGFDTAVETGVYAVDKIRDTANAHDRIFLVEVMGRHSPAIAIHTGVCTGAEHVIHTPENTDYDTLVSGIRRGRKRGKNSFIIIVAEGQVPGSAYQVQKHLADNYQIASHVAILGHLQRGGSPTAHDRFIAASMGFHAVQALKTGEVATVTACRDGRIQLVPLQECLEKNDAIDAFSLNLTQQLAI

SEQ ID NO: 10133 - protein, 463 aa, magnetite-containing magnetic coccus
NTKGAPHSGSMAVLTALQARLGAHKVLRDGAHLESYAWDNTGLYARPDGVVLASTLHDVQTTLALCHAHRVAVTPRTAGTGNVGGALAVEGGIVLSLQRMNRILEINPADRLVVVEPGVVNADLQDQLSAHGLFWPPNPSSSKSCAIGGNLAMCAAGPNAVRYGVVRDWVLGLELVTAEGKVMRTGSRCSKSVTGYDMTRLLLGSEGTLGVITQAILKLTPKPAVQLTMRVVYASVTAAAQAVSAIMAAGVPPSALEFMDSSCLGLLRQAGMAIPAQGAALLLLEVADEVTRVEGEVARLQEILQRYAPLELVVARQAAQAKAVWAARYALSPLLKNLAPKRVNEDVAVPVSRLPELIEGLQRIAERVDLPIVNFGHAGNGNIHVNLLVDPEDSVVMARLPDALDRVFDLVVKLDGTLSGEHGIGYQKRDYLGWELDAENLAMQRRLKALFDPNGILNPGKLF

SEQ ID NO: 10134 - protein, 301 aa, magnetite-containing magnetic coccus
MMACVVQATDLTKQYQNTPVVHGINFEIHGGECFGILGPNGAGKSTTMRMVTGLSPVDGGELLVFDQPMTPEATQVRRRLGVVAQEDNLDDDLLVWENILVYGRYFQLSDRQIKPRIQQLLAFAKLEDRANAPVRTLSGGMKRRLVIARALVAEPELMVLDEPTTGLDPQARHLIWQRLRQLREQGITLLLTTHYMEEAAQLCDRLLILDSGHILDQGTPLELINRHVEPEVVEVRSSIPLLLAELPKLPARLEQVGDTLFCYTHEARAVLEKLGNRHDLTLLARPANLEDVFLKLTGREL

SEQ ID NO: 10135 - protein, 426 aa, magnetite-containing magnetic coccus
FKVADIGLAAWGRKEIEIAETEMPGLVSLRSEYGAEQPLKGARVAGCLHMTIQTAVLIETLTALGAEVRWSSCNIFSTQDHAAAAIAAAGVPVFAWKGETEEEYVWCVEQTIKGPDGWVPNMILDDGGDLTEILHRPEYVEIMKGVRGISEETTTGVLRLYEMAQKGKLECPAFNVNDSVTKSKFDNLYGCRESLMDGIKRATDVMIAGKIGVVCGYGDVGKGCAQAFRGLGAVVWVTEIDPICALQAAMEGYRVVTMEEAASQADIFVTATGNRDIITRAHMEQMKDQAIVCNIGHFDSEIDIASIRELKWDNIKPQVDHVTMPSGNRIIVLAEGRLVNLGCATGHPSFVMSNSFTNQVMAQIELFNRGEMYENRVYVLPKHLDEKVARLHLAKVGAKLTTLTQVQADYLGISVDGPYKSDHYRY

SEQ ID NO: 10136 - protein, 379 aa, magnetite-containing magnetic coccus
LFSSESVSEGHPDKMADQISDAILDALLAQDPLSRVACETMVSTGFCTIAGEITTKAVIDYQKIARETINAIGYTSADTMGYSGDTAAIFVALDKQSVDIAQGVNEGEGIDLDQGAGDQGIMFGYACTETDVLMPMPIYYAHRLMEKHAELRKSGELAWARPDAKSQVTVRYVDDKPVSVEAVVISSQHSPDVDHDTIEKEIIEKVIRAVIPAELLHEGTQYFINPTGRFVIGGPVGDAGVTGRKIIVDTYGGMGSHGGGAFSGKDPSKVDRSSAYMGRYVAKNIVAAGLAEKCEIQVAYAIGVSQPMSVMVDTFGTGKLDDEAITELVKKHFDLRPKAIVQQLDLLRPIYKKSAAYGHFGRELPEFTWERTDKAAALR

SEQ ID NO: 10137 - protein, 531 aa, magnetite-containing magnetic coccus
WIAPTTSLQQLIVDLTHAKELAESANRAKTAFLAMISHEIRTPLHGIRGMTQLLLGTETNPQQQKHLHAIEQNNRALQQIIDDLLDLASLDAQTLEIKAQPFDLLALVEQVMTVIMQQSDTKNLALGYHLPQPLHGSYLGDGPRIGQVLLKLLGNALKFTARGSITLDLALISRHETQHLIRFSVQDTGIGIAPELQEALFERFAQADDSASRRYEGAGLGLSIIKALVARMGGAIHLTSQPSQGSLFWFELPLQPLPSNGPAPLPNLTHSHLLYWHGNSIVGELQRNLLTPYFARVTLVMDEEQTLRSLWRLHAQGRPVDLLLLDHPNAVMAQELRRKLRKESPFEHLPMLLLHPHSPWATAPSMEGLHTLERPLRLRPVLHKLDQLLHGVESTPEPPVDEPQALPSLQILVAEDNLVNQQIAAGYLTRLGHRYQFAKDGIQALNLVQKGGFDLILMDVRMPDMDGLEATRHIRALPKPWCDIPIVALTANVFEQDRQNCREAGMDGFLPKPLDLSQLEQALRTHLHSTP

SEQ ID NO: 10138 - protein, 714 aa, magnetite-containing magnetic coccus
QVLGVMVLYLAHGHEQKERETAFLARAGHIISMGLMRRRAAKELSCAKQRAERANHAKSDFLATMSHEIRNPMNAIIALSHLALEQSHDQRQRDYLSKIHTAGQSLLRIINDILDFSKIEAGKLEIEQTDFQLDDVLSNLATLTAVKAQEKQIELIFDKAPALPHALRGDPLRLSQILLNVVGNAIKFTEQGEVEMSITRHTQRGELLELCFTVRDTGIGMNEAQIAELFRPYQQAESSTSRRFGGSGLGLSISHQLVTLMNGTIQVSSTPGVGSQFVITLPFAVLPDRPESLVIPKLLTGQVVVASANQRMCDVVAENLGRFGLTCASVGAMSTLHQWLENNPLPRFMVLDADMLPVSMAQDLELLLNPMLHRFVEGGVLMLHGYQTQQAVMDLAAKDARVGAVQKPVTSSSLYDGAVQLLGVGSLSDAQHAPVQSNASPTTWPQLTGRHMLVAEDNAINQQIIQELLSKVGVNVTLVNNGFEAVEKANPLHHDAILMDLHMPLMDGFEATTQIRQRFGNTLPIFAMTASSTPEDQKQVQQSGMNGHLTKPIDPVLLYTNLSQWLGEQPPKPPSVSSPQPAQPQPADSLQSVPGQPGQRSPAGPPNIPGINYTLGLQQLGGDAELYHQILLAFEQDQRETSAKLIQLLEAGDLAALEPLVHTLKGLLGSVGAERLRARVIALETSLKMAQPKENIAALIQTMQAELAPMLAAI

SEQ ID NO: 10139 - protein, 348 aa, magnetite-containing magnetic coccus
VRPEILAMAGYTPGEQPKPGEQVIKLNTNENPYGPPEAVKQAMHAAIHDNLRRYPSPDGYGVREAAARVLGHGLTPEQIILGNGSDDLLTMLLRTFIDPGQVVASMEPTYTLYEALVTIQGGCYRSVPWQPDGGLPLEGLVALQPKLIFVTRPNAPTGHVVPLEQVAALCQAVAQSAVVVLDEAYGDFAEDHGLPLLAAHPNLIITRSASKSLSLAGMRIGIGFMHADVALQMHKVRDSYNVDRVAQAALLAAYENWSDYAPLIARIKQQRQWTTTQLRKRGFEVKDSYGNFVLARVPQGGLDGLQWLESLKKRGILIRYFGSIPQLSEFLRITIGTEEEMALLMTAI

SEQ ID NO: 10140 - protein, 120 aa, magnetite-containing magnetic coccus
MSIPQELYYTKDHEWLRKEGDEVVIGITRFAADQLGDVVFVELPQVEDTLQMGGTFGVVESVKAASDLFSPITGQVIATNPDLAEAPELVNEDPYGKGWMLRLKPEDPAQMDALLTAQAY

SEQ ID NO: 10141 - protein, 880 aa, magnetite-containing magnetic coccus
VYVFGNGQAEGDAGMSHLLGGKGANLAEMTRLGIPVPAGFTLCTEVCGLYLQKRRYPELLKEQVNEALLKVQSAMGAGFGSGDDPLLVSVRSGARVSMPGMMDTVLNLGLNDHTVQGLIKRTGDARFAYDSYRRFVQMYADVVLGVDHHHFEAMLNALKQQTGKVQDTDITADEWKSLVAQYKNKVLEVTQKPFPEEPQDQLWGAIGAVFDSWTIPRAITYRRLNEIPESWGTAVTVQAMVFGNMGTDCATGVAFTRDPSTGHNRFFGEYLINAQGEDVVAGIRTPQQITLEGKRLNGSTLPAMEEAMPELYKELYAVQNRLEMHYREMQDIEFTIQRNKLWLLQTRTGKRTAKAALKIAVNMVHEGLINTREAVSRVSPESLNQLLHPTLDPKADKRIIAKGLAASPGAATGRVVFEADEAEQWAATGQMVILVRDDTSPEDIHGMHSAKGIITARGGMTSHAAVVARGMGRPCVSGCAGLSINMENEQFSVGGVTVAKGDWVTIDGSTGEVMLGQVPTVPPELSGDFTAFMEWVDGFTRMKVRANADTPDDARMARSFGAQGIGLCRTEHMFFGAERIIHVRGLILAQTESDRMRAIDKILPLQRSDFAGLFREMKGYPVMIRLLDPPLHEFIPHDEEGQNEVALVFGMPIDKVRERVASLKEFNPMLGHRGCRLGISFPEIYEMQVRAIMEAACQLVKEEGFIITPEIMIPLVGLESELSYLRERVVAVCETVMGENSVRIPYMIGTMIELPRAALIADQLAKSGEFFSFGTNDLTQTTMGISRDDAGPFLQEYVQKNLLPKDPFISIDQDGVGQLVRLAAEKGRSTRPEIKLGVCGEHGGDPESIHFFEKVKLDYVSCSPFRVPIARLAAAQAVLA

SEQ ID NO: 10142 - protein, 700 aa, magnetite-containing magnetic coccus
YLILISPHGLIRGENLELGRDADTGGQTKYVVELARALAQRPEVGRVDLLTRRVVDAQLSSDYAEPVERLSDKARIVRIECGGLAYLPKEQLWDSLDNYADNALAYIHEQPHMPHLIHTHYADAGYVGAHLCSMLEIPLIHTGHSLGRSKRKRLLAGGLARQEIEAIYNISRRIDAEERTLAAASSVVVSTHQEIQGQYVLYDYYQPDQMQVIPPGTDLNKFYAPQGDEAQSDIAKQLARFLTHPDKPIILALSRPDPRKNITTLVEAYGQSPQLQEMANLVIIAGNRDDIRDMDAGAQEVLTSLLMTMDLYDLYGKMAMPKHHQADDVPQLYRLAALSKGVFVNPALIEPFGLTLIEAAACGLPLVATEDGGPIDIVSNCKNGLLIDPLDGEAIAQALMDILSDQGQWQRFAQAGQQGVRAHYSWQAHVEKYLAMIQPLVEGSRPLQRMCLSRRPAHYREAAIITDLDQNLLGDDTSLSAFVALMRQYRKQVSFGIATGRNLESALSVMRKHKIPQPDVIMANLGTEVYYAPDLLLDSAWKKHINHLWFRHEIVEILSQVPGLSMQPKGSQSPFKISYYMDPNVAPDLQEINRILHQQEQTVNVIFSRGQFLDILPHRASKGYALRWVSAQLDIPLENMLVAGGSGADEDMMRGNTQAVVVGNRHDEELSTLAEVDKIYFAQQSYAAGIIEAIDHYDFF

SEQ ID NO: 10143 - protein, 605 aa, magnetite-containing magnetic coccus
KVLYGNRNDFNEQMKRLVETMARQYIARPAQYRESDLEREKDHTWFLHQQWVGMALYSDGFANDLQGLNTKLSYLQELGINMIHIMPLLDCPPNKSDGGYAIRDFRKIDSRAGTLEDITTLADSMHTRGMLLTLDVVLNHTSDEHEWARRAREGDSDYQNYFYVFKDRSMPDLFEESMVEIFPQTAPGNFTWSEEMGRWVMTSFNSYQWDLNYSNPSVLIEILDIILYWANLGADIMRLDAVAFLWKKIGSTCQNQREAHLILQLLKDCCQVTAPGVLFIAEAIVSPLEITKYFGEDAINAKECEIAYNATLMALLWDAIATKKAELLYRGIKSLPDKLERATWLNYIRCHDDIGLGFDDTDIRQAGYEPFAHRRFLVDYFTGGYTDSPARGRPFGQNDKTGDARISGTLASLAGLESALYEGNEEAVHTSIQMILLLHSVILSFGGIPLLYYGDELGTLNDYSYEQQESKREDSRWIHRPTIDWDKAELRNQPGSVEYRLFNALKKMIAVRKEIPAFADFNNREMLDLGNPHLLAYARFDFMHASAKVLVICNFDLKPQYVELEQLRQLGFLKSHNLRDASTGESPQRFNDQLAIPAYGFYWLM

SEQ ID NO: 10144 - protein, 503 aa, magnetite-containing magnetic coccus
KPMTLVILDGWGLRDTQENNAIANASTPHMDDWLANRPHAQVRTSGRDVGLPDGQMGNSEVGHLNLGAGRVVYQEFTRVSCAIEDGSFMHNQVLLDAIRAANEAGGAVHLYGLLSPGGVHSHQDQILAAVQCAKQNGASEIYIHALLDGRDTPPQSAMEYMTRFEEGLQKLGAGRVATVCGRYFTMDRDKRWERVERGYRLMALGEGTPFDSACEAIQAAYDAQQTDEFVEPAVMVEQGQPIGMINDGDTLICMNFRADRVREISHVFTDTTFEPFVRDGLPKLSAYVCLTQYDVSLQNVQIAYPPVALTNILGQVMAQHGLTQLRAAETEKYAHVTYFFNGGQEQPGEGEDRLLVASPKVATYDMQPAMSAAELTDRVIEKIQSTPYDLVVVNYANPDMVGHTGVYEAAVQAIETVDTQLGRLTDAIVQMGGEVLITADHGNADQMVDEQGTAHTAHTLNPAPLIYLGRDAQLHDGRLSDVAPTLLALMGLPQPLEMDGVSL

SEQ ID NO: 10145 - protein, 210 aa, magnetite-containing magnetic coccus
MARLEVENIHYGFGRHKVLKGIDLTAEDGECLVLFGVNGAGKSTLLNILALRYRPKRGSYRLNGQEVWDNPDYSRSQIVTIAHHSHLYGHLTPVENLQFFSAMRDLERTDEQIKQCVRDVGLSRFLHRPVKGFSAGMRKRVALARVLLANPPLLLLDEPYSALDHQGVQWLNKILNAYIKEGGTLIIVTHDPDRVAALPYRALRVSKGLL

SEQ ID NO: 10146 - protein, 428 aa, magnetite-containing magnetic coccus
RLRLALEELGPTFIKFGQTLSTRLDILPDEIGQELKRLQDDVPPFDLATVRQSIEEDLKRPLHELFRSFDEKPVASASIAQVHHAFTHDGDEVAVKVLRPDVAARVETDIAMLMTMASLVEELMPEWRRLKPRGVVKEFAQTIRNEMDFLVEASRAQKLGENFKDDVGMMIPQVYWPLTSSRVFTMAWIEGVSIDELPRERVAGRPDPRVVAERLLSSFFKQVFHDGYFHADQHPGNILVREDGVVALIDFGIVSHVSEQTRQFLAEMVQGFITRDYKKVAQVHLDAGYIPHDTDMDAFEEACRQIGEPVFGQPLKDISVARLLAKLFKTTEQYNMEVQPQLLLLQKTLFTLEGVGRELHPDLNAWEIAEPLVMAWMKARIGPKGQLLKLRRQLEEMGYAMGAAPEMAFQVFGAGRQRPFSHSPPCQL

SEQ ID NO: 10147 - protein, 644 aa, magnetite-containing magnetic coccus
LELQSASQDIWDRKYRLKSKGGDPVDKTIEDTFKRVARALALVEQEPLQEQWYQRFLWALMQGAIPAGRIVSNAGARDHKPATSTINCTVSQTVKDSMDDILAAVHEAGLTLKAGCGIGYEFSTLRPRGAFVAGAGSSTSGPLSFMDIYDAMCRTVSSAGGRRGAQMATFDITHPDVVDFIRAKREDGRLRQFNLSCLVTEQFMEAVKSDMDWELVFPANHYELDDPTVEIVYRHWPVTEGYKTNEQGEVACRVWKSIPARRLWDVVMSSTYDYAEPGFILIDKVNEQNNNWFCEDIRATNPCGEQPLPPYGACLLGSVNLARFVKNPFTAKAEFDWARFKEVVAVFTRMLDNVVEIHGLPLPGQADEIAHKRRHGMGFLGLGSTLTMLNMVYGDRQSVEFTSQVAREMALTGWEVGLELANEKGPAPVMNQMYTITEAMMAKRPEMANDGICVGDQLPGKVLMARYSRYMAKFPERLRKRIETEGSRFSHHSSIAPTGTISLSLGNNVSNGIEPSFAHKYSRNIIREGRKTKEKVDVFSYELLAYRALVNPDADPYAEEEKNLLPATFLDSNAINPRAHVDIQAAAQEWVDSSISKTINVPTDFPYDEFKDIYLYAYEKGLKGCTTFRFNPEAFQGVLVKEED

SEQ ID NO: 10148 - protein, 680 aa, magnetite-containing magnetic coccus
  unsure (1)..(680): unsure at all Xaa locations
LHHLNAPQRQAVTTLDGPLMVLAGAGSGKTRVLTRRLAWIIQQQQASPEEVLAVTFTNKAAKEMRNRVQALLGLDAPAQAHRFWIGTFHGMSARMLRQYADRLGFERDFTILDSSDQERLFKRLCEELGFADAYWTPKRLTHTIGRWKDDGIRPQDLTDREIRKAWERARIQQMYERYQQALLQSNAMDFGDLLLHCLQLWQQEPAILAAFQQRFRYLLVDEYQDTNHVQYRWICALSGLHQNLCVVGDDDQSIYSWRGARIENILKFEEDFPQTKIIRLEQNYRSSGNILKAASGLINHNKGRMEKQLWTEDAQGDAIHFYQAENDEDEARFVASEILTLCPAGDYQQAAILVRTARQTRSLEEGLMRAGIPYQVVGGLRFLDRAEVRDALAYLRVVASNRDDVAFERVINLPKRGIGPGALQSLREIASQERCSLLHAARFAVESNTMKGAAAKGLAAFIQLIEHARSMLADDITPAEMLTKLLALSGYRDYVRDLEKGNDRIDNLDELRNALARTESLQLFLEEVALATDLQDGGPVANRVVISTLHAAKGLEFPWVFLVGVEEDVMPHKLALTEQPEIGLEEERRLAYVGMTRAKQRLYLTMARRRWLFNKPVMPIKSRFLKELPQEILEDRGFRVSSRRGATGSLAGLPGGSLHHQKVRFPLRXAGTNSRLWGAG

SEQ ID NO: 10149 - protein, 266 aa, magnetite-containing magnetic coccus
QRSVLITGCSSGIGACVAHGLRERGYRVFATARQEADVQRLMSEGFESYLLDLTDSDTIANALEAVLYRTEGKLYALFNNGAYAQPGAVEDLSRACLTASFETNLFGWHDLTVRVLPIMRAQGYGRIIQNSSVLGFTALKYRGAYNATKFALEGLSDTLRLELHGSGIYLSLIEPGPIHSRINANALQAFERWIDPQHSTHREHYVQQLPRLLDQQHAAYKLPPEAVLKRVIHALESDRPRRRYPVTMPTYLFSVLKRVAPTAFLD

SEQ ID NO: 10150 - protein, 289 aa, magnetite-containing magnetic coccus
MFKGVYTALITPFKNRAVDYTALAKLVEQQINGGIHGLVPCGTTGESATLSHEEHKAVIRTVVELVQGRVKVLAGTGSNCTEESTELTCYAEEVGADGALLITPYYNKPTQAGLIAHYTTVANHTKLPVVLYNVPGRTAVDMHADTVIALSKVSNIVAIKEATGNMERASQIHKGAGSSMTLISGDDATFLPFLSVGGQGVISVTTNLAPRLVRDLWDLWHNGQINEAREVHEQLLEINGLLFCETSPIPVKAGAAMLGLCHNELRLPMTAMSEANQAKLHRAMVKLNL

SEQ ID NO: 10151 - protein, 279 aa, magnetite-containing magnetic coccus
AHVIDGKAIAQSVREELRMEVERLKLNHQLTPGLAVVLVGADPASQVYVRNKKRACETAGIASFSHELAATTSQAELLALIEQLNQDDAVHGILVQLPLPKHIDEQKVLEAISPSKDADGFHPYNVGRLVTGDPTFQPCTPWGVMEMLKVSGVDPKGKHAVVIGRSNIVGKPVALMLLAAHATVTICHSRTPDLAETVKRADIVVAAVGRANMVPGSWIKKGAVVIDVGINRGEDGKLCGDVDYASCFEHASAITPVPGGVGPMTIAMLLKNTVEGAKR

SEQ ID NO: 10152 - protein, 529 aa, magnetite-containing magnetic coccus
INRKKVERTNIILQSEVLRRQATETAYRECESRHEAKRVFIAKMSHEFRTPMNSMIGMLDMLEGTPLSEEQFEYIDSMRQATDHLTSMVGNLLDITQLEAGIIKIKEKPFSLIALVKNVINIIRPLAFKKKILFIPYISPDIAPWFIGDANRLQQILVNLLGNAIKYTHWGSVALLISAKPVNSRYNVEFKVVDTGDGIDLENQEKIFQAFVRGAYNNAETTEGTGLGLSICKNLVDLMQGTIELKSTPQHGSTFSVSIPLTRYTAPVQTGKEKKLQGVNLSILTDHLVQGMLFEEQLTRHGAHSHLCFNGQSIAACFAEEKDTDLLIVHHDNTSKKKLLQGFEKFKQEVTDCKAKILICGRCYQRDDMEALADRGVSIFPDFHDEDELIDKIQSVLGLHKNRKKPDPLDAKKRVLIVDDSEDNRVLLSHYLRDYACEIIQAVDGHEAIDTYIASRHSLDLVLMDLQMPGLDGLSATQKIRAWEKAHRVAKVPIVIISAHATESHRDASLNAGSDAFLNKPIRKKTLKR

SEQ ID NO: 10153 - protein, 292 aa, magnetite-containing magnetic coccus
  unsure (1)..(292): unsure at all Xaa locations
QVEKVKVLIEALPYMRRFEGKTFVIKYGGNAMVDEDLKSAFAQDVILMRQVGINPIIVHGGGPQIGLIMKRMGLEPKFIDGLRVTDEDTMSVVEMVLAGKVNKDIVNLINLNGGRAAGLSGKDGYTIQARKRTHVRKGPDVQVPEIIDLGWVGDVERIETNLLDRFRASDIIPVVAPVGVGANGETYNINADSVAGHIAIAMQAEKLILLTDVPGVQDKNGTLINQIDETDVDKLIRNGTVTGGMIPKLETCRTAHTGGVNASHIIDGRVEHALLLEIFTDSGIGTVLRXVQ

SEQ ID NO: 10154 - protein, 631 aa, magnetite-containing magnetic coccus
PNVAANALINEEQYQEMYKRSIDDPAAFWAEQAEARIDWFKKWDNVLDFDLRKGHIKWFEGAKLNVSYNCIDRHLEKRGDKVAILWEGDNPAADRKITYRELSALVNKFANALKARGVKKGDRVCIYMPMIPEAAVAMLACTRIGAVHSIVFGGFSPDALRDRIIDAECRVVITADGGMRGSKKIPLRKNVETALAQCPNVHTCFVVQDTQLEIEWTEGRDVWYHEAIAAASADCPPEEMDAEDPLFVLYTSGSTGKPKGVLHTTGGYLLYASITHQYIFDYHEDDIYWCTADVGWVTGHTYIVYGPLANGATTLMFEGVPTYPDASRFWQVVDKHQVSIFYTAPTAIRSIMSQGDALVKATSRQSLRILGSVGEPINPEAWEWYYHVVGEGRCPIVDTWWQTETGGILITPLPGATPLKPGSATRPFFGVNPKVLSNEGKEMEGPCEGILVLDHPWPGMMRTVYGDHDRFINTYFANYPGYYFCGDGCRRDEDGYYWITGRVDDVINVSGHRLGTAEVESALVLHDQVAEAAVVGMPHEIKGQGIYAYVTLMSGVEPSDALKTELVKLVRKEIGPIASLDVIQFAPGLPKTRSGKIMRRILRKIAAHEVDTLGDTSTLADPSVVQNLIDN

SEQ ID NO: 10155 - protein, 422 aa, magnetite-containing magnetic coccus
MSRSASLFQQAAGLIPGGVNSPVRAFKSVGGIPPFIREAAGAMMTDEDGKSYIDYVGSWGPMILGHAPKEVVAAIQQAAVRGCSFGAPTSNEILLAQKLIELVPSLEMVRLVNSGTEATMSALRLARAATGRDAILKFDGCYHGHADSLLVAAGSGLATFGVPSSPGVTRGTAKDTLTVPFNDLAAVEACFAQHPEGIAAVIVEPVAGNMGCVLPRPGYLKGLRDICTKYGTILIFDEVMTGFRVDLRCAQGFYDVTPDLTCLGKVIGGGLPVGAYGGKMELMNQVSPAGPVYQAGTLSGNPLATAAGLATLEAISQPGFYETLTSRTQRLTVGIGKALDEAGIPHVSYHIGSMFGLFFTDAREVYNFADAAKNDHNRFKDWFHCMLEEGVYFAPSPYEAGFVSIAHDEAIIDLTIEKARKV

SEQ ID NO: 10156 - protein, 307 aa, magnetite-containing magnetic coccus
RHMLGMDGLARHEIGAILDSAQAFRDVNYREIKKVPTLRGKTVINLFYENSTRTRTSFELAGKRMSADVINISASSSSAAKGETLLDTVATLQAMRPDVVVLRHGDSGAPHFLARHLDAGIINAGDGQHEHPTQSLLDLLTIQDHLEEMGKSSFEGMNVAICGDVLHSRVARSNAFALRTLGANVRFVGPPTLMPSEATKVFGVTVHHNMEEGLRGVDVIIMLRLQLERMTSAYLPSVREYFAYWGLTRGRLELTQPHALVMHPGPINRGVEIASDVADNPNRSVILEQVANGLAVRMAVLYHLCTG

SEQ ID NO: 10157 - protein, 222 aa, magnetite-containing magnetic coccus
AVAGLKKRAWALEYYDAIVVALGFALLIRTFVIEPFKIPSGSMIPTLLVGDYLFVNKFAYGYRIPYTQNRILMGDGPQHGDIVVFKFPMDPSKDYIKRIVGLPGDRIAYENKRLYVNGKPLDYKIAGEYSYLNEYERRIDTLGLQENNGERSYRVLIQPNVPSAFPMEQVVPEGHYFAMGDNRDNSNDSRYWGMVPAFRLVGRATRLFWSWDHVEGRVRFDR

SEQ ID NO: 10158 - protein, 474 aa, magnetite-containing magnetic coccus
MKSIRRTKIIATLGPNASSRDFIKHLALTGVDTFRLNFSHGSHEDHRRRHGWIRSVEEELGRPLGIMMDLQGPKLRIGTFENSEVELVRGQKFALYKEERTGDINGVTLPHNELFQVMRPGLELLLNDGRINLRVMEVEDFGVCCEVRVGGILSDRKGLNVPAAMLPVKALTDKDLEDLEFGLELGIDWCALSFVQRPEDLREARKLIHGRAALLAKIEKPQAVDNLEEIVKVADGVMVARGDLGVEYTPERVPAVQKRLIRMCREQCKPVIVATQMLESMIDAPIPTRAEASDVANAIYDGADAVMLSAETAVGSYACNAVSVMDRIARVTEADPDCLQRNLHTPLTFDNSDNDAISKAARDVAMSRGCQAIVAFTKTGSTALRVSRTRASVPILGLTPDIRVARRLTMVWGVHSVNTSDVSNFAEMVGKATRICRREELANTDDRIVVIAGVPFGQEGTTNILRIARIGEAE

SEQ ID NO: 10159 - protein, 409 aa, magnetite-containing magnetic coccus
  unsure (1)..(409): unsure at all Xaa locations
SSTVSLVTPLLSVVSTVMPKEKSTLESLGALISKPSMVKVPSVAVSVTAPMGITAVPSALTVISVPSAKRISVPSGIPVRVTPVTDSDPSVSCRAKVGSLTEIHXSSRPEALPAVISTPSASGLTVRVNCEETEVVSVPPLLAPSSNTCTVTPILKTPETSPSTVAERPSRSPTERVQVPSPLSVPADRVTVSGTSEITTEVMDSEPSVSVTAAAISRGMLVASSXPTTSPTFRSGASASGLTVTVKLDEPFKESSTVTPSSPTSLRFQETSRSNLPLXSSGRSVNXMALKSTGASPVLVMVQVPSPLSVPAESCAPAGTPPMVTTRVSEPSTSAKPPLISRVMAXSSVPVVSLTVKLGSSATPVTSTEMVPLVISVSVVAPLSSMVVTRIPSSKSTLESAGAITCKPA

SEQ ID NO: 10160 - protein, 552 aa, magnetite-containing magnetic coccus
WFRMVMERFRTFFYYILGITFVITLLQVVTPLYVMQVYDRVVGSGSMSTLAFLVGGALAALGFDWGFRRMRAVMLGYVGARLDNIIDNAVFQRILYLLPAYTERATIGSQVARIRDFESIREFFTGALVVVFLELPFTVVFLLVIASLAGPLAFVPMVTMILFVILWVTMTPLVSNSGATARRFSSQKQSFIVEALNSMRAIKYCRAEDIWLDRFREMSAKAAQANFKTSFINAIVQSLGSAFIVLSGLGTIGWGVLRVLSGDMTVGGLVACMVLVWRVLTPMQALFTAMTRLEAIRASVAQVNNLMNVKPEREPHAPIKKIAQFRGDVTFSRVSIRYSQEADPALVGVTFEAKAGECIVVIGGNGSGKSTLVKLIAGIYSPQAGGIFIDGRDTRQLDPIELRQAIAYVPQTVNLFHGTIAQNLRLAHPTASQEELEDACSKATVLEEILALPKGWWTRIGDSRSSQLSSGFIQKLSLARAYLKKAPVILFDEPANALDWDADDAFQNVVKELKGKSTIFIVTHSPRHRKLADQLLYLERGYLQLAGPAEEV

SEQ ID NO: 10161 - protein, 531 aa, magnetite-containing magnetic coccus
RGVIRYVLLLSVVINLLGLALPLTLLQVYDRILPNQAYSTLQVLMLMVLAAVTLESTLKTIRTYIGGWVGARFEHRSSYLALERMLYTNLSTFEKSGSGEHLERMESLGTIKDFYAGQAMQVYLDLIFVPIFLFFIWHIGGYMVFVTIATFGFFVFAALLVGDRLKKAVKERSVADERRLNFIIEVLTGMHSVKGMAMEAQMLRRYERLQEGCANNAKQVVLESNSAQGLGSFYAQINTILIAAVGSTLVIDHQLTIGGLAACTMLSGRAMGPLQQAVGIWARWQTIRLAKERMQEIFRMQPDIHDNMEDCPEIEGKLELKNVSYQFDDDHPPLLHDLNLVVEPGEIIAVRGDNGSGKTSLLWLMMGALPATEGEVYLDDVPIRIYDPKSMRDKVSYLPQAGVLFQGTLLDNITMFREELYDAAMDVIALMKLEEVISSMPKGIDTHIDDGSKESLPKGIRQRICIARALLEKPKLILFDEANAAIDGAGDEQLKQTLEGMRGKVTMILVTVRPSLYKIADRVYDLKKGTL

SEQ ID NO: 10162 - protein, 314 aa, magnetite-containing magnetic coccus
  unsure (1)..(314): unsure at all Xaa locations
LVRIGTRGSALAVWQAEWVKSQLQAHHPGIIVELELIKTKGDKILDVPLAKVGGKGLFVKELEEAMLDGRVDLAVHSMKDVPAEFPDGLMLGPILKREDPRDALLSIHYQSLAELPQGALIGSSSLRRQSQIKAKRPDLRLDWLRGNVGTRIQKLVEGQFDAIILAAAGVKRLGLTEHVVQYLEPEEMLPAVGQGAVGIEHRVDDARIATLLAPLYHKETHSCVTAERAFLAKLEGGCQVPIAGYANPCAXXXAIXPXFKPLYGDWSPEVEGGRVVQAQCQGPRADAYRMGQQLATQLLEAGGGAILQAVYNQD

SEQ ID NO: 10163 - protein, 328 aa, magnetite-containing magnetic coccus
AVIGAGSWGTALAALLAGKLPQVTLWAREPEVVEGINQGHHNPVYLADLDLPPNLVAHQDLAWVAANHDVLVMVVPTQFCRQVLAQLKPHVRPHVTFVSATKGVETANLALISEIFTQTFAAPIAQRTCYLSGPSFAREVIAGQPVAVAMAGADEAALAAMQALFFFPHFRTYSTSDVVGVELGGALKNIIAIAAGISDGLGYGAGARAALITRGLAEIARLGHIYGANPQTFAGLSGMGDLLMTASSTLSRNYTTGFRLGQGESLSHISGSSREVAEGVQTAASTWLLAQRHGVEMPITQAVHAILFEQVPPQQAVTQLLNRDMKRE

SEQ ID NO: 10164 - protein, 509 aa, magnetite-containing magnetic coccus
EILNDPYMNKGVAFTEEERDLFHLRGLLPPRVQTMEAQLGRALDNFRCKPNDLEKYIFLTGLQERNETLFYRLVMTNIEEMLPIIYTPTVGKACQTYGHIFRRPQGMFISINDKGRIAELLGNWVHKDVRVIVVTDGSRILGLGDLGAHGMGIPVGKLALYTALAGIPPIHCLPVTLDMGTNNEALRNDPLYVGLPQPRVTGEIYDEMIEEFVLAVQEQFPRAMIQFEDFSNDNAFRLLEKYQDRICTFNDDIQGTAAVALAGILGALRITEADLCTQRYLFMGAGSAGFGIADLILRAMEQKGIPREQGLKQFRFMDSRGLVTRSRTDLRGRKSEFVCDDPPLTDLQQVVERFMPTVLIGVSGQPGVFHQGVVEAMARINPRPIIFALSNPTSKAECSAQQCYQWSDGRAIFASGSPFEPVTIAGQTFVSGQGNNAYCFPGIGLGVIMCEASRVTEEMFLVAAQTLAQMTAQSDLDQGRVYPSMQDIRAISLNIALAVVDLASKRGLA

SEQ ID NO: 10165 - protein, 321 aa, magnetite-containing magnetic coccus
KAILVTGGAGYIGSHVCKVLSQSGFLPITYDNLSEGHPWAVRWGPLVVGGLDDGAKLAGLFAQYQPQAVIHLAGRAYVGESMTDPALYYRNNVQAALVLLECMRQYGCKNIIFSSSCATYGEHRQMPITEAMSQHPINPYGRSKLMFEWMLQDYQVYGLQSVALRYFNASGADLEGEIGEQHQPEPHIIPRLLEAARKGSPFTIYGTDYESEDGTCVRDYIHVSDLAQAHLLALQWLWRGGESRAFNLGNGQGFSIRQLIKVAETVTGKSIAVQLGARRPGDPAVLVGSAEKAREELGWQPQYGTLEIILTSAWRWMQRRQ

SEQ ID NO: 10166 - protein, 433 aa, magnetite-containing magnetic coccus
  unsure (1)..(433): unsure at all Xaa locations
EALARAESANQAKSEFLAIMSHEIRTPLNVLLGMGDLLHESLLTEEQTGQLELLIKAGKHLVVLIDDILDLSKIEFGGLTLTREPLQPHRLFLLICDIVRLQAQEKGLTFNCDIPTELPPWVLGDEGRLRQIMINLLHNAIKFTQQGHVTLKIAYQPAGSLFSITISDSGIGIAAKHLNHIFDKFSQADSSISRRYGGTGLGLAIARNLVTLMGGHLTVESCVNQGSHFQLTLELPPTQPPIRPSTVALTDLATLKPLNILLAEDSLDNQTLFLTYLKPTPWQVEIAMDGQQAVERVKQGGLDLVLMDLQMPIMDGYRATQAIRHWEQTSGTTPLPILALSAHALRAEQQKSLEAGCNAHLVKPIKKKALIEAIHQNMARTTAKVSHETPXPHVKPQTRVCRSTATSSDQESLNPFFQALNLVHLLFNNRYTS

SEQ ID NO: 10167 - protein, 388 aa, magnetite-containing magnetic coccus
GFTTRAIHHGYDPYAGHGSLTPPIYMSSTYTFATTESGQKRFAGEEEGYIYARVGNPTTALLEQRLAELEGAEAGLVTASGMGATSALLWTLLKPGDEIITDKTLYGCTYAFFNHGLHKFGVTITHLDLTDPTQLAQAISAKTRVVFFESPANPNMRLVDIAAIAEIAHQHHALVVVDNTYCTPYLQRPIEFGADFVVHSATKYLGGHGDLLAGAILGPKAALTEVRFYGLKDMTGAVLSAQDAFLILRGLKTLALRMDRHCANALTLAQLLEAHPQVTACYYPGLPSFAQYTLAQRQMAQPGGIIAFELKGGMEAGRRFLDALQLITRAVSLGDTESLAQHPASMTHSVYRPEERAAHLISEGLVRLSAGLEDPEDLIADVTQALAA

SEQ ID NO: 10168 - protein, 236 aa, magnetite-containing magnetic coccus
VLELEGVAAGYGPVRVLHGVSLHVHAGEIVTLIGANGAGKSTLLMSIFGNPRPLAGVIRLHGVDIVGESTYGIARRGIAQVPEGRRIFGEMTVWENLLMGVTPLGARDGEREGRDLGWVMSLFPRLGERREQRAGTLSGGEQQMLAIGRALMSRPRLLLLDEPSLGLAPLMIKQIFAILRQIADEGVTIFLVEQNANQALQLADRGYVLVNGRITLSGSGQALLGDAEVRGAYLGG

SEQ ID NO: 10169 - protein, 258 aa, magnetite-containing magnetic coccus
LFIQTDWLQSNLERENLRIIQVGGENFYSRMHIPGAVMVGYQDITGYRDGIPGFRAETALLRKLFGRLGITPESHVVVYDASGGMDAARMVWTLHCMGHTQCYILDGGMGAWYTEKRVCTDHMPQIAPVEYRVDEDLRWDADIELMQRVVAGELEMKVLDTRSEAEYEGQTIRGPRGHIPGARHFEWMDALRTPQDPQLKDDEALREMLAGRGVENPHTDEVVVYCQTAHRAAHTWAVLRHLGYAKVRLYDGSMAEWG

SEQ ID NO: 10170 - protein, 652 aa, magnetite-containing magnetic coccus
MGKVVGIDLGTTNSCVSIMEGGEPKVIENSEGVRTTPSMVAFTNQGERLVGQAAKRQAVTNPTNTLYAIKRLIGRRFSDPLTAKDQGLVPYKIVKADNGDAWVEADGKKMSPSECSAMILQKMKQTAEDYLGESVSEAVITVPAYFNDAQRQATKDAGRIAGLEVLRIINEPTAAALAYGLDKKDGQTIAVFDLGGGTFDISILEIGDGVFEVKSTNGDTFLGGEDFDMAIIDYLADQFKKENSIDLRKDSMALQRLKEAAEKAKIELSSSNQTDINLPFITADASGPKHLNLSLTRAKLESLVDELVQRTLAPCRTALKDAGMTAADIDEVILVGGMTRMPKVQAVVGQFFGKEPHKGVNPDEVVAIGAAIQGGVLKGEVQDVLLLDVTPLSLGIETLGGVFTKLIEKNTTVPTRKSQVFSTAADNQSAVTIRVAQGEREMFSDNKTLGQFDLVGIAPAPRGMPQIEVTFDIDANGMVHVSAKDKGTGKEQSIHIEASGGLTSEEIDRMVHEAESHAEEDAKKRALIEARNNADSLVYSSEKSLKEHSDKLDDALKNQITAAIEDLKAVMPKEDPEAISSKTQALMELSMKMGEQIYKENPEAAGMDPEAAAHAAGMHGGAATGGGDGANKHGKGAEDVVEAEFEEVNDDK

SEQ ID NO: 10171 - protein, 264 aa, magnetite-containing magnetic coccus
KVGVTGVCGRMGRMLVEATHKAQGCMLGAASEYPGHTLIGADAGELAGVGKLGVLVGGDAETTFRDADVVIDFSVVEATLAHLRLALAQGTPIVIGTTGFSAAERQQIALAAERIPVVFAPNYAVGVNLLFKIAAEVAAVLGGEYDIEIVEAHHRHKVDAPSGTALGLGQAIAEAVERNLDEVAIYGRQGQTGARDPQTIGFSTIRGGDVVGDHTAMFMTDGERLELTHRASSRMTFAKGAVRAAKWVVEQKPGLYDMRDILGF

SEQ ID NO: 10172 - protein, 807 aa, magnetite-containing magnetic coccus
SEQRSDEPEVVDAIIEDQQGAQATTDATPPVRIENSLPTELVIYPLGGRPFFPGMLTPIQVEGSPYYETIKKAMDSHGRLFGILASHAEDGQEVFDANQLFGIGTVVRILEASVNEEAKQIKLLAEGLWRFEVRDVVSVGPPIVAQVTHHNNPVSVVDTDALKPYTMAVINTLKEILKYDSLYQEQVKMFLSRHNFSEPDRLADFVASMTSSSREELQEVLETLPIMARLEKVLTLLKKELEVVKLQNKIQRQVEEGIAEHQRQFFLREQLKEIQKELGITKDDRTAEIDRFRERLEKLTLSEEAEQKIEEELDKLAILETGSSEYGVTRNYVDWLTSLPWGVHSTDKLNIARARRILDRDHDGLEDVKERILEFLAVGKLKGEIGGSIILLVGPPGVGKTSIGRSVATAVGREFYRFSVGGMRDEAEIKGHRRTYVGAMPGKFVQAIKHTKVANPLIMLDEVDKIGASYQGDPASALLEVLDPEQNSEFLDHYMDVRFDLSKVLFICTANQLDTIPRPLLDRMEVIRLSGYITSEKVRIARNHLLPKQLEKNGLDKSQLRVSNGALREIIEGYAREAGVRRLEQKIGAIARKVAVKVLEEAELPISVGQNDLDSYLGKPDFREEKPLTGVGIVTGLAWTALGGATLDIESAQTSTEGNTLLLTGQLGDVMKESARIAFSFLQSNVEKLGGKSERLKGNIHLHVPEGATPKDGPSAGITIATALLSLARTQPLPRRLAMTGEITLTGSVLAVGGVREKVIAARRVGIRELIIPEACRKDYDEVPEHIREGFTVHFVKKYAEVAKLVF

SEQ ID NO: 10173 - protein, 691 aa, magnetite-containing magnetic coccus
RSEDPLLGTLLFLAHHWHLPATVQSLTANLPLTEAGLTPELFLRAAEQAGLKAHIRKQPLHALHTEHLPAVLLLHGRMAVVLLGWDEDEAHLLLPESGRETRLDRQALDERYEGHAILVSPMFKHDARTSFIGNPTTGHWFWSALFRYWPIYSEVAVASLLINLFTVASSLFVMNVYDRVVPNKAMETLWVLALGVAIVYCFDFLLRTLRAHFLDTAGKRVDIVLASNIYRHVSGMQLSYQPQSTGAMARNLQEFEPLRDFFTSATLTAIIDLPFTLIFVVLVAQLGGLNVAMVPLVCMPVVILVGLLLQAPLNRVMNRALKESAQKNAMLVETLGRLETIKLNNAEGHLAGKWENCIIETAKTAQQSRFLSTLGVNFAMLVQQFSSVAVVVVGVYAINAGEITMGALIACTILTGRALAPLSQVAGLMVRIQQTMISLRTLNQIMNTPQERPEGRTFLSRPRLSGKIQLKDLSFQYPNAKTAALQKLNLLIEPGEKVGFIGRVGSGKSTLLKLLQGLYPPTEGLVLVDDMDARQIDPADLRRNMGCVTQDAGLLYGTIRENITLGAPFADDSTLRRAVEQGGVAAFTDRHPDGLDLVIGEQGQGLSGGQRQCVSIARALIHNPPILLLDEPTSAMDSGSEERFKKVIEDTLPGKTLLLVTHRASLLSLVDRVVIIEDGQILADGPKEAIL

SEQ ID NO: 10174 - protein, 140 aa, magnetite-containing magnetic coccus
MTIERTFSIIKPDAVAKNVVGEIQSRFEKAGLRIIASKMIRLTPEIAGKFYEVHKARPFYNDLCSYMSSGPVVVQVLEGDGAVLKNRDIMGATNPKDAAPGTIRADFAESIDANAVHGSDAPETAAQEIAFFFSGTELCD

SEQ ID NO: 10175 - protein, 333 aa, magnetite-containing magnetic coccus
MSVTIGINGFGRMGRLVLRAGWNSPGIIWGPINETSTDAHGSAHLLQFDSVHGRWQHPCTAQQGEICIEDSRIPYHSVADIDAHHWSTCDLVIEATGKHHKQPHTLQRYFEQGVKKVLVAAPTEGALNLVYGVNDHLYQPQQHHLVTAASCTTNCLAPVIKVLHEKIGIVHGTMTTIHDITNTQTIVDKGHKDLRRARACGNSLIPTSTGSAKAITKIFPELTGKLNGVAVRVPLLNASLTDCVFEMAKPVTESAINTLFKEASESYLHGILGYEERPLVSVDFLNDPRSAIIDAPSTMVIDGTQLKVLAWYDNEWGYVNRLMDLALKIANTL

SEQ ID NO: 10176 - protein, 713 aa, magnetite-containing magnetic coccus
IIGLKKIFAQALRSQPQLLELTILNDDGKPLFSSTREQAPNTTLTHFRTPIMVQGSFQGILVGAWDLAPDLRAIDTHVNHILLLTSLLFGLITLMVIFMVHRLAIQPVDAIYNRLIKQISPPQSKPETFHAARELRRLHQTVESFSRTAASHLENARTLQESEALLKQRVERRTRELRLAKEAAEQANLAKTEFLATMSHEIRTPLNGVLGMSDLLLESDLNSYQRHHVETIHRSGRTLLRVINDILDLSRIQAGRMPLEVTAFKLRACLEDVQALFKDQARRKGLSFSINCQEELPQRLLGDATRLNQILFNLVGNALKFTERGFVRVSVQAEQVREADLLLRIQVEDSGIGISDEYKNRLFEIFSQQDSSISRRYGGSGLGLVITRKLAQIMGGKLGFSSRSGAGSTFWVTARFGRVPDTLPDHPLLPREEQQSNLLNQRFRAHILLAEDNPVNQDVARLNLERLGCRVTLVENGQQAVTVFQENRFDLVLMDCEMPIMDGYTATRTIRDLERQQGRRATPIIAVTAHALASHRNKAIATGMNDFLSKPFSTTKLIKLLATYLPPHTVIAQPDPAPPVVTQETAPSADPAHKTLDHRALDQIRALDPADPQGMLNRMIDLYFEQSAKDFKAIENGLATQNAELIRFHAHKLKSSSAQMGGQQLSLLCRTIEEQCHTFTRVEESMSQASKAQHELCAALHALRQTAPPTPPS

SEQ ID NO: 10177 - protein, 550 aa, magnetite-containing magnetic coccus
RADGSFFSTEFWSHPIQQNGELVGAVVTFIDISQRVLNQTALKASELKYRTIFESVPTPLLILDTSGVVRDVNSAHQSTFGRFAGGSLMGVSIREHPGVAGSLLAESFLALAKGEPMPLQQASYTMEAEGEAIHFNVRGVPFVTRDGEGREDLQGALVIHENITDLKQTELKLRKAVEEADCATHAKGDFLAVMSHEIRTPMNLVVGMAELLLETDVNAEQKHYLEKLQKAGDTLLSLINNILDLTKLDEGQLKLLDEPFAPQALLDEVSGIISLAAEAKGLTLSCEIQEGVPERVLGDSVRIKQVLLNLLSNALKFTQQGFIRLSLTVEGAEGAQQLCYAVSDSGMGIPDYHLDEVFERFSQGDSSMTRRFGGSGLGLAICKKLVILMQGQIQVSSQVDVGAIFQIRLPLRAAALAPASSQQQVKRRLNQGVRVLLAEDAVDNRMLIQAYLRNSPHDLVMVEDGQQALQLIEEGTDFNLILMDVQMPVMDGYSATRAILAELGAQQRPPCPIVALTAHALEGDQARSLQAGCVAHLTKPIKKKILLEAI

SEQ ID NO: 10178 - protein, 4327 aa, magnetite-containing magnetic coccus
  unsure (1)..(4327): unsure at all Xaa locations
MRPPWRSCRPLIRITGALTYGAGLKDAAAALEANTNSYVTGSYVVSITDAATMAQLSAIDQDTTGALTYGAGLKDTAAALEANTNSYVTGNYVVSITDAATMAQLSAIDQDTTGALTYGAGLKDGVAALEANTNSYVTGSYAVSITDVVTMAQLSAIDQDTTGTLSYGAGLKDGAAALAANTNSYITGSYVVSVTDAATMAQLSVMDTATSGTLTYGAGLKDGVAALDANTNSYVTGSYLVSITDAATMAQLSAIDQDTTGALTYGAGLKDAAAALEANTNSYVTGSYVVSITDAATMAQLSAIDQDTTGALTYGAGLKDAAAALEANTNSYVTGSYAASITDAATMAQLSAIDQDTTGALTYGAGLKDAAAALEANTNSYVTGSYAVSITDVVTMAQLSAIDQDTTGTLSYGAGLKDGAAALAANTNSYITGSYVVSVTDAATMAQLSVMDTATSGTLTYGAGLKDGVAALDANTNSYVTGSYLVSITDAATMAQLSAIDQDTTGALTYGAGLKDAAAALEANTNSYVTGSYVVSITDAATMAQLSAIDQDTTGALTYGAGLKDAAAALEANTNSYVTGSYVVSITDAATMAQLSAIDQDTTGALTYGAGLKDGVAALDANTNSYVTGSYAVSITDVVTMAQLSAIDQDTTGTLSYGAGLKDGAAALAANTNSYITGSYVVSVTDAATMAQLSVMDTATSGTLTYGAGLKDGVAALDANTNSYVTGSYLVSITDAATMAQLSAIDQDTTGALTYGAGLKDAAAALVANTNSYVTGSYVVSITDAATMAQLSAIDQDTTGALTYGAGLKDAVAALEANTNSYVTGSYVVSITDAATMAQLSAIDQDTTGALTYGAGLKDGVAALDANTNSYVTGSYAVSITDVVTMAQLSAIDQDTSGTLSYGAGLKDGAAALAANTNSYITGSYVVSVTDAATMAQLSVMDTATSGTLTYGAGLKDGVAALDANTNSYVTGSYLVSITDAATMAQLSAIDQDTTGALTYGAGLKDSVAALEANTNSYVTGSYLVSITDAATMAQLSAIDQDTTGALTYGAGLKDTAAALEANTNSYVTGSYVVSITDAATMAQLSAIDQDTSGALTYGAGLKDGVAALDANTNSYVTGSYAVSITDVVTMAQLSAIDQDTTGTLSYGAGLKDGAAALAANTNSYITGSYVVSVTDAATMAQLSVMDTATSGTLTYGAGLKDGVAALDANTNSYVTGSYLVSITDAATMAQLSAIDQDTTGALTYGAGLKDAAAALVANTNSYVTGSYVVSITDAATMAQLSAIDQDTTGALTYGAGLKDAAAALEANTNSYVTGSYVVSITDAATMAQLSAIDQDTTGALTYGAGLKDGVAALDANTNSYVTGSYAVSITDVVTMAQLSAIDQDTTGTLSYGAGLKDGAAALAANTNSYITGSYVVSVTDAATMAQLSVMDTATSGTLSYGAGLKDGVAALDANTNSYVTGSYLVSITDAATMAQLSAIDQDTTGALTYGAGLKDSVAALEANTNSYVTGSYLVSITDAATMAQLSAIDQDTTGALTYGAGLKDSVAALDANTNSYVTGSYAVSITDVVTMAQLSAIDQDTTGTLSYGAGLKDGAAALAANTNSYITGSYVVSVTDAATMAQLSVMDTATSGTLSYGAGLKDGVAALDANTNSYVTGSYLVSITDAATMAQLSAIDQDTTGALTYGAGLKDSVAALEANTNSYVTGSYVVSITDAATMAQLSAIDQDTTGALTYGAGLKDAAAALEANTNSYVTGSYVVSITDAATMAQLSAIDQDTTGALTYGAGLKDAAAALEANTNSYVTGSYAVSITDAATMAQLSAIDQDTTGALTYGAGLKDGVAALDANTNSYVTGSYVVSITDAATMAQLSAIDQDTTGALTYGAGLKDGVAALEANTNSYVTGSYLVSITDVVTMAQLSAIDQDTTGTLTYGAGLKDSVAALEANTNSYVTGSYVVSITDAATMAQLSAIDQDTTGALTYGAGLKDTAAALEANTNSYVTGSYAVSITDAATMAQLSAIDQDTTGALTYGAGLKDSVAALEANTNSYVTGSYAVSITDVVTMAQLSAIDQDTTGTLSYGAGLKDGAAALAANTNSYITGSYVVSVTDAATMAQLSVMDTATSGTLSYGAGLKDGVAALDANTNSYVTGSYLVSITDAATMAQLSAIDQDTTGALTYGAGLKDAAAALVANTNSYVTGSYVVSITDAATMAQLSAIDQDTTGALTYGAGLKDAAAALEANTNSYVTGSYVVSITDAATMAQLSAIDQDTSGALTYGAGLKDSVAALEANTNSYVTGSYAVSITDVVTMAQLSAIDQDTTGTLSYGAGLKDGAAALAANTNSYITGSYVVSVTDAATMAQLSVMDIATSGTLSYGAGLKDGVAALDANTNSYVTGSYLVSITDAATMAQLSAIDQDTTGALTYGAGLKDAAAALVANTNSYVTGSYVVSITDAATMAQLSAIDQDTTGALTYGAGLKDAVAALEANTNSYVTGSYVVSITDAATMAQLSAIDQDTTGALTYGAGLKDSVAALDANTNSYVTGSYAVSITDVVTMAQLSAIDQDTTGTLSYGAGLKDGAAALAANTNSYITGSYVVSVTDAATMAQLSVMDTATSGTLTYGAGLKDSVAALDANTNSYVTGSYLVSITDAATMAQLSAIDQDTSGALTYGAGLKDAAAALVANTNSYVTGSYVVSITDAATMAQLSAIDQDTTGALTYGAGLKDAVAALEANTNSYVTGSYVVSITDAATMAQLSAIDQDTTGALTYGAGLKDSVAALDANTNSYVTGSYAVSITDVVTMAQLSAIDQETTGTLSYGAGLKDGAAALAANTNSYITGSYVVSVTDAATMAQLLVMDSATSGTLTYGAGLKDSVAALDANTNSYVTGSYVVSITDAATMAQLSAIDQDTTGALTYGAGLKDAAAALVANTNSYVTGSYVVSITDAATMAQLSAIDQDTTGALTYGAGLKDAAAALEANTNSYVTGSYAVSITDAATMAQLSAIDQDTTGALTYGAGLKDAAAALEANTNSYVTGSYAVSITDAATMAQLSAIDQDTTGTLSYGAGLKDGAAALAANTNSYITGSYVVSVTDVATMAQLSAMDTATTGTLTYGAGLKDSAAALVANTNSYVTGAVTVTVTDAATTAQLGAIDQDTTGTVNYSLAGIKDTVSNITIDSGNYVANAGGATITVNDGIANLITDAGTVVTGTRNVTVTDAASMAQLSQIDNYTTGALKYVTIKDAVAALVANTNSYVTGSYAVSVTDAASMAQLSAIDQDTTGTLTYTKLTDAVANLVTNTNSYVTGSVNVTVSDIATISQLSSIDANTTGSVTYTQIGDAAATLATNAGNYVKATIHVTVTDAATIAQLTTIDGDNTTGSLVYTAGGVKDSAANLVVNTNSYVTGAVNVSVTDTVSIAQLSAVDEYTTGTLTYGAGVKDSVANLLVNTNSYVTGSYAVSITDVASMANLSAIDQFTTGTLNYTKLSDTVSALVANTNSYVTGSVNVTITDNASMANMSAIDQNTTGTLTYTKLSDTAAALAANTNSYVTGSVNVTVTDNATVAQLTTVDAATTGTIKVASVVDSGSNISSNFAYVDGLGVSYVNANDNVMAVTVAQATDATVTIADDDVLTITDTSSNIQGSTFSALVTAGADATYLDATDDILTVTAAQAATTNINFTAADVVTVSDTGSNIQTNITTILAKDVDKLSASSALDLTDSDVTGKTVDFSGVGDTTITMAYDSSNVAFGSLTSTGGGELILSVTGTGTLATVTGLSNFNQLSAASDLTIDSAQVAGQTLDMSGAGNVTVSLASATTASYSSLTSTGAGTLGLQIGSTGTYTSVTGWEVFDSITSDYAITVAASAVTGKTVAFSGTGAVTIDGASSSNATFLNVTHDSGTSGDLILAVSSSTGSAVFSSGAANFDKVSVDGTLYTGITSANGQIIVNGSTSVAAGISGTAYTDFIVNYDTDSLGTTYASTQGLLGGAGDDRLIDTTSSGVLLAGEAGDDTLTGGAGNDIFYHDGSSHGLDTITDFASGDLLQIASGNAGQWTLDSTGQALTKATNSSLGFNFNSGNDLNDATYDLQFNGASDAAGHIMTFDLDTDADHTVAGSSYADLMVNFSSGTTDGYTMSGGSGNDRLIDYNDSASTYMTGGSGQDNFVFNENTTGLTAGDYTLATGNADIITDWSVDDFFIWASSNLIAGGVTANGAAATKTYLDASVAGGSDGYDESASAHIYILRDANNVATSGDGTVADAQATIDAINGATSDGTFNAASASDVLLFAVYDSTTTDTHVWLASVGANQTLDVADMTMVATLQDTNITATGVMYTANFAX

SEQ ID NO: 10179 - protein, 650 aa, magnetite-containing magnetic coccus
KILIANRGEIACRVIKTARRMGIQTVAVYSDADREALHVRMADEAYYIGPSPSNQSYLVMDKLLEVIKQCGADGVHPGYGFLSENSTFCRRLQEMGVIFIGPNPTAIDAMGDKISSKKLAQAANVNTIPGHMGIIENADEAVRIAAEIGYPVMLKASAGGGGKGMRIAHNDAEAAEGWQSATNEGLSYFGDGRVFIEKFIENPRHIEIQVLCDGHGNGVYLNERECSIQRRNQKVIEEAPSPFVDADMRRAMGEQALALAQAVDYVSAGTIEFVVGADKGFYFLEMNTRLQVEHPVTEFITGLDLVEQMIRVARGERLSITQDQVLLKGWSMESRVYAENPYRNFLPSVGRLVRYEPPLESAHVRVDTGVFAGGEVTLFYDPMIAKLITWGQDRGEAIEHMREALDSYLIEGPGHNIDFLNAVLRHPRFVSGNISTAFIAEEYPEGFEGAPLSGMDRQLFAVAAAYIEQQAQALLMDLGVEKSWVVSVDEEVLPLIFREVEGGDEVEFGDGSRFGVSGVVRPGAKKVTLTIAGQVCTFGVVRGEEGYHLTRGGRQVGVYVRTPRQHQLAQRMPVKVAPDTSKMLITPMPGLVLKIIVEVGDCVSAGDPVCVLEAMKMENIMRVERDGVVGAIFAKPGQAVESDSIIMTFE

SEQ ID NO: 10180 - protein, 524 aa, magnetite-containing magnetic coccus
KDLERRLRTTTERAESASRAKSDFLAVISHEIRTPLNAIIGMGEVLLDDPLTTEQKHYAMVSQQAAHTLLDLINDVLDLSKIEAGEFQLEHAPYDLVGLIHSVVEVNTITANQQGLPIECNLPDTLPTLMHGDLRRVRQVLFNLLGNAIKFTEQGLIRVETERLETPVASWIRISVKDTGIGIAQEKQSLIFDAFTQSDGSITRRYGGSGLGLTISKRLVEMMGGKIGVDSQLGKGSHFFFTLPVTARWDVLEPLYPPPATLLQQQRILLIHSDVENRDRMQTLLEQAGATVILGGDCRQPTACLAQLDASLDGIVMNCGTLNSAGLNHLEQHLAHYPKLAKRTVILTNKVRGSLLDRTTPLGIHYLNTPVQAEQIYPLLKGISDTSSLYQTPFVGHTEGATPLLTQANVLVVEDSEDNRLLIRTYLKKSPYILDFASNGLEAIEKWQQNHYDLVLMDIQMPLMDGLTATRHIRKQERREQRPHTPIVALTAHAMASDHQNAMAAGCDDFLTKPIKRDTLFKAL

SEQ ID NO: 10181 - protein, 222 aa, magnetite-containing magnetic coccus
RIQRNVRRDDGTLETKWDEFQVKATPLTPVLNLLEDVKGNQDGSLTFRQSCRSAICGSCAMRIGGKTRLACKTQIGEVVDENNTVQIAPQQNSPVLKDLVVDITKFFNKVHQIKPYLQEGAESATEVNDTAFDQVNHVTQCIMCACCFSDCTMAEVSDAFIGPAALAKAFRFVSDPREGNKRERLRVLSQDHGIWSCSRCTMCVMVCPKDVKPMEAIVKLRT

SEQ ID NO: 10182 - protein, 562 aa, magnetite-containing magnetic coccus
MYKHDLIIVGAGLAGMRAAVEAVKAGVDVAVISKVHPLRSHSCAAQGGINAAINPKDSWESHAYDTVKGSDFIGDEDAIELMCQEAPNSVLEMDRMGTPFSRLEDGLIAQRPFGAASFDRTCYAADRTGQVLLHTLWEQLVKAGVRVYEECQILKISNVDGRIAGVVAYDIKKGEVFGVQAKVTLLCTGGYGRVFLTSTNATASTGDGMALAYRAGASLCDMEFVQFHPTGLRYSGILVTEGARGEGGYLINKDGDRFMTKYAPNKLELASRDVVSRAEQTEILEGRGVDGAIFLDLRHLGAQKINERLPQVRQLARDLEGVDPVYTPIPVRPTAHYSMGGIRTNKYGETILPGLWAAGESACVSVHGANRLGGNSLLDTIVFGYIAGRELGAKLGSMEMPTLPASEVQAVKDNIAQLVDRPNKGVRPASIRERLGESMNAYVSVFRHPDNIQKAADLIPTLRQDLTTMHLDDKSKVFNVDLLRAMEMQNLVDLAETIIAGAINRTESRGAHSRVDFPERDDENWRKHTITKWDNDAQTTAFSYEAVRTVGKDAYKLAVRSY

SEQ ID NO: 10183 - protein, 604 aa, magnetite-containing magnetic coccus
LNGFFKNLSLWLVIGLLMVMLFNLFNSPQGPGQSITFSDFSEMVAQGKVTAVTLEGRTVRGLSTDGSPFSSRVPDNYDLTKDLLAHGVDIDVREPEGTPMLMQILISWFPMLLLIAVWIYFMRQMQSGGGRGAMSFGKSKAKLMSDKAAKVTFQDVAGIEEAKEELQEVVQFLKDPHKFQRLGGKIPKGVLLVGPPGTGKTLLARAIAGEANVPFFNLSGSDFVEMFVGVGAARVRDMFEQGKKNAPCIIFIDEIDAVGRHRGAGLGGGHDEREQTLNQLLVEMDGFESTEGVIMVAATNRPDVLDPALLRPGRFDRQVTVPNPDILGRTQILKVHMNKVPLSDSVDAEVIARATPGFSGADLANLVNEAALIAAQLDKRVVEMEDFENAKDKVMMGKPRRSAVISEKERKTTAYHEAGHAVVAMALDGADPVHKVTIIPRGRALGLTMQLPLEDRYTYSKVQLEQNIAILMGGRLAEELVLNQLTTGAGNDIQRATDLARKMICSYGMSDTLGPLTYGENEQEIFLGREITQHKSVSEETARRIDAEVFDIVDRNYKRAKQILTDKMEVLHTMAQALLERETIDADEVIKLMAGEPAETALKP

SEQ ID NO: 10184 - protein, 823 aa, magnetite-containing magnetic coccus
LPIVATLQPLQAALLRHPNVILSAPPGSGKTTVVPLALLDAPWLAGERILMLEPRRLAARAAASRMAELLQEPVGERVGYQIRFERKVGPNTRVEVVTEGMLTRRLQSDPALQGVGAILFDEFHERSLQGDLGLALALELQQLRDDLRLLVMSATLESQRLAKLLGDAPIIEGHGRSYPVQVRYASQPYAHVVEGVVQTIRQALAQERGDLLAFLPGAGEIRRVEAALRSGLPDDVTLLPLYGELGMQAQDRAVRPWLEGGRRVILATDIAETSLTIPGIRVVVDGGLCKRPRFHASSGLTRLERLRISDASAQQRAGRAGRLEPGVCYRIWPESQQRMLQPATPAEIREADLAPLLLELALWGVADPTQMSWLDPPPEGAVAQGWALLVALGAVDEARHITPLGRQMAQLPLHPRLAHMVCMAPEPAAQAMACDVAALLSERDPLKGGARQVDLHLRWQSVAQFRRQGSAGPGVDAASLQRIVRGADQLRHLLGVSRQQVAHGDLGLLLAAAYPDRVAQLRPGQRGRYLLASGRGVRLDEMDPLSGEPLLVVAALDAGEAEGRAYLAVSLAQEAFMALQPPAWQAQVVWSDQQQRVVAERQRCFGALVLERQPLHGEAPEAAVLAAMLVGVRRMGLAVLPWTPAAMQYQARVQLMARLESGWPLLEEAVLLEQLEQWLAPFLRGVNRRAQLERLNMLEILQSQLTWSQQQSLEQALPTHYEVPSGSRIKLDYTAGAQPVLAVRIQELFGLAESPCLGQGRVPVTLHLLNPAQRPVQVTSDLRGFWQTTWPQVRKELRGRYPKHHWPENPWQAQATARAKPRS

SEQ ID NO: 10185 - protein, 292 aa, magnetite-containing magnetic coccus
ALVTGGAGFIGSHLCEMLLEQGHTVRALDNFSTGRRANVAHLINHPKFTLYEGDIRDPETLVTPFQGVEWVFHLAGLADIVPSVENPTTYFEVNVHGTLNVLEFARRNQAKRLVYAASSSSYGIPELYPTPEESPIQPQYPYALTKYMGEELVLHWANVYKMPNLSLRMFNVYGPRSRTTGAYGAVFGVFLAQRLNNKPYTVVGDGQQSRDFTYVTDVCAAFYAAAQSTWVGEAFNVGSGGHQTINRLVELLGGEITYIPKRPGEPDCTFADTRKIHAKLNWQAQVSFEQGV

SEQ ID NO: 10186 - protein, 576 aa, magnetite-containing magnetic coccus
  unsure (1)..(576): unsure at all Xaa locations
LDDRARHLRRLVLRALDKGGRGHPGSAMSLMELLRVLYDDVLNIDPHNPLWQDRDRCILSKGHGCLALYALLADKGFFPVAELDRFCQLESRLGGHPERHVLPGVEASTGALGHGLSLAAGMALAAKLKGASWRVFALMGDGEINEGSVWEAALFAAKHQLNNLVAVIDYNKLQSYGPISAVQGLEPLADKWRAFGFGVQEVDGHDVGALRHCFTQLTPDQPNLVIAHTVKGKGIPEAEDNPSWHHKSSLKPAEMESLYQALAXPANRKPXPCDAAVXMKFLPLAQQDARVLFMGSDLGAGTLETMRQACPRQFFMEGIAEQNLIGVAAGLALEGYLPYVNTIATFLTRRALEQIAIDVALHKLPVRLIGNGGGMVYAPLGPTHTTLEDVALMRALPNMTVLAPCDADEMQRLMGQTLAWPGPIYIRLAKGGDAVVSREELPCTIGKAIPLLYGRDVLIISYGIMVQRALTAAHALAQEGIECSVLNMHTLKPLDEAAIVREAQGKRLVVTVEEHSQIGGLGSAVAQLLATRDLLDGGPRLRILAFADAFCSGYGSQNQQIAQAGVDVLDIQRTIK

SEQ ID NO: 10187 - protein, 306 aa, magnetite-containing magnetic coccus
SPPPAVMRRLERMELKPYLADRKYLVESALDRLLPAADREPRALTGAMRYSLLIGGKRLRPILTLACCEAVGGALERAMNFACAMECVHTYSLIHDDLPAMDNDDLRRGHPTCHRQYGEATAILAGDALLTHAFELAAKPVTGVLPEARLELIGELAMAAGTYGMVGGQMLDIQGEKRPLELVQLQNIHIHKTGALIRVACLAGARLGGGTPDQVKHLKRYGEALGLAFQITDDILDEVGDTKTLGKATGVDRALDKATYPKLMGLAQAREAAENLMQEATRCLTEFGPQADPLRALAQYVIARTH

SEQ ID NO: 10188 - protein, 624 aa, magnetite-containing magnetic coccus
ILPMTTLLSTIDSPKALRQLNEAKLPQVAQEMRDHIIECVSQSGGHLGASLGVVELTIALHYVFNTPDDRLVWDVGHQSYGHKVLTGRRDQLASIRQRHGLSGFTKRSESPYDPFGTGHSSTSISAAMGMARAAKANGIQRKAVAVIGDGAMGAGMAFEALNHAGHDNHDLDLVVVLNDNEMSISPNVGALSSYLNRMLSGGAYNAFRDGTGKVLKTISRSMWDAAKKAEEHVKGLVMPGTLFEELGFTYFGPINGHDFDALLPTLRNVQKLGGPILLHVITKKGKGFPPAEEHPCTYHGVAPFDKDTGIIQSSSGGTSYTKVFAQELCALAEQNPHIHAITAAMREGTGLNLFEKRFPERFHDVGIAEQHAVTFAAGLATEGILPVVAIYSTFMQRAYDQLIHDVALQDLPVIFALDRAGLVGADGATHAGAYDLSYLRTVPGMTIMAPADENELRHMLHTAVALNKPVALRYPRGTALGLPPEPPHVLEIGRGRTLRKGEHAAILAVGQPVHPALEAAAILEQQGISVSVYDARFVKPLDQRLLQEVAMHGVVLVVEENAVQGGFGSAVLESLSNQGALDRGLKIRCMGIPDRYIPHGTQKELRGEIGLDAVGIATTLKELL

SEQ ID NO: 10189 - protein, 186 aa, Cytophaga hutchinsonii
LSESFYLRENVQLISKELLGKVLVTYIDGKYTAGIITETEAYQAPEDKASHAFNNRRTTRTEVFYNKGGIGYVYLCYGIHHLFNVVTNNENIPHAILIRSVEPLEGVDIMMQRRNKKKLDKTLTAGPGALSQALGITRLHNKIPLSANTVWIEDRNIPVESIVSTTRVGIDYAQEYKDKPWRYYIA

SEQ ID NO: 10190 - protein, 146 aa, Cytophaga hutchinsonii
DTATFGNGCFWCTEAVFQDIKGVVKVTSGYSGGTVTNPSYKQICTGTTGHAEVLQIVYNPSIVSYSELLQMFWYSHDPTTLNRQGNDVGTQYRSVVFYHNETQRKEAEFYKKKLDEEKIFEKPIVTEIVSFTKFYPAEDYHQNYYK

SEQ ID NO: 10191 - protein, 302 aa, Cytophaga hutchinsonii
MSVIVKDLVKIYGKQYAVDGISFTAEKGRITGFLGPNGAGKSTTMKVATCFIPPSSGTIEVCGYSVLESPIEVRRNIGYLPEHNPLYLDMYVQEYLQFIGGMYGMKDTALKKRVAQMIELCGLGVEQYKKLGALSKGYRQRAGLAQALIHDPQVLILDEPTTGLDPNQILEIRKVIKSIAKDKTVIFSTHIMQEVQALCDQVIIINRGKIVADKTITEIRNFNTSIKIIRLEFTEQVDIQAFKIFDFVSDARHMQGNAYELVVATHADTRPLIFKACADKGWTLIEMKVEEQSLESVFRELT

SEQ ID NO: 10192 - protein, 422 aa, Cytophaga hutchinsonii
VDYNQAIQFLYTQYPAFEKQGGLAYKPGLGNVLNISAAFNNPHTAFKSIHVAGTNGKGSSSSILAAVLQSAGYTVGLYTSPHIHDFTERIRINGVPIPKDIVVDFVQNNTAVFDRFKPSFFEITTILAFVWFAKQQVDIAIIETGMGGRLDATNIVQPEVSLITNVSLDHTQFLGNTIQAIASEKAGIIKAGIPVVISELQQELISVYEEQANALNSPLIKAFEAYTVDTIITASEHTEISITDHVLKKIIALRLDLQGLYQSKNVVGVLTVIDQLKKDGWAIPEDSIKEGLAHVQQLAGFKGRWQIISQKPLTILDAAHNEAGITLSMQQLQLYHKSIHIVIGMVKDKDIEKVLSLLPVQATYYFCQADSPRAMPAAELQTAAAVNGLQGQAITNVNDAVRAARKNAAPDDVIWIGGSLYV

SEQ ID NO: 10193 - protein, 355 aa, Cytophaga hutchinsonii
GVYMYGKQGEKYIDLISGIGVSNIGHCHPKVVQAIQEQSQKYMHLMVYGEFVQAPQVRLATKLIETLPPSLDSVYLVNSGSEATEGALKLAKRYTNRREIISCKNAYHGSSHGALSVMGNEFFKQSYRPLLPGIKHIRYNHTEDLDVITEQTAAVIIETIQGEAGVRIADKPYMQALRKRCDYTGTLLILDEIQCGFGRTGTFWAFETYGIVPDILLAAKGMGGGMPIGAFISSKKIMQTLSSDPVLGHITTFGGHPVSCAASIACMEVIQEEKLMDTVLKKESLIRKQLNHPGIKEIRSAGLMMAVEFESYSVLKRIIDQAIEKGVLTDWFLFCDNSMRIAPPLIISDDQIEQA

SEQ ID NO: 10194 - protein, 398 aa, Cytophaga hutchinsonii
DHSWYAQADTRIEQIRKGDFVLTVKDQNGNILKNCDVTVNLKQHDFKWGTALAFQQNSTEDEVWYRNTASNYFNNAVFENDFKWPSMEYVNGDVTYSNLERYLDWGNDQHIDFRGHTLVWGGKQASPPNSYWLTPSWLWDVSSDSAYKLIERRIKRDLTYFKGRIHEYDVVNEPVHEKALAGWLGDSVHVMAFKWAKQADPTATLYINDYANIDGATTSKYRSYISYLLSKGAPVEGIGVQGHFGSRIDWASVKLRLDYLAEMGLPIKITEFDMNQNTLNLTEAEQASEYSKMMRIAFSHPGVEGFLFWGFWDNRHWIPGAGLFKADKTPKPAADSVYKLIHTTWSTTAHVTTDQNGQVGFRGYYGSYEVLSTCGNALAGQTVFTKNTLSNTVTLDYA

SEQ ID NO: 10195 - protein, 319 aa, Cytophaga hutchinsonii
MIKKISVVLVLLTGMLLSASVFAQKTIVEKYGKLSVKGNYMVGQYGDTVQLRGMSLFWSQWMGQYYNSDVVKWLRDDWKCTVVRAAMGVEMDGYLENPDTEKMKVMEVVNAAIAKGIYVIIDYHSHEAQKNPAAAQRFFSEMAKKYGNIPNIIYEVYNEPLQATSWNKDIKPYAEGVITKIRVYDTTNIIVVGTRQWSQLVTEAAANPITRQNIMYTLHFYPGTHKQELRNEAQKALDMGIALFVTEYGTCDASGNGNFSPEETALWYEFLDAHKISYCNWSIADKPETASAIVPAASPYGGWADYDLTPSGKLVRDDL

SEQ ID NO: 10196 - protein, 498 aa, Cytophaga hutchinsonii
  unsure (1)..(498): unsure at all Xaa locations
INLIHSLLKTIGIIGSGISGLSAAAVLALNGQKVVVFEKNDQLGGRMRQFEANGFTFDMGPSWYWMPDVFERFYKQFGYSGSDFYELKKLDPGFQMITADGETVKIPAGWDELLALFEQIETGAADKLKAFMREAEYKYEVGVKKLIYQPGLSVLELINADTISGVFRLQIFSSFSKHVRRYFKNDTLIALMEFPVLFLGAMPKNTPALYSLMNYAGLKQGTFYPMGGFKKVIDAMVQISREHGVEFNTAEGVDAIKKESNSKISLTTHARSIQLDGLIASADYQHVESKLLQQKDRNYTEXYWDKKTFAPSSLIFYMGVNTKLDKLEHHNLFFDGDFPKHAREIYEDPQWPENPLFYVCCPSRTDPSVAPAGKENIFVLMPIAPGIADEEAIRETYYNLLMKRLEAYTGVPVRENIEYVKSYCVKDFVADYNSYKGNAYGLANTLMQTANLKPKIKNNSIPNFYYCGQLTVPGPGVPPSIVSGQVAANELLKTLSVN

SEQ ID NO: 10197 - protein, 439 aa, Cytophaga hutchinsonii
FKKILIANRGEIALRVIRACKELGIKTVAVYSVADKESLHVRFADEAVCIGPAPSNQSYLSIPNIIAAAEITNADAIHPGYGFLSENAKFSQVCEDYGIKFIGASAAMINSMGDKASAKDTMKKAGVPCIPGSDGLLGSIEEGIKLANKVKYPVILKATAGGGGRGMRIIRSDREFEKAWVDAKQEAGASFGNDGLYLEKFIEEPRHIEVQLLGDKFGTVVHLSERDCSIQRRHQKLIEETPSPIITERLRTKMGEAAVKGAKSIKYEGAGTIEFLVDKHGDFYFMEMNTRIQVEHTITEEVTGVDLVKMQIRVAAGEKLEKKNYLPLRHSIECRINAEDAANGFRPSPGKITNFHMPSGFGVRVDSHCYTGYTIPPNYDSMIAKLIVNAATRDEACDRMKRALQEFVIEGVKTTIPFHITMMDDPQFRSGKFTTAFLE

SEQ ID NO: 10198 - protein, 324 aa, Cytophaga hutchinsonii
NVKACITGIAGYVPDYILTNQELEQLVETSDEWILSRTGIKERRILKGEGLGTSHMAEKAVNDLLAKTNTDPSEIDLLICCTTTPDYVFPATGNLVSDMCGLKNAFSYDMNAACSGFLFGLVTGSQYIESGKFKKVIVVGADKMSAIVNYKDRNTCILFGDGAGAVLLEPNNDGFGVVDSVLKTDGSGAQYLIMKGGGSRHPASLETVMNSEHFAHQEGATVFKFAVKNMSDVAAEIMERNQLTGDNVQWLVPHQANKRIINATAERMNVGPEKVMINIERYGNTTSATIPLVLWDYEKQLKKGDNLVLAAFGGGFTWGSVYLK

SEQ ID NO: 10199 - protein, 227 aa, Cytophaga hutchinsonii
FKINMNKLVIITGGTKGIGRALVYKFASEGFDVFTCARNREDLDSLKNTILSNYAGIQVFTQVADVSNKKGREEVVRAFTQLNRAADVLINNAGVFVQGQIHNEPEGVLETQIQTNLYSTYDITRGVIGRMIENKRGSIFNICSIASIMPYANGGSYSVSKFAMLGMTKVLREEMKPYNIRVTAVLPGATLTASWDGVDLPEERFIKPEDVADSIFGIYKLSDHTVV

SEQ ID NO: 10200 - protein, 238 aa, Cytophaga hutchinsonii
KTALVTGASKGIGAEIAKALARNGSTVIVNYSTDRINAEAVVKHIRENGGAATAIQADVTKAAEVKRLFEEACQQFGKIDTLINNAGVYKFEPIEAVTEEEFHRQFNSNVLSVLLSVQEALNYFNEAGGSIINIGSVASVKATPSSLVYSASKSAVDGITRILSKELGPKKIRVNAILPGPTHTEGNRIAGTPVEEYIAAQTPLGRIGQPADISMLAVFLASDDASWITGQKICVSGG

SEQ ID NO: 10201 - protein, 318 aa, Cytophaga hutchinsonii
KPTSNTSFDVIILGAGPAGSTAALALQKSNLTVALLEKELFPRDKICGDALSCVAERVLKQIDPSLEQELLLYSEKTVVNKARVYSPEFRSIVLNFSKRGHCIKRLDFDNWLFEKANAKNIEVFQQAKVTDVRIDNSGAEVVLQDGTILHAAIVICCDGAHSVAARQLTHLKLDRKHYVGAVRQYYRNISDTAGNELEIFFLKDFLPGYFWIFPLKNGEANVGFGALSAIISKNKIDLKKSLQEIIQSVPQLKERFKDAEAMETVKGFGLPLGSRKLPISGAHFMLCGDAASLIDPVTGEGIETAMESGKYAAEQAIR

SEQ ID NO: 10202 - protein, 291 aa, Cytophaga hutchinsonii
MHQSPLQPIILPQTEKAGVQLYLKRDDLIHPLYGGNKIRKLKYNVQQCLREGKIGLLTCGGAYSNHIIATAAYGKEHGLKTKAIIRGEELLIDNPTLKDAAALGMEFVFVSRETYRSIREQNALAFDLSKSNYNEWYFIPEGGTNAFAVEGIAELVAEIEIPFDYIATPCGTGGTFAGLMKGIKVYSPWRTKLLVFSALKNGNYIIDEVAELLKADFDRTTLELFTSEYVFGGYGKVKPELIAFVKSFEHQTGILLDPIYNGKMMFGLLGKIESGYFKKGSVIVAIHTGGI

SEQ ID NO: 10203 - protein, 433 aa, Cytophaga hutchinsonii
GTIGGKPGDSLTPIDVAKFAAAYGTWAKTNSESNTIVIGRDARLSGPWISSIVSETLRCLGFNIVDLGLSTTPTVEMAVVWEKAAGGIIITASHNPGQWNALKLLNANGEFVSERDGKKILVLAKKENIEFVDVKHFGSYRQDNTYIQKHIDAILKLPLVDIEAIKAKDFNVAIDCVNSTGGIALPLLLKALGVKKVAEFYCEPDGHFPHNPEPLAENLSFISNEIAKGHYDLGIVVDPDVDRLCFVNEDGEMFGEEYTLVAIADYVLKHTPGNTVSNLSSTKALKDVTEKHGKQYIASAVGEVNVVTAMKKNKAVIGGEGNGGVIYPELHYGRDALVGIALFLSHLAKYGKSISMMRASYPNYVISKNKIELTPEIDVDCVIEKIKEHYAKTPMITVDGVRFDFDAGWVHLRKSNTEPIIRIYAEADTHATA

SEQ ID NO: 10204 - protein, 590 aa, Cytophaga hutchinsonii
LLTEVAWEVCNQVGGIYTVIRSKVPTMTEVWGDRYCLVGPYFHNKAIAEFEAIDTYEADDVFAQAVLRMRNLGYEVHYGHWLVSGRPKVVLINHFSAFYRLGEIKYSLWENHGISSPEGDDLLNQVIAFGFLAKVFHQQLDETKGELPCVSHFHEWMTGTAIPEMRREHVKTSIVFTTHATLLGRYLAMNDPNFYDNLPYYDWNKEAVNFNIEPAVKIERAAAHGANVFTTVSEVTARECQSLLGRNPDMVLPNGLNIERFTALHEFQNLHKEHKDQIHEFVIGHFFQSYTFDLDKTLYFFTSGRYEYKNKGFDITLEALARLNWRLKEENTDTTVVMFFITKQPYHTINPQVLQSRAVMEEVRSNCDAIVQQLGDKLFEAAASSGDLKLPDLNKFVDEYWKLRLRRTLLSWKSHELPKVVTHNLVYDNQDEILNFLRHSNMVNNEHDKVKVVYHPDFIASTNPLFGMEYGQFVRGCHLGVFPSYYEPWGYTPLECMASGVPAITSDLSGFGDYVLKNIPNNENKGIYVTNRFHKSYHDAAQQLADQMYHFVHLSRRDRITQRNRVESASEHFDWQNLGSYYDKAHRLAF

SEQ ID NO: 10205 - protein, 410 aa, Cytophaga hutchinsonii
RRVVVTGIGALTPIGNTSNEFWNNLLAGKSGAAPITYFNTEKFKTKFACEIKGYNPLNYFEKGEARKYDLFTQYALITVKEAIEQAKIDFDSLNKDRIGVIWGSGNGGILTTQEQIMEYAKGDGTPRFNPYFVPKILVDIASGVISIKYGLRGINYTTVSACASSTTSVIDAFNYIRWNKADMIITGGSDAPINESLIGGFGALKALSTQNENPESASRPFDNSRDGFVMGEGAGAIILEEYEHAVKRGATILCEVIGGGMCADAYHLTGSHPEGDGAYMGMKLTLEDAGISAADVDYINPHATSTPIGDQSELKAIQRLFGDASNASISASKSMTGHLLGAAGAIEAIICIQAVQHNMIPPTINTTAVEAGYENLNLVLNKAVAKEVNVAISNTFGFGGHIAALMVKKI

SEQ ID NO: 10206 - protein, 1180 aa, Cytophaga hutchinsonii
  unsure (1)..(1180): unsure at all Xaa locations
MQLSKLEIKGFKSFGDKVVINFDEGITGIVGPNGCGKSNVVDAIRWVLGEQKTRALRSDKMENVIFNGTKNRKPQQMAEVSLSFNNTKNLLPTEYSQVTITRRYYRTGDSEYLLNGVTCRLKDINDLFLDTGIGSDSYAIIELKMVDDILNDKDGSRRELFEEAAGISKFKMRKKQTLKKLEETDKDLERVEDLLFEINKNLKSLEKQAKQTEKYHEIKEDYKNASIDLAKVSVHSQHEEIQALNKTLDEKTDLRTQYNSQINEKESDVERVKLEMVNKEKLLADRQKTLNEHVNLIRTFESDKKIKNERLRFLNDKSKSLTDQIELDKQSNDRAAFSLDSLTKEKESAEKIFEEISLKVEKLKQEYEEQKEKNKLLQEEVGTASSAFKLKQEQVYQINKQLEIYAIQLSSLKQELEKTTSDTSAHSANLSEFESKANEVKRTLDTKNAELETLQAEDERIQQQVINLEKEIEQIREQLTQANRKLDSKQNEFNLTKSMVENLEGFPEAIKFLKKNASWGKDTPLLSDILTCDEKFRLCIENYLESFMNYYVVENEAQAIQAVNLLSDSAKGKANFFVLTRFNNYTSSQKNTFGDCVSALDIVEYDNKYKGLIQYILDGVYIITGNQDIIPEDPQSVFITQNGKLAKRKYSISGGSVGLFEGKRIGRAKNMEKLEADIKQITSDIENIRVVLDTKLKEFYLLKENTKKLEVEELRREINLVNNEYITLKTKQEQLASMLSDNSLRREDVLEKIAKIEEDININTPLAKEGKDELESLEERLNQLNDDFSLQTTQLSNKSAVYNQENIGFHQQQNRVNSLEQEIGYKQTTFDQSKERIAKNLEELEIANGEIRQMVDSADVSEDELISFYKEKESIEQGVHEAEKDYYSTRVRIDEVEKEVKEIRRNREECDEILVTLQNRVTETKIGLSSIKERLNVEFNLNLDDILANQNPDDVLPSEEELKEKVIKIKNSLDRLGPINPMAMEAYQEIKERHVFITTQKEDLAKSKESLMETINEIDTVAKATFLDAFEKIRDNFIRVFRSLFTDEDSCDLKLVDPENPLDSAIDIMAKPKGKRPLTINQLSGGEKTLTAISLLFAIYLIKPAPFCIFDEVDAPLDDANIDKFNNIIRQFAGESQFIIVTHNKRTMASTDIIYGITMVEQGVSRLVPVDLRSLNEAXQ

SEQ ID NO: 10207 - protein, 235 aa, Cytophaga hutchinsonii
TAWPIIIFFVAHWYLSLFSQTFFLHRYSAHAMFKMNKFWEKFFFIFLYLTQGSSYLVPRAYGALHRMHHAYSDTEKDPHSPLYSRNAFVMMWKTKDIYNAVLRREAQVEDKFNKNLPEWAFIDNIGDMWISRIIWGTLYVLFYIYFVPADMWYLYLLLPIHFLMGPVHGAIVNWFGHKLGYQNFDNKDASRNTLALDVLLGGELFQNNHHMYGSRPNFAMKWFEFDPTYPVIKVL

SEQ ID NO: 10208 - protein, 578 aa, Cytophaga hutchinsonii
FKDLGLSPEVVEAIESIGYSEATPIQEKTIPILMTGKDLTGQAQTGTGKTAAFGIPAIEHVDISINQTQSLILCPTRELALQVCTELKKLSKFKKGLRVLAVYGGESIERQIRDLKAGAHIVVGTPGRIIDHLDRRTLNASHLSQIILDEADEMLNMGFREDIELILTRLPEERQTVLFSATLAPPILALAKRFQNNPEIIKIERKELTISTVEQFYYLVKNSQKTEIVTQIIDLNNLQLMLIFCNTKRKVEEVTDELKAYGHNPISLHGDKTQRDRTEVMSKFRKGLANILVATDVAARGIDVTGVDAVINYDVPLDIENYVHRIGRTGRAGQLGKSFTLVTSDEKYKLRDIERYTKATIEKAETPTRQELVAYKKDKLATRITTELEKPNIKIWSDLLEEYKEKGITADQIAIALLSKEMKDLAEPERRVFEDRGDRRDRGDRGDRGGRFDRGDRRDGPRRDGRSSDRFGDRPAASRDRDGGERRERTPRPRTSDASMARLFVNVGRIDRISPGDIVGAFAGEANIKGSQIGQIDIFDKYSFVELPHDLVDQVMDGMRNNKIKGKSINIEISNGKQ

SEQ ID NO: 10209 - protein, 308 aa, Cytophaga hutchinsonii
MKSSIFTLTLSPAFDKSTSVESVQPEHKLRCDSPIYQPGGGGINVSRAIKKLNGSSVALYPIGGDTGNHFKALLTEEGIEQITFQIKNWTRENFIVVERSTNNQFRFGMPGSEIYKEEWEQMLAVIQDPSNDFEYFVVSGSTPKGVPDEFYTRLSQIILQKNARLILDTSGAALKHCLKEGIFLCKPNINELSEIVGKELITKEQQEAAAMEIINSGKVEILVVSLGGAGAFLASKQGIYHVTAPPVEKRSTVGAGDSMVAGMVLSLSRGNHYEDVIKFGVACGTAATMNFGTELCKLEDVERLYKQL

SEQ ID NO: 10210 - protein, 242 aa, Cytophaga hutchinsonii
VIFLHGFPFNRTMWKEQLEALQSETRVIACDLRGFGKSEDETSFLSIDQFADDLIGFMDALRIEKAIICGLSMGGYIALNAVNRFKNRFEALILCDTQCYSDTAEAKQKRYASMDEISTNGISAFNEPFLKSVCAAKTLETKPEVIEALREMVYSTSEHSLTMGLTALAERHETCSILSTIDMPALIICGSEDAVTPPEKSEYLHEQIYGSVLRIIDEAGHVSNLEQPELFNTHILHFIHAL

SEQ ID NO: 10211 - protein, 372 aa, Cytophaga hutchinsonii
VPLEILKLNKQLNTAMSDMGFVEPKEVQEKTLSRIIGGQDLVVIGPEGCGKTTAMILGVLAKLKYAFEIAPRAMIMVPNKDKGLELEEQFRFLGKNLDIRVLGVYPGAGMEGQRELLEDGIDVVIGTPDRIEALYIKSAVNLTQLKTFILDDADLIVKQGLQTVVKNISESLPKCQHIVFTEVMHEKLEKLIHFFLVYPTTIEVNLDSEHVLSTVDLQLFKVPNYKTKLNLLNLMMRDYDIYKKVVVFSNSKVTSDKLLKSLEKRIEGAVAIFNPSYSQKGFTSFEQFKQDENVRVLLLSNEEEVLLNLDDIGHILHFDLPADRTIFINRVERKQVDELPNTVAITYATDIELNMVRKIELGVGHSMEIMEL

SEQ ID NO: 10212 - protein, 464 aa, Cytophaga hutchinsonii
IAIIGGGISGFATALRLQNKGFKTIVFESHGQLGGCAGFFSEKGFSFDVGATTLVDFSKGGIGGDFFEELNFSLPEGEYIDYVLWLPDRKVTLYRDAIKWNKERLEKIGTTKNHIEFWNLIDKTTEVFWRAARKNIRLPIKNLNDIIYAFRVIGAKNIYLLKYQNYTMLDILKKFKLENDKALKGLLSVLIEDTVNSTIDKAPFINASLGCSIRGAGLMRATGGMKGFWNYLSKIYLSKDGVIKKAHKVLSLSKDRSVWTINTSKGSFYAKKIVSSLPIDLTYNIAPIHIKKILNKYMFHNKEATGGAIVIFLGVPESNLENEILTHHQILLNYDSPLGNGNNMFISISSKDDTLSAPLGYRSVMISTHCDINEWKNLSEHQYQLKKEEIGKRLLGYAKRVYPNLVDNGIIYKIGSPLTYQKFTNRVNGSVGGFKQTLENSNFNSIPQNIGEKDLWIVGDNTWP

SEQ ID NO: 10213 - protein, 336 aa, Cytophaga hutchinsonii
QYQNDLILRAARGEAVERTPVWLMRQAGRILPEYRAVREKLSGFIELCTTPALAAEVTIQPVDILGVDAAIIFSDILVIPEAMGLPYEMQESKGPFFPKVITSAADIDALLATDAADHLTYVYDAIELAVKELNGRVPLIGFAGAPFTILAYMIEGQGSKTFSKARRFLYTEPVLAHRLLEKITLATIAYLKRQVQAGAAMYQIFDSWAGVLPPDQYREFSLRYIKQICEAVPQVPRTVFSKGAFFVREDFNNFPCETVGLDWNMDIGESKKIIGPHKTLQGNMDPCALYLSEEQIRVKAKEMLDAFGTQSHIANLGHGLYPDTDKTKVKCFVDAV

SEQ ID NO: 10214 - protein, 315 aa, Cytophaga hutchinsonii
EDLFKVFRTFNVLIIGDVMIDSYLWGKVERISPEAPVPILQVEKREIRPGGAANVALNIKSLGATPLLCGLVGDDKDGADFLKILEDNQLPTEGIVSSKDRVTTIKHRIISNAHHMLRVDQEDDRVTNTAELALLKTRIDSLIDKAQVIIFEDYDKGVLSEELIAYVTDKANAQGIPTVVDPKKRNFLQYKNCSLFKPNRKELKEGIKTDANLNDSKQLEQTVEELIRLLTCDSVLITLSEKGVYWTDSSEHLHIPAHHREIADVSGAGDTVISVAALCAAARTKPAILAALSNLSGGLVCEQVGVVPIDKKLLQ

SEQ ID NO: 10215 - protein, 307 aa, Cytophaga hutchinsonii
MSSLKLFSGTNSHYLAEKIAAAYGEPLGHRTIKRFSDGEIYVSFDESVRGKDVYIIQSTFPNADNLMELMLMVDAARRASAAEVAAIIPYFGYARQDRKDKPRVPIAAKLVANLLSAAGVDRLMTCDLHAGQIQGFFDFPVDHLDGAAIFIPYLRSIQSDKLIIASPDVGGVKRAREFAKHLKAEFVVCDKHRERANEIASMQLIGNVEGADVILVDDLIDTGGTITRAAEVIMNKGAKSVRAICTHPILSGSAYENIENSVLTEMLVTDTIPLRKETSKIKVLTVADLFAKAIYQIQQNESVSSLF

SEQ ID NO: 10216 - protein, 285 aa, Cytophaga hutchinsonii
LFKPMLQAEAFKNKVVVVTGGGTGLGKSMAQMLLQLGANVVITSRKLEVLEAAAKELETLTGGSVLAVACDVRDYRQVEELLQKSVARFGRVDALLNNAAGNFVSPTENLSPKAFDVVVDIVLKGTYNCVLTFGKYWIDNQIPATVLSIVTTYATTGSGYVVPSACAKAGVIALTRSLAVEWAKYSIRFNAIAPGPFPTEGAWSRLFPGQIAELFEPGNRIPLKRFGKHEELANLSSYLLSEYSAYMTGEVVTIDGGEWLKGAGEFNGLDVVSKEEWAEIERSIR

SEQ ID NO: 10217 - protein, 720 aa, Cytophaga hutchinsonii
GMSCASCASSSQSILETQPGVISVAVNYANTTAQIEYIPTITNPKKLKASLQSIGYDLMVDESEEAKDTLEEIHKKNYTILRNKTIAAIVLSLPIVVIGMFFMDIPYANYIMWALSTPVIGYIGSSFFINAWKQAKHRSANMDTLVALSTGVAYFFSVFNTLFPEYWHQKGLHAHVYFEAASVVIAFILLGKLLEEKAKGNTSSAIKKLIGLQPKTVTVVHQGGHQVETPIANVKIGDVLLVKPGEKIAVDGKLVYGNSFVDESMISGEPIPIEKNINDSVLAGTINQKGSFQFVAEKVGGDTMLAHIIKMVQDAQGSKAPVQKLVDKIAGVFVPIVIVIAILSLIVWVLFGGENGFTQGMLAMVTVLVIACPCALGLATPTAIMVGVGKGAEAGILIKDAESLETARKINAIILDKTGTITEGKPAVTDVIWLNENADKINVFASIEKQSEHPLAEAVVNYFGEMSYLKVDNFESITGSGAKAVVDNTSYFIGNMKLIDAQKINIHTNLRNKSNLWLKEAKTVIYFANTTEVLAVLAISDKIKTTSIDAIKQLKTLGIEVYMLTGDNTFTAEAIAKQVGISQFKAEVLPSDKANFVKELQAQGKVVAMVGDGINDSNALAQANVSIAMGKGSDIAMDVAKMTIISSDLSKIPQAIKLSTYTVNAIRQNLFWAFIYNIIGIPLAAGILYPFTGFLLNPMIAGAAMALSSVSVVSNSLRLK

SEQ ID NO: 10218 - protein, 345 aa, Cytophaga hutchinsonii
QAKGYAAQNEKTDLAPWNFERRDVGPHDVQFDIHYCGVCHSDLHQIRNDWFKGIFPMVPGHEIVGKIVKVGAHVTKFKIGDLAGTGCLVDSCRTCDNCKDGLEQYCVNGNSGTYNSLEQDKKTPTYGGYSNTIVVHEDFVLHISDKLDLAAAAPLLCAGITTYSPLRHWKVGKGHKLAVLGLGGLGHMAVKFGVAFGAEVTVLSTSPNKEADAKKLGAHKFVVTSDAAQVNSVKGYFDFILDTVSAPHDVNMYMSLLKTNGVHICVGVPPTPYEVHAFSIIGGRKSLAGSNIGGLPETQEMLDFCAQHNITSDIERIDIKNIHASYERMLKGDVRYRFVIDMSTL

SEQ ID NO: 10219 - protein, 615 aa, Cytophaga hutchinsonii
QHFEACNTNQNGEIFWRETYLNPIFLPDGRIDEVSGISHDITEKKQWEITIQESEEKFRNIFESFQDIYYRTDLSGYITMISPSGCELSGYTQEEIIGKHISEFFTTPKQQVNLIREVLKTGRVKNYETNVNIKGGESIQSISNIRLIYNNEGKPIGVDGVARDITFLKKASQELYHAKEIAEKSLKVKENFLANMSHEIRTPMNGVIGMIDLLNETPLMEEQRKYVQTIKKSSETLLNILNDILDLSKIEAGKMQLRLAPISIEQTVEKLHALFYQQATLKNIDLLYSIDSNVPKVVLADETRLLQILSNLTSNAIKFTDQGSVRIQISLQSKKDLVNKIRVNISDTGIGIAQDKLNVLFGYFNQVDNSSSKSYGGTGLGLAISKELSKLMNGEIGVQTEANKGSVFWFTFEANESKRLVEAKVETPNAFSSEKTFKDYPKILLVDDNAINLFVASEILRKAGCEIDTAGNGLEAIQKVKENPYRMVLMDIQMPQMDGIEATAEIRKLNLAYTPPIIAMTAYSMKEDKDRFMVNGMDDYIAKPIKAESLISKVKAWLDSNAAKNGHTATQTSDETAVEIPILDLEVFEKLKSLSGAEIIDQIYKEFENESLEQI

SEQ ID NO: 10220 - protein, 282 aa, Cytophaga hutchinsonii
LRLAIQKSGRLSEESIKLIKECGIEFSSGGGTLKSVAYNFPLEVLFLRDDDIPGYVADGVADIGIVGENVAVETRKKMDTVRQLGFSKCRLSIGVPKAMEFTGKESLNGMRIATSYPNILSDYLFENNIKASIHEISGSVEIAPGIGLADAICDIVSSGSTLISNGLKETEVVFRSEAILAACPQLSAEKKAILDELMFRISAVKNAEKTKYIMLNVPDHAIQTVTALLPGVKSPTVMPLAEKGWSSLHSVVKESDFWEILSKLKEAGAEGILVLPIEKIVK

SEQ ID NO: 10221 - protein, 420 aa, Cytophaga hutchinsonii
ASDWSSLLKRPVMEAAELEGRVLAILKEVQERGDAALIDFALKFDGAAPKSLLATDAEIAEAKVLVSEELKAAIQVAKTNIEKFHTAQKEVQISVETMPGVNCWRKSLPIEKVGLYIPGGTAPLFSTILMLGVPATIAGCSQLVLCTPPNKEGKIHPAILYTANLLGIKTIVKAGGAQGIAAMAFGTASVPKVYKIFGPGNQYVTTAKQLVTKYGVAIDMPAGPSEVAVIADKQANAAFVAADLLSQAEHGADSQVVLISDSEDMINRVQTEVDAQLEKLSRKDLAAKALDNSKAFLVKDMNEAMAMSNLYAPEHLILQVEDLDNLVAKVVNAGSVFIGPYTPESAGDYASGTNHTLPTNGYATAYAGVSLDSFIRKVTFQKITKEGLQKIGPVIETMAAAEMLDAHKNAVTLRLKEINK

SEQ ID NO: 10222 - protein, 694 aa, Cytophaga hutchinsonii
TYTSTCSYCGVGCGVKIHKAVNGSLQIEGDKSYPANQGMLCSKGMNLHYAAMDQTDRLLYPEMRGNRNMPLQRVSWDTALDRAAAVFKALIEKYGPDSVGYYVSGQCLTEEYYIANKITKGFIGTNNIDTNSRLCMSSAVVGYKLALGEDSVPLSYDDIELADCFFITGANPAWCHPILFRRLENHKAANPHVKIIVADPRKTQSCSLADVHLQLQPGTDIVLCHAIARRLIETGKIDQAFIDAHTSGYEAFKEKVFTLSLQEAADICVLEKELIIQAADMIGDSQAFISMWAMGLNQSVIGVNKNVSLLNLSLITGQIGKPGAGPLSLTGQPNAMGGREVGGLSNMLPAHKNLLNPAHRKEVADFWGVPAINEKPGFTATEMFDQLLSGKMKAVWIICTNPLVSLPDARNAEAALRNARFVVVQDISNKSDTLKYADLVLPAAAYMEKEGVMTNSDRRISYLSKVMEPPGEALPDVDILCRFAHKMGWKESFNYASNAEIFEEYTRITKGTNIDISGLSYADLIQRRSVQWPVPEKGHPGTPRLFTDHTFYTPTGLANIISVDSMNHSEKLDDDFPLILTTGRIRDQWHTMTRTGKVRKLNKHISKPFLEIHPEDAGIRGIKQDDVVTIESRRGDVRVTAILTEDIKKGVVFLPMHWGRMLSTDLTRTNNVTNNLIDPVSKEPDYKFTAVQVT

SEQ ID NO: 10223 - protein, 198 aa, Cytophaga hutchinsonii
ETPLRVDAFELEDDIKVELISRKFKDIMEILGLDLSDDSLKDTPNRVAKMYVKEIFSGLNPLNKPAVALFENKYKYDEMILEKNITFYSNCEHHFVPIIGKAHVAYISNGKVIGLSKLNRIVDYFARRPQVQERLTVQIANELKSILGTEDVAIVLDAKHLCVSMRGVKDEASSTVTAHYSGKFKEEGVKNEFLAYIK

SEQ ID NO: 10224 - protein, 264 aa, Cytophaga hutchinsonii
MDLKLSDKVAFVSGSTAGIGFAIAKRLLMEGAQVIINGRTQHNIDEAIRELKSAVPKAKISGIAADFSNVDEVNKLIQALPDIDILINNAGIFEPKAFVEIPDEDWFRFFEVNVMSGIRLSRHFFPNMLKKNWGRIIFISSESAVFIPDEMIHYGMTKTAQLAVSRGLAELTKGSNVTVNSILPGPTKSKGVGTFIEDLSKANNISIEEVEKDFFKNMRPTSLLQRFASVEEVADTVAYYVSPLASATNGASIRVEGGLVRSIL

SEQ ID NO: 10225 - protein, 399 aa, Cytophaga hutchinsonii
LMSSRVLISGIGSVSSIGLNVTELTDSILESKTGVSRKTRLDSILARALPTAQIQLSDAALKSRVPGLPAKQVYSRTALLGMIAASEAVAMAGLTKEDCIRAGLVNSTSAGGMDKGEFFYADFIQSPSKGNLKLALTHDCGDAAEQMAALLGIEQYITTISTACSSAANAMIHAARLIKAGVCDIVVAGGSDAICKFTINGFNSLMILSEEPCKPFDKNRTGLNLGEAAGYFVLESEASVTRRGVKPLAVLSGYGNACDAYHQTASSPNGEGAYLAMMQAINVSGYAPSVIDYINAHGTGTQNNDMSESVALQRIFPADLPPVSSTKAMTGHTLAAAGGIEAVMSVLAIQNGWMFPNKNFKDPIEETGIIPVTELQTNKTIKHILSNSFGFGGNNSSLL

SEQ ID NO: 10226 - protein, 368 aa, Cytophaga hutchinsonii
NVYILADSVVTPLGQSTEENMEKLYSLQSAIRTYTHPQIGTFYASKFEDGKSFQIKKDAAGKTKIERLFISCIEKALERTEIDVENANVLFVFASTKGNVEYLTDETFDKNRLRIGITAQDVTAYFNNPNTPIVVSNACISGLQAIQYGYEVLQDNRYTHVVVTGADCFSEFILSGFHSFQALSPFPCKPFDKARAGLSLGEGCGTLILSNKKTDAAAIEILSVVSSNDANHLSGPSRTGEGLSSAILGAINEAGITAEQIDVISAHGTATLYNDEMESMAFKTANLEAKAVYSVKGNIGHTLGAAGIIETIYLAQSLQNNMLVPSIGFTETGTSVELNVTRQSTLKTMQIGLKTASGFGGGNTALLL

SEQ ID NO: 10227 - protein, 241 aa, Cytophaga hutchinsonii
NLKYALVTGAARGIGKAIAVKLASDGYHVLINYKSNDAEAEKTKSAIEEQGGAATLMKFDVSDRTEVNNVLAGWLEQHPDSVIEVLINNAGIRNDNLLMWMEPKDWDGVIDINLTGFYNVTKTLINQMLLNRYGRIINIVSLSGLKGVPGQMNYSAAKAGVIGATKALAQEVGKRGITVNAVAPGYIKTDMTQDINEKEAKAQIPANRFGEPEEVAELVSFLASKKASYISAEVISINGGL

SEQ ID NO: 10228 - protein, 460 aa, Cytophaga hutchinsonii
MITIGDQIVTLDQLKGFLYSNEQLEISAAAIERVKRNHQFLIHFSTDKIIYGINTGFGPMAQYRVSDEDRKTLQYNLIRSHCSGTGNALDPIYVKAAMIVRLNSFLIGKSGVHESLIFLLRDLINNNITPVVFEHGGVGASGDLVQLAHLGQCLIGEGSVHYKGEIREAAEVFAEAGISPITIQIREGLAVMNGTSFMTGIGVVNLIQAQNLVNWSVNAASLINELIASYDDYFSSELNDVKLHAGQRKVAAQIRERLEGSTLIKSRATHLYKKVDEMYFEDKVQEYYSIRCVPQIVGPISDTIEYATTVIENEVNSVNDNPVVDEAANNIYHGGNFHGDYISLEMDKVKIAITKLAMLAERQVNYLMNSKLNNMLPPFLNKGVLGLNFGLQGVQFTATSTVAECQTLANPMYVHSIPNNNDNQDIVSMGTNSALICSKVIENAYQVIAIELMSITQAID

SEQ ID NO: 10229 - protein, 690 aa, Cytophaga hutchinsonii
IPSIHCSSCLWLLEKLYTIEPGIIRSDVSFTKKEISITYNSSVVNLRRIVELMDSLGYAPHIQLNKTTEKETPETNRSVFYKLVVAGFCASNSMLMSFPEYLGLDREIEGMYAEVFGYISIALGLPVLFYSASDFYIAAWKGIKNKMINLDMPITIGMTALFSRSVYEILTHTSAGYIDSFTGLVFFLLIGKWYQSKVYQSMSFDRDYQSYFPVAVNRVEADGLKPAAISTLRAGEEIVIRSQEIIPADATLISESAYIDYSFVTGESLPVKKHKGELIYAGGRQTKESIHLRIEKEVSQSHLLQLWNNQVFDKSKGGNSVSQLADRFGRNFTIALLILSAITFGYWYTINIAAAFNALTAVLIVACPCALALSIPFAYGNAIRILAKKGLFLRSTEVVEKLAHIDTIVFDKTGTITQSDQSAVTFYGNKLTMEQLGCIYAVVQHSTHPLSMKLAAYLKPHALHYVVSDFEEISGKGLQASIAGNNYKIGSAAFTQRREAGTLAGAYVGISVNDVFYGYYIFRNKYRMHMDTLIQQLKGTYRLYVLSGDNDTEKKQLEAIFPEAENIIFNQSPEDKLAFISGLQQQGKQVLMLGDGLNDAGALKQSNVGISVSEEVYNFSPSCDGIMDALYISSLSRMLNFSRGTVKAVKATLLFSILYNIVVITLAVQGLFSPLVAAVIMPVSSVTVVL

SEQ ID NO: 10230 - protein, 425 aa, Cytophaga hutchinsonii
LITLAMVFCSMLAVNAQTTPVQKYGQLKIFNGKVSDQNNNPVVLRGMSLFWSGYPEGAPYYNATTVKWLRDDWCVDVVRAAMSVETGSSNYVNNPAAEMAKVKAVIDACIANGVYVIVDFHTHNAENYKNQAKTFFTEIATTYGNVPNVLYETFNEPIYQSWSGTIKPYHNELIQTIRAKDPDNIIICGTRTYSQEVDEAANDPVTGTNIAYTVHYYANSHQGSLRQKVTNALNKGVAIFATEYGTTDASGNGGYNPGESQTWWNFLEANKISSANWSVTNKNETSAALKPGTGISNWTTNDLTASGALVRAYLKGKCNVTVTTGSVTVAFAGNKIVYDAGETVTMTATATVANGTISKVEFYSGTTLLNSDASSPYTFSTSTLASGGHSITAKSYDAAGAVIAISPVYVISIIGASNVAYNRYH

SEQ ID NO: 10231 - protein, 281 aa, Cytophaga hutchinsonii
AYVFPGQGSQFSGMGKDLFENSAKAKELFLQANDILGFDITKVMFTGTDEELKQTNVTQPAIFIHSVILAKISETFAPEMVAGHSLGEFSALVANGTLSFEDGLKLVSKRAAAMQKACELVPGTMAAVLALADEKVEEICASIADEVVVAANYNCPGQLVISGSVKGIEKACELMKAAGAKRALVLPVGGAFHSPLMEPARIELEDAIKNTLFSKPACAVYQNVNAKPSTDVEAIKLNLIAQLTAPVRWTQSVQNMVKDGATTFVECGPGKVLQGLVKKIE

SEQ ID NO: 10232 - protein, 591 aa, Cytophaga hutchinsonii
KYNIIVVGTGLAGASAAASLAELGYNVQAFCFQDSPRRAHSIAAQGGINAAKNYPNDGDSVYRLFYDTVKGGDYRAREGNVHRLAEVSVNIIDQCVAQGVPFAREYGGLLDNRSFGGSQVSRTFYARGQTGQQLLLGAYSALSRQIHTGKVKMHTREEMLDLVMIDGEAKGIVTRNLETGKIDTHAAHAVLLCTGGYGNVFFLSTNAQGSNVTAAWRAHKHGALFANPCFTQIHPTCIPVSGDHQSKLTLMSESLRNDGRVWVPKAKGDKRKASEIPEDERDYFLERKYPSFGNLVPRDVASRNAKEQCDAGKGVGTSGLAVYLDFAESISRLGEDTVRARYGNLFDMYAQITGENPYKEPMRIYPAVHYTMGGLWVDYNLMTTIPGLYALGEANFSDHGANRLGASALMQGLADGYFVVPYTVGDYLAKIGPKAVDTKHPAFAEAKAKVEEQTKKLLAIKGTKTVAEYHRELGHIMWEYCGMARNEAGLKKAQVLIQELRADFWKNVNVTGTNEELNQQLERAGRVADFLELGELMVVDALNRSESCGGHFREESQTEEGEALRNDDDFCYVAAWEYKGDNQPEVLHKEV

SEQ ID NO: 10233 - protein, 243 aa, Cytophaga hutchinsonii
MSGHMNLTLKVWRQKDAKSSGKLETYEAKDISPDMSFLEMIDVVNEGLIKKGVEPIAFDHDCREGICGACSMYINGHAHGPKKGITTCQLHMRSFKDGETITIEPWRAKAFPIIKDLVVDRSAFDRIIQAGGYVSVNTGVTIDANAIAIPKEHADNAMDAATCIGCGACVAACKNASATLFLSAKVSQLALLPQGHPERASRVEAMIDQMEAEGFGNCTNTEACSAECPKEIGQEHIARMNRE

SEQ ID NO: 10234 - protein, 542 aa, Cytophaga hutchinsonii
GEIVFNTRKGQASEHFYGLGDKSADNDIREKRFENWGKDTYAYGKDTDPLYKNIPFFIGLHHKVAYGIFFDNTFRTYFDFGFERKNATSFWADGGEMNYYFIYGPELLNVVETYTNMTGKPELPPLWALGFHQCKWSYYPEKQVREITSEFRTRRIPCDAFYLDIDYMDGFRCFTWHPEHFSNPKGMISDLEKQGFKTVVIIDPGIKIDPNYRIYKEGLEKGYFCKRMDGPLMKGAVWPGECNFPDFTRAEVREWWAGLFDELMDTGVRGVWNDMNEPAVFEIETFPDDVRHDYDGDPCSHRKAHNVYGMQMARATYEGVKKFGHNRRPFVITRSGYSGLQKYSSAWTGDNVASWEHLSIANSQCQRLNVSGVSYCGSDIGGFIGSPSGELFVRWIQLGIFHMFCRVHSSGDHGDQEPWSFGLEVELLTKKFIELRYQLLPYIYTTFYQHVKTGVPTLRPLPFVAQEDSETYNRQDEFCMGDNLLVCPILAEKVDGRWVYLPEGKWYYYWDDKVHEGNQEVWAEAALDRIPLFVKAGAVIPM

SEQ ID NO: 10235 - protein, 398 aa, Cytophaga hutchinsonii
KTTMKTVDSFNFSGKKALIRVDFNVPLNKSFEITDDTRLKAVLPTVSKVLKDGGSAILMSHLGRPKGGPEEKYSLKHILPYLNKMFGQEVLFAADCIGEDAKAKAAALKPGQVLLLENLRFYPEEEKGDVEFAKKLSVLGDVWVNDAFGTAHRAHASTAVIGQFFKDKVCGYVMQAELDNANKLLKQGEKPITAVMGGSKISDKIMVIENLLDTVDNLIIGGGMSYTFTKALGGKIGKSINEPDKLELALSLIEKAKAKNVKLYLPLDNVVADDFSNDANKQTVKTGEIPDGWEGLDIGPETVKLFSEVVANSKTVLWNGPMGVFEFANFATGTIAIAKAVKEATQKGAFSLIGGGDSAAAINNLGFGNDVSYVSTGGGALLEYFEGKTLPGVAALEK

SEQ ID NO: 10236 - protein, 550 aa, Cytophaga hutchinsonii
  unsure (1)..(550): unsure at all Xaa locations
YRXKWLFCFNRSVNHFTESTNQPDGFTNNTNVLCNGNSTGSIVINPSGGNAPYTFSWTNGTTAQNLTNAPAGTYSVTITDNTTCSRTFGPYTITEPIAISATATPVSVSCNGKPDGSITLTPAGGTAPYTYSWSNGATTKDVSGLAAGTYTVTITDNNTCSKAFGPFTITQPVAISATGTVSNITCNGSSTGSITITAPTGGAAPYSYSWNTGAAIKDLTGLAAGSYTLTITDQNGCSRILPTFTITQPTALSSIGAVTQVVCNGTATGAINISTPTGGVAPYTFLWSNGLTTQNNPSLIAGSYSVTITDASGCKLVLPFTVTEPAAIATTETQMNASCNGTSTGSISISTPTGGTAPFTYLWSNGVTTQSNMSILAGNYSVTITDSKGCSKLFGPYTITEPASIAVTGTSTPPSCNGSASGSISLDLPTGGVAPYSYSWSNGATTQNLTNVVAGTYTVTITDSKGCSNPTPVSFTIANGVPITGTASATPATVCSGQGTMVTATIDAAYTPATNAYSFNAGSTFQSSSSFAIAKITGDTVISVVIKDIN

SEQ ID NO: 10237 - protein, 747 aa, Cytophaga hutchinsonii
IKKVYSLMPQRIEAAKKLIGKPLTLTEKILYSHLDEGTATKVYERGVSYVDFNPDRVAMQDATAQMALLQFMQAGRPKVAVPSTVHCDHLITAKEGATKDLPFANKESKEVFDFLGSVSNKYGIGFWKPGAGIIHQVVLENYAFPGGMMIGTDSHTVNAGGLGMLAIGVGGADACDVMAGLPWELKFPKLIGVKLTGKLNGWTAPKDVILKVAGILTVKGGTGAIVEYFGEGATSMSCTGKGTICNMGAEIGATTSTFGYDESMERYLRATGRADVADLANGIKQHLNADPEVYASPEKYFDQVIEINLSELEPHLNGPFTPDLATPVSKMKEEAEKNGWPLKVEWGLIGSCTNSSYEDLSRAASIAKQAIAKGLVTKAEFGINPGSEQVRYTADRDGLLGTFTDLNAKIFTNACGPCIGMWDRVGAEKKEKNTIVHSFNRNFAKRADGNPNTFAFVASPEMVAAIAIAGDLSFNPITDSLINDKGEKVKLDPPFGDELPTKGFAVEDAGFQAPAADGSAVQVAVSPTSDRLQLLDPFSAWEGTDLKGLKLLIKAKGKCTTDHISMAGPWLKYRGHLDNISNNMLIGAVNFFNDKTDDVKNQLTGTYGPVPATQRAYKAQGIGSIVVGDENYGEGSSREHAAMEPRHLGVRAVLVKSFARIHETNLKKQGMLGLTFANKDDYNKIQEDDSIDILGLTTFAPNVPLTLVLNHKDGSKEEIKVNHSYNEQQIEWFKSGGALNIIRANVG

SEQ ID NO: 10238 - protein, 255 aa, Cytophaga hutchinsonii
IPFYKYQGTGNDFIIIDNRSNIFDRERRDIVAQLCDRRFGIGADGFILLQNKEGYDFEMVYYNADGNESTMCGNGGRCIVQFAQDIGVMNLTTHFLAVDGVHYAFIKEKLVNLQMMNVAGIDTLADDTFFLNTGSPHYVKKVEKIEQFPVFETGKSIRYSDTFAPGGTNVNFMEMQDNWLFVRTYERGVENETYSCGTGVTAAAIAAEKLGIAPQYVLIKTLGGELEVTFIKKSDGSYKDVFLIGPAKRVFTGEI

SEQ ID NO: 10239 - protein, 417 aa, Cytophaga hutchinsonii
FIQNRSKLAEKLVPNALAIFHSNDIYPTNADGTMPFRQNNDLFYFSGIDQEDTILLVFPDASDKRYKEVLFILETNEHLAIWEGAKFSKEEAKKLSGIETIFWFHEFDAILKQLVYDATTIYCNQNEHGRAEKLIDTRNDRFVQTCKTRYPLHEYKRLAPLSNALRSIKSKSEIDTIQKACNITKDAFERILKSIKPGIKEYEIEADIIHEFIKQGSRGHAYQPIIAAGANACVLHYIQNDQVCKEGDLILMDFGAEYGNYASDLTRTVPVSGKFTARQKEVYTSVLTVFKQIKKCIKPGVTLQELNTQTGKFVTEELLRLHLLSKKEVDAPDGSLAYKKYFMHGIGHHLGLDVHDVHVKNEPLKEGMVITLEPGIYIPEEGIGIRLENDILLVTNGNIDLMEHIPLEIEAIESLMS

SEQ ID NO: 10240 - protein, 400 aa, Cytophaga hutchinsonii
YQYPNGITLLHKQVLSTRIAHCGYIFDVGSRDEDLKTQGLAHFWEHMAFKGTDKRKTFQILSSLEQVGGDLNAYTTKEKIWFHASLPFTYLERAADVLTDISFNSIFPEKEIEKEKKVVLEEMHMYADNPEDAIQDEFETLIFPEHSLGYNILGTEKTLQSFTQQNLKSFLKKNIDTSRVAFVVLSPQSFTEVKYITDKYIPHVKAQHSAKVREKNRGFKPATLIKKIDASQTHCVIGSLGLNIKEERRLGLFLLSNLLAGPGMTSTLNMAMREKKGYVYTIESNFTSYIDTGVYSFYFATESKQFEKALDVFHKEIAKVREKKLSTVQLHRLKEQIKGQLIMAEENNSNFMQMMGKSYLDFGKIDSFDHIIKKIDGISAEVINDLANQLMNPARMSKLI

SEQ ID NO: 10241 - protein, 398 aa, Cytophaga hutchinsonii
LIVFLIACLYSAMLSAQINTPSGAVVPFNSNPNYGGNGIMPTNLPTTGTYGKSQDAADAYNEWKAAYTETCTGDMIRIKFDEPNRTVSEGIAYGMQLAAYAADKALFDGLYKYWKNFQSPNSSGKAGKLMNWRINGCSGVSGTGSAADADVDAAWALMIAETQWPNLNTPYDYITEANNMLNAIKELEMLNGQLINGDGWGFADQCRNPSYQSPAYYEYFKVVNAGNSGTWNGGITGAYNLINANADVTTGLISDWSNPSGVRNTCNPGGLGQAATDGYGYDACRNPWRMAQDVIWNNNANAKTICGKITDKYINVKGPGGVGGPLYQNGNNYAGFSHNATFVSTFAMAVMGSTNQALMNSMYTETKNTKDVIKNSTLSGYFGNTLRCVSLFMMTGNF

SEQ ID NO: 10242 - protein, 573 aa, Cytophaga hutchinsonii
LPTTVFAISGIPATPIAAGGSATFKVTGKPAAAGVNTGSITIVTNDPVTGSYKVNVSVTGTVPALQVLNSATAVTSDNAPAISVGSSTVGTSAAAYTAFSVKNAGLAPLTFTSITSSSADFVISAVTPATPASIAAGNSATFTVTAKPAVVGANTAVITIVTNDPTNPTFKLNVSVTGIAASTPSVQVLNGASIVTDNSTAILVGTAPVNTTAAPFTTFSIKNNGTAALDFTSITSSSADFVISAVTPAAPTSLAIGASATFTVTAKPMVLGTGNTAVITIVTNDPTTASFKLNVTATGTAPAIQVFDGAGTTTQITSDNVTAISLGTATVTEAATPSHTFTIKNNGTAPLTGLALTATAGFEVSALTPAGTSLAPNATATFTVTGTPALVGANTGSITIASNDGTTPAFKINVSVTGTAAPAKLQVVDGTSILTSNGTAISLGTAVVGSAVPDYTTISIKNTGGSPLTFTSITSSSAVFVLADVTPAAPGTIAAGASATFTIKATPVLGANTGKITIVTNDATTPSFVINVSATGTSNPVPAVQVLDGSTQLVTNGTAVSLGTAPVGTDAPA

SEQ ID NO: 10243 - protein, 424 aa, Cytophaga hutchinsonii
TTLSIKNNGTAPLSFTSITSSSAQFVITDVSPAAPTTLAVGASATFTVTAKPLVVGTANTAKLTIVTDDPATASFVVNVSVTGTPAPLPSLQVLNGSAIVTNNNATPISLGTAAVGSPAPAYTSLSIKNNGSAPLTFTSITSSSAQFVVSGVTPEAPTTLAVGASATFTVTATPLAVGTGNTAKLTIVTNDPATPSFDVNVAVTGTPAPKPIITVTGVTNNGSTVSIGNVTENTATAPYTFTISNTGSLPLEVGSITSSNPVFVVTQVNPTTIAPNSTGTFTVIGTPTSVGTVTGKITIPSNDISTPSFVINVSVTGKTAPSGAILEILNKSAIVMVNDGTPMMIGANSINTVTAPYQFTLTNPGTVAVNIGGITATTGFIATQMNPTGTTLAPGAIATFTVRGTPNSVGTPRQGSVIIKSNNA

SEQ ID NO: 10244 - protein, 826 aa, Cytophaga hutchinsonii
MEAKFSNRVKEVISLSREEALRLGHDYIGAEHLLLGMIREGEGVAISLLKKLGITLDSLKKSLEEAVRGTATGNVKNLTNIPLTRQAEKVLKITYLEAKIFKSDLIGTEHLLLSVLRDEDNVATQILNKFDITYDVIKELLEYHTHTPKATDAEDADDDSSRLFGNSGSGAGKEAARPGAEKSRTPVLDNFGRDLTKYAEDGKLDPIIGREKEIERVAQILSRRKKNNPILIGEPGVGKTAIAEGLALRIVQKKVSRVLFGKRVVTLDLASLVAGTKYRGQFEERMKAVMNELEKSPEVILFIDEIHTIVGAGGASGSLDASNMFKPALARGDIQCIGATTLDEYRQYIEKDGALARRFQIVMVDATTPEETVQILNNIKEKYEDHHNVIYSPEALEACVKLSDRYISDRFLPDKAIDVLDEAGARVHINNIHVPADILKLEEQIENIKKEKNKVVKSQKYEEAAQLRDSEKKLIEQLDNAKLRWEEETKKKRYHVKEENVAEVIAMMTGIPSARVAQKESLKLLSMGSDLKAAVVGQDQAIEKLVKAIQRTRVGLKDPKKPIGSFIFLGPTGVGKTELAKSLAKYLFDKEDSLVRIDMSEYMEKFSVSRLVGAPPGYVGYEEGGQLTEKIRRKPYSVVLLDEIEKAHPDVFNLMLQVLDDGILTDGLGRRVDFRNTIIIMTSNIGVRDLKDFGSGIGFNTQSRKENVDEMMKGTIQNALRKAFSPEFLNRLDDVIVFNSLTREDIHVIIDITLAKVFSRITTLGYTIELTDKAKDFLAERGYDQQYGARPLNRAIQKYLEDPIAEEILKGDVQEGDTILADYKEG

SEQ ID NO: 10245 - protein, 245 aa, Cytophaga hutchinsonii
LLSGKTALVTGASKGIGKSIAMRYAQEGANVAFTYLSSVEKGQALEKELQALGIKAKGYRSDASKYTEAEELVTSVLADFGQLDIVVNNAGITKDGLLMRMTEEQWDSVMEVNLKSVFNLTKAALKPMMKAKAGSIINMTSVVGISGNAGQTNYAASKAGIIGFTKSVAQELGSRNIRSNAIAPGFIETEMTEVLDPKVKAEWENGIPLKRAGKSEDVANACVFLASDLSTYITGQVLQVDGGML

SEQ ID NO: 10246 - protein, 442 aa, Cytophaga hutchinsonii
MSTKFDVIVIGSGPGGYVAAIRASQLGKKVAVVEKAELGGICLNWGCIPTKALLKSAQVYEYIKHAKEYGINVGNAEADFTAVVKRSRDVAAGMSKGVQFLMKKNKIEIIAGFGKLVKGKQVEVTDDKGNKSLYGADHIILATGGRARELPNVKIDNNKIIGYRKAMVLESKPESMVIMGSGAIGVEFAYFYATMGTKVTIVEYLPNIVPVEDEEISKQLEKEYKKMGINIMTGAAVESVDTAGKGCKVTVKKGDATEVIECDIVLSAVGVATNLEGIGLEDVGVATDKGRVLVDDYYKTNIPGVYAIGDIVKGPALAHVASHEGIICVEKIAGLNPEPMDYGNIPGCTYCTPEIASVGLTEKAAKEKGYELKVGKFPFSASGKASAAGAKEGFVKVIYDAKYGELLGVHMIGANVTEMIAEAVVARKLEATGHEIINAVHP

SEQ ID NO: 10247 - protein, 758 aa, Cytophaga hutchinsonii
DNIKIIIGNGINITEIKQVQEKLAKSEELYRLVIHAANDGIWDWDIASGSLYLSERWKSMLGYTDETLANHISSWEKTMHPDDLSIAKEILQNHFEKRKPYNYTLRYLHVDGSIRWIMCRGFAIRNRKGEPYRMVGSCTDVTDTQIAEEKLKENEEKLQAIFNHSHDAKFLVDPCTNKIIEFNKRTLELFETDKPDTLYTIPLTSLRKYPLTDAELADTQNQFKQLGYWNQEVLYITQKKNEFWGNIVAKTIFINKKEVILVRITDISENKKIEQELIKAKQIAEESTKAKEMFLANMSHEIRTPMNGILGMAELISRTSLDVTQKKHVQLIKNSADNLLIIINDILDIAKIESGKLTIEQIPFDICEVIKSAIQTLTYKAEEKGIDLIIHPIKLDHRVVIGDPFRLTQALLNLINNAIKFTENGSVEISGRIPHSSSTDITFEFTVKDTGIGIPQEKLDSIFEGFTQASPDTSRKYGGTGLGLTISKNLIQMQGGNIWVESVVGKGSKFIFSITYKKGDLLDVSPNNKNKINLYQLHDLKVLLAEDNEVNQYFAKTLMDEIGVKVDVANNGIEAFQFFEQNEYDIILMDIQMPYMGGIETTSKIRSHANKTKAKIPIIALTANALVGDSEKYIEAGMSDYISKPFDRETLFRKLQLHAGSNKNIFQDAKNIHLFQSDTNDAYLPNYSHLEKNFQNNTVFLKKIFTLFIESTPEIVNELKLFSEGKDYEKLQATAHKLKASVDAFKIVALHQTIRNIE

SEQ ID NO: 10248 - protein, 328 aa, Cytophaga hutchinsonii
VKTLVQFITESQKHVFGASGDLSKILNDIAVAAKIINREVNKAGLLDILGMEGGMNVQNEEVKKLDVYANDQFISALRSGGQCCAIASEENTDIIPIENNGHSKSNYVVLIDPLDGSSNIDVNVAIGSIFSIYRRVSESGPGETVDCMQVGNKQVAAGYIIYGSSTMMVYTTGDGVNGFTLDPSIGEFCLSHPNLKIPEDGFIYSVNEGNYADFPREIQEYIYYCKTPDFETSRPYSSRYIGSMVADFHRNLIKGGIFMYPATAKYPLGKLRLMYECNPLAFIVEQAGGKAIDGEGRILDIEPTNIHQRTGIIIGSKNMVEKVEAFIQ

SEQ ID NO: 10249 - protein, 474 aa, Cytophaga hutchinsonii
GNNTTGCVPAIAVPSTAFCAGGSVLMTATTGTSYKWFNGTSQVGTAATYTATTAGNYTVEVTNASGCKATSIPVTITVNTLPVITPYVKIDANAWTSSSTAAVCEADTVNFGPHPNVASGWSWTGPNNFNSSLRNPVLTAITATQAGTYKATYTDANGCKTTSDFILQVSKPTAAITVSAASFCPGGSAVLTASTGTTYKWFKGTTALGTASTQTVTEAGAYTVEVTNAAGCKATSAPSTVTLSTPQATPTITATVTSFCPGGSAVLTASTGTTYKWFKGTTALGTASTQTVTEAGAYTVEVTNAAGCKATSAPSTVTLSTPQATPTITATATSFCAGGSAVLTASTGTTYKWFKGTTALGTASTQTVTEAGAYTVEVTNASGCKATSAVTQITLNAAPPAIITASATSFCAGGSAVLTASTGTTYKWFKGTTALGTASTQTVTEAGAYTVEVTNASGCKATSAVTQILTTQPS

SEQ ID NO: 10250 - protein, 412 aa, Cytophaga hutchinsonii
KRVVVTGIGALTPIGNNTESFWNSLISGTSGAAPITKFDASKFKTRFACELKNFDPVNFMEKSEARKYDLFTQYALIAVEEAVQHAQINFETLNRNRIGVIWGSGNGGIGTFQEQVTEFVKGDGTPRFNPFFIPKMILDIAAGVISIKYGLRGANFATVSACATSNTAIIEAFNHIRWGKADMIITGGSEAPINEVSVGGFNASRALSTLNENPSIASRPFDTNRDGFVMGEGAGALILESYESAVKRNAPILAEVVGGGMAADAYHLTGTHPEGEGAYLGMLEALAEANISAADIDYVNAHATSTPQGDISEMKAIERVFGASTKLHVSATKSMTGHLLGAAGAVEAIACIKAVQHNIIPPTINTMEIDAAINPSFQFTLGEAHHKTVHYAMSNTFGFGGHIATAIFKKYE

SEQ ID NO: 10251 - protein, 868 aa, Cytophaga hutchinsonii
VLSKTKEATETPLMKQYNAIKGKYPGALLLFRVGDFYETFSEDAIKASKVLGITLTKRGNGTASETALAGFPHHSLDTYLPRLVRSGLRVAICDQLEDPKSVKGIVKRGVTELVTPGVSFNDHVLDVSKNNYLAAIHFQKDSLGISFLDISTGEFLTAQGDRHYIDKLLQSFSPSEVLFCKQKKEVFIEYFGDRYNTYALEDWIFAYDFTYDLLIRHFQTTSLKGFGIEEMLEGITSAGAILHYLNETEHKEVAHITRVNRIEEERYVWLDRFTIRNLELVNAQQLEGVPLIEILDHTKTPMGARLLKKWLILPLKELTPIQERLDTVELLVKNKELTTTLVDELKPIGDLERLISKVAARRVNPREMVQLKRSLERLVPIQQLLKQQDQHVLLKLAEQINPCEYLAGRILNMLKEDAPMLTNQGRIIRDGCNAELDELRAIAYTGKDYLLQIQQREIERTGISSLKISYNKVFGYYLEVTNTHKEKVPADWIRKQTLTGAERYITEELKIYEEKILGAEDKINVIEQKMFQDLVLEAESYINPILQNARIVAQIDCLCSFAHAAVANNYCKPIVEDSALINIKAGRHPVIEKQLPLGESYIPNDIYLDDETQQVMIITGPNMAGKSALLRQTALIVLMAQAGSFVPATHATIGTVDKVFTRVGASDNLSKGESTFMVEMNETASILNNLSGRSLVLMDEIGRGTSTYDGISIAWAIVEHLHNHPNFRPKTLFATHYHELNQLTEDLKRVKNFNVSVKEAGNKVIFMRTLKPGGSEHSFGIHVAQMAGMPTSLVLRANEIMGHLEKEHVREGHEDKLKEVPKSTLQMSLFEAADPAWDSIKKILTQTDVNIMSPVEALLKLNELKQLI

SEQ ID NO: 10252 - protein, 329 aa, Cytophaga hutchinsonii
KVAVVGATGLVGTQMLNVLKERNFPITELIPVASEKSVGKEVEYNGNKYKVVTAETAIAMKPEIAVFSAGGGTSLELAPLFAAAGTTVIDNSSAWRMDPTKKLVVPEVNANVLTKEDKIIANPNCSTIQMVVVLEPLHKKYKIKRVVVSTYQSVTGTGKKAVDQLFDERKGIMNGVKAYPYQIDLNLLPHIDVFQENGYTKEEMKMILETNKIMGDDSIKVTATTVRVPVIGGHSESVNIEFENDFDVNEVKELLSKAPGIIVKDNPSKLEYPTPMDAHNRDEVFVGRIRRDESQPKTLNLWIVADNLRKGAATNAVQIAEYLVANKLV

SEQ ID NO: 10253 - protein, 405 aa, Cytophaga hutchinsonii
KIKVANPVVELDGDEMTRIIWKFIKDKLILPYLDLDIKYYDLGMENRDATNDQVTIDSAEAIKKYSVGIKCATITPDEQRVEEFKLKQMWKSPNGTIRNILDGTVFREPIVCTNVPRLVPNWTAPIVVGRHAFGDQYKATDFVVPGKGKLTIKFEGEDGKVIEHEVYQFKGPGVAMGMYNTEESIRGFAYSCFNMALSKKWPLYLSTKNTILKKYDGRFKDIFEEIYQKDYKSKFEAAGIVYEHRLIDDMVASALKWNGNFVWACKNYDGDVQSDTVAQGFGSLGLMTSVLVTPDGSTMEAEAAHGTVTRHYRDHQAGKPTSTNPIASIFAWTRGLEFRGKKDGNQELVNFCQTLEKVCVATVESGKMTKDLAVCIHGNKVKHGEHYLYTEEFLAAIDDNLKIAL

SEQ ID NO: 10254 - protein, 385 aa, Cytophaga hutchinsonii
MKAAVFHKPGHISVDTVEDPKIEKSDDIILKVTSTAICGSDLHIYDGFFPQARPLIMGHEFMGIVEEVGNAVTHLKAGDRIVVPFPIACGHCYFCNHDMQPNCEHSNPEHYGPEGDVLSGKGGGLFGYTDLYGGYAGGQAQYVRVPYADYSPRLVPESLSDEQVLFLTDIFPTGWSAIDWAQLKGGETVAIFGSGPVGLMAQKAAWLKGAGRVIAIDPLNYRLAKAKMVNNVETLNPHEVDVIEAIRAMTNGRGADVCVDAVGVEAERTFFDKVKAVVRFEKGTDKVLENCFKAVRRGGTVTVVGVYGTPYDNFPLHTMFDKGLTVRLGQAPVQKYIDHLFTLVQNEKVVLNDIVTHVLPLSHASHAYDIFKNKQEDCVKVILKP

SEQ ID NO: 10255 - protein, 868 aa, Cytophaga hutchinsonii
LINDFQTNTQSGLTTSEAENRIKEFGQNIYQVQKQKSIWLMLLLQFKSPIVYLLLAAAAVSLYFKDVIETAAILVVIVVNAIIGFLMELQARSSMNALKEMDVIKTNVIRDGKKQEIPSENITPGDIVLLEAGDVVPGDGRIIEANQLKCDESSLTGESLPAEKKTEELQANTALGDQHNMVFKGTSVVNGNGKALITGIAEHTQLGTITSLVEKSEDKQTPLDQKINVLSKKLIWITLTMTAIFAATGVIQGKEWVLIFESSIALAVAAFPEGLPIVATIALSHGMLLMAKRNAIVKKLSAVETLGGTRVILTDKTGTLTENKIYVETFSFPEEKIAVKINNNTVNYPDKQIEKSKENFEKMRLVGALCNNAPLEQQEQKDDQKPAAGDPIDIALILLANVSGTSAKDLQGQFERIGEVPFNSDIKIMGTLHNSPNGKFVAAKGSVEHLLNNCSKIQYGSEIKDLNDEQKKGILDESEKMAADGLRVIAFAYREGQDINTDNYLSELIHVGMIGFLDPPRMDIKDAILRCRNAGIRIVMITGDHPMTALNIAKKIGLVDENEQHVIIGQDLPEAEAVTDEWREKILATSVFARTTPKQKLEIVEAFQKAGNIVAMTGDGINDAPALKKADIGIAMGLRGTQVAKETAGIVLKDDSFTSIAEAVAHGREIFDNIKKFIVYLFSCNLSEIFIVTILGFITPLSTLLPLQILFLNMVTDVFPALALGVGKGDEKVMEKQPRDAKENILTNKDWIRIALYSLLISVSVIISVLYCNHIIESDHKIANNAAFLTLAFSQLFHVLNMSSFSSKMFLNDITKNIFVWLAILLCAGIMITVYAIPYTRLILGLELLPAEAVVVSIACSFIPVVVV

SEQ ID NO: 10256 - protein, 383 aa, Cytophaga hutchinsonii
DYYNMDDLLTEEHKLIRQSVQAFMNKEVKPIIENYAQRSIFPDHLVKPFGALGLYGPTTPVEYGGGGLDYISYGIMMQEIERVDSGMRSMASVQGSLVMFPIFKYGSEEQKKKYLPKLASGELLGCFGLTEPDHGSNPAGMVTSIKDAGDHYILNGAKMWITNSPKADIAVVWAKDDAGRIKGIIVERGMEGFTTPEIHNKWSLRASITGELVFDNVKVPKTHVLPKADGLSGPLKCLDSARYGIAWGALGAAMECYDIAKNYAMERVQFGKPIAGFQLTQKKLAEMLTEITKAQLLVWRLGMLKNEGKASTGQVSMAKRNNVDMALKVAREARQILGGMGITGEYPIMRHMMNLESVVTYEGTHDIHLLITGHDITGLNAFK

SEQ ID NO: 10257 - protein, 465 aa, Cytophaga hutchinsonii
LTKSAFGLVGLGVMGKSLARNFAANGVALSLYNRFVKGSEEQVAEKCIAEYPELQSAKGFEDLKTFAASLEQPRKIFLMIKAGEETDTFIEELVPYLNAGDVLIDGGNSYYGDTKRRIEFLARKGIYFIGTGVSGGEQGALKGPSIMPSGDPDAYALVEKYLTLIAAKDKQGESCCTYIGKDGSGHFVKMIHNGIEYAEMQLIAEVYAYLRYAIKIEPTEIAALFTEWNSGELNSYLLGITAALLIKKEGDAWLIDLILDKAGNKGTGNWATIAASELGQPATLITSALFARYVSTIKEHILVNTQPASVYHFNTAALSEIKDAYMLARIVNHQQGFMLIHEASQKYGWDLNFAEIARIWTNGCIIRSAFMEELIPALKKDSNIFTHPAILKQLKDLKPALKAFAVNALQYDLSVPSHLAALDYLNVLSGNYATANIIQAQRDFFGAHTYQKIGDSSGKYYHTEW

SEQ ID NO: 10258 - protein, 162 aa, Cytophaga hutchinsonii
MENRIYIVMGVSGCGKTTIGTLLAETLGINFYDGDAFHPISNIEKMAAGIPLTDEDRYNWLLDINKQAKESLSEGHSVVFACSALKESYRKLLAQQIEDTIVWIYLKGDLDTIHLRVKNRTGHFMSPALLQSQFNILEEPSSAMHIDTALDTDTIIHTIVKK

SEQ ID NO: 10259 - protein, 468 aa, Cytophaga hutchinsonii
VNKKTKIIATVGPACNTKEKLWELVQAGANIFRLNFSHGTHDVHQGVINAIRELRKEHNVNIAILQDLQGPKIRTDEVENNGVELVAGAQIVITKEKMLGTKDKISTSYKMLTSDVKKGDAILIDDGNIELKVLETGNGEVTCVVIYGGILKSRKGINLPNTIVSEPSLTDKDKEDLLFGLKNEVDWIALSFVRSAVDLNELKAIIAEHGKSCKVIAKVEKPEAVKDIDAIIEASDAIMVARGDLGVELQMEDVPMIQKMIIKKCNQLAKPVIVATQMMESMITNARPTRAEASDVANAIIDGTDTIMLSAETASGNYPVITVKAMTRICQAVEKEADIYNKSTLDDITNTSDSVIASACELADKVNAKAIIGLSQSGYSAFRIASHRPKASIYIATHDEQLMNQMNLVWGVQAFRFEKFTTTDESIEAVKKSLVEKGLLKKGDIYVTTASMPMADIQLANSLKLGIV

SEQ ID NO: 10260 - protein, 73 aa, Cytophaga hutchinsonii
MSEIAQKVKSIIVEKLGVEESEVTTEASFTNDLGADSLDTVELIMEFEKEFNISIPDEQAENITTVGQAIAYL

SEQ ID NO: 10261 - protein, 413 aa, Cytophaga hutchinsonii
MNLKRVVVTGLGSLTPIGNTVPEYWDSLIKGVSGAALITKFNPEKHKTKFACEVKNFNVEDFIEKKEARKMDPFTQYAVVVADEAIKDAGITADLDHDRIGVIWGAGIGGLKTFEDEVSAFSKGDGTPRFNPFFIPKMIIDISAGYISIRNGFRGPNFSTVSACASSSNAILDAFNYIRLNKANIIIAGGSEAAVVESGIGGFNACRALSERNDDPATASRPFDKDRDGFVMGEGAGALVLEEYEHAKARGAKIYCEVIGGGMSADAYHLTAPHPEGLGAKNVMLNAISDAEIAKEDVDYINVHGTSTPLGDIAEVTAIQAVFGEQAYKLNISSTKSMTGHLLGAAGAIESIATILAIKNQIIPPTINNHNRDEAFDARLKLTLNKAEKREVNVAMCNTFGFGGHNCSIVFRK

SEQ ID NO: 10262 - protein, 137 aa, Cytophaga hutchinsonii
VSRQEHFNAAHKLYNPAWSEEKNAEMFGPCANSNWHGHNFDLIVTVKGEPSPDTGFVIDLKKLSTLIREKVTDKVDHKNLNLDVDFMIGKMASTEILAYEFWKILEPHITTLSDGRGKLHSIKLYETPRNYVEYFGE

SEQ ID NO: 10263 - protein, 875 aa, Cytophaga hutchinsonii
GKASPDTITEKHIQVYSIAFQLLNMAEENGAVKLRRKHESEKSLSSVNGLWGKSLLMLKQKKITPEQIAEELCNVRIEPVLTAHPTEAKRTIVLEHHRQLYLLFLRWEDSTYTELEKSEIRREIKLTLDRLWRTGEIYLEKPDLSSERSNVLHYLTTVFPEVVSILDRRLGMAWEQMGFDPELIITYTKLPKISFGNWVGGDRDGHPLVTSEVTRETLELFRLNAFILMHRHLEKLEKNLSFTCLFKETIKPLQKRINELVEETGTQELLEKESNNREIFRFYIELLIMKLPLEENKGDGLRLNEKTYSYNESQKLIEDLVILRDALLAFGARAIAYNDVRDMVRLVQTFGFHLAHLDIRQNSKFHDNAISQLMNAASMDGDRFLTLNEEERCKFINKELLSLRPFSYPNTTLGPEAEAVTSCLRVVAEHVEKYGTKALGSLIVSMTRSTSDLLLVYLLAREAGLLIKTEKGIVCKLPVVPLFETIEDLQGSPHILSKFLEHPITKNSLEYHRTCTGEKEKVQQVMIGYSDSNKDGGILASQSNLSNTQLKLVDVGKKYGARIRFFHGKGGSISRGAGPTQWFIKTLPHNTIQGDMRLTEQGETISQKYANKINAAFNLELLEAGTAGYTILHKYTKHKKNRFDKHLDYLAEKSKEFYTNLITDKNFITFFGQATPIDVIEQSKIGSRPARRSGKRTLADLRAIPWVFSWAQSRFNITSWYGVGNALETFYKEQPEEFEYLKKMASSDTIIRYIFTNVDTSLAATDEKIFRSYATLVEDEEVRAEILDMIVKEYNKTKKMLALLFDNPFEVRRSFHHYSNVLRAEALNDLHYDQIELLRKWRKMNTQPQSEKANKILTELLLTVNAIAGALRNTG

SEQ ID NO: 10264 - protein, 430 aa, Cytophaga hutchinsonii
KRLLSAFIFVSLVFTTVCHQTVAQTQPFPANKTYSYGTMPGNKNSQDAINNYNTWKTNYVEACSNGRFRVKFDNRSQTVSEGIAYGMLLAAYSGDRTLFDGLWNYYKDNRNGNGVMNWKINGCSGTAGANGATDSEVDAAMALIVADYQWSTSGSINYKNDAKALITAIKNFEVESGSYVLKPGDQFGGSSLTNPSYFAPGYFRTFATYMNDTFWNNVADKCYVVINNNLSVNNAAGGLVSDWCTASGSYSSAAGGYANGGRNYSYDAARTPWRIAVDYVWYGNASAKTYSKKSSDFVRVNLGGSQNVKDGYSQNGSAVSNYHNSTFVGAFAAAAMAGENQSHLDNSYSDLKGINDANSYFNQTLKTLYLFLLTGNFYLPGSGTVVPPVNAAPTVSLTAPSNNAAFNAPASVTLTANAADADGTIAKVEF

SEQ ID NO: 10265 - protein, 706 aa, Cytophaga hutchinsonii
TSKTEGTDPKFQDLQKNTSDATDQFMTTDQGLKINDDNNSLKAGERGPSLLEDFILREKITHFDHERIPERIVHARGSAAHGYFQVHESMAQYTKAGFLQDPSIKTPVFVRFSTVAGSRGSTDLARDVRGFSVKFYTAEGNYDLVGNNMPVFFIQDAAKFPDLIHAVKPEPHHEMPQAASAHDTFWDFISLMPESMHMIMWVMSDRAIPRSLRMMEGFGVHTFRFINKNNESHFVKFHWKPKQGTHSVVWDEAQKISGKNCDFHRQDLWEAIESGNFPEWELGVQLIPEADEHKFAFDLLDPTKLVPEEEVPVTIIGTMVLNRNPDNFFAETEQVAFHPGHLVPGIDFTNDPLLQGRLFSYTDTQLSRLGSPNFHEIPINRSVAPTHNNQRDGHMRQEINTGRVSYHPNSLGGGCPFQAKMAEGGFTSFNERIDAKKVRERSESFSDHFSQATLFFNSQTEVEKGHIIKALRFELGKVETEAIRVRMVGLLSQIDKTLATKVAAGLGIAVPAPAFPMNHGVGADDDFEKHEPKKAEQVTKSSDALTILRNPTVTPSIATKQIAFLCADEVSGASVVSYKNALERKGAVVKIIAPHLGFIKTEEGKKIKVDQSLLIAASVLFDAVFIPAGKGIKQLKGIKEVAEFITDTYKHCKVIGGEDEGALVIQSVQAIMEAGKNADEGIVLNKDTTAFVKALGKHRFWEREEA

SEQ ID NO: 10266 - protein, 354 aa, Cytophaga hutchinsonii
FTPGPSELYPTVRQHMITALDEKIGVISHRSKKFEEVYKTASDNLKTLLELPSNYEVLFLASATEIWERIIQNCVEKKSFHCVNGSFSKRFYEFAGELGREAYKEEAAFGKGFYPADITVPADAEIICLTHNETSSGVSMPVEDINTFRDKNKDALIFVDAVSSLPYPKFDWTKIDSVFFSVQKCFGLPAGLGVWILNDRVIEKSKALLAKRKSIGTYHTIPSMLEKARVNQTPETPNAMNIFLLGKVTGDMLQISADGIRKQTEEKAALINTYIESSKVFSFGVEDAKLRSMTTIVANTTMLPGEINKILEPFDMAVGAGYGSKKETQIRIANFPAHSLEQVHKLVQTLKEKI

SEQ ID NO: 10267 - protein, 540 aa, Cytophaga hutchinsonii
KKKIQTWLSGSYDADTKKEIQSLVDAGKEDELIECFYKDLEFGTGGLRGLMGVGSNRMNKYTIGAATQGLCNYLKKNFPGQPLKAAIAHDSRNNSDFFARTTAEVFAANGIQVYFFKALRSTPELSFAIRHFGCQTGVVLTASHNPKEYNGYKAYWNDGAQVIAPHDKNIITEVQKISSIDDVNFNADQSLITEIGEEVDNAYLNEIVKLTVSPDAIKRQKDMKIVYTPIHGTGIVLVPEILKRFGFENVRVVQEQAVPDGNFPTVVYPNPEEKDALSLAVKQATEWNADLVMATDPDADRVGIAIKNDKNEFQLLNGNQTGSLLILYMLQAWKNANKITGKEFIVKTIVTTDLIEKIANKFGVKYYNTLTGFKYIAAKIKELEGKEQFIAGGEESYGYLIGDSVRDKDAIASCAFIAEMVAYAKDQGKSLYDMLLDMYVEYGFYKEHLISLTKKGKSGAEEIQTMMKELRATPPKTLSGSPVEWMFDYDSQLATNIINGTTKKIELPQENVLQFKTADGTLVSARPSGTEPKIKFYFSV

SEQ ID NO: 10268 - protein, 530 aa, Cytophaga hutchinsonii
QRAALLEHATQVEYGLIVIGGGVTGCGIALDAQSRGIPTLLIEMHDIASGTSSRSTKLIHGGLRYLKQLEFGLVKETGRERAVVHHLAPHITIPEPMLLPIIKGGSMPKWMASMGTLIYDFLAGVKKSERRKVLNKADTLAAEPLLSGLNVTGGIRYYEYRTDDARLTMALACTAKAQGTTVLTYTKVVKLMYQAGEIIGVKVIDRFTDKEYILKSEEVINAAGPWVDSIDEQDADIRKNKLVLTKGVHIVVDFKKFPIQQAVYFDVGDGRMVFAIPREKKTYIGTTDTKYTGDYKEPGIEEADKTYLIGCIRTAFPGVTLTVADIESYWSGLRPLIRQRDSKSPSAISRKDEVFQSATGLLSIAGGKLTGYRKMAERIVDIVAERLKLAYDIDTCQTEFHLLSGGDIAKHGGLDTFIAEMLPVLKAFGLDTNTAARMIRLYGSNIHLYEAELKHIDERLASINLPDWQKAQLQYTIKHEFVCKPADFIVRRTADFYFRRAEAEQYASELIKAMQLLLGWTDQEYALYNE

SEQ ID NO: 10269 - protein, 378 aa, Cytophaga hutchinsonii
HPLNFEELKLNRQLLNAIEEAGYTEPTEIQSKAIPQILAGHDIIGVAQTGTGKTAAYALPILMKIKYAQGHNPRAVIFGPTRELVMQIEIAMKQLAKYTDLRIVALYGGIGPKLQKEHLQKGVDIIVATPGRFLDLYLEEEIVLKEVKTMVLDEADKMMDMGFMPQLRKMLEVIPRKRQNLLFSATMSERVERLTEEFLEYPMKIEVTPQATPATLISQKLYKVPNFKTKIHLLEYLIRKDESVTRAIIFVRTKKSADDIYKFIIRKTTNTCRIIHANKDQNSRINAMDDFKDGTIKILVATDVAARGIDVHEVSHVINFDVPIIYDDYIHRIGRTGRANHTGVAITFATEAEMYHIEKIEKIIRMQIPVEELPAAVE

SEQ ID NO: 10270 - protein, 577 aa, Cytophaga hutchinsonii
LLNYLKNYKGLIAIALLLASTSQVFSLLDPHITGKIVDNFIEKKEILSRAEFVKGILILVGFSIGAAMVSRIAKNLQDYFTSIVVQKLGAQMYADGLKHSLELPYQTFEDQRSGETLGILQKVRTDSEKFITSFISVLFASVVGLLFVVVYSLSVSYKVTLVYFAAVPIIAFTSWLLSRKIKVVQKSIVKETTALAGSTTESLRNIELVKSLGLANQEIERLNNTTFKILALELKKVKYVRSMSFLQGTTVNFIRSVMVVILLLLIFDNELSPGMYFTFLFYSFFLFGPLQELGNVIITYREAEVSLLNFDRILNLPKEIKPQRPETIGQINTLRFDAVSFKHQSARSNALNGISFSTHNGQTIAFVGPSGSGKTTLVKLLVGLYPPKDGSILYNDVLSTNIDLDELREKIGFVTQDTQLFSGTIRENLLFVRPDASDEECLAVLHKAACGTLLARADKGLDTVIGEGGVKVSGGEKQRLSIARALLRQPDILVFDEATSSLDSITEEEITQTIREVSTVKDHITILIAHRLSTIMHADTIFVLEKGNIIESGKHEDLLLEKGLYYAMWRQQIGEKA

SEQ ID NO: 10271 - protein, 255 aa, Cytophaga hutchinsonii
MKIATYNVNGVNGRLPVLLRWLQEARPDVVCLQELKAPQEKFPEEAFLQAGYHAIWHGQKSWNGVAILSRSSDIRELRRVLPGDPEDNHSRYIEAFVNGIVIGCLYLPNGNPAPGPKFDYKLKWFKRLTAHAADLIEADMPIALIGDFNVMPTDLDVYKPESWIDDALFRPEVRAAFKKLMKQGWTDAIRKLHPDEKIYTFWDYFRNAYGRNAGLRIDHFLLSPPLAAKLKKAGVDKHVRGWEKSSDHAPTWIIL

SEQ ID NO: 10272 - protein, 218 aa, Cytophaga hutchinsonii
LITGATSGIGLELAKLFAYDNYNMVLIARDEERLIEIATELQEMGAGRITIITKDLCLQNAAAEIHHITSQHSIHIDVLVNNAGMAEYGLFSETEVQKDLCVIQLNIASMVQLTKLYMKDMIEHDKEGRILNLASVSSYQPSPMLAVYAATKAFVLSFSDAIAAELRDTDIKVTSLIPGPTDTDFFRKAGMEHTRAAQDNPEDPEIVALVGYQALIKG

SEQ ID NO: 10273 - protein, 347 aa, Cytophaga hutchinsonii
GVITGDQVQDLFAAAKKAKLAFPAVNVVSTGTVNAVLETAKLANSPVIVQFSNGGGQFYAGKSLPNGKQEASIAGAISGAHHVHQVSELYGVGVILHTDHAAKKLLPWIDGLLDAGEAFYKVHGKPLYSSHMLDLSEEPLHENIEVCKRYLERMSKIGMTLEIELGVTGGEEDGVDNSGIHQDELYTKPEEVAYAYEELMKVSDKFTIAAAFGNVHGVYTSGSVKLEPKILRKSQDFIKANYGRTEENPLDFVFHGGSGSSQEEIREAIGYGVVKMNLDTDLQWAFWEGVLNYYKANEAYLQGQIGNPKGADQPNKKFYDPRVWLRKGEDTFVARLKKAFEDLNSFD

SEQ ID NO: 10274 - protein, 389 aa, Cytophaga hutchinsonii
KVVLAFSGGLDTTYCAKYLSEDLGYELHTAIVNTGGFSKEELADIEKKAYELGVTSHTTLDIIEKYYAECVKYMVYGNILRNNTYPLSVSAERVFQAMAIAEHAKKVGATAVAHGSTGAGNDQVRFDVVFMIMNPGIEIITPIRDMKLSREAEIEYLKKKGVVRDWSKAAYSINVGIWGTSVGGKETLTSDKTLPESAFPTQVTKTGEEEVELEFEKGQLVGLNGKRMKSTDAIVELNKIVAPYGIGRDIHVGDTIIGIKGRVGFEAAAPMVIIKAHHTLEKHTLTKWQMYWKEQLANWYGNFVHEGQFLEPVMRNIETFLEDTQVHVTGKVKVFAAPYRFHVVGIESAHDLMSAKFGKYGEENNAWSGDDVKGFSKIFGNQTMIYHRV

SEQ ID NO: 10275 - protein, 314 aa, Cytophaga hutchinsonii
IKIGIVGGAGYTGGELLRILVNHPNAEIVFVHSNSNAGNPIYKVHTDLIGSTDLVFTGELSNAIDVLFLCVGHGDAIKFLQANPVESHIKIIDLSQDFRIEKDGNDFIYGLPELQRDKIKLAKNIANPGCFATAIQLGLLPLAAENVLTNDVHVSGITGSTGAGQSLSQTSHFSWRNNNMSVYKALNHQHLKEIRQSLTNLQSSLEKNIHFIPYRGDFTRGIIATMYTPCSWTIDEAIAKYKAYYASHPFTHVVDENIDLKQVVNTNNCLLYLEKHGDQLMIVSIIDNLLKGASGHAVQNMNLMFGLEETVGLR

SEQ ID NO: 10276 - protein, 329 aa, Cytophaga hutchinsonii
LFDVYPLIPIEPVRALGSRLWDAAGTEYLDLYGGHAVISIGHSHPYYVQKITDQINKIGFYSNSVIISLQQELADKLGVVSGHNDYQLFLCNSGAEANENALKLASFHNGKKKIVAFKKGFHGRTSLAVAATDNPSIVAPVNETDNIIFLPWNDEAALEATFKSHGNEITAVIIEGIQGVGGIHEASMSMLKKIRTLCDEYNAVYIADSVQCGYGRSGKFYSHDFAGVSADIYSMAKGMGNGFPIGAISIAPYLKPKHGLLGTTFGGNHLACAAAIAVLDVIKQENLLEHTTQLGNYIIEQARKIQGVKEVRGKGLMIGIELEIPCAEI

SEQ ID NO: 10277 - protein, 302 aa, Cytophaga hutchinsonii
DIPGLVKEALELKKNPYAFKKLGENKTIGLIFLNPSLRTRISTQKAAKNLGMDTIVMNMDKEGWALETQDGVIMNHNTVEHIREAAAVMGQYCDIIGVRSFPRLVDKNEDYSEDFFNKFIKYAGVPIVSLESATLHPLQSLADLITIEETKTKPRPKVVLTWAPHIKALPQAVANSFSEWMCKADVEFVITHPEGYDLANEFTNGARIEYNQDKALEDADYVYVKNWSSYEDYGKVHSMDSHWMMTNEKLKLTNNAKVMHCLPVRRGIELADEILDGPNSLVIQEASNRVWSAQAVLKRMLE

SEQ ID NO: 10278 - protein, 231 aa, Cytophaga hutchinsonii
IIKVGGNIIDNPEALTSFLKDFASLKENKILVHGGGKVATEISKGLGIEAQMVDGRRITDAETLKIVTMVYGGLINKNIVAKLQSNECNAIGLTGADANIMLSSKRPLKNGIDYGFVGDVKKVHPQPLIHLLSQGITPVVAPLTHDGNGTMLNTNADTVASELAVALCGAFAVNLVYCFELKGVLRDFEDKDSVISTINPDTYEELKSTGVINKGMIPKLDNSFNAINAGV

SEQ ID NO: 10279 - protein, 383 aa, Cytophaga hutchinsonii
EVNKDIERFTVGKDREMDLFLAPFDVLGSMAHITMLESIGLIGKDELPVLLNELRTIYTEIEAGNFTIEDGVEDVHSQVELILTRRLGDLGKKIHSGRSRNDQVLVDLKLFTRHAIRETVENTKELFDTLLSQSEKYKSVIIPGYTHLQIAMPSSFGLWFGAYAESLADDMHMMLAGYRISNKNPLGSAAGYGSSFPLNRTMTTNLLGFEELNHNVVYAQMGRGKTEKNVTAALASIAATLGRMSMDVCLYMNQNFDFMTLPDELTTGSSIMPHKKNPDVFELIRARCNRLQALPNEISMIMANLPSGYHRDMQLIKENFIPAFQDINDCLRIANFMLKQVKVKENIVKDPKYLYMYSVEVVNNMVLEGIPFRDAYKKVGGMI

SEQ ID NO: 10280 - protein, 626 aa, Cytophaga hutchinsonii
LKQRRKIANEVKIKNTLLEYAQQITQMGTFEYNVFTNTLFWSNEMYNIFELDRSVIPEINFIDSLIKEESEITHNRRKKNFQPGASYSDELKIRTVNGNEKVLISNGYVVNEENGLVVHGAIIDITPLKKAELTAREQQELMRVAKEKAESASQFKTRFLSNMSHEIRTPINAILGFTAILSKQELTEQQKKLLKNISISGELLLKLIGNILDISKIEEGKVIIESKSFHLKESIRSVLSPFQHSASEKGLQFHLIIDKSIPDYLLGDFPRISQVLVNLIGNALKFTSHGNITVSVLLTKKQDGLSFVEFVINDTGIGIQANKQDEIFESFTQANESISVKYGGSGLGLSIVQEVVHLMGGNIQVQSPAHYNERGKGYGSKFFFTLPFKLGEKGADPQAKKTAVQPFPRVLHILVADDNEMNRTLATYTLQSLGCTFEIVENGLQAIQKAAANTYDIILMDMQMPVCDGLQATRQIRLNKNTTPIVGLTANVFQEDINRCLDAGMDGHLGKPYTEEDLYHIIDKWVFKNEKNIAASVPSFSNYEFIEKLSKNDPVIFREMLEMFLNQNAQLLKIIHTAINAEDLETLSFNVHQYKSCARMLNIEKQISLIKQIEEKIEARVSLETI

SEQ ID NO: 10281 - protein, 453 aa, Cytophaga hutchinsonii
RGKAFIADKDGTYDLSGGWHDCGDHVKFGQTEFYSAYMLLKGYAEFPAGYGDYYAYDYQGYKTSGSWSFEGTGHAPNGIPDILDEVKHATDFFIKCAKDATTFYYQVGQGDPDHKQWVTAVKMQTLSVANGGQTRATYKNPNDASMPSFCGATLALMSRLYRPYDAAYADLCLVHAKYAYDYAKTKTSTVGSPDGSFYAANDNYKDDYSTMCAELFWATNTASYKTEALSFSISTAPGQGADIYGKNYGFDYSNNGDIAIYNQALLGNTYAKDVLNSIVNSFYLNNTRSDGQFNDGNTSWGPLRYNANTAFIVALWQKLYGTSATPNKYIYDNIDYILGKNSSNQSFVVGFGTKSPAHPHHRNVYLSDANTPVNSLAIPAKNQQFGLMVGGTRNAGSFNDNLETYTHTEGGIDYNACLVGVLAYINSVLSPVVTHSTPSLGADQSLCGKTSIV

SEQ ID NO: 10282 - protein, 291 aa, Cytophaga hutchinsonii
EQQLRRMKQDKGFIAALDQSGGSTPKALTGYGIQENAYKNEDEMYGLIHAMRSRVLTDKSFTGDKILGVILFEKTLNAKVEGMPTTEYLWKKHIVPFLKIDKGLEEKKNDVQLMKPIPNLAGIIQDAKSKGVFGTKMRSVIFANNQAGIAAVVQQQFEFARIIIENGLVPIIEPEVDIHAADKKEIEATLKAALLEQLNKLTANQNVMLKLTLPAENNFYSDLTTHPQVVRVVALSGGYDFEKATNLLANNKNVIASFSRALLDDLRVDQTTEQFSTVLSKAIDGIYNASI

SEQ ID NO: 10283 - protein, 647 aa, Cytophaga hutchinsonii
KGIALIEDDPWLEPYEAEIQDRIIRYKRAVKEIKEHYGDLLTFATGHKYYGINFDEDERGWYYREWAPEAYEVYLTGDFNDWDRRSHPLTRNEFGVWQIFLPYDLYQKRFVHKSKIKVQIVGANGTHDRIPAYITRVVQDTETTDFSGQLWFPQKPFEWTDRDFNLRKIKNPIIYEAHVGMAQEKEGVGTYREFADKIVPRIRQMGYNSIQLMAVMEHPYYGSFGYHVSNFFAPSSRFGTPEDLKYLVDRAHKFGLAVIMDVVHSHAVKNLSEGLNEFDGSDHQYFHPGDRGYHTGWDSKLFDYGKLEVKRFLLSNLRYWLEEYHFDGFRFDGVTSMLYFDHGMKTFDSYDTYFKGGVDFDAVTYLQLANEVTHRYLKDSITIAEDVSGMPGLSRSIRDGGVGFDYRLAMGIPDFWIKYLKHLQDEQWNIYEMWSTLTNRRYKEKTIAYAESHDQAMVGDKTIAFWLMDKEMYFHMQVDDPNPVIDRGIAIHKLLRLFTFALGGEGYLNFMGNEFGHPEWIDFPREGNGWSYQYARRQWSLVDNPKLKYQYLGAFDEAMMRLVRKTRLLAAEPAQQLNMDDHNKVIIFERNNMIFVFNFSVSNSVFDYKFKSFAPGTFEIVLNSDDTRFGGHGRVDDTLEYHTNTEG

SEQ ID NO: 10284 - protein, 431 aa, Cytophaga hutchinsonii
IAIIGAGISGLTLAYQLQQAGKPYILFESNSRPGGYINSQRFGKYLLEVGPNSILVDKKLEEFIHELNLDKLFEPAAIINKNRFIYKDANIQQVPSGPLSFLTGRFFSAKTKYAIFKELFNKSISKENETVYDFFARRFSAPFTQYTIDPFATGVYAGDIKQLLIEETFPQLVELEKQYGSIIKGIFKKGFGEKRKTGTFVHGLQTLTDTLAAQLHSLQLNTRVLNLRKQMDKIVLTTDTKHGIEELTFDKVVVCGTTFQAATLIKDSYPDLSAILSQVQYASMKAVFAAFKRTDVTHPMNGFGCLYPSAEQSFLAGTIWNSSIFNDRCPADEVLTTSFIGGMHHPEYTALSESELEQRAIQQLSKDLGITGKPTFTHVAGWNKAIPQYDIYLKKARLASKLLSDDHIYFRSNWTNGISLGNCIQSARDLA

SEQ ID NO: 10285 - protein, 158 aa, Cytophaga hutchinsonii
SIIVAQSENRAIGINNTLPWHLPADLKRFKAITMGHHMIMGRKTYESIGNPLPGRTSIVVTRNKDLVFAGCTMAHSLAEAFEIAQNNNDSEAFVIGGAELIKEAINSCDKLYLTTIHQNFEGDTFLDALASDWKETEHVVHAPDDKNAYSYSFITYEK

SEQ ID NO: 10286 - protein, 576 aa, Cytophaga hutchinsonii
PSRNVLNPIYTPTAAEISAGTLNLTLQSTGNGNCNAVSSTGTITFSPAPTVTPTTPVNVCADFPTATISATRTLATGIVWSGGTGTIANTTAASTSYTPSLSEITAGTATLTVTTTGNGTCSPVSANVTILIAPAPTVNAGANQVVCGTVSTVSNLSGTVTGATGGTWSKVSGTGTFGNANNTSTTYTPSNQDVINGSVTLRLTSTGNGLCQPVSNTMTISYTPVPSINAGADQIVCSTELPISLSATGSPAVWSAAGGVYGNANSLTTTYMPSAGEIAAGTVTLTINTTPSGACPTKSSQITITIPAGPIVNPGPANQTMCGSLATYQLTGTVTNATGGVWTTSGTGSFLPNANTLNATYSPSATDRANGSVNITLTSTGNGFCKQVARQITLTITPAITVSAGPNQTFCADAGGFALNGTVAVATGGVWSITSGSGTIGTPASLSTTYTPSAADLTAGSVSLLLTSTGNGGCPAVTSAVTFTITPAPTLTIPSNLTICGDSAYVQLSATYTIATGVAWTTSGTGSFTPNASTASARYIPSAADIAAGTVTLTATTTGNGICNPIVRNVTITITP

SEQ ID NO: 10287 - protein, 607 aa, Cytophaga hutchinsonii
PNNTAVQPTYFPSAADITAGLVRIAGVTTGNGTCLAVRDTINIRITPRPTVNAGTDIAICADSGGVILDGNSTIAGGVRWTTSGSGTFVPSALVKNAEYIPSNADTTAKNIVLTLTTTNNGTCRPVSDNVNITIAPVPVVNAGSDRTVCADVDQLLLGGKVLNATGGIWTTSGSGVFDPNNTTLNPNYSPSASDLTVGTVVLTLTSTGNGLCNAVSENVNLQFNPVATISAGNNLQVCNSVPTVTVNASGTNLSNVSWIILSGNGSLSSASTLSTTYNVDAADAVPGGSVTLRIIGSALSGCSNVMDDVVITFVAAPPIDAGPSKTVCSTDLPIKLEGTGSSAKWSGYAGTFNPNDETLNALYTPSAGEISAGTVTLTLTTINNGVCSAATDNVTFTIIPGPVVDAGTVPRICTNSPNVGLSGTSNGISTGVIWSTSGSGSFANGTTLTPTYTPSNSDKNGGEVVLTITSTGNNTACRAATDTVKLSIAPAPKITVGSNQTVCGDATTVDVNSTVTNATGVLWSNVTANGTFVNNTATSTKYNVAVPADTTAGTITVQVSTTGQLTGCPAATAQMSITFTRPPKVNAGSPITVCTDTTSIPLNGSVL

SEQ ID NO: 10288 - protein, 611 aa, Cytophaga hutchinsonii
IEMSEDAKIYEEELAKQSIQERKELGITWYPLFIKSEYYGFAERLHIEVERKYEADTPNIFYSGDKVRIFSNQQHNTKEDFIDGVITASAGNLVTVQLMKDEAPDWLSDGKIGMDKLFDKHSYETMLSTLDYWASDDGLTKDSIRLRDVILGEKTASFNTKENYAAPDKLDITQKKAWEKAIQAQDVAIIHGPPGTGKTTTIVEIVKTLIEKGERVLVCASSNAAVDVLTERLAARGLPVVRLGNPSKITEQNLQYCLDRQVVNHEQFGLVKELKKRAEEFFRMANKYKRNFDREEREQRKAILKEARNLRGQADDHLHFLQQNVLVKNQVVTCTPVVSMHREIGKEKFDTLIFDESGQTMEPMCWIPIQKVKKVILAGDHLQLPPTVKSDEAAKKGLAISLLEKLMPLPGISEMLAIQYRMNEKIMQFPSQWFYDNKLEAHGSVKDHAFDDDVIQFIDTAGTGYEEELVGAPFGIRNKQEADLVLAILNNVAELNKQASIGIISPYKLQIQYIREQLIEQKITSKNIQVTTVDGFQGQEKDIIIISLVRSNGKQEIGFLKDLRRMNVAITRARKKLIVIGDSSTLSSSKFYAGFQEYIESHNGYHSAWEY

SEQ ID NO: 10289 - protein, 643 aa, Cytophaga hutchinsonii
LDSLNDVQRQAVEQTDGPVMIIAGAGSGKTRVLTYRIAHLIQKGVEPFNILSLTFTNKAAKEMQHRIQAVCGSEARNVMMGTFHSVFSRILRVESQKIGFPSNFTIYDTEDSKSLLRTILKEQNLDDKVYKPNTVFNRISAAKNRLISYKEYIANPNYMADDRAALRPEMGKLYQMYQERLIRAGAMDFDDLLFYTYKLFNEHPDVLNKYQHKFKYIMVDEFQDTNIAQYNITKKLAAMNRNICVVGDDAQSIYAFRGADIQNILNFEKDYPELKVLKLEQNYRSTKTIVEAANNVITKNKAQLKKDVWTSNESGEKIHVYRAASDNEEGRIIAQTIFENKMNMQLRNKDFAILYRTNSQSRSFEEALRKLNINYKVVGGMSFYQRKEIKDVLAYLRFVLNDQDEQSFRRIVNFPKRGIGDTTIAKLFVIADEQGTTVWDILCNVKSIMTGRLVPVIEGFVDLIKSYKILANTKDAFEAANEIAKQSGLLKELYEDKTVEGIARYENVQELLNGIKEFVDRPDQEDKSLGSYLQEISLLTDTEKDKEDKDSVTLMTIHSAKGLEFNQVFVVGIEEDLFPSAMMLNSRADLEEERRLFYVAITRAEKRLTLSFATSRYRFGQLKSCSPSRFLEEIDPRHLQMTS

SEQ ID NO: 10290 - protein, 435 aa, Cytophaga hutchinsonii
LMASFEIIGGTKLRGEIIPQGAKNEALQILCAVLISPEPIVIHNVPNIIDVNKLIELLNDMGVLVTKITSSSYRFESKDINLDFLDTEDFKKKASALRGSIMIIGPLLARFGKAKMPKPGGDKIGRRRLDTHFIGLQKLGASFDYDSNDSFYNISASELKGCYMLLDEASVTGTANVVLAAVMAKGETTIYNAACEPYLQQLCSMLNRMGAKISGIGSNLLKIEGVDYLGGTEHTILPDMIEIGSFIGLAAMTGSEITIKNCRIDMLGLIPSVFQRLGIKLEFRGDDIFIPEQENYEIDTFIDGSILTVADQIWPGFTPDLLSIVLVVATQAKGSVLIHQKMFESRLFFVDKLIDMGAQIILCDPHRATVIGLGKQVALRGISMSSPDIRAGVSLLIAAMSAQGKSTIHNIEQIDRGYQNIDTRLNALGAKISRL

SEQ ID NO: 10291 - protein, 227 aa, Cytophaga hutchinsonii
LDALVKLQSIDSKLDEIIKVRGDLPEEVRDLEDELAGYETRLTKHEGEINTLEESIKNFKNGIKESEKLIKKYEEQQKNVRNNREFDAISKEVELQQLEIQVSEKRIKEALQQIEFKKEEIKKTDYNLSERKKDLENKKQELEVIVSESQDEEVKLNKEREKASKQIEERLLNSYTKLVNNYRNGLAVVSVKRGACGGCFNTVPPQRQGEIRERKKIIVCEHCGRIL

SEQ ID NO: 10292 - protein, 380 aa, Cytophaga hutchinsonii
MKFESYDLAPGIKKSLAEAGFNRPTDIQFKSIPPILAGEDVLAIAQTGTGKTAAFVIPVLNTLINVKKSEHTDISCLVMAPTRELAVQISEVFKKIGAYTRLRTVCITGGVEQEAQIAAADYGIDILVATPGRMFDLIYQKHIKITRVKILVLDEADHMLDLGFIKDIQDVKKFLPARHQTLFFSATINEEIKKLAYSLVKNPIRIQIAPKDRVSKNITHSVAFIGMDDKRFFLERLLKEHPESKVIVFVRTQVRADRVQAAMERVGLKSVTMHGGKEQQARDAAMDAFKNGTVHVLIATDISARGIDIAGVEYVVNYDMPEVAENYVHRVGRTGRGVSKGFAISFCSMEEKPVLDEVEEFLGKEINVIEITGKDYDATL

SEQ ID NO: 10293 - protein, 528 aa, Cytophaga hutchinsonii
MQSSLFRTKNPNELHTEVSALKRTLTFKDLTALGIAAVIGAGIFGTIGQAAYDGGPGIIFLFIITSLGCLFSAFCYAEFAASTPISGSAYTYAYISFGELIAWIIGWDLFMEYAVGNMAVAISWSDYFTAFLKGVNIEFPLWLSMDYFTAVHQKSAAAQQAYVHAPRIFDFPVIVDLPAILITVLITILVYIGIQESKRTNNVLVVFKIIVLLLFIIVGFTTVNTANWSPFIPNGWSGIFKGTAAVFFAYIGFDALSTTTEECVNPKRDLPRAIFSSLLISTLIYIAIALVITGMVSYHDLNVGDPLAYALEKTGLHKFAGLLSFSAIVSMTGVLLVFQIGQPRIWMNMSRDGLLPKALSRIHPRYQTPSVATVLTGGSIILPLLFLDLKEVVDLTSIGTLFAFLIVCAGIWLKKEKIKTESFTVPFIGGRYLLPVTMLPVLYLYLHTVSTENVFSFTQIPLYSCILAMIATIFYGSVRNLSLLPGIGVCLNLLLLSTMHHQNWIRFVAWLAIGLIVYMTYGRKHSVL

SEQ ID NO: 10294 - protein, 89 aa, Cytophaga hutchinsonii
VNIKPLADRVLIEPAVAESKTASGIIIPDTAKEKPLKGIVVAVGSGKKDEPMTVKVGDSVLYGKYSSTEISVDGKDYLIMKESEIYAIL

SEQ ID NO: 10295 - protein, 542 aa, Cytophaga hutchinsonii
MAKQILFDRDAREKLKKGVDALADAVKVTLGPKGRNVILDKKFGSPAITKDGVSVAKDIELKDAIENMGAQLVKEVASKTADQAGDGTTTATVLTQAIFNAGLKNVAAGANPMDLKRGIDKAVSAIIADLKVQSKKISNSNEIAQVATISANNDHEIGKMIAHAMDKVGKDGVITVEEAKGTETEVKTVEGMQFDRGYLSPYFVTNTDKMEVELDRPYILIYDKKVSSMKELLPILEQVVQSGRPLLIIAEDVDGEALATLVVNKIRGALKIAAVKAPGFGDRRKAMLEDIAILTGGTVISEESGYKLENATLEYLGTAEKINIDKDNTTVVNGSGLKDNIVARVNQIKSQMENTTSDYDREKLQERLAKLSGGVAIMYIGAATEVEMKEKKDRVDDALHATRAAVEEGIVPGGGVALIRAGAALDNVAFHNEDEKTGIQIIRTAIESPLRAIVYNAGLEGSVIVQKVKEGTGDYGYNAREDRYEAMIAAGIIDPTKVTRLALENAASVASLLLTTECVVADEPEEKSAMPPMGGGGMGGMM

SEQ ID NO: 10296 - protein, 181 aa, Cytophaga hutchinsonii
KGLIFDIDGTLADTMPAHYRASLRVARQFGFEFPLEFFIKMAGIPTTDVFKELLNLQHKSHISTEEVSALKEKYYLEEIPTIQPISYTMDIVKKYAGVLPMSMGTGGTLEIALPNIKQIKADTYIDILVSAEDVKKHKPFPDTFLECARRMNIAPGNCLVFEDALQGFKAAQAGGMDYIDV

SEQ ID NO: 10297 - protein, 863 aa, Cytophaga hutchinsonii
NNYTIKGQEAFQKAMEIVAANEQQSIESVHLLKGIIVADENVVPFLFKKNNINPVTFNQTLDAVIKTYGKVSGGSPYLSNDATQVLNKATALSKEFGDEYISIEHMLLALVSGKDKAATLLKDAGLSEKGLRAAIQELRGTSKVTDQHAEGKYRSLEKYSKNLNDLARSGKIDPVIGRDEEIRRVLQILSRRTKNNPILLGEPGVGKTAIAEGLAQRIVSGDVPENLKSKQLISLDMGLLVAGAKYKGEFEERLKSVIKEVIDSDGEIVLFIDEIHTLIGAGGGEGAMDAANLLKPALARGELHAIGATTLKEYQKYIEKDKALERRFQAVIVDEPNTQDAISILRGIKEKYEVHHGIRIQDDAIIAAVELSQRYISDRYLPDKAIDLMDEASAKLRIELDSMPQELDEILRRIMQLEIEREAIRRENNKEKETILSRELAELNEQKSQIMAKWQEEKRVIDGLKQAKEDIDRYKMEAEQAERNGDYGKVAEIRYGKIQESEKQLVEFNKQLQELKQTLGSSMLKEEVTPEDIAEVVAKWTGIPVSKMLQSEREKLLHLEEELGKRVAGQAEAIEAISDAVRRSRAGLQDPKRPIGSFIFLGTTGVGKTELAKALADYLFNDDNAMVRIDMSEYQESHAVSRLVGAPPGYIGYEEGGQLTEAVRRKPYSVILLDEIEKAHPDVFNILLQVLDEGRLTDNKGRVANFKNAIIIMTSNMGAHVIQENFDKLTAANEDQVVEETKNEVIDLLRKTIRPEFLNRVDEIIMFRPLTRKEIRKIVGIQFSLIQKRLEENGIKVEASTEVLDKLGELGFDPQFGARPLKRVMQRLILNELSKEILSGNIQKESVVGITLGEDGNLQFLNL

SEQ ID NO: 10298 - protein, 370 aa, Cytophaga hutchinsonii
MTFSDLGLNAALLQSLSENNISSPSEIQQKAIPVILNSTKNVVGVAQTGTGKTAAFGLPVLQQINPSLQQTQVLVLVPTRELGQQVAKDLFVFSRYIVRIHTEAVYGGKKIEEQIKKLETPKHILVATPGRLLDLIARKAVNLSNLKYLILDEADEMLNMGFLPDIDKIMKIAKPTARKLLFTSTLGSELKLIIREYLGTDIEEIRIKPQEYVNRNIEHQYLAYQYGYKLEYLKAFLLKHSNERGIIFCRTQAAAKLLGQQLAGFDIVVGSLYGDLNQYERTKVMHAFKDKRIEVLIATDIAARGIDVSDLNYVIHYHLPDNEAQYVNRSGRTARAGKKGKSIALLQSDELYHKDDFEDALRIRFEPIKL

SEQ ID NO: 10299 - protein, 823 aa, Cytophaga hutchinsonii
MNQYPIAEIVEEIKETLNLQTTVILQAPPGAGKSTILPLELLKADWLEEKKIILLEPRRMAARSVAQRMADLLGEEVGKTVGYRVRFDQRVSAQTRIEVVTEGILTRRLQQDNTLEGVGMVIFDEFHERSLHSDLSLALCRDLQQILREDLRILIMSATLDGENLSAILDKAPIITSKGRQYPIDVRYTSIDTNAPISGQITTVISKVLKEETGDILVFLPGVREIQQTAAALTERHGDIAVRPLYGELSLNAQQEAIRPDAQQRRKVVLATSIAETSLTIEGIHIVIDSGLARVPKFDPNSGMTKLETVKVTQDAADQRAGRAGRLGPGIAIRLWPEATQQYLKPQRVPEIAEADLAPLVLELAQWGVRDIQSMTWITAPPSGSVDQARTLLQELDAIQNGVITEDGKALANLPTHPRTAHLLLKGKEHTILPLAIDLVCILEERDALGKHAGADISLRVDALQAWRAGKRFQGDTFILERIERAVQSWRKIFSIKSSVYEFDTDSIGLLIAAAYPERIARLVDAASARYRMANSRNVRLHENDVLVKEEWLAVAHADAGVGEGRIYWAAALNPMLLTDRMVQEARIRWDETKGVLLQQEETRIGSLTVTSKPLKEVDETLRAAALCEAVRKEGLKIFNWDEACVQWQARILSLKQWRPTEAWPNVDAEGLLQTLEDWLPFYLKQVKRREDFKKIPLPEVLHTILPWEQAKILAKLAPTHIDVPSGSSIALEYKTDGSFPVLSVRLQELFGLTDTPTVNEGRTKVMIHLLSPGYKPVQVTQDLKSFWANTYPEVRKELRMRYPKHSWPEDPWNAEAVRGVKR

SEQ ID NO: 10300 - protein, 628 aa, Cytophaga hutchinsonii
MGKIIGIDLGTTNSCVAVMEGSEAVVIPNSEGKRTTPSIVAFLENGERKVGDPAKRQAITNPTNTISSIKRFMGKKFSESKSEADRATYKLEAGSNDTPRVRIADRQYTPQELSAMILQKMKTTAEEYLGHEVKEAVITVPAYFNDAERQATKEAGQIAGLEVKRIINEPTAAALAYGMDKKGKDMTVAVFDLGGGTFDVSVLELGDGVFEVKSTNGDVHLGGDNFDEVIIDWLAGEFKSEEGLDLRQDPMALQRLKEAAEKAKIELSSSASTEINLPYIMPVNGMPKHLVKTLTRAKFEQLADSLIKRTLDPCKQALKDAGLSIGQIDEVILVGGSTRIPRIQEEVEKFFGKKPSKGVNPDEVVALGAAIQGGVLTGEVTDVLLLDVIPLSLGIETMGGVFTKLIEANTTIPSKKSEVFSTASDNQPSVEIHVLQGERAFAKDNRSIGRFHLGDIPPAPRNVPQIEVTFDIDANGILNVSAKDKGTGKEQKIRIEASSGLSADEIERMRNEAKANEGKDREEKEKIEKINQADSMIFQTEKQLKEFGDKLSAGNKSAIEASLEDLKKAFEAKDISAIDTAMAAINTAWQAASQEMYSAEQGAGQPGADAGQSGPSDSVTDVEFEEVD

SEQ ID NO: 10301 - protein, 392 aa, Cytophaga hutchinsonii
VNHTITPPASKSESNRVLVIDALTGRKSQLDNLSNARDTQTMIRLLDSDSNPVWDVLDAGTTMRFLTAFSAFNGKPREMTGTPRMKERPIKLLVDALRELGAVIEYKEKEGYPPILIHPFKPELAKTDYIKIKGDVSSQYITALLMIAPVLPKGLTIELLGHVGSKPYIEMTLRLMEHFGVTSEWKDNIIKISHQTYKPAQYKVESDWSGSSYWFSVAALAKEANIELKGYVKNSLQGDHVIVDIMDQLGVKTEFTADGLKLTKQPVKGNLVWDFTDCPDLAQTVAVILAAKGVEGTLSGLQSLRIKETDRIAAIQNELRKFGADMIEIEKDVTYKVVPGTFKVDGQSVHTYEDHRMAMAFAPLALLGKVTIEEPSVVNKSYPLYWEDLKKV

SEQ ID NO: 10302 - protein, 291 aa, Cytophaga hutchinsonii
IKSGEKEKTLETCSVIWSQMTELALDRKALLVNLGGGVIGDMGGFCASTYKRGIDFIQIPTTLLSQVDASVGGKLGIDFTDAHENVFKNHIGVFNVPVAVIIDPTFLQTLDAKELRSGYAEVIKHCLIADKAKWNEIKTVTDLTKLDWMALAKHSVTIKEKITIEDPLEKGLRKILNFGHTVGHAIESHFLFIPHKRLLHGEAIAAGMVCESWLSVQKGFITEAEHKEIEAYILSIYGHTHILFTEIDLIVPLTLQDKKNEHGAVQFSLLEKVGTANYNISLTKEEITASL

SEQ ID NO: 10303 - protein, 240 aa, Cytophaga hutchinsonii
IIAGPCSAETPEQLMSTAKLLKDLGKVDVLRAGIWKPRTRPNAFEGSGEEGLKWLAEVKKELGIQIGTEVANPEHIELALKYGVDVLWVGARTTVSPFAIQEMADAMAGVKDKAVLIKNPTHPELGLWIGAFERFYRAGVRDLAAIHRGFSTIDKSKFRNVPTWSIPIELKRIAPQIPIICDPSHIGGKRDLIFEISQKAMDLGFDGLMIETHIDPDKAWSDADQQVTPERLGEILTDLK

SEQ ID NO: 10304 - protein, 202 aa, Cytophaga hutchinsonii
EDHVSTSAETPLREDAFEKDDALKIELIQKHFKEIMLILGLDLTDDSLKGTPNRVAKMYVQEIFSGLNPANKPSIRLFENKYKYSEMLVEKDITLYSYCEHHFVPIIGKAHVAYISNGKVIGLSKINRLVEHFSKRPQVQERLTVQIAEALKEALQTEDVAIVIDAAHLCVSSRGVKDTASTTITAHYSGKFTEDQTKNEFL

SEQ ID NO: 10305 - protein, 134 aa, Cytophaga hutchinsonii
KLKTAIFRKEHFNAAHRLFNASWSDEKNDAVFGKCNNPNFHGHNYELIVKLTGEIDPITGYVFDTKELSNLIKQHILTRYDHKNLNLDCEEFKDVNPTAENIAKQIYTTLRSLIDASLDLKVILYETERNFVEY

SEQ ID NO: 10306 - protein, 182 aa, Cytophaga hutchinsonii
VLLHILSEFDPSIPVYFINTGYHFPETVLYRDQIADLFNLKNIKVVSSATPRNMQKDAEGRLLFTSDPDYCCYLNKVQPLDAVLPDYDIWINGVRADQSAVRKSFSVEQPAPHDTIRFHPMLDWDVRMIEKYIKEHKIPRHPLEEKGYLSIGCEPCTRKFDLETYNRQGRWFGLNKTECGLN

SEQ ID NO: 10307 - protein, 129 aa, Cytophaga hutchinsonii
NKESIENLLPHRSPFLFVDEILSVTEDEIIGYKTFGEECSWLSGIFPEHNIIPGTILIESLAQCGGAGMRLLKDTNGLFGLASIESATFLKAATFHTPIKYVIKNIRLSDKLVKQSGIAFINDEALLEA

SEQ ID NO: 10308 - protein, 435 aa, Cytophaga hutchinsonii
LTFNDFNFNSGLLDSLSSMGFNKPTPIQTEAIPVIMSNSDLVACAQTGTGKTAAYMLPILHKIIESNTDSLDTLVLVPTRELAIQIDQQIEGFSYFINVSSIAVYGGGDGATWDQQRKALTDGANIVIATPGRLLAQLQSGTANLKQIKHLVLDEADRMLDMGFYDDIVRVISYLPTERQTIMFSATMPTKMRALANKLMKDPQQINIAISKPAEGILQQAYLVYEEQKNKLIKHILSSGNFNSIIIFSSTKEHVKKLERDLSNMGFSLKGFHSDLEQEEREEIMRAFKSRQLQMLIGTDILSRGIDIDGIDLVINAEVPGDAENYIHRIGRTARAATTGTAITFISDTDQYKFLQIENLIGREIEKLKIPIEIGEGPAYEPEKKPKYNNKGFSNNKSKSGSKGSNRPTPKEHSKPVHREPSGIKHTIVKKQNPP

SEQ ID NO: 10309 - protein, 259 aa, Cytophaga hutchinsonii
LKGQTALITGGDSGIGKGIALKMAAAGANILVNYNSDKDAAEETVAQLKVLGASAICYQADVSDEADVQNMFREAVKHFGTIDILVNNAGLQQDAAFVDMTLKQWNKVISVNLTGQFLCAREAVREFTKRGARPEISKALGKIICISSVHEVIPWGGHVNYAASKGGIMMLMKSMAQELGGLKIRINSIGPGAIKTDINNEAWETPEAAEKLLKLIPYNRIGETEDIGNVAVWLASDESDYVHGTTLFVDGGMTLYPGF

SEQ ID NO: 10310 - protein, 132 aa, Cytophaga hutchinsonii
LDVNQIYKLLPHRYPFKLVDKIVHLDENMIIGVKNVTINEPFFEGHFPGNPVMPGVLQIEAMAQTGGIFVMQSVPDPENYWTYFLSIESAKFRRMVVPGDTLVFKCELTAPIKRGIAKMQGQAYVGGNLVCE

SEQ ID NO: 10311 - protein, 197 aa, Cytophaga hutchinsonii
KGIATPMLPQAFLKTDEEKIASIAGHFKAIMETLGLDLSDDSLAGTPQRVAKMYVQEIFSGLDERNKPKIALFENKYRYGQMLVEKNITFYSNCEHHFVPIFGKVHVAYISSGKVIGLSKLNRIVNYFAKRPQVQERLTMQIAGEMESVLNTKDIAVLIDAKHLCVSSRGIKDDNSATITAYYGGRFSDDAVKNEFL

SEQ ID NO: 10312 - protein, 451 aa, Cytophaga hutchinsonii
SINPFSKENIQNLAFESIESLNEKLIRSDSAYKNWRKYSINDRKPYFKNLISVLTKEKELLAREITLEMGKPLLESIAEIDKCIGTTEWYLNNVDAIIQQHLPTVSIEHIKSQIAFEPIGAVLGIMPWNFPYWQVFRYAIPTLLIGNTVLLKHAPNVPGCAQSLEKIFKLAGFPDDLFLSLYPAVEDIEYIIASPAVQAVTVTGSERAGRSVASLAGKHLKKCVLELGGSDPFIVLADAPIKQTVAEAIKGRLQNNGQSCIAAKRFIIHEQCYDAFLKELKEQLNARIIGDPMLKETHLGPMARADLKEQLSKQVQSSVAAGADCTYKHPFDDSNSNFFSPLILENIPANSPARAEELFGPVFSCIRVTDTNEAIAVANETRFGLGASIWSNTITEAEKLSQHIEAGSVFINGITRSDARLPFGGIKQSGFGRELSVFGLQEFVNVKTYWV

SEQ ID NO: 10313 - protein, 419 aa, Cytophaga hutchinsonii
FSRAKEVIPGGVNSPVRAFRAVGGNPLFIKRAHGAYLVDEDDNQYIELINSWGPMILGHGNELIEKAVRDALSNSLSFGAPSRKEVEMAELIVSMVPSVEMVRMVNSGTEATMSAIRVARGYTGKEKIIKFEGCYHGHGDSFLIAAGSGAVTMGVPDSPGVPQGVANDTLTAPYNDIEAVRILVEKNKNKIAAIIIEPVAGNMGCVLPKAGFLEALREICDQENIVLIFDEVMSGFRLSVSGAQGVYGVQPDMTTMGKIIGGGMPVGAYGGKKEIMQNVSPSGPIYQAGTLSGNPIAMSAGLAILQYLQASPALYTQLNDQTDYLIHGMRKANNLLGLDYTFNHVGSMFTMFFTNIGVYDFETAKKSDLSKFAAYFQAMLSRGIYLAPSQFESLFISSAITKQLADQIIQAHAESMKEI

SEQ ID NO: 10314 - protein, 266 aa, Cytophaga hutchinsonii
NMKIAILGGGNMGMTYAKAFVSRKIVSKDELLIIEKHDEKREQLKQEGVASLSADIDDSIKNYDILIVAVKPQDFRVLSETLKKYLTENQMILSIMAGIQIAQIQTLLEHKNVVRAMPNTPAQLGFGITAFTVAKDASFENISVVDMLLETTGKAIFMKDETMLDAVTALSGSGPAYFYYIVQNMIEAGKQMGVDENVAGMLVKETMMGAFQILNHSKSSIDELIAMVASKGGTTEAALNTLKQREVGAHIIEALKNAEKRAKELS

SEQ ID NO: 10315 - protein, 257 aa, Cytophaga hutchinsonii
TYALITGASKGIGKSIAEELAAKGKNLLLVSRSEETLNELRLSLIQRYNVHVAYLAIDLSAAEAPQLVSNWCTSNNYSIDVLVNNAGYGLWGPFEKVSLESHQEMLQLNMLTVVQLTYALLPELKKHASSYILNVASTAAYQAVPTLSLYAASKSFVLLFTRGIRLELEGTGVSVSCLCPGPTSTDFVTRAGMSLAIQKKSDTFSMTSEAVARIGVRGMYNHKAEIIPGLLNKIIVAATAWLPKYVTEKIANDLYKK

SEQ ID NO: 10316 - protein, 314 aa, Cytophaga hutchinsonii
  unsure (1)..(314): unsure at all Xaa locations
KPDILVSVPSDIGAQRMGTSLAVDALLVADAERAQPVLKQFSKKTLSSFPEKRGETGPYVQGKYAKLLSELNNNTAKEISAIVKKQYPLVISGDHSNAIGIMAGIREAIGADKKLGVIWVDAHADLHTPYTTPSGNLHGMSLSASMGYDNIELSRSTIDAGLKPFWEELKHCGASRLTPKIGPEDIFFIGLRDFEIQEYHLIRDYKLNHYSPYDVKAKGLTYILDQAVTYFADYDAVYVSFDVDVLDTSVSTGTGTPVYNGLLLPEAKQVVDTLKRLKNIRLWEFTEINPLLDNNNSMSKAVIELIDVLMEDXL

SEQ ID NO: 10317 - protein, 614 aa, Cytophaga hutchinsonii
PEELRKLDETQLIQVSEELRQFIVDNVSVYGGHFAASLGVVELTVALHYVFNTPVDQLVWDVGHQAYGHKILTGRMENFHTNRTYNGLSGFPKRSESPYDTFGVGHSSTSISAALGMAVASQYQKDNRQHIAVIGDGALTGGMAFEAMNHAGVTNSNLLIVLNDNCMAIDPNVGALKDYLVDITTSRTYNRVRDEVWNMLGKISKFGPNAQAIASKVESGLKASLLKQSNLFESLHIRYFGPVDGHDLNHLVQVLNDLKDIPGPKILHTLTVKGKGYALAEKDQVKWHAPGKFDKVTGQIHVKTYDTPQAPKYQDVFGNTIIELAEKNDKIMGITPAMPSGCSLNLMMEKMPDRAFDVGIAEQHAVTFSAGLATQGLIPFCNIYSTFMQRAYDQVIHDVCIQNLHVIFCLDRAGFAGVDGPTHHGAYDLAFFRCIPNLVVSAPMNEQELRNLMYTAQLQKNKGPFSIRYPRGQGVMPNWKTPFEEITIGKGRKVSDGDDVAILSIGHIGNYVIEAKALLREEELSPAHFDMRFVKPIDEEMLHLVFKKFKKIITVEDGCLMGGFGSAVLEFMADNNYAAQVIRLGIPDRIVEHGEQAELHKECGFDPQSIARTV

SEQ ID NO: 10318 - protein, 137 aa, Cytophaga hutchinsonii
MGGNRTFSMIKPDAVKDGHSGSILKMIEGAGFRIVAIKLTYLSAERAGEFYAVHTGKPFYDSLKSIMSESPIIALILEKENAVEDFRKLIGATNPANADAGTIRKLFAKSLERNAVHGSDSDENAQIEGSFFFSALE

SEQ ID NO: 10319 - protein, 390 aa, Cytophaga hutchinsonii
  unsure (1)..(390): unsure at all Xaa locations
LKAGEDVQTTYIGSLLSNGSVFDKSAPGDYFKFRLGSGQVIQGWDQGFLKLKHGDKALILIPSRLAYGTRGAGGSIPPNAPLVFEVQVKXIKTPMNKVYIILGFCFLSISVFAQKKQKTPSKASLFHEKDVAYTPSGLAYKYRLDVPGKTGAVGDVVKLHFVLRNSKDSILRSTIEEDRMVITTIQKPRYAASFEEGLGMLSKGDSCAFWISADSLFKKGIGAEMPPFIEKGSFLRFEVKMYDVLTMAEYVEEQEIMAKKVKADEDAALASYIKTNNIPAVLDTATGVYYQVVQAGTGAKPKKGNKVIVHYTGHLLNGEIFDSSLDRGDPFDFIIGQGRVIEGWDEGIPLMRKGEKGILYIPSYRGYGEQRAGSIPPNSTLIFEVELLDI

SEQ ID NO: 10320 - protein, 425 aa, Cytophaga hutchinsonii
VAHTAKSVFVTGKAGTGKTTFLKQLREHTPKKLAVAAPTGVAAIHAGGVTLHSLFQLPFKPFLPTVSNALFQQEQNFCDQKTLFTTTHLSAAKIDVIKELEVLIIDEVSMVRADLLDAIDTILRHYRGNESPFGGLQMVFIGDLYQLPPVVRNEEWSVMQLYYDSPFFFEAHALRALNPLVIELQKTYRQKDGLFLDILNRIRVNGVHPTDLDHLNTYYKPTFRPSPGEAYITLTTHNDKAETINKHQLNQLKTEERKYKAFVTGDFNERSYPVELQLQLKVNAQVMFIKNDKGDNRKFYNGMLAVVTELADEYIMVKPVSGADVMKVERETWKNIRYQANKEQDKIEEEELGSFVQFPLRLAWAITIHKSQGLTFDRAIVDAGDSFAAGQVYVALSRLTSTKELVLYSKISTHSIRVDERILKY

SEQ ID NO: 10321 - protein, 169 aa, Cytophaga hutchinsonii
LETDKLRIDFIKSDKIDAHSLALTILPGRKDYSRDLSEDLKEIKEQQIDCVVSLITKDEMDMYGVPELLDVYKKQGVECLHVPVIDQKIPVKAEIERINAFINAQQKKHKKVLIHCVGGLGRSGLVAACYLKSLGYPSDDAIKIVREARSSRAIESTEQEKFVYDYNER

SEQ ID NO: 10322 - protein, 376 aa, Cytophaga hutchinsonii
MLNFDYKNPTKILFGKGQIAALAKEIPVQAKVLMLYGGGSIKTNGVYEQVKNALKDFEVVEFGGIPANPEYDILMEALAIIKKENITYLLAVGGGSVIDGTKFLSSAALYTGEEPWDILTKPIRTEKGMPFGTVLTLPATGSEMNSGAVITRRSTQQKLGMGGPGLFPIFSVLDPQVINSIPDRQIANGITDAFTHVLEQYMTYPAKALLQDRIAESIMQTLIEIAPVILKDKSNYEAASDFMWSCTMALNGLIQKGVPTDWSVHAIGHELTALYDIDHARTLAIIAPSLYRYKFNTKKEKLAQYAERIWNIQTGSVEEKAMQAIEKTEAFFHSLNIKTKLSEYTDDYKKCAGFAAERLKSRGWIALGERKDITPD

SEQ ID NO: 10323 - protein, 194 aa, Cytophaga hutchinsonii
IDFQKGGGLVPVIIQDAVTRNVLMLGYMNEEAYTKTKAEGKVTFFSRTKNRLWTKGETTGHFLHVVDIKIDCDNDTLLIKVKPDGPTCHTGTDTCWSEVNSGRTFFIEKLANVIKDRRNNPTDVSYTASLFKKGINKIAQKVGEEAVEIVIEAKDNNDDLFKGEAADLLYHYLILLEAKNIPLDDVIQVLESRQ

SEQ ID NO: 10324 - protein, 709 aa, Cytophaga hutchinsonii
LARLNTAQREAVETIEGPVLVIAGPGTGKTQILSARIGKILASPDLQVQPHNILCLTFTEAGTVAMRKRLLDFIGPEAYRVHVYTFHGFCNQVIQENLDYFGVRNLQPISELETIELYQKLIDNFDATSKLKRFKGDIYYDQIGLKELFKNMKSEGWSEESMYILIDRYVDELKDDPEHQYKRKSGNNNKGDLKASYYTEIEKMAKLKAAIAEFANFNAAMGAIRRYDYNDMILWVLKAFKENELLLRNYQERYQYILVDEYQDTSGSQNEVVDLLASYWERPNLFVVGDDDQSIYRFQGANIKNIIDFNSKYNPALIVLKENYRSTQAVLDASMAVIKNNNERLVNSVQGLDKQLTAKGIIAASHVEPKIIEYYNELHEEASVVEQLEKLHHEGVDLSEVAVIYRKHSKVADIIKVLEKRKIPLNIKQSINVLHLPFVQNLIDILAYIQKENEYPDSGEEQLFRLMHFEYFNIDPTDIANISRKTRRTSESSAIRWRELMSKKEELAKLNLHSLPSILSLEANLTYWQKEFHNITLQVLFEKITTRGGILSWIMNSSEKTWYMQVLTTFFDFLKEETARNPLLSLKEFLSTIQKMLDNDVRLNLQKIIHAEKGVNFVTAHSSKGLEYRYVFLIGCNSRQWEGQAERSFGFKIPSTITENVEHDKEEDERRLFYVALTRAKEYLYISYPAKDVNEKELVCSRFLVELTE

SEQ ID NO: 10325 - protein, 250 aa, Cytophaga hutchinsonii
IMRKKVIAGNWKMNKTLEEGLSLASEVANMAKDEVPADVNLVMCIPYISLAAVSKVINDKVAIGAQNVYQKESGAFTGEISAPMLKSVGVKYVIIGHSERREYFGETNQQLADKVTISLANGLTPLFCCGETLAQREAGIHINFVNAQLTESLFHLSPEDFKKVVIAYEPIWAIGTGVTASDEQAQEMHAKIREHLASKYGAAVADEISILYGGSMKPDNAKGLLACKDIDGGLIGGASLKSRDFIDIAK

SEQ ID NO: 10326 - protein, 913 aa, Cytophaga hutchinsonii
MPKDTSIKHILIIGSGPIVIGQACEFDYAGSQAARSLREEGIEVTLINSNPATIMTDKVVADNVYLLPLEKKSIIKILENHKIDAVLPTMGGQTALNLAMECDKAGVWKKFGVRMIGVDINAIETTEDREKFRLKMIEIGVGVCKGATATSFLQGKEIAQEIGFPLVIRPSFTLGGTGGGFVHTADKFDEALTKGLHASPTHEVLVEQSILGWKEYELEILRDSIGNMIIICSIENFDPMGIHTGDSITVAPAMTLPDTIYQEMRDQSIKMMKAIGNFAGGCNVQFSVCPDTDHIIGIEINPRVSRSSALASKATGYPIAKISAKLAIGYNLDELKNQITKTTSAFFEPALDYVIVKVPRWNFDKFKGADRTLGLQMKSVGETMGIGRNFQEALQKACQSLEIKRNGLGADGKELTNQDQILDSLANPSWNRLFHIYDAFKLGVQFKTIQKLTKIDPWFLTQIEELVLLEKEIQKTTIQNISREMLKTAKQKGYADRQIAHLLRCMESEVFSKRHEFGIKRIYKIVDTCSAEFEAKTPYYYSTFEGENESIPSDKKKIIVLGSGPNRIGQGIEFDYSCVHGVLAAKECGYETIMINCNPETVSTDFDIADKLYFEPVFWEHIYEIILLEKPVGVIVQLGGQTALKLAEKLERYGIKIIGTDFQSLDLAEDRGRFSSLLKEINIPYPEFGVIENADEAVAISKKLNFPLLVRPSYVLGGQSMKIVINEQELEQHVVNLLKDHPGNQVLVDHFLENAIEAEADAICDGENVHIIGIMEHIEPAGIHSGDSHSVLPPFDLSDDVIRQIEEHTKKIAIALKTVGLINIQFAIKNEIVYIIEANPRASRTVPFICKAYDEPYVNYATKVMLGENKVTDFTFNPKKNGYAIKIPVFSFNKFPNVNKELGPEMKSTGEAI

SEQ ID NO: 10327 - protein, 275 aa, Cytophaga hutchinsonii
PQQQERPGKETDMKPRPQSENNAPGNNKLKNKIALITGGDSGIGKAVALLFAKEGADVAIVYLNEHADALETQSIINAKYSKQCLLLPGDISNESFCSKVIDQVIETFGRIDILVNNAGIHYECEDLAELVTEKMIATFETNVYSMFWITKYALPHLKAGSSIINSSSVTAYRGSKHLIDYAATKGAIVSFTRSLSSSLVDKGIRVNGVAPGPIWTPLIPSSFEEDRVAKHGLNAPMHRAGEPSEVAPSYLFLASEDASYITGQFLHPNGGEIIN

SEQ ID NO: 10328 - protein, 167 aa, Cytophaga hutchinsonii
RVAYRYAKSLIDLAAENGVLDRVNADMAGIESVFKQNHQLVAVMKNPIVQGDKKHAILEALFGGKVDNFTMSLLSLLTKKHREAVVFEISSEFQRQYREKMGIKIVEVTTTQPITEDQRANFKAIMASKASKVELIEKIDEKILGGFVLKMDDQQIDESVIAKLNKI

SEQ ID NO: 10329 - protein, 514 aa, Cytophaga hutchinsonii
LDVRPDEVSAVLRQQLSNSLTEAQLEEVGTVLQVGDGVARIYGLTKAQAGELLEFEGGLKGMVLNLEEDNVGAVLLGEYSAIKEGSTVKRTKQIAFVNVGEGMVGRVVDTLGNPIDGKGPITGELYKMPMERKAPGVIYRQPVTEPLQTGIKAIDAMIPIGRGQRELIIGDRQTGKTTVALDAIINQKEFYDRGEPVFCIYVACGQKASTIAGIVGTLEKHGAMAYTVVVAATASDPAPMQYFAPFTGAAVGEYFRDTGRPALVVYDDLSKQAVAYREVSLLLRRPPGREAYPGDVFYLHSRLLERAAKINKSDEIAAAMNDLPESLKGIVKGGGSLTALPIIETQAGDVSAYIPTNVISITDGQIFLEINLFNSGVRPAINVGISVSRVGGNAQIKSMKKVAGTLKLDQAQFRELEAFAKFGSDLDASTKLTIERGRRNLEILKQPAFSPVSVEEQVATIYVSTNGFMDSVVVNKVRDFEKDFLTVLRTSHKDTLKEIKSGKIDDAITEVLKK

SEQ ID NO: 10330 - protein, 293 aa, Cytophaga hutchinsonii
MPSLKEVRNRIASVNSTQQITKAMKMVSAAKLRRAQDRAMKIRPYAEKLNGILQNIAASLEDGADNVYAEERELKRLLIVVVTSDRGLAGAFNANIVKAANALIEEKYSNLYQANKVDFICIGKKGAEAITKRGESANLEYQGLFQNLSFDTARGASEYVMNAYLTGKYDRVEVIYNEFKNVATQIIRTEQFLPIKGQALSAVKHSATEVDYIFEPSKEEIVKELIPKSLKVQFYKYLLESNASEHGARMTAMDKATENAKEMLKALKLTYNRSRQAAITKEILEIVGGAEAL

SEQ ID NO: 10331 - protein, 220 aa, Cytophaga hutchinsonii
  unsure (1)..(220): unsure at all Xaa locations
IETSWKHRIQDEFNKTYFKNLIQFVKEQYKTRVIYPAGKNIFKAFDACPFDAVEVVIIGQDPYHGPGQANGLCFSVNDGIVQPPSLKNIFKEIESDLGKSAPVSGNLERWANQGVLLLNATLTVEANTPGSHQKKGWETFTDAVIKKVSDEKEHVVFILWGAYAQKKGEIIDREKHLVLKSAHPSPFSAYNGFFGNKHFSKTNAYLKSVGKKEIDWXISD

SEQ ID NO: 10332 - protein, 450 aa, Cytophaga hutchinsonii
  unsure (1)..(450): unsure at all Xaa locations
MLFQDLKLIDPILKALSEEGYTTPTPIQSQAIPYVLQGKDLLGCAQTGTGKTAAFSIPILQLLSVKKSTDRKRPIRSLIVTPTRELAIQIGESLQAYGKYTGLTSTVIFGGVNQSRQVTALQNGIDVLVATPGRLLDLMNQGFISLRHIEIFVLDEADRMLDMGFVHDVRRLLLALPAKRQSLFFSATMPPEIVKLADNILVNPSKVEVTPVSSTADTIKQFMYFVDRGNKNNLLVEVLQDPKIKTCLVFTRTKHVADKVVKMLAEHKIKAEAIHGNKSQNARQNALTNFKAQTTRILVATDIAARGIDVDNLEFVINYEIPNIPETYVHRIGRTGRAGAKGTAFSFCDAEEKAYLKDIEKLISKKIPVIDEHPYPLMDHNPPKTPQGRQQRPASSSRPKAASGANSGSSRAGNAGGSQRSSGSSSRSGSSTGKKKWYGKSGSNTKXGXP

SEQ ID NO: 10333 - protein, 236 aa, Cytophaga hutchinsonii
MRIALIGYGKMGKTIERIAIERGHTISAIIDVHNKEDIKNLNGSMADVAIEFSQPESAFLNISHCLENNLPIVSGTTGWLKKKPVLDEICRQNNGSFFYASNYSIGVNIFFHLNKILAGLMKKFPDYAVSMEEIHHTEKKDAPSGTAITLAEGLMSQNSAKTKWVNEASENDDELEIISKRIDDVPGTHTVFYNSPIDTIEIKHTAHSREGFAQGAVMAAEWTAKNRGVFGMNDLL

SEQ ID NO: 10334 - protein, 282 aa, Cytophaga hutchinsonii
FYGTGTALITPFKKDHSVDYDAFKNLIEFNISSGVDYIVVNGTTAESATTSKEEKAKLLEVALDVNNGRVPVMYGIGGNDTAEVIQRIGSADFKGVDALLSVCPYYNKPSQEGVFQHYKAIAEKCPVPVLAYNVPGRTGINISAKTSIRLSEVKNIFGIKEASGDLVQALEIIKNTPNEFLVISGDDLLAVPTISLGAVGAISVLSNTYPAKFSEMIKAAIQSRFQQATQILARFTEMNPLMYEEGNPVGVKSLLELMGICSSEVRLPLVKASGELIHKIEQ

SEQ ID NO: 10335 - protein, 376 aa, Cytophaga hutchinsonii
YFAFPKLEGDIAPHMKFRGKDVLNWSLNNYIGLANHPEVRKADTDGTSQYGLAYPMGARMMSGNSNLIEEFESQLANFMGKEDAMVLNFGYQGIMSIIDALLDRHDIVIYDSESHACIIDGMRMHIGKRLVFPHNDIDNLKTQLERANKMIDPAKGSILVITEGVFGMAGDMGKLKEIVELKKHYSFRLLIDDAHGFGTMGKTGAGAAEEQGVQDEVDIYFSTFAKSMASVGAFVASKENIIEYLRYNTRSQIFAKTLPMALVVGNMKRLELLRTQPQLRDNLWNVVRALQSGLKEKGFNIGNTQSPVTPVYLSGTESEAAQMIIDLRENYGIFCSIVIYPVVPKGVMMLRLIPTAEHTLADVTRTINAFAEIAEK

SEQ ID NO: 10336 - protein, 318 aa, Cytophaga hutchinsonii
KIAVIGGGSWATALVKILSEQNVRINWWLKNKKDVDYILQHGKNPNYLSNVPIDTKKVTPTTNVRKALEGASVVIFVVPAAFIGEVLETIPAADLKDKIVVSAIKGMIPSENILVTDLLQKTHAVPSQKICIIAGPCHAEEVALEKRSYLSIAGEDFTAASVVADLLQCGFVKATVVEDLYGVEYCAVMKNVVAIACGIARGLNYGDNFQAVLVSNAMLEIELFVDALSKKERNWNASAYLGDLLVTCYSPYSRNRTLGNMVGRGYSVKAAQVEMNMIAEGYYAVKCVYELNKKLHVQMPITKAVYNILYEKISPSVE

SEQ ID NO: 10337 - protein, 416 aa, Cytophaga hutchinsonii
GKSYKFPVIEGSEGEKAIDIAKLRDLTGYVTLDTGYKNTGATKSAITFLDGEQGILRYRGYPIEQLASKASFLEVSYLLIYGELPTTSQLENFKERIRKHTNLHEDIKKVFDGFPSSAHPMGVLSSAVSSLTAYYPGSIDPTANDDEVDMTIVRLMAKLPTIAAWSYRNSKGQPLMYPKPKLGYCENFLYMMFGQPNEDFELDPVVVEALNTLFILHADHEQNCSTSTVRIVGSAHASLYSSIAAGINALWGPLHGGANQEVIEMLEEIKASGISTKDYIAKVKTKEVRLMGFGHRVYKNFDPRAKIIKKACDDILNKLGVKDPALEIAKELEQAALSDPYFVERKLYPNVDFYSGIIYKALGLRSDLFTVMFAIGRLPGWIAQWKELRDAKEPIGRPRQIYTGYTERDYVSIDKR

SEQ ID NO: 10338 - protein, 250 aa, Cytophaga hutchinsonii
VLTKRIIPCLDVKDGKTVKGVNFLNLRDAGDPVELGALYSQQGADELVFLDITATLEKRGTLVELVKRVAQHINIPFTIGGGIGSIEDVSACLNAGADKVSVNSSAIKNPALIDQLSKEFGNQCIVVAIDTRNVGGMNLVHSHGGTKPTDLDTIAWAKEMQERGAGELLLTSMDKDGTKAGFANELTAYISTHVSIPIIASGGAGTMEHFTDVFTLGKADAALAASIFHFKEIAIPELKSYLSGKGIHMR

SEQ ID NO: 10339 - protein, 372 aa, Cytophaga hutchinsonii
MKKKALFIDRDGTIITEPADEQIDSLEKLVFLPRVLTALSKIAVETDYELVMVTNQDGLGTNSFPEETFWPAQNKMLKTLEGEGIVFKRIHVDRSFPKDNLPTRKPGIGMLTEYMNGTYDLENSFVIGDRVTDVQLAKNLGTKAIYITPSTKALDWGLGELKYALATDDWMEIYKFLVKSERIARVNRKTNETDITIYLDLDGEGKGVMNTGLGFFDHMLDQLCKHSGIDLSVEVKGDLHIDEHHTIEDTALALGEAFLLALGSKRGIDRYGFLLPMDEALAQVAIDFSGRSWLVWDAEYKREKIGDMPTEMFFHFFKSFCDTAKCNLNIKVEGDNEHHKIEATFKAFAKAIKAAIRKDPANTRIPSTKGVL

SEQ ID NO: 10340 - protein, 344 aa, Cytophaga hutchinsonii
FSLDSILRDNIKNAKPYSSARDEYKGTEGIFLDANENPYGSAIQKMVNRYPDPLQRDVKTALSALKNVSAEHIFFGNGSDEPIDLLIRATCQPGKDSILILPPTYGMYEVSAGINDVDIISVPLTKAFDLDVDAILAAVKTHTKIIFICSPNNPTGNLMSEDKVKRILNAFSGIVVVDEAYIDFADTKGFVPLLDQYPNMVVLQTFSKAWGMAALRLGTAFASKEIVSVLNKIKPPYNINLLTQEAALEALQNVSVKDEMVYKILKQRDWLREELSKLPVCLELYPSDANFILMRTADGKKVYDYLVEHIVITRDRSKIILCEGCVRITVGTEAENKRLLDVLK

SEQ ID NO: 10341 - protein, 314 aa, Cytophaga hutchinsonii
VKDDMKDFEKKFRDSMKSKVMLLDKIMSYIVKRNGKQMRPMFVFLSAHLAGNVNDSTQRGAALIELLHTATLVHDDVVDDSDYRRGMFSINALWKNKIAVLVGDYLLSKGLLLSINHGDFHLLKIVSNAVREMSEGELLQIEKARNLNINEEIYFEIIRQKTASLIASCCAVGVSSTGADEALVERAKMFGEKIGMAFQVKDDLFDYETSEMIGKPVGIDIKERKMTLPLIYALNKASWLEKKRIMFIIKNQTHKSAKVKEVLQFVRESGGIEYTRTVMENFREEAYGFLEEFQDSVYKKALRDLVDYTIARKH

SEQ ID NO: 10342 - protein, 192 aa, Cytophaga hutchinsonii
MPILVIVRHGQSEWNLKNLFTGWSDVELTPTGEHEAEYAGIVLRPYHFDIAFTSVLKRAIHTLSIILNQTGATIPIIENEALNERNYGDLQGLNKAEVGEKYGAQQLIAWRRSYTEVPPGGESLENTCQRVIPYYQEKIEPELKDGRNVLIVAHGNSLRALMMHLEKISPEDIAHVDLATGAPRLYEFSSKL

SEQ ID NO: 10343 - protein, 575 aa, Cytophaga hutchinsonii
MLSKTVSDQLVAMLVQAGIKRVYAVTGDSLNFVNDAIRRSGKIEWIHVRNEETGAFAAGAEAQLKGIACCAGSSGPGHVHLLNGLYDAHKSSASVLAIASTCHSTEFGTDSFQETNTIKLFDDCSCYNQIAVTPLQFPRMLQAAVQHAIHKKGVAVLGLPGDLTSMAAELSPTSMEIYHSNPVIRPSAVELIQLAAILNDHSKITIFCGIGASEAHDQVVKLSKVLQAPVAYSFKAKMSMQHNNPNEIGMTGLLGLPSAFESMHESEVILLLGTDFPYADFMPVKNKIIQIDTAPEKLGRRAKLDMGLCGNIQDTLDALFPLITQKEDDSFLQKQLNLYTEVKEHLKSYVDDPGKENLIHPEYVASRIDALSAEDAIYTVDTGMTCVWAARYLNATGKRTLLGSFNHGSMANAMPQAIGAALACPGRQVIAMCGDGGISMMLGDIMTIVQYKLPIKLIVFNNHSLGMVKLEMEVSGLPDWQTDMVNPDFSKIAEAMGMRAITVTDPADVDGALIEAFAYSGAILLNIITDPNALAMPPKITFEQMKGMATSMTKLMLSGQMDEVWKKIESNKKHL

SEQ ID NO: 10344 - protein, 398 aa, Cytophaga hutchinsonii
MNIHEYQAKEILKKYNVKIGEGIYADSPESAVEAAKKLKEQTGTDIFVVKAQIHAGGRGKGKFVGTEHRGVMIAKSYDEVKEKAAQMLGNTLVTIQTGPSGKVVSRLLVAADVYQKGASEPKELYLSMLLDRGTGQDVIIASTEGGMDIEEVAHSTPHLITKEFVDPAVGLQGFQARKIAFGLGLSGTAFKEMVTFVTRLYTAYKATNAEMIEINPVLKTSKDEILAVDAKVSIDDNALFRHPDLAAYRDVTEEDPLEVEAAESHLNYVKLDGNVGCMVNGAGLAMATMDVIKLAGGEPANFLDVGGGANAKTVEAGFRIILKDPNVKAILINVFGGIVRCDRVANGVVEAYKNIGTINIPIIVRLQGTNAEEGAKIINESGLKVRSAVILKDAAKLV

SEQ ID NO: 10345 - protein, 335 aa, Cytophaga hutchinsonii
MSASIHEILKTYWGHSNFRPLQEDIINSILGGNDTVALLPTGGGKSICYQVPALARDGLVLVISPLIALMKDQVEQLRRRGIIATAIHSGLRKTEIDIALDNCIYGNIKLLYVSPERLKSDLFKERVEKMKIICIAIDEAHCISEWGHDFRPAYREIASIRTLLPEVPVIALTATANEMVLNDIMDQLALQNPQIFTQSFTRKNLSYSCLYEENKEKRLVSMLQKIPGVCIVYANTRARVVRIAEFLNRQGIPTEFYHGGLDHKQRSIKQDAFMKNTVRVMVATNAFGMGVDKPDVRLVVHMDVPDSLEGYFQEAGRAGRDGNKAFAVLLHTKKD

SEQ ID NO: 10346 - protein, 549 aa, Cytophaga hutchinsonii
IKMPKMSDTMTEGVIAAWHKKVGDKVKSGDLLAEVETDKATMEMESYEDGTLLYIAAEAKSAVPIDGVIAVIGKDGENIDALIKEIKGGGAPAEAPKTEAKAEAEVPKAEKPAEAAKQAAPAVDLSSIKAEAILMPKMSDTMVEGTIVAWHKKVGDAVKSGELLAEVATDKATMEMESYEDGTLLHIEVKEGDAVQIDGLIAIIGEKGTDVTPIINAYKNGGKPSAAPAAASEPAKQETASAPASNNAPAAQASSSSDERAKISPLARKIASDKGIDIKQVKGSGDHGRVIKRDIENFKAAPAEAAPAKGSGAPAASLPNIVGQEGFDEVPVSQMRKVIVKRLSESLFTAPHFYLTMEINMDKAIEARASINEVATAKVSFNDMVIRASAAALRKHPMVNASWQGDKIRVNHHIHIGVAIAIEDGLVVPVVRFADSKSLSHISQEVKELGGKAKSKKIQPADMAGNTFTISNLGMFGIDEFTSIINSPDACILSVGGIKQTPIVKNGQIVVGNIMKVTLACDHRVVDGAVGSAFLQTLKSYLEDPVRIL

SEQ ID NO: 10347 - protein, 322 aa, Cytophaga hutchinsonii
KSKLEYIWLDGYKPTQSLRSKTKIEENFSGKLEDLSNWSFDGSSTEQAKGGSSDCLLKPVFVCPDPQRKNGYLVMCEVLNADGTPHPTNGRAQIEDDDNDFWFGFEQEYFLYDLSTNMPLGFPAGGYPKPQGPYYCSVGAQNAYGREIIEEHLDVCLDAGLNVEGINAEVAAGQWEFQIFAKGAKRAGDEIWVARYLLERIGEKYGVYVNYHCKPLGDLDWNGSGMHANFSNTLLRTAGSKEVFDKVCEAFRPVVKEHIEVYGAHNELRLTGKHETASIHDFSYGVSDRGASIRIPVLVPAKGWSGYLEDRRPNSAADPYKV

SEQ ID NO: 10348 - protein, 285 aa, Cytophaga hutchinsonii
QLLDGKITSDQIKEELKTKVEAIKAKGGKIPHLAAVLVGDSGAAVTYVNAKVKACELVGFKSTLVKLPETITEADLLAKVAEINADKDIDGYIVQLPLPKHIDEQKVTEAISPDKDVDGFHPTSLGRMVLNLPTYLPATPYGIMQLLERNGIETSGKHCVVMGRSHIVGSPMSILMARNTNPGNATVTMVHSRTKNLKELTLQADILIVAIGKPEFVTADMVKEGAVVVDVGIHRIDDATKKSGFRLLGDVKFDEVAPKTSYISPVPGGVGPMTIASLLMNTLQA

SEQ ID NO: 10349 - protein, 424 aa, Cytophaga hutchinsonii
VLLGLQWGDEGKGKVVDVLAPKYDYVARFQGGPNAGHTLIFDGHKVVLHQIPSGVFRSNITNLIGNGLVLDVIALFEKEIDKLEAFKLNLNKNLFISKKAALILPSHVELDKAYEAAKGAGKIGSTLRGIGPTYTDKVSRHGLRVGDILSPDFMDKYNKLVDQHKQILDFHKHDYSEMKEREDLFFKYIDRLRKMNLVDSEYFINDAIQSKKTILAEGAQGSLLDIDFGSYPFVTSSSTMVAGACTGLGIAPKHIGNVFGIFKAYCTRVGSGPFPTELHDAVGEEIRKQGNEFGSTTGRPRRCGWLDLPALKYACMINGVSHLLMMKADVLNAFEELQVCTHYKLGNGDIVDTLPYDMCTNDLTPVYKTLKGWNQDLSNCETFDSLPQALLDYSAFIEAELGLPITLISIGPDRKETLIKDFSF

SEQ ID NO: 10350 - protein, 466 aa, Cytophaga hutchinsonii
YDVCIIGAGPAGYAAAMRALDLNKSVILIEKDKIGGAGLYNGAISSKTFWELAKDIQTARKRLAQYSPDQHFSVTYQQVLRQVREGIANRRFHLEGQIESLAKQQTSRFRYIKGSAKLVSHNTVEVSTGTEEEIIEAENVVIATGSKPRKLPNIPIDEKIIVTSDGVENFENFPKSLVILGAGVIGCEWATIFSNFGYTSVNIIDKAERILPFEDDDVTDVVEANMKKQGITVHKKSNLLSMRIVDGEVEYILEYTDGRKEMHRVEKVLVSVGRIPNTQNLGLERVGVNILANGQIENTDGQTNIPNIYVAGDISSDVALVNVAELEGRHVIEKMFGLSDSVITYNNVSTIMFVQPEVAGVGMNEKKALQNKMSYKVVKIRYDMIPRAIAMRNNDGFFKILVTNDADMKIIGMRAVGVHASSAIQAVALLISMDKGVEELADMIHPHPSIIEGIQECIRMLLGKSV

SEQ ID NO: 10351 - protein, 211 aa, Cytophaga hutchinsonii
MSLRLGDIAPDFKADTTEGPISFHEWLGDKWGVLFSHPADYTPVCTTELGATAKLKSEFEKRNVKVAALSVDGLESHKGWIKDINETQNTTVNFPIIADEDRKVAELYDMIHPNASEKFTVRSLFIIGNDKKIKLIITYPASTGRNFTEILRVIDSLQLTANYSVATPANWKDGEDVVITPAVKDEDIAAKFPKGYTRVKPYLRTTPQPNK

SEQ ID NO: 10352 - protein, 280 aa, Cytophaga hutchinsonii
KYILIIGSGTMGSGIAHSFAQFGFQVFLCDSNAAALNKAMLQISTNLERQISKGIIPDSEKETIISRITPITDFKEAAKTVSLVVEAVPELLEIKADLFKELDMHCPPETILASNTSSISITTLASYTSRPEKVIGMHFMNPVPVMQLVEIINGLLTSSETTRRIEEISTQLNKIPVQTADYPGFISNRILMPMINEAIYCVQERVAGIAEIDQIMKLGMAHPMGPLQLADYIGLDVCVNILNVLYKGFGNPKYSPCPLLVNMVHAGLLGSKTKKGFYDW

SEQ ID NO: 10353 - protein, 175 aa, Cytophaga hutchinsonii
ILEQTIKSTIRDIVDFPEPGIIFKDITPLLKDPQLCKAIVQSITDQLRPLQPDALACLDSRGFWFGLSIAMELGIPMIPIRKKGKLPYETVYEEYALEYGTNTIEMHTDAVQPGCRVAIHDDILATGGTAEATSKLIKKAKGEIIAYSFLIELDFLKGKDKLAPYCTTIQSLINY

SEQ ID NO: 10354 - protein, 283 aa, Cytophaga hutchinsonii
GLQDKFGEIRITDTGIREATIVGQAIGTAMRGLRPIAEIQYLDYLLFAIEILSDDVASLHYRSAGGQKAPLIIRTRGHRLEGMFHSGSPMQMILGSIRGMFLCVPRNMTQAAGMYNTLIKGDEPAIMIESLNAYRLKEKLPENLGEFTVQLGIVDVLRPGTDITIVTYGSMCRIVQEGANELQQLGISCEIIDIQTLLPFDRTQQIVESIKKTNRVLFADEDYSAGATAYMMQQVLEGQKAWQYLDSEPRTLAAQDNRPAYSTDGDYYSKPSSDDVIDVVYEM

SEQ ID NO: 10355 - protein, 246 aa, Cytophaga hutchinsonii
KIALITGGSRGLGKNMALALAQKGIDIILTYHSNQAAANEVVTAIELMGQKAVAFQLDTSNTATFDSFIMQVKDYLKENYSRSNFDFLINNAGTALYSLAAETSEEQVIDIFNIHYKGVFFLTQKALPIMHDGGGIVNISSGLSRITMPGSSVYASMKSAIETYSRYLAKELGDRKIRVNVIAPGAIETDFGGGRVRDNKEINANIAGITALGRVGLPDDIGKVVAFLCTQDAGWVNAQRIEVSGG

SEQ ID NO: 10356 - protein, 249 aa, Cytophaga hutchinsonii
LDIQHLKKVYPTPKGDFTVLQDFNLQVKKEEFISIIGHSGCGKSTILSMIAGLNELTEGNIILNGRKITEAGPDRGVIFQSPSLMPWMTALENVMLGVNQVFSHISKSERTDIAKYYLAKVGLEDSFNKKASELSQGMKQRVGIARAFALKPKMLLLDEPFGMLDSLTRGELQDVLVDVWTKEKITAIMITHDVDEAILLSDRVVMMTSGPFAKVGDIMGVGMERPRNRRTLIEHPEFYDYRAYLIDFL

SEQ ID NO: 10357 - protein, 196 aa, Cytophaga hutchinsonii
LIKILRDKGIQDELVLQAIDRVPRHIFLDNAFLEHAYQDKAFPIGDGQTISQPYTVASQTSLLKLSPGMKVLEIGTGSGYQCSVLLEMGVNVFTIEYHKSLFEKSKKMLQSLGYKAQFFCGDGSEGLARFGPYDRILATAGAPYVPQKLLEQLKVGGILVIPVGDQKTQKMLRLTKVTEKEITQEECGDFRFVPLV

SEQ ID NO: 10358 - protein, 294 aa, Cytophaga hutchinsonii
KEHIENEFQKIQQHICRALETADGKATFKTDEWTRPEGGGGKSKIITDGNTLEKGGVNFSAVHGETPDNILHALKLSKAEFYATGVSIVMHTTNPWVPIIHMNIRYFEMSNGIWWFGGGIDLTPHYVIKEEAVAFHQSLKDLCDQFHESFYTTFKEWADNYFYIKHRGESRGVGGIFFDRQGNDAPVSKESLFEFVCALGYLFPKIYTKLIADNNSKTFTEAERNWQKLRRGRYVEFNLVYDKGTKFGLDTNGRIESILMSLPPEANWTYDFQPAAGSKEAQTIEWLKAQPNWL

SEQ ID NO: 10359 - protein, 392 aa, Cytophaga hutchinsonii
MKPVYIVAASRTPIGSLAGSLSSLNASQLGAAAIKGCLNNLELPLDAIQNAYMGNVLSAGLGQSPARQASKFAGLPDSTEATTINKVCASGMKAIQLGTQQILCGDAEIVVAGGMESMSNVPYYLDKARQGYKLGNAQVIDGIIKDGLWDVYYNCHMGNAAENTAKELHITREMQDAYAIESYKRSASAWQNGSFKNEIVPVNISGKPGQETVVDTDEEFSKVNFDKIPQLKPVFDKEGTVTAANASSINDGAAALILVSEDALKKYNLTPIARILSYADAAQDPLWFTTAPVLSVNKALEKAGLNIQDIDYFELNEAFAVVCLAINNKLGIDSRKANVWGGAVSLGHPIGASGARIVVTLVNILKTNNARLGVAGICNGGGGSSALVIENL

SEQ ID NO: 10360 - protein, 278 aa, Cytophaga hutchinsonii
AIEWKTVKEFDDITYKKSNGVARIAFNRPDVRNAFRPKTTSELYDAMYDAYEDASIGVVLLSAEGPSSKDGIYSFCSGGDQKARGEKGYVGEDGRHRLNILEVQRLIRFMPKVVIAVVPGWAVGGGHSLHVVCDLTLASKEHAIFKQTDADVTSFDGGYGSAYLAKMVGQKKAREIFFLGRNYSAQEAFDMGMVNAVIPHDELESTAYDWAQEILAKSPTSIKMLKFAMNLTDDGMVGQQIFAGEATRLAYGTDEAKEGRNAFLEKRKPDFGDIGWAP

SEQ ID NO: 10361 - protein, 330 aa, Cytophaga hutchinsonii
LHSQLLGTGHYVPEQIVTNNDLTAFMETSDAWIQERTGIKERRFFKEGVDTVSNMGAKAAQMALANAKIEAKEIDLIVFATLSPDYAFPGAGVLLQCELGVPNIPALDIRQQCAGFIYALSVADQFIKTGMYKTVLVVGSEIQSNIMELSDRGRNMAVIFGDGAGAVVLKATTENKGVLSTHLHADGTHAEELMLEHPGSRSKTRVTTEMIENGALLPVMNGQGVFKQAVQKFPEVIKEALDANNLQTTDISLLIPHQANLRIAEYVQKQLKLEDHQVFNNIQKYGNTTAASIPIALSEAVQEGRLKSGDLLCLAAFGSGFVWASALVRY

SEQ ID NO: 10362 - protein, 605 aa, Cytophaga hutchinsonii
  unsure (1)..(605): unsure at all Xaa locations
ELQKVSSQVRRDIVRMVHGAKGGHPGGALGCTDLLVLLYFKLMKHDKNFNMDGIGEDIFYLSNGHISAVLYSVLARSGYFPVDELVSHRKINSRLQGHPTPHSHLPGVRMASGSLGQGLSVGCGTAQAKKLNKDERFVYVLMGDGEQQEGQVWEAAMYAPHNKLDNLIGFVDYNGQQIDGPCDKVLSLGDLEGKYKAFGWNVITCDGHDFACLEETILKAQANKGTGIPTMILMKTEMGYGVDYMMGSHKWHGTAPNDAELASALGQLEAHLAIINPLLKKDITTMKKYPFTEKKDTRSGFGDGMTELGKTNPNVVALCADLTPSLKLNDFEKQNPERFFQIGIAEANMISMAAGMTIGGKIPFTATFANFSTGRVYDQIRQSVAYSDKNVKICASHAGLTLGEDGATHQILEDIGLMKMLPGMTVINPCDYNQTKAATIAIADHKGPVYLRFGRPALPVFTDPNQKFEIGKAWMVNEGTDVTIIATGHMVWEAILAGQQLEELGISAEIINIHTIKPIDEEAILKSVGKTGCVVTAEEHNILGGLGESVARVLASNLPTPIEFVAVKDTFGESGTPDELMEKYGLKDRHIVEAVQRVIKKKKXI

SEQ ID NO: 10363 - protein, 367 aa, Cytophaga hutchinsonii
MSFATLGLSPAILKALEKQFYNAPYPIQEQAIPAILKGKDILGIAQTGSGKTASFVLPILQMLQTKPLGKNRHINALVLVPTRELAVQVGQVFQAFSNALPNKIKSLAVYGGVSINPQMIQLQGVEILIATPGRLLDLVDSKAVYLSDVEVLVLDEADKMLNLGFKEEMANIFKLLPQKRQNLLFSATLGKDVDTITEFLLHDPVKIEIIAEEQNIDLIQQIAYAVEDARKGPLLRYLIKEQKMNQVLIFTSSVHRADAVVEKLKANNILAAALHSKKSQGARTEALKQFKAGNIHVLVATDLMSRGIDIPFLPFVINYELPRSPKDYIHRIGRTGRAEASGVAINLISEEETHHFSVIQKKMGKKV

SEQ ID NO: 10364 - protein, 793 aa, Cytophaga hutchinsonii
MLVLKRDGRRESVKFDKITSRIERLCYGLDMNYVDPTSVAKRVIDGLYDGVTTEELDHLAAETAASMTTKHPDYATLAARIAVSNLHKKTSKSFANTMKRLYTYVDPKTGENASMISNEVYEFIRKNAAILDSAIIYDRDYGYDYFGFKTLEKSYLLKVDGKIVERPQHMLMRVSCGIHSGDIDAAIETYNLMSERWFTHATPTLFNSGTPKPQLSSCFLLTTQDDSIDGIYETLKQCAKISQSAGGIGLSIHNIRATGSYIKGTNGTSNGIIPMLRVFNDTARYVDQGGGKRKGAFAIYLEPWHADVFEFLDLRKNHGKEEMRARDLFYAMWISDLFMKRVEENGDWSLFCPHEAPGLADCYGKDFEALYEKYEKEGRARKTIKAQELWFAILEAQVETGTPYMLYKDAANRKSNQKNLGTIKSSNLCTEIMEFTSPEEVAVCNLASLALPKFVINGKFDHQKLYDVTYVATKNLNKIIDVNYYPVPEAERSNKRHRPIGLGVQGLADAFILLRMPFESDEAKQLNIDIHETIYYAAMTASKDLAEKLGPYETFKGSPVSKGIFQFDMWGVTPASGRYDWEALKREVKKHGVRNSLLVAPMPTASTSQILGNNECFEPYTSNIYTRRVLSGEFVVVNKHLLKDLIKLNLWDDKMKNRLIEMNGSVQNINNIPQNIKDLYKTAWEIKGKTLIDMSADRGAYICQSQSLNIFMPEANFGKLTSMHFYAWNKGLKTGMYYLRTKSAANAIQFTVEKQAEVQLAPGTTDQSIVDAEKKAKDMACSLDNPEGCESCS

SEQ ID NO: 10365 - protein, 321 aa, Cytophaga hutchinsonii
LEEPLLKENKNRFVLFPIKHDDIWAMYKQEEASFWTAEEIDLSQDLIDWANLNDGERHFISHVLAFFAASDGIVNENLAVNFLEKVQIPEAKCFYGFQIMMENIHSETYSLLIDTYIKDPKEKDRLFNAIDTVPCVKKKADWALRFIDNGSFIENIIAFAAVEGIFFSGSFCSVFWLKKRGLMPGLSFSNELISRDEGLHCDFACLLYTKYINNKLPAERVIQIILEAVEIEKEFVTDSLPVDLIGMNARLMQQYIEFVADRLLVALGVPKQFNATNPFDFMEMISLQGKTNFFEKRVSEYQKSGVMAEKDSQKFSLDEDF

SEQ ID NO: 10366 - protein, 236 aa, Cytophaga hutchinsonii
KEPTELYEPIRYIMDLGGKRMRPLLTILSNYIFTEDTNNVMNAAIAVEVFHNFTLMHDDIMDNAPLRRGKATVHAKWNTNIAILSGDVMLVEAYKQLMTIDEKYLKQVLDRFNETAAGVCEGQQFDMNFESLPTISVDDYINMIRLKTAVLLGFSMELGGILGDADEKSCTYLNTVGISAGIGFQLKDDLLDVYGDAATFGKQVGGDILANKKTFLLIRALEKAAGKTKKDLEKLL

SEQ ID NO: 10367 - protein, 542 aa, Cytophaga hutchinsonii
NTSDFTSWKKLNEHYSKSSNLQMRDLFAADKDRFSKYSVQFNDILVDYSKNRITDETISLLIALAEEAGLKQAIEDMFAGKKINNTEKRSVLHVALRNRSNTPILSDGKDVMPEVNAVLEKMKGFCEKVRSGAWKGYTGKSITDIVNIGIGGSDLGPVMVTEALKPYGSPTLHVHFVSNVDGTHIVETTKKLNPETTLFIIASKTFTTQETITNAESAKAWFLQTAKDEAAVAKHFVALSTNAKSVAAFGIDTENMFEFWDWVGGRYSLWSAIGLSIALYIGYDNYIELLSGAHAMDKHFKETPFAKNIPVLLALIGIWYNNFYKAESHAILPYDQYMHRFAAYFQQGDMESNGKRVTKDGTAVTYSTGPIIWGEPGTNGQHAFYQLIHQGTKLIPCDFLAPVISQNPIGDHHPKLLANFFAQTEALMKGKTAAEAKAELEKAGLSAEDVAALVNHKVFEGNRPTNSIFFKKLTPFTLGSLIAMYEHKIYTQSVVWQINAFDQWGVELGKQLANAILPELKDNAAVTSHDSSTNGLINFYKA

SEQ ID NO: 10368 - protein, 562 aa, Cytophaga hutchinsonii
MQEKGNISIHTENIFPIIKKFLYSDHEIFLRELVSNAVDATQKLKRLAALGEYPGELGDTKVTVSVNKEAGTITITDRGIGMTAEEIKKYINQIAFSGATEFIEKYKDKTDTNQIIGHFGLGFYSAFMVSSNVEINTLSYQPNSKAAHWICDGSTEFEIKLSDKAERGSEITLHIAEDSLEFLETSRIHSILDKYCRFLPVEIEFEGEIINNPSPLWTKQPSELKDEDYIAFYKELYPMSEDPLFWIHLNVDYPFSLTGVLYFPKLKKDFEFQRNKIQLYSRQVFITDEVKDIVPEFLMLLHGVIDSPDIPLNVSRSFLQADGNVKKINSHITKKVADKLNELFNNDRAGFEAKWDDIGMFVKYGMISEEKFYDKAKNFCLLKNTDNALSTIEEYEQKIKPIQTDKNDKLVYLYSNNAVAQDIFIQAAKKKQYDVLLLDSVIDSHFLGQLESKLEKVQFKRIDSESVDKLIEKDEPKLSLLTKEQETQAEELFKKVVNNGKVIIKLEHLATDDMPVTIVISEFMRRMKDMAATSGQSMFGGFELTHEVVVNTNHPLIAKAIA

SEQ ID NO: 10369 - protein, 473 aa, Cytophaga hutchinsonii
SPINGELLATVEYASKETYNALIEKAQEAFPVWSALPAPKRGEIIRQIGDAFREKKQELGALITIETGKLLQEGLGEVQEIIDVCDFAVGLSRQLYGLTMHSERPDHRMYEQYHPLGIVGIISAFNFPAAVWSWNAIIGAVCGNVCIWKPSEKAPLSAIACQSVVSEVIKKNGLPEGIFTIYQGAAAQGSWMADDERVALVSATGSVAMGKKVNQAVAGRLGKVLLELGGNNAIIVTEKANLDMATRAIVFGAVGTAGQRCTTTRRLIVHESIYKKLVDDLTRIYAQLSIGSPLDADTLVGPLIDETAVELYEKRIATAQKEGAVLVTGGKRMQPKGFEKGTYVLPAILEADGAIPSIQEETFAPILYISKYTGHVENAIKMNNGVRQGLSSAIFTGDLQQMERFLSNKGSDCGIANVNIGTSGAEIGGAFGGEKETGGGRESGSDSWKAYMRRQTNTINYGNTLPLAQGIKF

SEQ ID NO: 10370 - protein, 362 aa, Cytophaga hutchinsonii
KKALITGVTGQDGAYLSEFLLKKGYEVHGVKRRSSLFNTDRIDHLYVDQHEKNVKFKLHYGDLTDSTNLIRIIQEVQPDEIYNLGAMSHVKVSFDTPEYTANADGIGTLRILEAIRILGLEKKTKIYQASTSELYGLVQEVPQKESTPFYPRSPYAVAKMYAYWITVNYREAYNMFACNGILFNHESPLRGETFVTRKITRAVARIALGAQDKVYLGNLDSKRDWGHAKDYVEAMWLILQQKKPQDFVIATGVTTTVRDFVKMAFARVGIEVEFKGSGVKETAVVKSCKNKEFQLKKGTVVVAVDKAYFRPTEVDLLIGDPSKCKKILKWKPKYNLAMLVNEMVDADVQLFKKDEYLKKGGF

SEQ ID NO: 10371 - protein, 360 aa, Cytophaga hutchinsonii
KRDYYEVLEITKSASADEIKKAYRKLAIKFHPDKNPDNPEAEEKFKEAAEAYEVLSTPEKRQRYDQYGHQAAGGGGYGGGMNMDDIFSQFGDVFGSGGSPFESFFGGGGGGRGRGVRKGSNLRIKLKLNLEEIANGCEKKIKVKRQVACDECSGTGAKNGAVQKCGTCNGTGQVKRVVNTMLGQMMSATTCPTCNGEGTTIKDKCTSCHGQGTVEKEETITIKIPAGVVDGMQLSMSGKGNMPPRGGVAGDLLILIEEIEDEQLKRDGLNIIYELYVTFFDAVFGTSVEVPTVDGKVKIKIEPGTQSGKILRLRSKGLKDVNSYQKGDQLIYVNVWTPQTLSKEEKELLATIKESENFKP

SEQ ID NO: 10372 - protein, 817 aa, Cytophaga hutchinsonii
  unsure (1)..(817): unsure at all Xaa locations
NTMKVLKFGGTSVGSVESIRKVAEILSSYKKKEKFVVVFSAMSGITNLLVEVGQKASTTDISYQQVLKTIEQKHVSTAKTLIDVKNQGKVIAQLKLILNELQDLLHGVYLLKELSPRSNDLVLSFGERLSSYLVSEFLKQEGVDVTFLDARKVIITDSSFGSAKVDFKKTDKAIKDYFKDIKSSVVTTGFIGSTDKGETTTLGRGGSDYTASVFGAALDSEGIEIWTDVDGIMTADPRKVKRAFTLPQVSYIEAMEMSHFGAKVIYPPTLQPAFKKRIPIWIKNTFNTAFEGTLINEKTSATDHSVKGISSIENISMLNLTGSGMVGVPGVSGRLFGALARNFINVILITQASSEHSICFVIDSKESAKAKDAVEEEFEHEIKAGKIDKLHEKDNLAIVAVVGDNMRHTPGIAGKLFSSLGKNGXXXXXXXQGSSEINLSVVIGKEDLTKALNVIHESFFLSDVKTINVFVVGVGLIGSALLKQLQKQSTYLQKEKGFKINVVGLANSKKMLINENGVALTSWKEKLDEGEKANLKEFVKRMIDLNLRNSIFVDNTSNKDVVSFYHNILDESISIVTPNKLANSGLYKDYQKLQETAFKRGVKLMYETNVGAGLPVINTLNDLKDSGDKIIRIEGVLSGTLSYIFNNFKGDKKFSDIVKEAKEKGFTEPDPRDDLNGKDVARKILILSREAGFNLEFDDVVVENILPAPCLKAKTVEEFFVELEKNNNVFSKKRDEADKANKVLRFIAKLENGKAEVSLQSVDSTHPFFSLSGSDNMIAYTTERYKERPLVIKGPGAGAEVTAAGVFGDIIRISNYL

SEQ ID NO: 10373 - protein, 299 aa, Cytophaga hutchinsonii
KHLLGIKDLTTKDIELILETAGQFKEVINRPIKKVPSLRDVTIANVFFENSTRTRLSFELAQKRLSADTINFSAAASSVKKGETLLDTVNNILAMKVDMIVMRHASVGAPHFLAKHISANIVNAGDGTHEHPTQALLDSFSIKEKLGGVAGKKVCIFGDILHSRVALSNIFALQKQGAEVMVCGPSTLIPKFIGELGVKVEFDLRKALQWCDVANVLRIQLERQTIKYFPTLREYAQYYGINKQLLDSLNKEIVIMHPGPINRGVELSSDVADSGHSIILDQVENGVAVRMAVLYLLAG

SEQ ID NO: 10374 - protein, 291 aa, Cytophaga hutchinsonii
MSVLVNKNSKIIVQGFTGTEGTFHAQQMIEYGTNVVGGVTPGKGGSSHLDRPIFNTVAEAVAKTGADVSIIFVPPAFAADAIMEAADGGIKVIICITEGIPVRDMIDAKAYVTKRKVTLIGPNCPGVITPEEAKVGIMPGFIFKKGRIGIVSKSGTLTYEAADQVVKAGYGISTAIGIGGDPIIGTTTKEAVELLMNDPETDGIIMIGEIGGQLEGDAAKWIKANGTKPVVGFIAGQTAPPGRRMGHAGAIVGGADDTAAAKMKIMAECGIHVVQSPADIGETMAKAMKKQ

SEQ ID NO: 10375 - protein, 617 aa, Cytophaga hutchinsonii
EYTRAYAASIADPEKYWDDQAAQFIWKKKWDKTLEWNFSDPDVKWFIGGKLNITENILDRHATKTPDKVAIHWESNNPDEAGKDITYKQLYEQVCVFAGVLKQKGIKKGDRVCIYMPMIPELAIAVLACARIGAIHSVIFAGFSASAVADRVNDAKAVAVLTSDGSFRGTKSIAVKALIDEALQQCETVKTVLVAKRTGDAVAMKDGRDYWWDEAIAGATPVYEAEEMDSEDPLFILYTSGSTGKPKGVVHTIGGYMVYTAFSFANVFQYNEGDVYFCTADIGWITGHSYLVYGPLLQGATQVMFEGIPTYPDAGRFWSIIDKYAVTHFYTAPTAIRSLMSFGDTMVEKYSLKSLKVLGSVGEPINEEAWHWFNEHIGKKNCPIVDTWWQTETGGILISPLASITPLVPSYATLPLPGVQPVLVDANGTVLEGNNVEGNLCMKFPWPSIIRTTYGDHERCKQTYFSTYPNLYFTGDGCKRDEKGYYRIMGRVDDVINVSGHRFGTAEIESAINEQADVIESAVVGYPHEVKGQGIYAYVICDKTDKNEDQLRKEILDSIVKLIGPIAKPDKIQIVTGLPKTRSGKIMRRILRKVAEGDLNNLGDTSTLLDPEIVEEI

SEQ ID NO: 10376 - protein, 511 aa, Cytophaga hutchinsonii
LGLTILSGIFLYLQRKIIIGTSRRIEYDVKNEIYDHYQQLPVSFYKRNNTGDIMNRISEDVNQVRNYLGPALMYGMNLFAIFIVTVPIMLSVSTELTLYTLIPLPFLVISIYTVQNVITRHSEEIQRSMSRLSSLVQETFSGIRVVKSFGRETSMTTQFDAQSNEYKSKSIHLTQINALFFPLMVFLIGASIIFIVWIGGKKVIAGEGVTNGNIAEFIFYLNKLAWPVTSLGWITVMIKRAEVSQERINQFLKQKNTLLKGKEITTPIKGAIAFKDVSFTYPDTGIEASKHISFMVAPGQTLAIIGNTGSGKSTIASLLCRLYDTSSGDIEIDGISIRDYNLQFLRSQIGFVPQDVFLFSDTIRNNIAFGFDNVTEEQIIEAAKFSDLYTSIQHFPMGLDTILGERGITLSGGQKQRLSLARAFIRNPRLFILDDCLSAVDTKTEDTILNNLKVVLGDRSTIIISHRVSSVKLADKIIVLEDGQIAQSGSHEELMDKEGIYRNIYLKQLHE

SEQ ID NO: 10377 - protein, 157 aa, Cytophaga hutchinsonii
MAEKNLILTKKQIQQRIKRIAYEILEQNFKEKEIVFAGIYDRGYSVAKLLEKEFKSISSTQTVLIKVTLDKQAPSQSEVTLDVDVKTLKNKCIIIVDDVLSTGRTIAYSLKPFLNIRVKRIQTAFIVDRGHHTFPISADFVGYVMATTLNEHVEVNL

SEQ ID NO: 10378 - protein, 301 aa, Cytophaga hutchinsonii
VRIGTRGSKLALWQAEHVAACLQTKGLEPQIVIIDTTGDKILDQSLSKIGSKGLFTEELEEQLHAGTIDIAVHSAKDLQTHLKGGMYILAITERELVNDVLVSHKPIDTLKNNPDLIIGTSSTRRRALLRKFYPQAKMVDMRGNLQTRIRKMEEGACDAMLLAYAGMHRMGYDSLIKEKLSLEEFIPAAGQGTLAIEAASTLDKEKAAVIRAVLNDAATETAVSAERAFLRTLEGGCSIPVFALAVERDTDYLLTGGIVSLDGTKYLRKEIRFTAADAEQRGVELATVLLKDGADEILAEI

SEQ ID NO: 10379 - protein, 527 aa, Cytophaga hutchinsonii
LLHRILDSGYGKSTTLIFIALFLISTNFLTNIFKYFSQLINTRLRATVIYNMRERMFDKVVKLDVGYFTNQRKGDLMSRMTNDLGEIENSVIGALQVFFRDPFNLVIYFITLLMIQWELMLFTLLILPIAGLGVSIIGKKLKKESEESQRSVGHILSLIDESISGIRIIKGFIAEKFVINRFNDQGKKYADLTNSMGNKRELASPLTEFMGVTIVAIILYIGGNLVFSGKMEASTFFLFIICFYKILEPVKSLASSITSIQRGIAAGDRIFDILDHPVSIEDTPSAKTLSAFTTGVSLKNIGFKYEEHEVLKHISIDIPKGKLIALVGPSGGGKSTLVDLIPRFYDPATGSVEIDGVNIKDYTLNSLRSYIGIVTQESILFNDTIFNNIAFGLPNITQEDVERAARIANAHEFIIRTEKGYQTSIGERGSKLSGGQRQRLSIARAVLKNPDILILDEATSALDNESEKLVQEALNYLMKDRTSIVIAHRLSTIRHADMILVLDKGQIKEQGTHEQLLAQEGIYYKLH

SEQ ID NO: 10380 - protein, 92 aa, Cytophaga hutchinsonii
LSAEEFSQKIKKEPNALILDVRTPEEFSEAHIANATNVNWKDNFASGITEVNKNQPVLVYCLSGGRSASASDYLRKNGYTQVYELQGGLLKW

SEQ ID NO: 10381 - protein, 303 aa, Cytophaga hutchinsonii
ILISVLFAAAFAACTHEKPATQVTLMDTLSEIEILDPEAEKLFSKETKAEVIASGFLWSEGPLWLKDEQKLIFSDVPRNRINSWSEKDSLQLYLEPSGYTDTIKRGGETGSNGLCLSKDGKLILAQHGDRRIAEMQAPLNAPKADFKTLAGTFNGKRFSSPNDVCADSKGNYYFTDPPYGLEKQENDPAKEQPKEGVYRINADGSVEQLIDSLTRPNGVIVSNDGSKLYVANSDPARAIWAVYDIDAAGKLSNGKILMDATAYVPKGKGLPDGLKMNKAGYIYATGPCGVWVFNPSGKHIATI

SEQ ID NO: 10382 - protein, 476 aa, Cytophaga hutchinsonii
MFSSLFKTKSIQSILKEEKGELKKTLTATSLVLLGIGAIIGAGIFSLTGIAAAENAGPAVTISFVVAGLGCAFAGLCYAEFASMLPIAGSAYTYSYATLGEFIAWIIGWDLVLEYAVGAATVAISWSRYLIKLLEKLGVDHIPYQWMMSPFETHRVNGTELHGIVNIPAIFITCLMSLVLIRGMKESAKLNNVIVALKITVVIAFIILGWSYMDPINHADYVPDNTGVFEHFGWTGVMTGAAVVFFSFIGFDAVSTAAQEAKNPQRDMPIGILGSLVICTILYVLFSYVMTGLENYQNFKGEAAPVALAIAATPYAFFQELIIIAILAGYTSVIMVLLMGQSRVFFSMSKDGLVPAIFSEVHPKYQTPWKSNILFAILVSLFAGLVPVSVVGEMTSIGTLFAFVLVCIGVLVLRKKQPDAPRAFRTPWVPFVPIMGIVVCLYLMYALPIDTWIRLIVWMAIGIAIYFLYSRHHSKI

SEQ ID NO: 10383 - protein, 583 aa, Cytophaga hutchinsonii
KGGEYIIREQEASSIFIPEQFDEEQKMMADMARDFLATEVHPILDRIDAQEPGLMEKLLEKAGELGLLATSIPEQYEGFGKDFNTSLLLTEIVGAGHSFAVALAAHTGIGTLPILYFGTEEQKKKYLPKLASGEWKASYCLTEPGSGSDALAAKTKAVLSADGSHYILNGQKMWITNAGFADTFIVFAQIDGDKFTGFIVEKGEGVTLGNEEHKMGIKGSSTRQVFFNDCKVPKENVLGEIGKGHLIAFNILNIGRIKLAAAALGGSTRVSTLSIQYAKERIQFKQPIANFGAIQYKLAEQAIKIYTVQSAMYRAGQGIQDAEEELVKQGKTYEEALLAAAQEYAIECAMLKVAGSETLDYVSDEGVQILGGYGFSADYPMDRSYRDSRINRIFEGTNEINRMLTMDMFLKKAMKGELDLMGPAMAVQKELMAIPDFGAEDEGLFADEKKAIKNMKKALLMLAGAAAQKYMDKLATEQEILMNLADIAIDIYVAESTLLRTEKLISIKGEDAVKGQIDMTKVNIFDAADRINIAGKNAINSMSDGDMQRMMLMGLKRFTKVAPLNTKDARRRIAAQLIEANQY

SEQ ID NO: 10384 - protein, 390 aa, Cytophaga hutchinsonii
QEVYIVAAYRSAVGKAPRGLFRFYRADDLGADVVKHLVASVPALDKDRIDDVIVGNATPEAEQGLNIGRMISLMGLNTVKVPGMTVNRYCSSGLETIAIADAKIRAGYADCIIAGGVETMSPIPFGGWKTVPNYELTKSHADYYWGMGLTAEAVAAQYNVSREDQDLFSYNSHQKAVAAIKNGHLQDGIVPITIKETYLDEKEKKKIKEYQVLVDEGPRADTSIAALAKLRPVFANGGSVTAGNSSQTSDGAAFVLLMSEKMVKELNLKPIARLVSYAVAGVEPRIMGIGPVEAIPKALKLADLKQDDINLIELNEAFAAQSLAVIRTLGLDESKINVNGGAIALGHPLGCTGAKLSVQIFNELKRTNQKYGMVTMCVGSGQGAAGIFEM

SEQ ID NO: 10385 - protein, 801 aa, Cytophaga hutchinsonii
MSHRKIRKVAVLGSGVMGSRIACHFANIGLEVLLLDIVPKEPNDAEKAKGLTLESKAVRNRIVNDALMASLKSNPAPLYDAAFASRITTGNFDDNMKDIASFDWIVEAVVENIDIKKKVYEQVESFRTPGTLITSNTSGIPMHLMSEARSEDFQKHFCGVHFFNPPRYMRLLEIIPGPKTSPEVIDFLMLYGDLYLGKTTVLCKDTPGFIANRIGIYGIMEALHTIIDLGLSVEEVDKLTGPVIGRPKSATFRTLDVVGIDTVIKVANGLLAGAPNDEAKDMFVLPEILKKIDENKWYGDKSQQGFYKKTKNDAGQTEILSLNLNSLLYGQQQKVKFAALEQTKAIEDLKPRFSVLIKSADKAGQFYRRTFLGLFKYVSNRIPEISDELYRIDDAMRTGFGWELGPFETWDAVGVAKAVKLMEEDGRKPAQWVYEMLEAGNTSFYKSENGKRLYYDIPSKSYKVIPGTESFIILDTLRANKPVFKNAGATLHDIGDGIVNLEFHTKMNTLGGEVVDAINRSIGIAEKDFQGIVIGNDGANFSAGANLALVLMYAIEQEYDEIDFMIRAFQNTMMRARYSSIPVVVAPHNLTLGGGCEMTLHADHVQAFAETYIGLVEFGVGLIPAGGGTKEFTLRVSDSFEDGDIQVNNLKNMYMHIATAKVATSAEEARSMGILRKSDGITLNRSRLIADAKAAAISLAEAGYTQPKQRKDIKVLGQSALGMFYAGANSMVSGKYMSEHDRKISEKLAYIMCGGDLSAPTLVSEQYLLDLEREAFLSLTGEKKTLERIQSILTSGRPLRN

SEQ ID NO: 10386 - protein, 582 aa, Cytophaga hutchinsonii
LFDLIPQQIAKYPKQDALATKENGTWISYSSVRVQEIIDKVSIGFIKSGLQKDDKVAIISPNRPEWNFIDLGLQQIGAVSVPIYPTLTVEDYRYIFDDAEVKMVFVYDEQLFAKATEAVNGSRTNPVIYTLQDVNGAKSWKDITALADGQPASMLDPYKANVFNDDLLTLIYTSGTTGKPKGVMLTHNNILSNVLAAIPLMPVNHNHKALSFLPLCHVYERMLCYLYLSQGVSIYYAESTDTVGENLKEVQPHMFVTVPRLLEKVYDKIVAKGAELTGIKKFLFYWALELGLKYDMQKNQGFFYNIQLKLANKIIFSKWREALGGNVITVVSGGAALQPRLARVFWAAQIPVMEGYGLTETSPVIAVNRFNPDETRISTVGPLLPGVEVKIAEDGEILTRGPHIMKGYYKRPDLTAEAIDSEGWFHTGDIGQFVENKYLKITDRKKEMFKTSGGKYIAPQLVENKFKESRYIEQIMVIGEGEKFPSAIVVPSFADVKSWCEIKGIPYTTNEEMVCNAQVIEKFQKEFDEMNENFAQYERVKKFILMPRPFTIESGEMTPTLKLKRKIIMQNCQGQIEKMYAR

SEQ ID NO: 10387 - protein, 670 aa, Cytophaga hutchinsonii
IAEKPSVAKDIAEVLGAKKRNDGYWEGNGYQVTWTFGHFCTLKEPHDYLDRWKMWRLEDLPMIPPSFGIKLIDNSGVKKQFNVIQKLVNACDEVINCGDAGQEGELIQRWVLLKAKCAVPVKRLWISSLTTEAIKEGFTKLKEADQYNNLYAAGSARAIGDWLLGMNATRLFTKKFGQGKIVLSIGRVQTPTLAMIVARQKEIDAFVSEEYWELKTTYRETEFTATIERLKSLDKANKGLEYLKGHPFVVTSFEIKEGKEGNPKLFDLTLLQVEANKKFGYSAEDTLKYVQTLYEKKFVTYPRVDTTYLSEDLYPKVKGILEDLTIYSHLTAPVLAKPIPKSKAVFDDKKVTDHHAIIPTGVTPSPNLQIEEKRIYDLIARRFIAVFYPECKVSNTTVLGTVGQVEFKATGKQIIEAGWKEVYANDKTEKKEEGDEEKVMPNFTVGETGPHEPKVHQGKTSPPKAYTEATLLRAMETAGKQVEDEEMRELLKDNGIGRPSTRANIIETLFRRKYIERKKKNIFATQTGMDLIDCIHSELLKSAELTGNWERKLRLMEKGEYQLETFKQELIDMVTEITKEVKSNSYKAIYIAPEKSKAPARSAPKEPATGSKEGKTKEAKEKKIKEEVSIETLKCPKCKEYLLKKGNTAYGCSNFQQCGFKIPFVMLGKK

SEQ ID NO: 10388 - protein, 445 aa, Cytophaga hutchinsonii
LVMPKMGESVMEGTILNWLKKPGDRIQQDESVLEVATDKVDTEVPSPFNGILKEIKANQGDVVQVGTAIALIETDVNQAANSEPATTAPAANTNSGTATTQTVQQTAVAEKIPVSTPQTHIPAHTAGAKGGRFYSPLVLNIARQENISLAEVETIAGTGKDGRVTKNDLFDYLQAKKEGKVTAVTQETVVNETPQATEQKAPVAEPVYVNKPASSQSGNVEIIQMDRMRKMIADRMVESKRISPHVTSFVEADVTNIVYWRNRWKNDFMERENVALTFTPIFIEAVVKAIKDYPMVNISIEDDKIIVKKDINIGIAVALPNGNLIVPVIKNADQLNIVGLTKKVNDLAKRARQNKLTADDLSGGTYTVSNVGSFGNLMGTPIIVQPQAAILALGAVVKKPAVIETPQGDTLGIRHMMFLSHSYDHRAIDGSLGGMFVRRVADFLE

SEQ ID NO: 10389 - protein, 714 aa, Cytophaga hutchinsonii
  unsure (1)..(714): unsure at all Xaa locations
TLPVQEIVPQVINHFQDNTTLIVKAPPGAGKSTLLPLTFLNESWLEGKKIIVLEPRRLAAKTIATRMSQLLGEQAGETVGYRIRFETKISDKTRIEVVTEGILTRMLQTDNTLKDVALVIFDEFHERSIHADVALALCREAQLTKRNDLRLLIMSATMDLPELSAKLKAKIIESEGRQYPVEIHYTGVTDMHLLPELTARVVSKASKDNKGDILVFLPGQAEINACRDLLDNKLSNTVVHTLYGQLPFAQQQAALLPDQTGKRKVVLATSIAETSLTIEGVTTVVDSGFGKRSKFDPQSGLSRLETVNISVDAADQRAGRAGRLSAGTCYRMWSKAQHETLQKHHQPEIEITDLSSLVLEMAVWGISNIYNMVWLTPPPQSHVKQAKETLHYIDALDRNKVTAHGKKIHQLPCNPRIAHMLLMAEKLEQEALATDIAAIIEEKDPLTIKEAGVDINERIKALRRFRRNDGKGRAFGLIERVARSYRDLMEIEVENEGFDSFMTGLLLAHAYPERVAFARPGNQSQFQLANGTYAQFSHKDSLSRESWVSVSHIDAREGTGKIFMASPLNPKDLKGMVKTAVSVHWDLISNDLIVHTELRIGKIVLKSFPMDDPTDEERSRALCDVVKKDGRELLHFTPEFEQWQAAMFRAQQQHPLAQFPDVDTESLLLTCDDWLTPFADEIEEKDDLKKLDLLQIISARIPKELLKLVDXDSP

SEQ ID NO: 10390 - protein, 579 aa, Cytophaga hutchinsonii
MEKKKNKVTLAQVFKTFIWPRRTILLIGLIMIIISRLASLVLPGASKYLLDDVVANKDIDMLYTLLWVVGLSIAVNAAMSFLLTKLLSVEAQLLISKLRVQVQRKILGLPISYFDNNKSGALVSRIMTDVEGVRNLIGTGLVQLIGGTITSVIALILLIKISPVMTVYVLLPVAIFAFIAMKAFGYIRPIFKERGIINADVTGRLTETLNGVRIIKGFNAEEQENKTFEAGVERLFDNVKKSLTSTSLITSASLFLLGMATLGIMGIGGYLMIKGEMTSGDFLSFTLYLGFMIAPIVQMSNIGSQLTEAFAGLDRTEEIMNMDPEEDTEKRKTVLKEIKGDVTFDGVSFAYQEGKEVLHDVSFDAPAGTVTALVGTSGSGKSTIAGLVATFLNPESGKITIDGVDLSEVTLSSYRKNLGVVLQDDFLFEGTIRENILFPRPNATEEQLLNAVKAGYVNEFTDRFEKGLDTLIGERGVKLSGGQRQRIAIARAILADPKIIILDEATSNLDTQSESLIQQSLAELMKGRTTFVIAHRLSTIRQANQILVIENGKIAEQGSHAELIAKEGRYYELHTYQAR

SEQ ID NO: 10391 - protein, 252 aa, Cytophaga hutchinsonii
MKIITYNVNGIRAAITKGLLTWVKATNADVLCFQEIKASVDQFDVESFKALGYTTYAFPAQKKGYSGVAICTKEIPVHVEYGCGIEKYDFEGRVIRADYPTFSVMNVYMPSGSSGDDRQAFKFGWMDDFLLYISEVRKKIPNLIVCGDYNICHKAIDIHNPKSNAKTSGFLPEEREWMSKFFDSGFVDAFRHFNEEPHHYTWWSYRAGSRGKNLGWRIDYHSVTQEMVGKLKRSVILPDAIHSDHCPVLLEI

SEQ ID NO: 10392 - protein, 337 aa, Cytophaga hutchinsonii
KKSKTAVFLINLGTPDSPNTPDVRKYLRQFLMDRRVIDIPWLNRWLLINMIIAPFRAPKSAHEYKKLWTEQGSPLMFHGVAVKELLQQALGDEYKVVLGMRYQNPSIESAAKELEAKGYNKVIVVPLFPQYASASTGSAVEEALRVLGKWEITPHIEVISKFFDHPLFIKAFAEIGRKYLAERNWDHIIFSYHGIPERQIKKASIGDQCKLGTCCQVYGSRNEYCYRAQCYETTRLLVKELGLAEGSYSVSFQSRLGKTPWIKPYTDHNIEELGKAGKKSILFFSPSFIADCLETTVEGGEEYKLLFEEHGGKDWQLVESLNTNPTWVECLKDMVVS

SEQ ID NO: 10393 - protein, 410 aa, Cytophaga hutchinsonii
LWHPYTPLLNTRPYAEVVSAKGMYLHLADGTSLIDAISSWWVNIHGHANEVLAETIKNQILQLDHTLFAGFTHKPAVDFATTFLRVLGCNQQRVIYSENGSTAVEVAMKLAVQYWKSKGRQKTTFLALEGAFHGDTFGAMSVSARGLFTEAFESLLNPVKFIPFPDGTNDAFVLESMEKHIRENAVAAFIYEPLIQGTGGMRTYTAEMLDKMITVCKQNDVLCIADEVMTGFGRTGNAFASQYCTTTPDIMCFSKAITGGLLPLGVTTCSREVEAPFLSGELRRAFFHGHSYTANPTICQLALASLKLFESETCQNNIKRIGAAHQAFVLTHVNHRHIKRIESLGTILSVEIKTGQQANYEHDIRHFLYDFFIKKGILLRPLGNIIYVFPPYIITDQELEKIYSAIVEML

SEQ ID NO: 10394 - protein, 372 aa, Cytophaga hutchinsonii
  unsure (1)..(372): unsure at all Xaa locations
IAQKLQARMAENALRRLTVREGLIDFFSNDYLGFARSKALHTAIQQKEETYQLSVCNGSTGSRLLSGNSALAEQVEKQLAVFFQVEKTLLFNAGYNANVGVLSAIPQKGDTILYDELIHASLKDGARLSFADRLSFKHNDLEDLQRKIKKAKGDLFIVVESIYSMDGDKAPLKEIAALAKQYGACFIVDEAHSTGTFGLQGRGLVYEENLQHEVDIRIHTFGKAMGIHGACVAGSAMLIDYLVNFSRAFIYTTAFAPHAFISVQCAFEMLEQTADVIPALNKNINHLASALRTHSCYIPSSSPIQVLNIGGNDVVKNLAATIQEKGFDVRPILSPTVKKGEERLRICVHAFNTQQEIAALVSCINSQLXKNI

SEQ ID NO: 10395 - protein, 523 aa, Cytophaga hutchinsonii
EQAAIFYQAEQSSEIHTISYGALKQKVIQYASGLSKNGFAAHDRIILYLPFSIDAIAFYLACIYMGAEPVLVSDSFSAQELTKRIAIIKAKAVLTTDQYWYADKKIAVLPKVLEANPCRIILYSEEQSDASTIRANKADLLLSDLLDVYGTSYPPYYHTTADTISILFSSGTTKEPKALPWKAATPIKCAVDGKLLQDIHAGDVVTWTSGMGWMMAPWLIFAALLNKASIAVYGGAYSKKEFLDFTVQTHVTVLGTIPSVVKSWRAQAFQPVANWKVRIFSSTGEPSDAEDYFYLMYLNNFNAPIIEYCGGTEIGGGYISNVVELPIALSSFNTPAPGSTFILLDENKHVVEQAGAGEVFLIPPAIGLSQEILNKSHAEEYYANLPVLPAYPLLRRHGDGFHKTTIEGTAYYRSMGRTDDSMNLGGIKVSAVEIETVVNTHPDIIESAAVALQSTGGGPERLVVFVHTTHETDNVQLQKELQKIIQAELNPLFKIYDLVFKENFPRTASNKLMRKELRKELAG

SEQ ID NO: 10396 - protein, 242 aa, Cytophaga hutchinsonii
ISIKGLYKSFGELHVLKGIDLEVHKGENVVVLGKSGTGKSVLIKILVGLLKPDAGVVQVLGKEVDKLNQKELDALRLHIGFAFQSSALYDSMDVRQNLEFPLLMNFKNLSKAEVKDSVEEVLDAVGLIDKLNQMPSDLSGGQRKRIGIARTLILKPKIMLYDEPTSGLDPITSFEINELINEVQEKYNTSSIIITHDLTCAKETCDRVAMLLDGTFVKTGTFEEVFEDQDERIQSFYNYNFI

SEQ ID NO: 10397 - protein, 332 aa, Cytophaga hutchinsonii
IKVGINGFGRIGRLVFRAAVNNPNIQIVGINDLIDVDYMAYMLKYDSTHGRFSGTVDVTDGKLVVNGNAIRVTAERDPANLKWNEVGAEYVVESTGLFLTMDTADKHIAAGAKRVVLSAPAKDDTPTFVMGVNNKSYTKDMTIVSNASCTTNCLAPVAKVLNDNFGILEGLMTTVHAATATQKTVDGPSAKDWRGGRGAYQNIIPSSTGAAKAVGLVIPQLKGKLTGMSFRVPTPDVSVVDLTCRLEKAASYETIKAAMKAASEGDMKGILGYTEDEVVSTDFLGDARTSIFDAKAGISLNDNFVKVVSWYDNEWGYSNKLVDLIVHMDTVK

SEQ ID NO: 10398 - protein, 771 aa, Cytophaga hutchinsonii
MDKEEFPSVLPILPVRNIVLFPGVVLPITVGRQKSIRLVKKFYKGDRTIGVVAQENQKSEEPSFQDIFKVGTVAKILRMFVLPDGNTTIIIQGKRRFKIEEQVQDEPFMQAKVSMLKDIHPDMSKKEVKALLQSVKESATKILKMNPEIPQDAQIAINNIESENFLTHFLSSNINAELKDKQKLLEFDDAVERATWLLQLMDKDIQMLEIKREIHTKVHTDIDQQQRDYFLRQQIKVLQDELGDFSSEQEFERLKEKALTKKWSDKVRAHFDKEMSKLQRVNPMAPDYPVTFNYLELLVDLPWGENSTDNFDLVRAKEILDEDHFGLTKVKQRILEYLAVLKLKNNMKAPILCLYGPPGVGKTSLGKSIAKALDRKYIRMSLGGVHDESEIRGHRKTYIGAMPGKIIQGIKRSETSNPVFILDEIDKISKDFRGDPSSALLEVLDPEQNSSFMDNFLEVEYDLSKVLFIATSNALDTIQPALRDRMEIIEINGYTLEEKIQIAKKYLIPKQKEEHGLKAKDISFTDAAIVKIIEDYTRESGVRNLERKIGAVVRNIAVAIAMETAYTKKIQPAQVREILGSEDFEKDTYQQDDLAGIVTGLAWTPYGGEILTIESIISKGKGKLTLSGQLGDVMKESASAALSLLRANVDAIGIDHRVFDHFDLHVHVPAGATPKDGPSAGIALYTSLASTFTQRKIKPALAMTGEITLRGKVLPVGGIKEKILAAKRAGIKEIILSKKNKKDIEEIHPPDIADLKFHFVETADEVLAIAL

SEQ ID NO: 10399 - protein, 253 aa, Cytophaga hutchinsonii
LKGKRGIIFGALDENSIAWKVAQRAHEEGAVFTLTNAPIAMRMGEINKLAEACGAVVIPADATSIEELENLFDKSMEILGGKIDFILHSIGMSPNIRKGKEYGDMNYDWFLKTLDVSALSFHKIMHVAEKKDAMNEYGSILALSYIAAQRVFPDYTDMADAKSTLESIARGYGARFAKLKKVRVNTISQSPTKTTAGKGISGFGAFYDFADLMSPLGNASADECAGYSIVLFSDLTRKVTMQNLMHDGGFSST

SEQ ID NO: 10400 - protein, 549 aa, Cytophaga hutchinsonii
MLQNLVIQNYSLIEDLELAPSANFNIITGETGAGKSIMLGAVGLLLGNRADTKVLLHTDRKCIIEGTFQIGSYKLETLFEEYDLDYTNQCIIRREISSNGKSRAFINDTPVTLDALKKLGDYLMDVHSQHDTLLLGSVAYQLSLLDGFASNQSALKDYQQAFKKYKDLQHRFQLKKNELQELQQQADYNQFIYTELAEAALIEGEMEAKEAELKKIEHAEDIKQKLEATLDALSNSEQSILSTLQNYNKQLQSIKQWSIAYETLANRLQSVFVELKDIEAELEAESAQVEFNPKLIPPIEERLNSIYSLLKKHRVQTVSELLILEKTLEGKVVSLDQLNEEVLQLEKEVKHTYDVVLSKAKVVSENRIKAVPKFEQSVKALLKELSMPDAHIQLVLSADAPTMYGIDKINMLFSANKGVAPNELKQVASGGEFSRLMLAIKYVLADKVALPTIIFDEIDTGISGEVSIKMGKMIREMSARHQVVVITHLPQIASMGDKHYFVFKDASGERSVSKMKELLAKERVTEIAKMIGGEKPSETALKNAMEMLE

SEQ ID NO: 10401 - protein, 304 aa, Cytophaga hutchinsonii
KVTVVGAGNVGATCADVLAYREIVNEVILLDIKEGVAEGKALDIWQKAPITQYDTKTTGVTNDYSKTANSDVVVITSGLPRKPGMTRDDLISTNAGIVRAVTESVVKYSPNAIIIVVSNPLDVMTYCAHITSKLPRNKVIGMAGVLDTARYRAFLADEIGCSPKEIQGMLLGGHGDTMVPLPRYTTVGGIPVTELVEADKLNAIIERTKNGGGELVKLMGTSAWYAPGAAAAQMVEAIVKDQKKIIPVCIKLEGEYGIDDCYLGVPAVIGKNGIEKVIELKLNAEEKALMETSRKHVKEVMNVL

SEQ ID NO: 10402 - protein, 769 aa, Cytophaga hutchinsonii
AHNLGYPRIGDNRELKKACEQYWSGAITQQKLQDVAKAIRTNNWLTQKDAGLDLIPCNDFSFYDQVLDMSFMLGLIPERFSSLLQKKDLTELDIYFAMARGYQKDGYDITAMEMTKWFDTNYHYIVPEFRKDQKFSPISEKAIREYTEAKVVIGKAAKPVLLGPVSYLLAGKEKEAGFNRIELIENLLPVYTKLLATLQQNGAEWIQLDEPFLVMDLTVQERKTYETTYTALRNLFPSLKFIVATYFECTGTNIDIAAKLPVDALHLDLVRCPSQLSDILTPAFISSNTMLSLGVVDGRNVWKNDFSTSSTFITKAIAALGKERVMIAPSCSLLHVPCDLDNEKNGNVLTPEIKNWMAFAKQKLHEVAALKKLNRAPMQSEELRLLKANTESIENRAKSKLIHKQHVKARVKAVQPSDSQRKSLFKSRQQIQEKALQLPLMPTTTIGSFPQTDEVRANRAKYKKGDITLAQYEDFVKTEMTKAIEWQEKIGIDVLVHGEFERNDMVEYFGEQLKGYVFSENGWVQSYGSRCVKPPIIYGDIERTEPMTVAWTTLAQSLTKKYMKGMLTGPVTILQWSFVRDDQPRRDTCMQIAFAIRDEVVDLEAAGIKIIQIDEPAIREGLPLRRENWETYLNWAVECFRISASGVKDETQIHTHMCYSEFNDIIKNIAAMDADVITIETSRSQMELLDAFVDFNYPNEIGPGVYDIHSPRIPTTDEMADLLNKAMHVLPVRNIWVNPDCGLKTRRWPETEAALINMVAAAQKIRKEI

SEQ ID NO: 10403 - protein, 207 aa, Cytophaga hutchinsonii
VTMKLKVCGMKYPDNVSAATALAPDYMGFIFYKPSKRYCGETLTPAFVKGLPASIITTGVFVNESLEKVLRICASYGFKAVQLHGHETPDFCLSCKEAGLEVIKVFHVGEEMDWSILEPYKKATDYFLFDTKTPEYGGSGNRFNWELLKQYDNEIPLFLSGGVDETILEELDILKNVNIYALDINSRFESEPGLKDVARIKKFKSAL

SEQ ID NO: 10404 - protein, 409 aa, Cytophaga hutchinsonii
LLPCMQVTNRTYEFQGVSLTELATEYGTPLYVYNSEKILSQYKRLHDAFSGVNVRIKYAAKALTNQAILKLLKGAGAGVDVVSIQELQLALKAGFDKKDIMFTPNCVDFSEIEEAVGYGVQINIDNIPFLKQFGQVYGSSVPCCVRINPHIDAGGNVKIMTGHKGSKFGISIEQVNEIYEVVDEYEILVNGVHVHSGSDFKSADAFVRAAEVVYSVAMQFDKLTFLDFGSGFKVSYKEGDYVTDIEELGKKMTDSFNAFCLNYGKKLDIWFEPGKFLVSESGMLLVTCTVIKETPACNFIGVNSGLNHLIRPMMYGSHHDIVNVSNPDGDKKMYTVVGYICETDTFGSDLFIEETKAGDIIGLKNAGAYGFSMSSNYNSRFRPAEVLVHKGKHQLIRKRETMEDLLKNQ

SEQ ID NO: 10405 - protein, 456 aa, Cytophaga hutchinsonii
YDVVVIGSGPGGYVAAIRCAQLGMKTALIEKYSTLGGTCLNVGCIPSKALLDSSEHYYNATHTFKEHGIDVKDVKVNLKQMIDRKAGVVKQTCDGINYLMKKNKVDVHTGIGSFVDKNTIKVTAADGSVKELKTAKTIIATGSKPTSLPNVAIDKKRIITSTEALELTEVPKHLIVIGGGVIGMELGSVYARLGAKVSVVEFMDTLIPTMDKALGKELIKVSKNHLGFDFYFSHKVTGATAKGKEVTVTAEDKDGKVLELKGDYVLVATGRRPYTEGLGLEAAGVKLDERGRVAVDGHLQTNVPGIYAIGDVVVGAMLAHKAEEEGVFVAESIAGQKPHINYNLIPGVVYTWPEVAAVGYTEEQLKKDGKAYKVGNFPFKASGRARASMDLDGFVKVLADKETDEILGVHMIGPRVADMIAEAVVAMEFRASAEDISRMSHAHPTFTESFKEACLA

SEQ ID NO: 10406 - protein, 402 aa, Cytophaga hutchinsonii
VEVKIPTVGESITEVTLGAWSVKSGDAVKAGDLLLEIESDKATFELHAETTGTIEILSKSGDTVAIGTVVCKIVPGAGGASQAAAPASAPAATAAASSGGANYAGGHASPAAGKILNEKGVDASAVAGSGKDGRITKEDALKASAAPAAAAKPAAAASTAAPAAKASAAGRADDRVKMTSLRKTIARRLVAVKNETAMLTTFNEVDMKPVMDMRSKYKDTFKEKYGIGLGFMSFFTKAVCMALQEFPAVNAYIDGDEIVYHNFCDVSVAVSTPKGLVVPVIRNAETMSFNEIEAEIVRLATRARDGKLSIDEMSGGTFTITNGGIFGSMLSTPIINSPQSAILGMHNIVERPVAVGGQVVIRPIMYLALSYDHRIIDGRESVGFLVRVKQLLEDPSRLLLGV

SEQ ID NO: 10407 - protein, 922 aa, Cytophaga hutchinsonii
SYVSNAEISYVDEMYQSYRKDPSSVDETWQKFFEGYNFSLQKYGEKGATNGGSAEAPSGNGVAAVASSPATTVSEKEVRVHYLIHAYRSRGHLRSKTNPVRERKDRKPLLELTDFGLTDADLDVVFEAGNEIGIGAASLRKIVETLKFIYEGAIGFEYMYIRKPEKLAWLRNKIEKESLAHNLTLDEKKRILSKLNEAVVFENFLHTKYVGQKRFSLEGGETTIPALDKMITASAELGVEEVVIGMAHRGRLNVLANIMGKTYEQIFNEFEGNIKPDMTMGDGDVKYHMGYSSEVVTPKGQKINLKLMPNPSHLEAVDPVVLGFVRAKGDRLYGYDYKKVLPVLIHGDAAVAAQGIVYEIVQMSKLAGYQTGGTIHFVINNQVGFTTDFEDARSSIYCTDVAKIVDAPVMHVNGDDPEAVTFCMRLAAEYRQKFNEDIFIDMVCYRRHGHNESDEPKFTQPKLYNVISRHANPRELYNQKLIERGDVDAEIAKNMDREFRDMLQDRLNQVKQKPLPYSLQKMEKEWTELRKATKEDFDQSPDTSITQEVIDKVGKAITDIPADFKPLKQIEKLLKDRKEQFQDTKIVNWATAELLAYGSLLLEKKIVRFSGQDVQRGTFSHRHAVLKDAETNEPYYSLNHISDNQKRFRIYNSLLSEYGVLGFEYGYAMANPSALVIWEAQFGDFANGTQVMIDQFVTSGETKWQRQNGLVMQLPHGYEGQGPEHSSARLERFLGLCANNNIIVTNITTPANMFHALRRQLKWEFRKPLINMAPKSLLRHPLVVSDLKEFTSGRFQEVIDDANVDAKKVKRVLFCTGKVYYDLFEEQKNAKRNDVAIVRIEQLYPYPEKQMAAVFEKYKGAEYVWVQEEPYNMGAWGYILRRMYLMNNTGIEVIARDEASSPAVGYLKAHNEKQAELVKRAF

SEQ ID NO: 10408 - protein, 501 aa, Cytophaga hutchinsonii
VRVRFAPSPTGPLHIGGVRTALYNYLFARKMGGKMLLRIEDTDQNRFVPGAEAYIQEALAWVGIVIDEGAGVGGPHAPYKQSERKPMYREYAEKLIAEGNAYYAFDTSEELEAMKERLKAAKVASPSYNMVTRMQMNNSLTLPEDEVKRRLDAGDEYVIRLKVPRKEEIRLNDMIRGWVVVHSSTIDDKVLLKSDGMPTYHLANIVDDHLMEITHVIRGEEWLPSAPLHVLLYRFLGWEDTMPQFAHLPLLLKPDGNGKLSKRDADAGGFPIFPLDWKDPASGDTWIGFKQQGYLQEATTNFLAFLGWNPGTQQELFTMDELIEAFTVERIGKSGTKFDINKAKWYNQQYMRQLPDETLTRLLKEEADKHQAKYDAAKLPLIAQMLKERLTFAKDYWIEGQFFFEAPETFDEKVASTKWNAEAVTVISAYKEALAAYTGEFNAENVKHVLHEVLEKADVKIGKIMQALRLALTGAGAGPDLMQFIEIVGKEEAIKRMQFAL

SEQ ID NO: 10409 - protein, 285 aa, Cytophaga hutchinsonii
KGILLAGGTGSRLHPLTLAMSKQMMPIYDKPMIYYPLSCLMLAGIREILIISTPQDLPNFQKLLGDGSALGCRFEYAVQPSPDGLAQAFVIGEQFIGNDKVALILGDNIFYGSGLGRLLHSHNDPDGAVIFAYHVTDPERYGVVDFDDDMNALSIEEKPIKPKSNYAVPGVYFYDNSVIDIAKNLKPSSRGELEITDVNKIYLEKNKLKVAVLNRGTAWLDTGTFASLMQAGEFVRVIEERQGLKVGCIEEIAYTMKFITKEQLEALAKPLMKSGYGQYLLGLIK

SEQ ID NO: 10410 - protein, 408 aa, Cytophaga hutchinsonii
NQTLAVIGLGYVGLPIALAFAKKVKVIGFDINSKRIDIMKKNIDPSGELRESDFLNSDIFFTAELSDLKKASFYIVTVPTPIDEFNHPDLAPLVSATRTIAKVLKQGDYVVYESTVYPGCTEEECIPLLEELSGLVCGKDFKVGYSPERINPGDKEHTLAKITKVVAGCDAESLDIIAQTYEIVVDAGIHKASSIKVAEAAKIIENTQRDVNIALMNELSVICDKLNINTLEVLEAASTKWNFLPFTPGLVGGHCIGVDPYYLTYKARKLGLNPNVILSGRLINDQMPMNIAKKIVKSLIKSGTDISKGRVLVLGVTFKENVEDIRNSKVAELIKELQSYSLQVDAVDPYASFQEFKHEYNLDFSTEITGTYDVVILAVSHKEYQKLNIEYFENLLTEKGIFVDIKGL

SEQ ID NO: 10411 - protein, 436 aa, Cytophaga hutchinsonii
MKIVIVGTGYVGLVTGTCFAEVGIEVVCVDIDQKKIDNLKNGILPIYEPGLEEMVERNVKKGRLKFSTDLSQSIVDAEVAFIAVGTPPGEDGSADLKYVLAVATAIGQSMKNDIVVVTKSTVPVGTSLKVKKALQEELGKRNASLTAYVSSNPEFLKEGAAIDDFMKPDRIVVGIDAPQAEETMRKLYKPFLLNGHPIFFMDIPSAEMTKYAANSMLATKISFMNDIANLCEIVGADVNLVRKGIGSDARIGNKFIYPGVGYGGSCFPKDVKALIKTAKQNGYDMRVLSAVEDVNDDQKYVLVKKVNKYFNNDLKGKKFGVWGLSFKPKTDDMREAPSLVIIPELLKAGASVIAYDPVAMHEASHTLKDTITYAQDPLEVLEGIDGLLIVTEWSEFRSPDFDVVKSKMKGKAIFDGRNIYDPKEMKTLGFDYYCIG

SEQ ID NO: 10412 - protein, 379 aa, Cytophaga hutchinsonii
MNLEPTENQRLIASMAKDVAEKYIRPNIMKWDEVQEFPVDLFHKMGEFGLLGVLVPEQYGGAGMGYFEYITALEEISKVCGSIGLSMAAHNSLCTGHILAFGNEEQKAKYLPLLATGKWIGAWALTEANTGSDSGNMKTVARQDGDYWILNGSKNFITHAKSSNVVVVLARHADSEDKKFSSAFIIEKGTEGLTHGRKENKMGMRASETCELLLDNVRVHKSQLLGNIGDGFKQAMKVLDGGRISIAALSLGIAQGAYEAALQYSKERQQFNQPIGNFQGISFKLVDMATEIEAARLLTYKAADMKMKGQPMTREAAMAKLYASEVSVRVANEAVQIFGGYGYTKDYPVEKFYRDAKLCTIGEGTSEIQKIVIAKSLQK

SEQ ID NO: 10413 - protein, 418 aa, Cytophaga hutchinsonii
MPYLFTSESVSEGHPDKVADQISDALIDHFLAFDPNAKVACETLVTTGQVVLAGEVKSKAYLDVQEIAREVIRKIGYTKSEYMFEANSCGIFSAIHEQSADINQGVDRKKKEEQGAGDQGMMFGYATNETNDYMPLALDLAHKLLIELAALRREGKQIKYLRPDAKSQVTLEYDDNNRPVRIDAIVLSTQHDDFDTEEKMHKKIEKDIVSILIPRIVSKYPKYKKFFDGKTKIKYHINPTGKFVIGGPHGDTGLTGRKIIVDTYGGKGAHGGGAFSGKDPSKVDRSAAYATRHIAKNLVAAGLCDEVLVQVSYAIGVAKPMGIYVNTYGTAKVKKNDGEIAKIVEKLFDMRPYAIEQRLQLRNPIYSETAAYGHMGRKPETVTKSFKSNDGKIIKKKVELFTWEKLDYVDKVRKAFGI

SEQ ID NO: 10414 - protein, 807 aa, Cytophaga hutchinsonii
  unsure (1)..(807): unsure at all Xaa locations
QPVKKETPKAETQKPPVADKPAEKTPVVEEPAAPVADVPVQVVQAHADKLQGLTVLGKIQLPDKKKEPTRVASSDEVVDKNKNKRKAQTSXRRTQXTCRSXSERTKTSWQQSKRAKTARYXSERTETTGPGWXSERAKTSRRTKSSGCSEPSXQQRTKTYVNKSKRKRXSNRKTDSDKIKATMAKLSGGGTKSGPVNRAKYRKDKRSAMADAEEERLMAEQEDAKSLKVAEFISASDLASLMDVSINEVISKCMAMGMFVSINQRLDAEAITIIADEFGYDVNFQTTGEEDDVTDVDQDDPASLIDRAPIVTIMGHVDHGKTSLLDYIRKSKVVAGEAGGITQHIGAYNVMTDSGKPITFLDTPGHEAFTAMRARGAKITDIVIIVVAADDSVMPQTKEAINHARVAGVPIIIAINKIDKPAANPDKIKEELSKENILVEDWGGKYQCQAISAKAGTGISELLDKVLLEAEMLELKANPDKRAIGAVIEASLDKGRGYVTNVLVEAGTLRIGDIILAGAHFGRVKAMVDHTGKKLKEAGPAMPLQVLGLNGAPQAGDKFQVMETEREAREISSKREQLLREQSIRTKKHITLDEIGRRLAIGNFKELNIIVKADVDGSVEALSDSLLKLSTEEIQIRILHKGVGQISESDILLASASDAIIVAFQVRPSTSARKLAEQEQIEIRMYSIIYDAINEVKDAMEGMLEPKMEEVVLGTIDVRDVFKITKVGTVAGAYVSEGIVKRNNQVRLIRDGIVMFTGTISALKRFKDDVSEVKTSYECGISLKGYNDIQIGDQIEAFEQKEVKRTL

SEQ ID NO: 10415 - protein, 245 aa, Cytophaga hutchinsonii
IESKVVVLVRTTHSIAKAAAEKFCDQGFRVVLWEDNKTKVDESIIASCNLRKGSCVVESFDFSIQDNFEKAAVHVIKKYGRIDVLVNNPKLAPVSKVPNLSTEAWHETIDANLSVFLNSISVIAPFMQQQKIGSIINCCLPLRIHDSLTDRHYDGIREGVKGITQLWARELGQSGITVNTIIPGYIEEDNLPLADSAELTQFRLKIPVRRFAKALDVVNAYSFLITDDASYITGTELVIDGGVRI

SEQ ID NO: 10416 - protein, 419 aa, Cytophaga hutchinsonii
NFKSISLTYRKAPLEIRERVALNEAECKSLMLRIKDFTDTAELLILSTCNRTEIYYTSNEDYSNDIIKLLGVEKNITGLIQQKEYFEIYNEQADAVLHLFEVGIGLDSQVVGDMQIVNQVKYAYQWSADLNLAGPFLHRLMHTIFFTNKRVVQETAFRDGAASVSYATVELSEELLSATPNANILIVGLGEIGADVCRNFKANTSFKNITLTNRSPLKSEALAAECGIEHVPFETLWEAVAKADLVISSVAKEEPLFTKEEIQKLSILSHKYFIDLSVPRSVDARAEELPGIIVYDIDHIQNRSNEALENRLNAIPHVRKIILDSIVEFNEWSKEMEVSPTINKLKNALEQIRKEELSRFVKQLSDEEAKKVDEITKSIMQKIIKLPVLQLKAACKRGEAETLIDVLNDLFNLDKQPEQ

SEQ ID NO: 10417 - protein, 495 aa, Cytophaga hutchinsonii
GKITQIIGPVVDVGFEGEYALPQILDALEVTRPDGQKVILECQQHLGEDRVRTIAMDSTDGLTRGMEVKTYGMPISMPVGEDIRGRLYNVVGDAIDGIPSGVAANRMSIHRQAPKFEDLSTNTEVLFTGIKVIDLLEPYVKGGKIGLFGGAGVGKTVLIMELINNIAKAYAGLSVFAGVGERTREGNDLLREMIESNVIRYGDEFKHSMEKGEWDLSKVDATELLKSQATLVFGQMNEPPGARARVALAGLTVAEYFRDGDGQGQGRDILFFIDNIFRFTQAGSEVSALLGRMPSAVGYQPTLATEMGAMQERITSTKRGSITSVQAVYVPADDLTDPAPATTFAHLDATTVLNRKISELGIYPAVDPLDSTSRILSPEILGSEHYDCAQRVKEILQRYKELQDIIAILGMDELSEEDKQAVHRARRVQRFLSQPFHVAEQFTGLKGELVNIKDTIKGFNMIMDGALDHLPEAAFNLVGSIEQAIAKGEKLVADS

SEQ ID NO: 10418 - protein, 369 aa, Cytophaga hutchinsonii
IKPLGTIFIKLLQMLAIPLIITSIISGIAGLRDINKLGRIGGRTLVLFTITCFTSTILGVILASAFTPGNAIPEKTKSELFASYQDKTTGLIDKAQQGTGSAMDMITEMFPNNIFYAMSNNGMMLQVVIFSILFGIALSKVDVSKSEIVIQFVEGLNETFMKLVMLIMGIAPVGVFALIASISFDAKVFLSLLYYMLTVIAGLAVILFILYPLIIRLFSKISYGKFFKTMQPVFLMAFSTSSSAATLPVTMERVSNGFSIKKEISDFVLSLGTTINMDGTALYQSIAAVFIAQATGIDLTLGQMVIIALTATLSAVGAAGIPGAGMITLIIVLDAIHVPIEAIAFIMAPDRLLDMFRTVINVAGDACGA

SEQ ID NO: 10419 - protein, 356 aa, Cytophaga hutchinsonii
MSNTYGTIFRITTFGESHGNAVGVIVDGCPPNIEIDEAFIQSEMARRKPGQSKIVTQRQEDDEIEILSGVFEGKSTGTPIAMMVRNADQRSKDYSHIADRFRPSHADYTYQEKYGFRDYRGGGRSSARETLARVAAGALAKMILAKVNIKIQAYVSQVGPLKLTTDYKALNIPNAETNIIRCPDDAVAAKMIEFIDETRKNKDTIGGVVSCVIEGVPVGLGEPVFDKLHAELGKAMLSINAVKGFEYGSGFEGVEQFGSQHNDKFYADEQGNVRTQTNNSGGIQGGISNGEDIYFRVAFKPVATIMIDQESINDKGETVTVSGKGRHDPCVVPRAVPIVEAMAAIVMVDFYLRNKA

SEQ ID NO: 10420 - protein, 393 aa, Cytophaga hutchinsonii
RIVVTGIGIISAIGDSLESNRSSLQKKVCGISTVELFQTRYAAILPFGEIKYTNESLKQQLNVNTLNVTRTSLLAQHAFEQAIRDSALTAAEVSSFDTAFINATTVGGMCLTDELYRDANNQSDHSPYVTSYDLASVAIYLQELHNIQGICNTINTACSSSANAIMYGARLIKQGKAKRAIVGGTDSLAKFTINGFNALHILSPEKCKPFDQNRSGLNLGEAAAFLVLETEENCKGKKAYAVLSGYANANDAYHASALSDTGDGPYEAMKQALNVANLKASDISFVNAHGTGTENNDKAESFAMQRIFHTPPPFASSKSNTGHTLGAAAAIEAVYSILSITHQELYPEINFEVPIEETGLIPLQTFRQAPVKHVMSNSFGFAGNCSSLIFSSL

SEQ ID NO: 10421 - protein, 218 aa, Cytophaga hutchinsonii
NLTVFEGERFGLFGPNGAGKSTLISLMTGLLKPVSGVVTLFNEDIHAKCTRKLFGFVPQDFSLYDELSPIENLQFFGAWAGLSKKEITNRTTELLDILGLTDVKHKAVKTFSGGMKRRVNLAIGVIHQPRILFLDEPTVGVDIQTRHAIIEYLKQLNKAGMTLVYTSHQLAEAESLCNRIALIDNGQLIACNDIPDLLASHHEEDLESLFLHLTGKAF

SEQ ID NO: 10422 - protein, 707 aa, Cytophaga hutchinsonii
  unsure (1)..(707): unsure at all Xaa locations
PSYIXERKEXKMNDEKRLIIVAYRIPFKVTFKESGERVLQQNSGGLVSAILSLAEKGDVFGKNQKIHWFGYSTPDILQEGETQVENENFIVHPVLIEDALNDAYYEGFCNSTIWPISHYYPYLTSFNEEDYEAYVKANKIFADQINAFIRPGDMVWIQDYQLMLLPGMLRSENPDASIGYFHHIPFATFEIFRLLPKQWQTELLKGMIGADLVGFHTNDYSQYFLRSVQRVLGYDTTARDISIPNRIVRVDTFPISIDYNKFQELYNDPGVIEKRKEFLKDLSAEKNIFSVDRLDYSKGLIHRLNGFEYFLDQYPQWHTRVVLTMIVVPSRETILKYAEMKHELEEAVGRINGKYGTLGWRPVIYLYRSLSFEELGALYTLADVALITPIRDGMNLVAKEFVATRTDKKGVLILSEMAGASLELNGAILINPTDKRTLAAAIIQALTMDEQEQTQRMQMMQDRIRVYDIFKWTEDYMDQLDIIKLKQMEFEEKIINQDVLKSFKQIFDESSRRLFLLDYDGTLSPIVPDPSSSKPSVGIVDVLKKLSSDFNVNVAIISGRDKEFLNYIFDPNTILSAEHGAFLRIPGQDWELQYDYNDQWKRSVLPVFQKYTDRCAGSFIENKSTSLAWHYRNTEKEYAHIRSREFIEELENKVGIKSNLAIIDGDKVIEMKPSDVDKGIAARKICDLYQPDFILSIGDDRTDEDMF

SEQ ID NO: 10423 - protein, 568 aa, Cytophaga hutchinsonii
ILSRLFQFVKPYKNLFYTQVALTLTGAVLASVKPYLVKVAIDDKIASHDLNGLYVMIGLMVVVLVAQAFMQYFDTYLAGKLGQTIIRDIRIRLFKHLLKFRLGFFDKTPIGRLVTRNISDIETLSNFTSDGLAGILGDFLQLIFIFGFMLYIDWRLTLICLCPLPILLFSTYVFKERIKHSFNEVRIAVSNLNTFVQEHITGMSIVQIFNSEQREYAKFKKINIEHRDSNLKSVNAYSVYFPIAEFIGSLGLVLLIWFGSTLVLGETSSFGTLVSFIMYISMFFRPIRMIADRFNTLQLSVVSSDRILKLLDDHTPIQSTGEKPLPEIKGDVQFNNVFFSYIEGQTVLKDINFHVPQGGSIAFVGSTGAGKSSIINLLNRFYDIEKGHILIDGTDIRDYNLHELRLQIGLVLQDVFLFSGSIRNNITLYNPDITDEKIWEAIRMVGAERFIERLPGGLDYEVMERGSTLSSGQRQIISFIRVMVYDPKILILDEATSSIDSETEELIQEATAKIMLGRTSIIIAHRLSTIQHVDTIFVLEKGEIVESGSHEVLLGQQGLYSQLSALQY

SEQ ID NO: 10424 - protein, 425 aa, Cytophaga hutchinsonii
DALNAAIGAYKNGTGEWPTMSVEGRIRAMEKFVKAMKSKRTEVVKTLMWEIGKNIKDSEKEFDRTVEYILDTIEAYKKLDRTSSNFQFEQGIIGKIRRSPLGVVLCMGPYNYPLNETFTTLIPALIMGNTVIFKPAKIGVLLHRPLLEAFRDSFPKGVINVVFGRGRATVGPLMTTGKIDVLAFIGTSKSANIMKMQHPRPNRLRSVLALEAKNPAIVLNHADLDLAVKECALGSLSYNGQRCTALKIIFVQKNVVDTFINKFLKEVEGLKWGMPWENGAQITPLPEPEKPGLLKELIEDAEVHGAKVINAGGGTIEHTFYAPAVVYPVNNKMKLYYEEQFGPVVPIVAYDKIEEVIQYMVESNYGQQASIFGTDNDEMATLIDNLVNQVCRLNINSQCQRGPDVYPFTGRKDSGEGTLSVSDAL

SEQ ID NO: 10425 - protein, 254 aa, Cytophaga hutchinsonii
LGGAATYIGLSSSYFNPKINLVGVVGSDFPESDIKMLQSHSINTEGLQIKENEKTFFWSGRYHNDMNTRDTLVTELNVLGTFDPIIPASYQDCEFLMLGNLAPAVQRSVIERLKNRPKLIVMDTMNFWMDIAMDDLKQTLALIDVLSINDEEARQLSGEYSLVKAARKIIAMGPKVLIIKKGEHGALLFNQDQVFFAPALPLEDVFDPTGAGDTFAGGFIGYIASTKDTSFENMKRAIIYGSAMASFCVEKFGT

SEQ ID NO: 10426 - protein, 423 aa, Cytophaga hutchinsonii
FETLQLHAGQEVDPTTQSRAVPIYQTTSYVFKDSNHGANLFALKEFGNIYTRIMNPTTDVFEKRIAALEGGVAALATSSGQSAQFIALTNILQAGDNFVTTSFLYGGTYNQFKVSFKRLGIEARFAEGDQVASFEKLIDAKTKALYVETIGNPEFNIPDFEAFAALAKKHDLPLIVDNTFGAGGYLFRPLEHGANVVVESATKWIGGHGTSVGGVIVDGGNYNWGNGKFPQFSEPSEGYHGLVFWDVFGTNGPFGNIAFIIRARVEGLRDFGPSQSPFNSFLLLQGLETLSLRVDRHVQNAQKLAEWLEQHADVATVNYPGLQSSKYHNLAKKYLKRGFGGVLSFEIKGGKSRAAQFINSLKLASHLANVGDAKTLIIHPASTTHQQLSDEEQKVAGVSAGLLRVSVGIEHIDDIIADFEQAF

SEQ ID NO: 10427 - protein, 331 aa, Cytophaga hutchinsonii
MKVAINGFGRIGRISYRALLKKKNIEVVAINDLTDTKTLAHLFKFDSSHGVFDGEVSYDAENLIINGKKVKVLSVKNPADLPWKALGVDVVLESTGFFTEKEKAEAHITAGAKKVIISAPATGDLKTIVLGVNDNILDGSETVISNASCTTNCLAPMVKVLEDNFGIESGFMNTIHAYTSDQRLQDAPHKDLRRARSAALSIIPTSTGAAKALGLVIPSVQGKLNGTSLRVPVPVGSITDFTATLKRTVTKDEINAAFKKAAEEGSLKGYLAYSEDPLVSVDIVGNPASSIFDSELTMVQGNNVKVFGWYDNEFGYSNRTADLIELVGKQI

SEQ ID NO: 10428 - protein, 512 aa, Cytophaga hutchinsonii
KIKGFRDNTIDSEKFRSFRLTRGVYGQRQEGVQMIRIKLPYGKVTTDQIIRIADISDKYGSSNLHLTTRQDIQLHYVKLENAPLVWNELEEVGVTLREACGNAVRNITASYTAGVDPNEPFDVSPYAHSMFEYFLRNPICQDMGRKFKISFSTSEADTAFGFIHDLGFIPRVKTVNGKEVRGFKVLLAGGLGAQPFVAHNVHEFLEEDQLIPFSTAVIRVFDRFGERSKRHKARLKYLVNGIGVEAFMEHVAKERIAIKDKSVVIDRNRVDEIILPAVTSFTEATPVDAVKFERFVKANVFEQKQKGYFGVQLKQHLGDLKSDKARVFAAIVKKYASDDVRITVNQGWLLKFVKKEALPALFNELNEIGLAEPGFDSMADITACPGTDTCNLGISSSTGLSVEIEKMLLEEFPDTVFNKNIKIKISGCMNACGQHTIGNIGFHGMSIKNGTNVLPAMQVMLGGGLEPDGTGTIADKILKLPTRRCVEAVREILTDYDTNATEGEYFNDYYRR

SEQ ID NO: 10429 - protein, 380 aa, Cytophaga hutchinsonii
TLAIRTQTERSQNREHSAPIYMTSSFVFEDAEQARAMFADEVGGNLYTRFSNPNNSEFIEKMCLMEGAEDGFATASGMSAVFSSMAPFLNSGDHILLCKSVFGSSLQIVTQIFPKWGIEYTFAPIDKPETWESLIKPNTKMVMIETPSNPALDLIDLEWLSSLCKKHKILLNVDNCFATPYLQNPIKLGADIVTHSATKFIDGQGRAIGGIILASKELIKQVRFFCRHTGPALSPFNSWIFSKSLETLAVRMDRHCENALKLATFLEQHPDVELVKYPFLPSHPQYQLAKKQMRAGGGIVTFIIKGGVDRGRKFLNATEMASHSANLGDTRTIVTHPASTTHSKLSDADRESVGIFPGTIRISVGLEHSDDIIAEIRQAL

SEQ ID NO: 10430 - protein, 325 aa, Cytophaga hutchinsonii
MREIQFREALREAMNEEMRRDPNVLLLGEEVAEYNGAYKVSQGMLDEFGAKRIIDTPISELGFAGIGVGAAMNGLRPIIEFMTFNFSLVAIDQIINGAAKIMSMSGGQYTAPIVFRGPTGNAGQLSSQHSQNFENWFANTPGLKVVVPANPYDAKGLLKSAIRDNDPVIFMESEVMYGDKGPVPEGEYLLPIGVADVKREGTDVTLVSYGKILKVALQAAEDLAKEGVSAEVIDLRTVRPIDFEAIVHSVKKTNRLVIVEETWPLASISSEISYHVQRYAFDHLDSPILRVTSRDLPLPYAPTLIQEILPNVKRTIDAVKTVMYQ

SEQ ID NO: 10431 - protein, 340 aa, Cytophaga hutchinsonii
LIKPILFCFTPERAHHITFTGLKILFKIPGVSSIFRSIYAVQDKRLERTVFGITFPNPVGLAAGFDKDAKIVDEFSSLGFGFIEIGTVTPVPQAGNDKPRLFRLPEDKAIINRMGFNNGGMKEVAARLRKRKSRVLIGGNIGKNKVTPNEEALNDYIKAFNELFDCVDYFVVNVSSPNTPGLRALQEKGPLTELLNRLQEVNNQKSVPKPILLKIAPDLTNEQLDDIVEIITETKLSGIIATNTTISRDGLTTEKEKVEKIGMGGLSGKPLTVRSTEVIRYLVKKSNGSIPVIGVGGIHSPKDALEKLEAGASLIQLYSGFIYEGPALVGAINKEILRNI

SEQ ID NO: 10432 - protein, 133 aa, Cytophaga hutchinsonii
LILNGPNLNLLGKREPGIYGAASAEDIYNDLKKAYPAISFSYFQSNVEGELVNKLHEVGFDYDGIVFNAGAYTHTSIAIADAVAGIKTPVIEVHISNVYAREEYRHKSLMAKNCMGIITGFGMKSYALAVHHF

SEQ ID NO: 10433 - protein, 207 aa, Cytophaga hutchinsonii
LVGKKAPSFVAPAVLNGYEVVEAFSLDQYLGKKYVVFYFYPKDFTFVCPTEILAFQEKLAAFEAKDTVVVGCSTDTENSHFAWLSMPKNKGGIQGVKYPLVADTAKTIATNYGVLGGNFDIDDNGQMIFVGAPIAYRGTFLIDKEGIVRHETVNDFPLGRNIDETLRMVEALQHVEKFGEVCPANWGEGKEAMKATVEGVSDYLAKN

SEQ ID NO: 10434 - protein, 321 aa, Cytophaga hutchinsonii
MKKIAVYTSGGDAPGMNACIRAAVRAGHYHNLEVYGIVRGYDGMINGNFIELDNRAVSNIIQKGGTILKSARSEEFRSPEGRRKAFDQIQKFGIDGLVAIGGNGTFTGAELFYNEYQIPCVGAPGTIDNDLYGSDFTIGYDTAVNTCLAAIDKIRDTADAHERVFFIEVMGRDTGYIAVRSAISGGAEMAIIPEFPYDKNVVINRLKHGTSDTKASHIIIVAEGHQEGRASMIARDIKEALPQLDCRVTTLGHVQRGGGPSAADRVLASRLGLATVEGLLEGRANVMAGIIDHKVVYTPFIDTITKRKPINEDLLSLAEKL

SEQ ID NO: 10435 - protein, 422 aa, Cytophaga hutchinsonii
IEEIVARQIFDSRGNPTIEVDVITENGLIGRAAVPSGASTGKHEAVELRDNDKSIYMGKSVLKAVANVNDIIAPELIGSHVFEQNLIDRLMIDLDGTANKGKLGANAILGVSLALAKAAAQEAGLPLYRYVGGVSANTLPVPMMNIINGGSHADNSIDFQEFMIMPTGAKSFTEAMRMGSEIFHNLAKVLKSKGMSTNVGDEGGFAPNIASNEDALITVIQAIEAAGYRPGEDVMIAFDAASSEFYDSETKLYHFKKSTGDKLTSSQMASYWADLVKRYPIVSIEDGMDEDDWSGWAELTKLVGDKVQLVGDDLFVTNVSRLQQGIDQGIANSILVKVNQIGSLTETISAVNLAKRNSYTSVMSHRSGETEDNTIADLAVALNCGQIKTGSCSRSDRMAKYNQLLRIEEELGEAAYFPGKNM

SEQ ID NO: 10436 - protein, 354 aa, Cytophaga hutchinsonii
KEAYLMLEDGTWYKGIAVGKIGTTSGEICFNTGMTGYQEIYTDPSYYGQIIVNTTSHIGNYGVKEDEQESAGVKFSGLVCRNFSEMFSRKDGDGSLQAYFEKNNIVGISDVDTRELVRYIRSKGTMNAVISSEILDVEKLKEEVKKVPSMKGLELSSRVSTKESYFLGNPDAKYKVAVLDLGVKTNILKNLTDRDCYLKVFPAKTTYAEMKQWSPNGYFISNGPGDPAVTSYAIDTVKNILSENRPMFGICLGHQILAEANGIPTYKMPNGHRGLNHPVKNLISGLSEVTSQNHGFAVDANAVPKDSNVEITHINLNDNTVEGIRLKDKNAFSVQYHPESSPGPHDSRYLFDQF

SEQ ID NO: 10437 - protein, 272 aa, Cytophaga hutchinsonii
MSLKKFRPITPGTRFRVAASYDDVTTSTPEKSLVVSIKKSGGRNSQGKMTMRYIGGGHKQQYRIIDFKRDKHAIPAVVKTIEYDPNRTARIALLSYADGEKRYIIAPTGLEVGNTILSGPGIAPEVGNCLPLSDIPLGTVVHNIELKPGKGAAMARSAGTYAQLVAREGKYATLKLPSGEMRMVLVVCYASIGTVSNADHMNLTKGKAGATRWAGRRPRVRGVAMNPVDHPMGGGEGRSSGGHPRSRKGLYAKGGKTRSANKYSKNMIVKKR

SEQ ID NO: 10438 - protein, 1390 aa, Cytophaga hutchinsonii
FTKVTISLASPESILEGSHGEVTQPETINYRTYKPEMGGLFCERIFGPVKDWECHCGKYKRIRYKGIICDRCGVEVTEKKVRRERMGHIELVVPVAHIWYFRSLPNKIGYMLGLPTKKLDQIIYYERYVVIQSGVKSEDGINYLDFLTEDEYLDILDKLPRENQLLDDKDPNKFIAKMGADALETLLSRLNLDELSYSLRHAAANDTSQQRKAEALKRLKVVEAFRDARSRIENKPEWMIIRMVPVIPPELRPLVPLDGGRFATSDLNDLYRRVIIRNNRLKRLIEIKAPEVILRNEKRMLQEAVDSLFDNSRKINAVRAEGNRALKSLSDMLKGKQGRFRQNLLGKRVDYSGRSVIVVGPELKMHECGLPKDMAAELFKPFIIRKLIERGIVKTVKSAKKIVDRKDPVVWDILENVLKGHPILLNRAPTLHRLGIQAFQPKLIEGKAIQLHPLVCTAFNADFDGDQMAVHVPLGHEAILEASLLMIASHNILNPANGAPITVPSQDMVLGLYYVTKGRKSTPEHPIKGEGMAFYGAEEVVIAINEGRLSQHAHIKVKGIVRTDAGELVEQMIDTVAGRVLFNLVVPEEVGFVNELLTKKKLQLIIGMVFKIAGMSKTAKFLDDIKQIGFQMAFRGGLSIGLDNIGIPADKNTLIDGAKKEVDSVWSNYLMGLITDNERYNQVIDIWTRVNSEITDTLMKQLEADQQGFNPIYMMMHSGARGSREQIRQLGGMRGLMAKPQKNLQGSVGEIIENPILSNFKEGLDVIEYFISTHGARKGLADTALKTADAGYLTRRLVDVAQDAIINEQDCGTLRGLTVSALKDNDDIVEPLTERILGRVSVHDVFHIISNELLVSSGQEITEEIARSIDDSGIESVEIRSVLTCESRRGCCAKCYGRNLSSGQMVGIGESVGVIAAQSIGEPGTQLTLRTFHVGGTASNITVDANIKAKFDGVVAFDDLRVIQSTNLEGDKVTVVMGRSGEIRIVEPVSGKTLLSNHVPYGAFLNVKDGETVKKGQELCFWDPYNAVILSEFEGTIQFDSIEEGVTYREESDEQTGHREKVIVDTKDKTKNPAIIVNHKKGEPKGYSIPVGAHLAVEDGQDVKPGQVLVKIPRSVGKTRDITGGLPRVTELFEARNPSNPAVVSEIDGIVTYGAIKRGNREIFIESKDGVKKRYMVPLSKHILVQDNDFIRSGNPLTDGAITPSDILSIKGPTAVQEYLVNEIQEVYRLQGVKINDKHIEIIVRQMMQKVQIIEAGDTSFLTNQAVDRFKFREENDNILDKKVVVECGDSEKLRPGMIITARQLRDENSSLKRKDQRLVVVRDAEPAVSMPTLQGITQASLDTESFISAASFQETTKVLSEAAVRGKVDFLKGLKENVIVGHLIPAGTG

SEQ ID NO: 10439 - protein, 1279 aa, Cytophaga hutchinsonii
  unsure (1)..(1279): unsure at all Xaa locations
RKSFAKTRSTVEYPDFLDIQVRSFKDFFQIDTPAENRFKEGLYKVFAENFPISDSRDNFILDFIDYNIDTPKYNVDECIDRGLTYAVPLKAKLRLTCNDKDNEDFQTIEQEVFLGNIPYMTERGSFVINGAERVIVSQLHRSPGVFFAQSKHTNGTKLYSARVIPFKGSWIEFATDVNNVMFAYIDRKKKFPVTTLLRAIGYGSDKDILDLFGLSEEVEATKANIKKAIGENWLPAYFVHGQKISXMKILVKLFQSTVTKFFXERDSIIKEEDINIIVESGSKSIILHREDVNIADYTIIYNTLQKDNSNSEKEAVEQIYRQLRNTDAPDEQTARDIIHNLFFSDKRYDLGEVGRYRINKKLGSGMGSEVKVLTKEDIINIVKYLIGLINSRAVVDDIDHLSNRRVRTMGEQLYSQFSVGLARMARTIKERMNVRDNEDFKPVDLINARTLSSVINSFFGTNQLSQFMDQTNPLAEITHKRRMSALGPGGLSRERAGFEVRDVHYTHYGRLCTIETPEGPNIGLISSLCVHAKVNSMGFIETPYRKVIDGIVDVKNQPVFLTAEEEDGAHIAQANAMYDDNGNFISDRIKARYEGDFPVIAPDKVDLIDIATNQIVSVAASLIPFLEHDDANRALMGSNMQRQAVPLLRPEAPIVGTGLERRVAMDSRTLLIAEADGVVEFVDANEIKMRYDLTDEDRLVSFDSDIITYSLIKFRRTNQDTCINLKPVIQHGERVKKGQVLCEGYATDKGELALGRNLMVAFMPWQGYNFEDAIVISEKVVRDDIFTSIHIEEFELEVRDTKRGEEELTSEIPNVSEEAVKNLDENGIIRTGAEIKEGDILIGKITPKGESDPTPEEKLLRAIFGDKAGDVKDASMKAPPSLRGVVIDTKLFSRPKKDKDLRIKSKKQVETIKGKYSKDLLALREQMIEKLAALLDGQTSQGVKHKFGDEVISKGVKFSRKNIEANVFPDKNPYRDESNYNVQEEANLLGDLIIDNWTSDKKINENVLRLVKNYLTKRNETAGKFKRERFTLEVGDELPAGIVQLAKVYIAKKRKLKVGDKMAGRHGNKGVVARIVRDEDMPFLEDGTPVDIVLNPLGVPSRMNIGQIYETLLGLAGKKLGRKYATPIFDGASEEEVINELRDAGLPTIGRTKLVDGLSGNPFDQPVTVGVIYMMKLGHLVDDKMHARSIGPYSLITQQPLGGKAQFGGQRFGEMEVWALEAFGAANILQEILTVKSDDVVGRAKTYECIVKGENLPRPNIPESFNVLVHELRGLALEI

SEQ ID NO: 10440 - protein, 401 aa, Cytophaga hutchinsonii
LDNGLKVFVHEDRTTSMAALNILYDVGSKDEVVTKTGFAHLFEHLMFGGSKHIPSYDEALQKAGGENNAFTSPDITNYYITIPANNIETAFWLESDRMMALSFDPKVLEVQRSVVIEEFKQRYLNQPYGDVWLKLRPLAYKEHSYKWATIGKEISHIEEATMDDVRDFFYSYYLPNNAYMVVAGNVTLEQVKKLSEKWFAPIPSGTRRKRNIPAEPKQTAARFEQTEAKVPLDALYKTYHMGGKLSADFYSTDLVSDILGRGKSSRLYDKLVQEKKMFSSLNAYIMSSVDPGLLVIDGKLSKGVQLKDADDAISELIEKFTQEQFSEKELNKVKNQAESTLLFGEVEVLNRAMNLAYAAMLGDPEIVNREAANIQKVTTADISRVAKTVLQPENCSTLYYK

SEQ ID NO: 10441 - protein, 176 aa, Cytophaga hutchinsonii
  unsure (1)..(176): unsure at all Xaa locations
MLIYLIGLPGSGKSTIGKTLAQKLKYTFFDMDDAICAQEKKTIEEIFADKGENYFRELEHSILHDTFELKNAIISTGGGVPCYFDNITEMKKHGLTIFINPSADELANRLVGQGGQNRPMLKGKTHKQVLDFIETKYRERAPYYEQAKLIFSTNKLNAEELLKHLKKEKLISXKRN

SEQ ID NO: 10442 - protein, 76 aa, Cytophaga hutchinsonii
FEESVAASKSLPNQSNENLLKLYSLYKQASEGDVNVEKPTNFFDFAAIAKFNAWESLKGVSKENAMQQYIDLVKSL

SEQ ID NO: 10443 - protein, 689 aa, Cytophaga hutchinsonii
SEKNTPKTIQTSRGAYNPSNPLYWDLIHTKLEVSFDFKKKHLLGKATLSAKPHFYAQNTVVLQAKGFDIHSISYLNGAKISSYTYDSKAITITLDKNYTRTDTLKLVIDYTAKPDDLPKTGSDAITEEKGLYFIDPLETDPKKPTQVWTQGETQSASCWFPTFDSPNQRSTQEMYITADKKYQVISNGELNYKTENADGTLTWSWSMKKPHAPYLFMMAVGEFAKVTDTWNGIEVSYYVEPAYEKYARSIFGETPAMIEFFSTKLNYPFPWPKYSQIVVRDFVSGAMENTSASIFMEALEVDDRFLVDDNWEQIIAHELFHHWFGDLVTCESWSNLPLNESFANFSEIAWFEHKHGYEAGLKHAQEDLEGYLSEAETTQNPLIRFHYTDIEEMFDRHSYNKGGLVLNMLRDAVGEEAFYKSLNLYLTRNAYSPVEIDELRMAFEDVTGEDMHWFFDTWFMKRGHAQLSVEHHVSKDKKTEIVIEQMQDTTEGTLYRIPLQIDYRTSGDTTLRSARYWISQKKDSIVLPVSVSELSYLVVDSKHLVVGTVQHEKNRTLLKGQFLYGTDYLLRKNAFEALVKPASAKDNPYLVQPENIDFLTKALNDRSAEVRSVALLEFTKRAVPNLETVFIPKMKEMAQTEPNGELRSKAISLVASLENNADYISIYKKGLNDPSYYVSGASLKALLVL

SEQ ID NO: 10444 - protein, 480 aa, Cytophaga hutchinsonii
KGHQIHIMNHQEANINHYARTLQKTIDFVTAHFRNTTQPFSGITPADLKPAVQSIDFNTTSSSIDDLLLEVKSIYSQHAVAFHLPKYIAHLNCPVVTPSLAAEIIISALNSSMDTWDQSAGGTLMEMKLIDWTCEQLHLGASADGVFTSGGTQSNLMALLMARDYYINRTLLYNVKMQGLPEDAKRFRVFCSEKSHFSIKKACSILGLGEHAVVCVPVGNRFKMNTKELKNLMEKEIAQGNIPIAIVATAGTTDFGSIDPLIELGELAKEYGTWFHVDAAYGCGLMLSDNHRYKLSGIEYANSVTVDYHKSFFQPVSSSALLVSDKDTLRLMCYHADYLNPVEQEKDGYPNQVNKTIQTTRRFDALKLWFTLRLMGKDVLGEYIDQIIYTAKQAANMIDKDPDFELLNHPEISTLLFRYNPYSTEVSALNTLNQFIRKKLMDSGKALVASTKVNNEVYLKFTLLNPATTAKDISTILELI

SEQ ID NO: 10445 - protein, 428 aa, Cytophaga hutchinsonii
HKVKDISLAAWGRKEIELAEAEMPGLMSIRKEFGPSKPLKGARVAGCLHMTIQTAVLIETLIELGAEVTWSSCNIFSTQDHAAAAIAAAGISVYAWKGMNEEEFDWCIEQTLFFGEDRKPLNMILDDGGDLTNMVLDRFPELVKDIRGISEETTTGVLRLKDRERNGSLVLPAININDSVTKSKFDNKYGCKESLVDSIRRATDVMMAGKVAVVAGYGDVGKGSAASLRGAGARVIVTEIDPICALQAAMDGYEVKKMADAVKRADIVVTATGNKNIITGEHFKAMRDKVIVCNIGHFDNEIDMAWLNKTYGSTKVTVKPQVDIYNVDGHDVIILAEGRLVNLGCATGHPSFVMSSSFSNQVIAQLELWENSSKYENKVYTLPKSLDEKVARLHLSKIDVELDILSADQAAYIGVTVDGPYKNDEYRY

SEQ ID NO: 10446 - protein, 661 aa, Cytophaga hutchinsonii
  unsure (1)..(661): unsure at all Xaa locations
EYTXGXKKEKESNTKSITKNXYQIFLISALLLVVVGIAYFSGSGGIQKTTKQRFFDMVLQHDVKKIVLVNDRNVEVTITDEALKSGRYDELLKRTNSPFSGTATGPQFQFEITPSYDFEAKYEEFLNKEKVPKEYQVPIEVDSNRAEVTSQLVTLGFWVLLFVGTWFLFRRVSGGGAGGQIFNIGKSKAALFDQDNKVKITFADVAGLDEAKEEVKEIVDFLRFPTKFTKLGGKIPKGALLVGPPGTGKTLLAKAVAGEAGVPFFSLSGSDFVEMFVGVGAARVRDLFKQAKEKAPCIIFIDEIDAIGRMRGKGGNMPGSNDERENTLNSLLVEMDGFGTDSGVIILAATNRPDVLDSALLRPGRFDRMISIDKPDIVGREQIFKVHLKPLKLGPDVDPKKIAAQTPGFAGAEIMNVCNEAALIAARRDKSEIDMQDFQDAIDRVIGGLEKKTKIISPEEKKIVAYHEAGHAVAGWFLEHADPLVKVSIVPRGVAALGYAQYLPKEQFLYTVEQLTDEMCMALGGRAAEDIIFGKISTGALSDLERITKMAYGMVSIYGMNDKIGNISFYDSKAGDYSFNKPYSESTAQTIDEEARNIVHEAYNRTKKLLLEKQPELEIVAKQLLEKEILFQSDLEKLIGKRPFEAETTYQAFTNKVDAPE

SEQ ID NO: 10447 - protein, 511 aa, Cytophaga hutchinsonii
  unsure (1)..(511): unsure at all Xaa locations
DLLRFTTAGSVDDGKSTLIGRLLYDSKAIFEDQMEQIEEISTRKGKGYVDLSLLTDGLRAEREQGITIDVAYRYFATPKRKFIVADTPGHVQYTRNMVTGASTANLAIILIDARHGVIEQTCRHSFIASLLQIKHVVVCVNKMDLVDFSEEKFNKIREDYTNFASKLNIPDIRFIPISALMGDNVVEPSTNTPWYQGGTLMYTLETVNIASDLNMIDSRFPVQYVIRPQSDEFHDFRGFAGRIEGGVFKPGDEIMHLPSGLTTKIKTVETIDGQLEEAFPPMSVTMTLEDNIDISRGDMIVKPNNQPEVGQDIELMLCWLNEKKMTPGGKYSIKHTTKDARCVIKEVRYKMNINTLHKIEDDKTIGLNDIGRVLIRTTSPLFYDSYNKNRITGSVILVDEFTNETVGAGMILXTPITIHYKAPAKNRGFYFXHYLFILLCNKHCNYERQNYSTYLLHSFYRLAYSIHLVSGKQYXRLISKVSPATDTWHTNHVYWRFNNTWFLSSVFFVRP

SEQ ID NO: 10448 - protein, 164 aa, Cytophaga hutchinsonii
LQREDKEAQLKQHSIVIWMVGLSGSGKSTLAKALERDLHDRGFLTTLLDGDNLRTGINNNLGFTEADRTENIRRAAETSKLFAACGIITICSLISPTEEIRSMSKNIIGANDYFELFVNTPIEVCEQRDVKGLYKKARAGEIKNFTGIDSPFEHPKAPSLEVRT

SEQ ID NO: 10449 - protein, 321 aa, Cytophaga hutchinsonii
LMRRPRRNRKSEAVRQLVKEHRVYTEDLMFPLFLTGGTNVKTEIASMPGIFRFSEDNLLREIDSCMNLGLRSFVLFPHFPDEVKDPYATISYQENMYLKALREIKKRFPECCLMTDVALDPYSSDGHDGIVVNGEIVNDETLIVLGKMAVAQAQAGADIVGPSDMMDGRVGFIRDMLDDSGFTNTSIMAYTAKYASAFYGPFRDALDSAPKSGDKKTYQMDPANVTEALLEAELDVQEGADIIMVKPALAYLDVIKTLYDQFDVPIAAYNVSGEYAMVKAAAANGWIDNDKVMLETLLSMKRAGAKIILTYFAKEFAGKVK

SEQ ID NO: 10450 - protein, 419 aa, Cytophaga hutchinsonii
  unsure (1)..(419): unsure at all Xaa locations
LISKYIXKQSIMNTTVSLSQQAIELEDKYGAHNYHPLPVVLAKGEGVHVWDVEGKHYYDFLSAYSAVNQGHCHPRIINALIEQAQTLTLTSRAFYNDKLGEAEKFICDLFGYDKALLMNSGAEANESAIKLARKWGYQVKGIPTDQAVIVAVERNFHGRTTGIISASTDPDSRNNFGPFMPGYQIIPYNDVIALEEALKNPNVCGFWVEPIQGEAGVFVPGDGYLKKAQELCTKYNVILMMDEIQTGCGRTGKLIASNHEGVHPDMLILGKALSGGTYPVSCVLTSDEIMLTIKPGEHGSTFGGNPLACAVLVESLAVLMDEGLIDNAASMGELFRDRMNALKDKCEHVTLVRGKGLLNAIIIKPTADGRTAWDVCMKLMENGLLAKPTHGDIIRFAPPLIITEEQINACCDIIEKTLL

SEQ ID NO: 10451 - protein, 358 aa, Cytophaga hutchinsonii
FFDAFQMHPTHISTAPGRINIIGEHTDYNDGLSMPCAINRWITVTFSPRSDDQIYIISKDFNQVLFLSMYAGYQPDSDWKKYMYGCIQILSDVKKLHGGFNALIEGNVPVGSGVSSSAALEVAFMNGLNAFYNLKLDPLAIIKLCQRVEHEYLKVKSGLLDQYASQFSKENNLLVLDFQKNTHTYISAEMDEYCWVLCNSNVTRSLAGSKYTERVMETQAALNQLSETFPDIKHFRDIKEIHISAVKNVTQQKRIKHYVLENKRVQDAIAALEQQDLTHFGALLTASHLSLRDLYEVSCDEIDFLMEQAISLPYCLGSRIMGGGFGGCTINLVKKNCTQEFSKFMKFAYLKRYNMVTE

SEQ ID NO: 10452 - protein, 158 aa, Cytophaga hutchinsonii
EEYVLLVDEQDNEIGSMEKMEAHRKGLLHRAFSVFIFNTKGELLLQQRAASKYHSPLKWTNTCCSHQRKNETTLQAAARRMQEEMGITCNVSLSYTFIYKADVGQGLFEHELDHVLIGTTTQTTIPFNKNEVHAVRFASLEDIEKEMSINPEDFTKWF

SEQ ID NO: 10453 - protein, 542 aa, Cytophaga hutchinsonii
  unsure (1)..(542): unsure at all Xaa locations
FXTAVQMTIKPEKINETLLHYAPGSAERSAVQQKITELKAAEVIIPMIINGKEVFTDQHVRIAPPHEHAYTLGYFCEGKGVHVSNAISAALHAKHSWAVKSLKERAAVFLKAADLISTTYRAEINAATMLGQSKNVYQAEIDSACELIDFFRLNVAFAYEIETIQPCSHEGIINRMIYRPLEGFIFALTPFNFTAIAGNLPAAPALMGNTVVWKPAYTQIYSARIIMKVLIEAGLPNGVINLIYTDGPVTGDIIFQHRQFAGLHFTGSTAVFKQISTTIHNNIDLYQNFPRIVGETGGKDFVLAHASCDVQALSVALVRGAFEYQGQKCSAASRAYIPASIWPSVREHIVHMLDEIKMGTVEDFSNFINAVIDEKAFDKIVRYIDAAKKDPEASIIAGGKYDKSIGYFIEPTIIEASNPQYVTMREEIFGPVLTVYVYKDSEWNQVLGIVDTTTPYALTGSIFAADSAIIEEAKKALYYSAGNLYINDKPTGAVVNQQPFGGARLSGTNDKAGSVLNLLRWVSPLVVKENLSPPHDYTYDFM

SEQ ID NO: 10454 - protein, 123 aa, Cytophaga hutchinsonii
MNFPSELKYSKDHEWVRVEGQTAYVGITDFAQKELGDIVYLDVTSVGQTIDKEAIFGTIEAVKTVSDLFMPVSGEVLEFNAELESAPELVNSDPYGKGWIVKVTLANASDLDALLDAAAYTTL

SEQ ID NO: 10455 - protein, 609 aa, Cytophaga hutchinsonii
MSDIIRLLPDNIANQIAAGEVVQRPASVVKELLENSVDAGSTNIQLIVKDAGKQLIQVIDNGKGMSDGDARLCFERHATSKIRSADDLFAIRTFGFRGEAMASIASVAQVEMKTKLPGNELGTLIRIEGSAILVHEQTAHPQGTSISVKNLFYNVPARRNFLKSNSVEMRHIMDEFVRVALAHPEVAFSFYHNDLELFNVPEETLSKRAVSLLGGSYREQLIPCKEETDFVSISGYIGKPESARKTRGDQYFFVNNRYIRSNYLHHAVMHAFEELIPTDAFPFYLLFIEIDPAHIDVNVHPTKTEIKFDDEKTVYAIIKACVKRSLGTHNIMPSLDFDFNVNVSGFTGMGLSDSSGRESNTNFTPKSFSTSDSIQRSNQSNWERMYSGLENNREEVYQESIKMVSAINGTEDLKQLSKEQLYTENTSTFQLHQKYIVTQVKSGVLLVDQQAAHERILFEKYIGMLQNRFGSSQQFLFPQTLELSAADFAMVVEMEEDIRKLGFVFNVFSNTTIVVNGVPSDVKSGNEKNLFEGLIEQFKQNRTDLKIDRQENLARSLAKRSAIRAGNKLSLMEMNSIIDQLFACKSPNYAPDGNLTVVMLDMDKIGRLF

SEQ ID NO: 10456 - protein, 367 aa, Cytophaga hutchinsonii
MKIGIVCYPTFGGSGVVATELGKALAELGNPIHFITYSQPHRLDFFHENIFYHEVTVKSYPLFEFAPYEVILASKIVDVVKHEKLDLLHVHYAIPHASAAFMAREILKTQGIYIPIITTLHGTDITLVGKDPSFAPVVAFCINQSDGVTAVSEDLKKDTFEHFDIHREIEAIPNFIDVSRFRKQKKDHFKKAICPNDEKLIVHTSNFRKVKRVEDVVSVFNIVRQTVPSKLLLVGDGPERVLIEGMCRELGICNDVRFLGKLDAVEEVLSVADLFIMPSEKESFGLAALEAMACEVPVISSNAGGLPELNIQGKTGFLSNVGDVKEMAKNAIFILDNANLQEFRKNALERAKEFDSNHIVPKYLEYY

SEQ ID NO: 10457 - protein, 242 aa, Cytophaga hutchinsonii
KTYGLIGFRLSHSFSKKYFTEKFLKEGIEDCVYENFQLDTVKEFSALLRTDANLKGFNVTIPYKEEIIPFLNDLDAAAKEIGAVNVIKIQEDGTLIGYNSDYYGFKTSLETFIPKEVSHKALVLGTGGAAKAVVTALNHLGIPYQYVSRNKSAQSLSYEELDQNVMQEYTLVVNTSPLGMYPEVDSFPAIPYEFLDSRHYLYDLVYNPEETLFMKKGIARGAHVMNGLPMLIGQAEKAWEIW

SEQ ID NO: 10458 - protein, 611 aa, Cytophaga hutchinsonii
MCGIVAYVGHREACPIIIKGLKRLEYRGYDSAGIALMTHELSVYKKKGKVSELEAFIKNLPINSNIGIGHTRWATHGEPNDVNAHPHYSSNKELAIIHNGIIENYASLKTELESRGHVFLSETDSEVFIHLIEDVKQNNDCSLDEAVRLALSMVVGAYAIVVMSNNDKEMLIAARKGSPLVIGIGKKEFFLASDASPIIEYTNDVVYLNDYEIAIINKGELTIKNINAVTQTPYIQTLDLELDQIEKGGYPHFMLKEIFEQPKSIKDSMRGRVNASLGHLQLGGILQYANKLTNAERIIIVACGTSWHAGLVAEYLFEDIARIPVEVEYASEFRYRNPIIREGDVVIAISQSGETADTLAAIELAKSKGAVIFGVCNVVGSSISRASHEGAYLHAGPEIGVASTKAFTAQVSVLAMMAIIVGNKKGTITESQYIALLTELETIPQKVEKALKSNDQIVEIAEQFKDAKNFLYLGRGYNFPVALEGALKLKEISYIHAEGYPAAEMKHGPIALIDAEMPVCVIAPQDNSYEKIVSNIQEVRARKGRVIAVVTEGDTHIKNMAEYTIEVPATHEALMPLLTVIPLQLLSYHIAVMRGCNVDQPRNLAKSVTVE

SEQ ID NO: 10459 - protein, 379 aa, Cytophaga hutchinsonii
MNFDLTEEQKAVQLAARDFAQTELLPGVIERDEQQKFPAEQIKKLGALGLMGIMTAETYGGAGMDTVSYVLAMEEICKVDASTGVCMSVNNSLVCWGLEHFGSEAQKQKYLKPLASGERIGAFCLSEPEAGSDATSQRTTAVEQGDHYILNGTKNWITNGNSASVYLVIAQTHPELKHKGINVFIVEKGTPGFVVGKKENKMGIRASDTHSLMFTDVKIPKENRVGDDGFGFKFAMQTLNGGRIGIAAQALGIASGALELSLAYSKERKSFGTEIFNHQAIQFKLADMATKIDAARLLVLKAAYLKDQHKDYTEAAAMAKLFASQVAMDTTIEAVQIHGGYGFVKEYHVERMMRDAKITQIYEGTSEIQKLVIGRELFK

SEQ ID NO: 10460 - protein, 444 aa, Cytophaga hutchinsonii
  unsure (1)..(444): unsure at all Xaa locations
KQLDASFVWGVSASAYQTEGAYNIDGKGPSIWDTFTNENKNKIKDRKNANIACDFYSRYEDDLKLMQSLGINHFRFSISWSRILPSGTGEINPAGIAFYDRLIDTCLRYGITPWVTLYHWDLPQALEKRGGWTNREVVNWFTGYVAICVKHFGDRVQHWMVMNEPMVFVGAGYFLGLHAPGRRGMKNFLPAIHHAVLSMCEGARAIKSIYPNATVGTTFSCSHIEPYRNIEKDHLAAYKVDALLNRMFIEPTLGMGYPIDTLKPLQNIHQYILPGDEYKMKYDFDFIGVQNYTREFVKHSWFTPYLNARLITAPNRKVPHTLMNWEVYPESIYHMIRKFDAYPGIKKILITENGAAFEDTHHESLISDHLRTTYLQDHIEQVLRARAEGSKVDGYFVWTWTDNFEWAEGYHPRFGLIYTDFKNQNRIVKESGLWYGSFIREXXL

SEQ ID NO: 10461 - protein, 327 aa, Cytophaga hutchinsonii
DVQRKIKIIASKTGIEKRYSVLKDFNAQPEDFEFFPKDASLLPEPGLSKRMEIFNKEALQLSIKTISKIPEFDHIKNTITHLITVTCTGLFAPGLDIQLIQALALKPSINRSSINFMGCNAAILALKQADVICKANGNANVLIVCTELCSIHFQKDYSDDYIISNQLFGDGCAAVLVTADPVAYATDQLVKINEFHSLLLHKGYNDMAWQLSETGFRMNLTTYVSDLINGNIKQMLADINVDANAINFWAVHPGGRKIIDGFCEALRLDKGQLEASYDVLKNYGNMSSPTILFVLKQVLDGNKESAKGKSLLTAAFGPGLSIETLTL

SEQ ID NO: 10462 - protein, 366 aa, Cytophaga hutchinsonii
  unsure (1)..(366): unsure at all Xaa locations
STTPRLKFIDTKNSQFFATVKRNVDLYFKENNISKNANALMIFKSIFFFGGVWVFYGLILSQNFSLSVMLILAMLMGVFKAASAFNISHDAMHGSYSSKEWVNNLLAYTFNILGANISVWVVSHNIVHHTFTNIEEHDEDLIIAPGLIRLTDGDKKSKIQRFQHLYAFFLYGFASLSWVLRKDYMKMFQDKIGQHVTKHYTKRDYIELFLYKAINYTIFIVIPLVVLDITWWQFLIGFIAMHFAMGFTLGLVFQLAHVVEETSFPVTNGEGNIEEAWAVHQMCTTANFGMDSFLTSFICGGLNFQVEHHLFPKVCHIHYPAISKIVRETAESMNVPYLYNDTFFTALQSHYQVLKKFSLEAAXNIV

SEQ ID NO: 10463 - protein, 676 aa, Cytophaga hutchinsonii
  unsure (1)..(676): unsure at all Xaa locations
KTLFEKVWNAHVVTEVKDGPSILYIDKQLIHEVTSPQAFAGIEKRGIGVFRPERTLATPDHNVPTKGQNLPIVEDLSRFQVDKLTENCNKFGVTLYGLGHASQGVVHVVGPETGTTLPGMTIVCGDSHTSTHGAFGSIAFGIGTSEVEQVLATQCLMQTKAKTLKIEINGKLAKGVTAKDVILYVIAQISAAGGTGYFVEYCGSAITSLSMEARMTICNMSIEMGARGGMIAPDETTFNYIKGREFAPKGAKWDEAVAYWKTLYSDSDAVFDKTLKYDAADIGPMITYGTNPGMGISVNKNIPSLDSIEESNKVTFNKALDYMGFHAGDSLIGKQVNWVFLGSCTNGRIEDLRQFAEFVKGKQKAANINALIVPGSKQVEKQAIAEGIDKVLAEAGFELREPGCSACLAMNEDKVPKGEYCVSTSNRNFEGRQGPGARTLLVSPLTAAAIAVSGKIVDVREMLNXSSNIQISFIKRIXDFKTFRTMEKFITIKSTVVPLPIEDVDTDQIIPARFLKATTKEGFGKSLFCDWRYNQDGTPKADFVMNNPLYSGQILVAGKNFGCGSSREHAAWAIGDAGFRVVVSSFFADIFRGNALNNGILPVQVSDAFLKSIFDAVAANAKQELVVDLANQVISIAGTDLKESFVINEYKKTCLINGYDDIDYVLSIKDKIEAYE

SEQ ID NO: 10464 - protein, 386 aa, Cytophaga hutchinsonii
  unsure (1)..(386): unsure at all Xaa locations
KXIVRSIIMGKRIFVFDTTLRDGEQVPGCQLNTEEKIIVAKALDELGVDVIEAGFPVSSPGDFNSVVEITKAVTRPTICALTRAKEADINIAGEALRFAKRSRIHTGIGSSDIHIEHKLRSTRENILEMAVAAVKQAKKVVHEVEFFCEDAGRADQAFLARMVEAVIEAGADVVNIPDTTGYMLPWQYGERIKYLMDNVSNIDKAILSAHCHNDLGLATANSLAALQNGARQVECTINGIGERAGNTALEEVVMAMECHKETLGLETGINHKKLVPISHLVSTLMRMQVQSNKAIVGRNAFAHSSGIHQDGFLKHRETYEIIDPAAVGADSSSIILTARSGRAALNHRLATIGYMLSKDQLDQAYTQFLDMADHLRKVEDENLHEL

SEQ ID NO: 10465 - protein, 504 aa, Cytophaga hutchinsonii
KKVILMILDGWGLGTNPKVSAIAAAKTPFVDSLFVNYPHSKLEASGLAVGLPVGQMGNSEVGHMNIGAGRIVYQDLVKINLAVENNTLADEPAIKDAFNYAKTNNKKVHFIGLVSDGGVHSHVNHVKGLCNIANQYGLKDVYVHAFTDGRDCDPKSGLGFVKELQESMAKSTGKIASLVGRYYAMDRDNRWERVKLAYDVMVNGEGTHAADALKAIEESYAAGVTDEFIKPVVLVDANDKPIAKIEPGDVVICFNFRTDRGREITVALTQKDFHEQNMFKLDLYYVTMTNYDDTFNNVKVIFDKDNLSNTLGEVLQGASKKQIRIAETEKYPHVTFFFSGGREEPFKGEKRLMAASPKVATYDLAPEMSANEIKEKIVVELKSKDPDFVVLNFANPDMVGHTGVFEAAVKACEVVDSCTEAVVTTALENGYTAIVIADHGNADYMINEDGTPNTAHTTNLVPCILIDNEYKKPLKDGKLGDLAPTILALMGIEKPKEMTGESLL

SEQ ID NO: 10466 - protein, 404 aa, Cytophaga hutchinsonii
MNKISWVVISVLCLIHVQTHAQINTPAGATVPFGSNNSYAYGILPTNLPTSGTYGKGTEVAAKYTAWKSAYIENCGTDKARVKFDNTSETVSEGIAYGMLLAAYAADQDLFNRLWAYYKQHRNAKGVMHWKISGCNSVIGQNGATDAELDAAMALIVANYQWPNTTSPHNYKTDAVSLINAIKNYEINATDFTFENGDAWKPACRNPSYQAPGYARVFKLFMAENGQANNTFWDNVIQKTENLLINNAHTTSGLSTNWCTPAGPPNSSCSGSGTAPDKFGYDACRAPWRQATDYIWYGPSTILTITNRQAAFWIGKGGAGSVQGGDGVNHDGSGSGNHNAAFVGPIGALSLATTNTTANQQFCNALYSENKNDGLASGYFTKILQMLGLFVQTGNFWNPYAVSS

SEQ ID NO: 10467 - protein, 481 aa, Cytophaga hutchinsonii
  unsure (1)..(481): unsure at all Xaa locations
GFXSCRRQAWQQRRXSSDYSAKNAGTNDLNQVRTINRXXIMRVLKFGGTSVGKPERMHSVAKLISSPDPKVVVLSAVSGTTNALVDISTKLCKKDIKAAEDAIEKLFTPYHAFVEELYTTEAGKYKGHAIMRTYYELIKSYVTAPSFGDKETRFFLAQGELISTNLFQEYLAEQGYSSALLPALEFMKTDADSEPMLEYIEEKLNEQLAKHPNKQLYITQGYVCLNSDGEVDNLKRGGSDYTATLIGAALRMEEIQIWTDIDGMHNNDPRIVKRTFPIPEISFDEAAELAYFGAKILHPTCIRPAQVRKVPVRLLNTMQPEQKGTVINSKPSDRDITAIAAKDDITAIKIKSSRMLQAHGFLRKVFEIFENYKTSVDMITTSEVAVSLTIDDAKNLEQIVKELKEFSIVEVDTDQTIICIVGNFGKEKTGISKRLFDAMETIPVRMISYGGSASNISILINSTLKNETLNALNERLFFQAE

SEQ ID NO: 10468 - protein, 314 aa, Cytophaga hutchinsonii
KETYLFWYEKMQLVRKFEEKTGQLYGQQKIKGFCHLYIGQEACAAGAVSALKKGDHYITTYRDHGQPLVLGTDPKAIMAEMYGKATGISKGKGGSMHIFDKAVNFAGGHGIVGGQIPLGAGLAFAEMYKGTDNLCVCYMGDGAVRQGALHETFNLAMLWNIPVIFVIENNGYAMGTSVQRTSNVTELYQIGESYDMPSEAVDAMSVEEVHLSVARAAERARSGGGPTLLEFRTYRYKGHSMSDPAKYRTKEELESYKAQDPIEKVRAVILEKKHATEADLEAIDAKIKATVEEAVKFAEESPYPDASEAYKDVY

SEQ ID NO: 10469 - protein, 461 aa, Cytophaga hutchinsonii
SIRIEKDTMGLVEVPADKYWGAQTQRSIENFKIGDASTRMPIEIIHAFAILKKAAAQTNLELGILDKEKAGSIAEVCDEILAKKLDDQFPLVVWQTGSGTQSNMNVNEVIANRAHVLLGGNLLDETKKIHPNDDVNKSQSSNDTFPTAMHIAACLMLKKVTIPGIEQLQHTLRTKTEQFKDVVKIGRTHFMDATPLTLGQEFSGYAAQLSYALKAIHNASAHLSELALGGTAVGTGINAPKGYAERVAGHIAALTGFPFTSAPNKFEALATHDALVEMHGALKTSAVSLMKIANDIRMLASGPRSGIGEIHIPDNEPGSSIMPGKVNPTQVEALTMVCAQVMGNDVTLSVAGSMGQFELNVFKPVIIYNFLQSARLIGDACVSFNEKCAKGIEPNTATIERNVENSLMLVTALNPHIGYDKSAEIAKHAHKENTSLRQAALALGYVTNEQFDAWVNPKNMI

SEQ ID NO: 10470 - protein, 386 aa, Cytophaga hutchinsonii
ITLTKDGQHVIAASDSMLYNYTITSKTVVAYKLYLSETVNDIALSLDEKEILVASDNMTAWALEAASGKVIRTYQGALQEQDKGGLNYNADNYWEYNIARYLRLKNELLLTKDDNNFITGKTGVNAIQWNISTGAPNKLYEGHTKAVISMDQSADGSILATADGAGEVFLWNTKTGALINRIKPHTEPIFDVSLSRDGKYVATGSWDASIEVYDVQTGEVSSDMYLKENSCYSISFTPNGLYLLCGRLDKSLELREPDSKKVVLSFIGHTDVVSSIAFGADPNKALTASWDGTARIWDVTTGMMLQKFKGARGMLHSAIYSTDSKKIITGGDDRIIRIWDIQSGQVLKTLNGHQSEITSLSLSKDGKMLVSYSTDGVVKFWNLESG

SEQ ID NO: 10471 - protein, 335 aa, Sphingomonas aromaticivorans
RPLLKTLQGENISPDPIWLMRQAGRYLPEYRELRAEKGGFLALVYDTDAAAEVTVQPIRRFGFDGAILFSDILIVPYAMGQDLQFLAGEGPHLSPRLLDAALNSLVAVPGRLSPIYETVAKVKAQLSPETTLLGFAGSPWTVATYMVAGEGSRDHHDTRALAYRDPSAFQAIIDAITEVTIEYLSGQVEAGAEGLQLFDSWSGSLAPAEFERWVIAPNARIASAMQQRYPHVPVIGFPKGAGEKLSAYARETGVNAVGVDETIDPLWAARELPANMPVQGNLDPLLLLSGGPELERQTIRVLEAFADRPHVFNLGHGIGQHTPIENVEALLKIVR

SEQ ID NO: 10472 - protein, 94 aa, Sphingomonas aromaticivorans
RYFTKDHEWIAVEGSEATVGITDYAQSQLGDITFVELPGEGSEVGKGDSASVVDSVKAASDVYAPVSGKVTLANAALEEQPELVNTDPEGEGWL

SEQ ID NO: 10473 - protein, 413 aa, Sphingomonas aromaticivorans
EAYIIDAVRTPRGIGKPGKGALSHLHPQHLAATVLKALKDRNDLDTSTVDDIIWSTSSQVGKQGGDLGRMAALAAGYDISASGTTLDRFCGGGITSVNLACASVMSGMEDCVIAGGTEMMSFTAAHGAELANAGIKPLGMGSGNMELDALHPQSHQGVCGDAIAAREGIDRMALDALALVSQERADRAIREGRFDKSVVTVYNPDGTVALDHEEFPRPETTMEGLSSLKASFDGIADFDLGGTTFRKQIQRRYPELEWKGVHHAGNSSGVVDGAAALLIVSPAYAEKHGLKPRARIVAYANQGDDPTLMLNAPVPAARKVLDKAGLSKDDIDVWEINEAFAVVAEKFIRDLELDRDKVNINGGAMALGHPIGATGSILIGTALDELERSGGRYGLVTMCAAGGMAPAIIIERI

SEQ ID NO: 10474 - protein, 473 aa, Sphingomonas aromaticivorans
DKLYIAGRWVPAHSGRMIPELVSPNTELVVGRVAEADETDMDAAVAAARDAFDHGPWPTTPPAERIAAFRRMVAHLETRVPELAKAWTAQMGGLASFAGPMHGGSVMALGQIAGFAEKFEFVERRPSMAADTALIAYEPVGVVAAIAPWNGPFGIMANKVAYALLTGCTVIMKPSPETPLEAYIIAEAAEAAGIPAGVVNLVTGHREASDHLVCNEGVDKVSFTGSTVAGKRIASVCGSRMARCTLELGGKSAAIVRDDFPIDAAAKMLAGTITMMSGQVCAMLSRVIVPRRRHDELAEAIAAEMKKVRIGNSDDPETQLGPVAMKRQLERIEMYIEEGRKTADLVTGGGRPAHLNRGYFIEPTLFANVRNESRIAQEEIFGPVLSLIPVEDEEDAIRTANASAYGLNGSVLTNDAEAAYRIARRVRTGGFGQNGLRMDFGLPFGGFKQSGIGREGGPEGLFPYLEMKTILID

SEQ ID NO: 10475 - protein, 535 aa, Sphingomonas aromaticivorans
FDYIIVGAGSAGCVLANRLSADPANRVLLIEDGGDNQHPFIKMAGGFIKIMGNPDYFRVFPTEPRPGMRPGIHTYGRGLGGSSAINGTWYLTGMPKDFDGWAQSGLAGWGWDEIARCYRKFEDYREPGAHPGRGRGGELQVTASTYESPVFDALAQGFAAQGMPWLDDITTPGVQGVGRSQYTVDRKGVRESTYKAFVMPILGRHNLTIAQHTAVKRVTIEQGRATGVVTEAHGQESTHVAKREVILAAGVYGSPQLLQLSGIGAGAVLQELGIPVLKALPMVGRQLCDHTKFGVSFDLTNHPGTNREFFGWRLYRNALQYFLTGTGHLARVGMPLTGLYASEGTDKDWPDLQVAAAPFAMRTVNEMAARPGSPLTPNPGLTFSGYHLRPKSRGSIRLVSPDFRDAPVADAAIWADPHDKAKSLELFRLFRAIAASEPLRPFIGKERMPGPDVQDEAAILAELGKMVEVGLHGTGTCSMGTDEATSVTDARARVHGVGALRVVDCSIMPTPVSGNTNGPAMALAERAAELILEDA

SEQ ID NO: 10476 - protein, 432 aa, Sphingomonas aromaticivorans
RRFTANGPLKGRIGVPGDKSISHRSIMLGALAVGETRVTGLLEGEDVLSTAAAMRAMGATIERDADGMWHVHGVGVGGLLQPQQALDMGNSGTSTRLLMGLVATHPITATFVGDASLSKRPMGRVIDPLSTMGAEFTASPGGRLPLTLRGISPAVPIEYRLPVASAQVKSAVLLAGLNTPGVTTVIEPIPTRDHSERMLRGFGAELTVDVAADGARVIRVRGEAELKPQDIAVPGDPSSAAFFVVAALLVEGSDLVVENVGLNPTRAALFDVLRLMGGSIEELNRREVGGEPVADLRVRHSLLTGIDVDPAVVPSMVDEFPVLFVAAALAKGRTVTTGLEELRVKESDRISAMRAALELAGATVTETEDGLIIDGTGGDPLPGTAEGASVVTHLDHRIAMSMAIAGIASRNGVEVDDTRPIATSFPVFESLL

SEQ ID NO: 10477 - protein, 409 aa, Sphingomonas aromaticivorans
  unsure (1)..(409): unsure at all Xaa locations
FPEGFLWGAATAAHQIEGNNLNADLWVIENVPGTIFAERSGDAANSFELWPVDLDLVKGMGLNSYRFSLEWARIEPDEGHFSNAMLDHYKAMIEGCRARGLKPVVTFNHFTTPRWFAAKGGWHNPESSALFARFCERAARHLAAGIELATTLNEPNLAGVIGEILPPPLVAGDKATQEAAAKQLGVALYTPGVALYIKEPKTYRANMMEGHRRGVAAIKAVRPDLPVGVSLAMIDDQAVGKNSMRDRIRERYYNEWLRLAGETCDFIGVQNYERKVWTDKGELPSPADARRNTGGAEVWPGSLAGAVRYAHAVTKLPVYVTEHGVNSDDDALRQWLIPEALTELKRAIDDGVPVRGYIHWSLIDNFEWGFGYKYRFGLHSFDQSTFQRTAKPSAAILGRIARRNRLXEA

SEQ ID NO: 10478 - protein, 208 aa, Sphingomonas aromaticivorans
MNVLSPSLAASSGMADVIGEDGKIVVPADVEEAIRTLIRWSGDQPEREGLLDTPKRVARAWREYCSGYAQDPGLHLSRTFEEVGGYDEVVLLRDIPFQSHCEHHMAPITGTASIAYLPRDRVVGISKLARVLHGFAQRLQVQERLTAEVAQCIWDNLKPHGVAVVIEAQHGCMTGRGVRTHGVGMVTSRMLGCFLDDASSRKEVLALM

SEQ ID NO: 10479 - protein, 277 aa, Sphingomonas aromaticivorans
AYKIIDHTYDTVVVGAGGSGLRATMGSAQAGLRTACITKVFPTRSHTVAAQGGIAASLGNNSPDHWTWHMYDTVKGSDWLGDQDAIEYMVREAPAAVYELEHAGVPFSRNPEGTIYQRPFGGHMQNMGEGPPVQRTCAAADRTGHAMLHALYQQSLKYDADFFIEYFAIDLIMENGECRGVIALCMDDGSIHRFRSHAVVLATGGYGRSYFTATSAHTCTGDGGGMVLRAGLPLQDMEFVQFHPTGIYGAGVLITEGARGEGGYLTTSEGERFMERY

SEQ ID NO: 10480 - protein, 258 aa, Sphingomonas aromaticivorans
FRKMHGLGNDFVVIDAREAAVSMTAARAAALADRRTGIGCDQLIVLEPSDVADVRMRIFNNDGSEVEACGNASRAVGLLLGGTQFIETLGGLIRSEARPDGVSVDMGAPRLRWDEIPVSYAMDTLEMPVGWEDLENPVGVNVGNPHVIFFVDDADAVDLARLGPLIENDPLFPERINVNVASVVGPDHLKLRVWERGAGLTRACGTGACATAVAAIRRKLTGRKVRIDLPGGPLTITWPEGGTIDMTGPATLSFEGAF

SEQ ID NO: 10481 - protein, 255 aa, Sphingomonas aromaticivorans
LDGKVCIVTGSGSGMGRASAMEMARQGGRVVVTDINTSAGEETVEAIRAEKGDAIFIACNLRKAHEIKVLMQKTADHFGGIDVLHNNAAIHETDLTDKTSIEDLPEEIWDAVYEVNLKALWLTTRYAVPWLKLSKGAAIVNVASTGSFVSYPQAGAYCATKGGVLLLTKATAVDLAKYGIRCNCYCPGAIETPMLQKYLDAAEDKKAIMSVLTGAHLIPRLGKPEEVAKLACFLASDDSSFINGASYVIDGGTLA

SEQ ID NO: 10482 - protein, 530 aa, Sphingomonas aromaticivorans
  unsure (1)..(530): unsure at all Xaa locations
NFGDLLDATAANVPGDRPAIIRGDRVVEWGDFDARTNRLARAMLAAGLPTGARVAILARNIPEFIEIAAAAFKARLAHVNLNYRYTTSEIEYVLRDCQAAAIFYQDEFAPVVAPLINGSIDHLSYAVQIGDGGAYDDIVTIGDPEPLGIERSPDDGYLLYTGGTTGRPKGVMWRAADARQTQLESPVAVTSPASMDDHVAQVLAGRAGRVMPACPLMHGAGLTSSLAELLIGGTVVLLPSNRFSALELWEEASRNRVTRILIVGDAFARPMADTLAANRERWNLDSLRLISSGGLMWSQQVKEALLEALPGITLLDTLGASEASGFGYAITTKDRATPTGLFEPAPHTVLIDPDRDRVLGSDEAGKGWLARRPPFASGYHGDPVKTASVYRIIDGERLAVPGDMAERLPDGRLRLLGRDSMCVNTGGEKVFVEEVEEALKRVNGVADAMVFGLPDPKWGSVVTALIEAGPSPDDEVIRTALSHDLAAYKQPRTIIRVAVLPRHANGKSDYRTGMEIAQRQIATGPSADXV

SEQ ID NO: 10483 - protein, 691 aa, Sphingomonas aromaticivorans
TVDALVAVGDDLIRLDPVGVAPSPDRAPVGEAVGAIVVVPLPNGLHARPAARLGEAARAFAAETRIVKNGRAVSTRSPVGLLGLSIQLGDEILVEASGPDASQAVAALVDLIRSGLGEGAEHDAAAEPRASSAGMPPFAPVPDGALRGNLASPGFALGTCHRLDRSEPELPVQGKGKEEERIRLLSAMDHLRSRLAISSEVSPKAAICSAHRALLDDPELEAAALSRIAEGEDAAHAWREACRASAVVLRGSGSARFAERADDVLDLGRQLVTILIGELDETLAFPPGTILLADELLPSQIMQLGAEVTGIALANGGPTSHVAILAASMGIPMLVAIGDALAGVRAGDKAILDADGGFLLPAPGAAALAEAEAEVAARQARRADALASASELCHSRDGARIEVFANLGSLDDARRAVSAGAEGCGLLRTEFLFLERESAPTVAQQAELYAGIADALGGRPLIVRLLDIGGDKPATYLPIAPEANPALGLRGIRVGLAHPDVLEDQLRAILSVERGGALRIMVPMVTGVAEVREVRQRVDRISAELGLAQRVEVGIMVETPAAAATAFLLAPHADFMSIGTNDLTQYVLAMDRDNPAVAGGIDGLHPAVLNLIAQTVRGAQSVGRWTGVCGGLAADRLAVPLLLGLGVTELSVPLRQLPEIKALVRGLSISDCKTLALEALQLESAAEIRAL

SEQ ID NO: 10484 - protein, 698 aa, Sphingomonas aromaticivorans
MSNTRRDFLKSAAIGGVAGTLPASIARALAVPARRTTGTIQDVRHVVILMQENRSFDHYFGTLKGVRGFGDRHPVPMEGGRSVWWQHNGARHLPPFHLDTRTTNALKVPGTPHSFADAQAAWNQGKFGLWPKFKTDYSMGYYRREDIPFQFALAEAFTICDAYHCSVTSGTDPNRIVFWSGAGFDPELCAQGINSRADRSEPDNLRCWIKGALPEPGYTYASNALMWKTIPEVLEDAGVDWRIYQDPNDNWTGAMHGGLAFEGFRKSRPGEPLYEKGMRHHSLEQLARDVQQGTLPAVSWVLPPKPWSEHPSSSSPIEGAEFTARVLDALSANPEVWSGTVFFQTFDENDGLFDHLPPAAPPSYNADGTLAGKATLRLDGHYFDDNEDRHTSRDDVISGHLRPFGLGPRVPMYVVSPWSKGGWVNSEVFDHTSVGQFLEKRFGITVPAISPWHRAVCGDMTSCFDFSRDGDARFPELPDVSNSVATISRHQQQARLLPPREPQGLFQEQGLRRSRALPYRLEVDASIEAGRVTLAFVNSGSVGAVFHVYDRQHLDRIPRRYTVEAGKQLEDVWQFGGDAGFDLWVLGPNGFLRHFMKKAATAGEVPGVRIRTSARQARLDLAFSNPGGESVAVTLGDDAYGFAQTRQVVVPAGGTTRAVWNAERSQDWYDFTITTAGVAIRAAGRIERGIDGVSDPLM

SEQ ID NO: 10485 - protein, 493 aa, Sphingomonas aromaticivorans
RRLDYDQFFAWRDQLVPLLHVRRGDRVAIAMRNRAEWLVAFLAVMKAGGVAVLVNSRGSGPELLAMLEDVDPAVVLADTDRADAVRDAGYKGRVLDLTKPLPEDELTRRAAEPAADAGVADPEDPCAILFTSGTTGRVKGAILSHRNVITGLMSTQMSGMVVLTNMAAQMGTTVEALIGQMPQQASLLVYPLFHVSGLGAGFLSPFVSGGKVVIMRRWDADEAARLIAAEQISMFSAVPTMLWDILHRARTDGASLVSLRNIGSGGQALPVNLVEEVHALCPHAQIGTGYGMTECSGAIAQAVGPDFMRRPAAAGRVLPMVEVRIEGPEGQILAPGEAGEIVVRGAQVMKGYWNRPEETAAVLTGDGWLRTGDVGFVDEDGYVFIVDRKKDMVISGGENIYCAEVERVLGELPGLTECAAFGLPDERLGERLVAVVIAAGNDGIDEAGVIEWVAGRLARYKAPTRVAFATTTLPRNALGKVDKIALRKLWPQL

SEQ ID NO: 10486 - protein, 256 aa, Sphingomonas aromaticivorans
KCALVTGSTSGIGLAYARALAAEGAHIVLNGFGDPAEIEALCRELADASGGRAIFAAGDLTRREGTEAMMATALAEFGAVDILINNAGMQHVAPVEEFPVEKWDAIIALNLTSAFDACRLAIPGMKAKGWGRIIFTASAHSLTASPFKAAYVSAKHGIAGLTKTLALELATHGVTANCISPGYVWTPLVENQIPDTMKARGMTREQVINDVLLTRQPTKQFVQPEDVAALALFLCRHEARNITGANYNMDGGWVAE

SEQ ID NO: 10487 - protein, 479 aa, Sphingomonas aromaticivorans
GLTFDDVLLRPAESDIVPSQADTRTRLTKGIGLNIPILSSAMDTVTEADMAIVMAQLGGIGVLHRNLSIEEQCAAVRAVKRFESGMVVNPITISPDAPLGEAQALMRQHKISGIPVVEASGKLVGILTNRDVRFADNPQQPVRELMTHENLATVKLGSSGDEARRLLHQRRIEKLLVVDDAFHCIGLITVKDIEKAVTFPNATKDAAGRLRVAAATTVGEKGLLRTQALVEAECDVVIIDTAHGHNRDVARAVEAAKKLSNSVQVIAGNVATAEATRSLIDAGADGVKIGIGPGSICTTRIVAGVGVPQLTAVMECAAEAEKSGVPVIADGGLRTSGDAAKALAAGASSVMIGSMLAGTEEAPGETFLYQGRAYKSYRGMGSVGAMARGSADRYFQQDIKDQMKLVPEGIEGQVPYKGPAKDVVHQLVGGIKAAMGYTGSPTIDDLRKRAQFVRITNAGLRESHVHDVTITREAPNYKV

SEQ ID NO: 10488 - protein, 282 aa, Sphingomonas aromaticivorans
CDGTGAQFLFQRPVHPPRRRDPHGPALRIEPMSQSPFRDDVLAGKTAFIAGGTSGINLGIAKRFAELGARVAVLGRNPEKAASAADEIGHDAIWRAADVRDYGAICEAMKSVRDEIGALDIVVSGAAGNFLAPVLGMSANAFKTVVDIDLLGTFNVFRGCHELLNPGASLIAITAGQAEQAMAMQAHACAAKAGINQLVRTLAIEWGPDVRVNGISPGPIADTEGMARLAPDESTRQQHYARIPMKRWGTCYEIAEAAVYLSTPAASYVTGAILDVDGGSSV

SEQ ID NO: 10489 - protein, 375 aa, Sphingomonas aromaticivorans
TERVTMGRPAREAIRDQAEKMGARRVFILASDTLRTKTDEIAAIERELGERHAATFSGIAPHAPRSDVLRAADAARAAGADLIVSVGGGSVTDSAKIVALLLKHDVRSVEAFEPLHVYVDGDGNVINPLAVGPDVRVICVPTTLSGGEFNALSGATDEAVQHKQGYEHRDMAPVMVVLDPALTVYTPEWLWLSTGVRSVDHAVETLASHLSNDFADGLADSALRLLVEGLSRAKADPTDMEARLKCQIGAWQSMISIIGGVPMGASHAIGHILGGTCDVPHGYTSCVMSPYVLAWNAEHDASRQGRILQCLGNTHASASEALDAFIRSLGMPRTLSEVGVGEDRFQQVAEYTMLDIWGRTNPRPVRSPADILEIL

SEQ ID NO: 10490 - protein, 505 aa, Sphingomonas aromaticivorans
FLRFWAEDRPQGVALDGPDRKLTYGELEETTARIAGGLAAMGIAKGDRIAWFGKNSTLYFALFFAAARLGAVMVPIGWRLAPVEATWIAGDAQARMVFLGERLRRPGRCIRGAAGGRSLPDPGRGMALDDGLPAGAFEPAGADDAVLQLYTSGTTGNPKGAVLSNRNLFGLRKQSIGNDQPYTTMTDDEAILVAMPCAHIGGTGLGVMAIGAGLPGIVLAEFEPRAVFDAVEQKGVTRFFIVPAALQMLLNHPDCASVDFSRVKYIIYGASPIPLVLLRECIAMFSAEFIQAYGMTETTGTICMLPPEDHDVNGNQRMRSAGKPLPGVEVRVIDENGRSLGPNEIGEIQTRSSNNMLGYWNLPEATAKTMTPDGWISTGDAGYLDEDGYVYMHDRIKDMIISGGENVYPAQVESAIYGHPDVQEVAVIGVPDEKWGEAVKAVCVPKPGHTIDPQSIIDWTRERLAGFKVPKSVDVIDALPRNPSGKILRRTLREPYWAGFERQVN

SEQ ID NO: 10491 - protein, 708 aa, Sphingomonas aromaticivorans
RSPALDNALRDHQPGAGQTDEATALGNAGEIHQEAAAENDAAAFLTDNFGHRLSDNQNSLRAGMRGPTLIEDFILREKIFHFDHERIPERIVHARGSGAHGVFEVTRAIPDLTRAGLFQKKGQTCPVFVRFSTVAGGAGSIDTPRDVRGFAVKFYTDEGNWDLVGNNIPVFFIQDAMKFPDLVHSVKMEADRGYPQAASAHDTFWDFIGLMPESMHMIMWAMSDRAIPRTLRMMEGFGVHTFRFVNAAGEGRFVKFHWKPVLGMESLIWDEAVKVAGADPDFHRRDLFESIAAGHFPAWDLGVQVFDEEFAASQPYDVLDATKLIPEEDVPVEIVGRMTLNRNVDNFFAETEQVAFLPSNVIPGIDFSNDPLLQGRLFSYLDTQKSRLGTTNFHQIPVNAPKCPFHNMQRDGLMQTLVPTGRANYEPNSLDEAGEDSGPRACPETGFTSFRENGERHDPTEKVRVRADLFADHYSQAALFFHSQTESEQAHIASALVFELSKVALEHVRARVVSRLRNIDETLAQRVADGLAMDLPEKAPAARQPVKMKPSDALSIQKQAKKTFAGRKVGILFAEGSDKATIDKLKAGVEEAGGTVFLVAPKVGGIPVKGGTLKADGKLDGSPSVLFDAVASVLMPEAAAKLAMQGAAVQWFMDAYGHCKTIAHCNGTRIILEKAGVEPEEGVVPNEKLLEVGPVRHFAREPKVRDLA

SEQ ID NO: 10492 - protein, 488 aa, Sphingomonas aromaticivorans
VVSTTDGDVRGTANAGADAFLGIPYAAAPVGANRWREPQAAASWTGVRDASAFGPVCQQGVPSPWGPYTAEFLAMPPMSEDCLTLNVWRPKSAATKKLPVLVFIHGGGFGGGAGSLPIYDGAKLAANGAVVVTINYRVGVLGFMAHPALTAESPLGSSGNYGLLDQIAALKWVRANAARFGGDAGNVTVSGESAGAASVADLMVSPMASGLFDKAIAFSGASMAVDVPPLAKNEMIGADLAAKLGKTSIAQMREVPAEALIEATRYVPGANSGPPPLRFVPNVDGNVVPFDPVRASGPVASPVPLITGFNAAEMIDPSVRTPAQFETAVRGRYGDFADRLLSLYPHATEAEAVASNALLARDRYMAGVLLWARERTRTAQQPVFAYLYDHAYPAVKGGQSWGAFHSSQLPYVFGNIGIGERTFGPADARVVRQWQDRLLAFMRSGNPGKGWPRSRAPARGSWDWATAKAFGPQCPRPNGWRRSAPMPR

SEQ ID NO: 10493 - protein, 406 aa, Sphingomonas aromaticivorans
RCNYRPPKETRHMAGMVRFDWEDALGLEGLLTDDERMIRDAARAFAQDRLQPRVIDAFANEHTDPAIFREMGEQGLLGVTLPEDYGCAGAGYVSYGLVAREVERVDSGYRSMMSVQSSLVMFPIYEYGSEEQRRKYLPRLASGEWIGCFGLTEPDAGSDPGGMRTTARKVDGGYVLSGSKTWISNAPIADVFVIWAKSDAHDGGIRGFVLEKGMKGLSAPKIENKVSLRASITGMVVMDDVFVPDDALLPNVQGLKGPFGCLNRARYGISWGSLGAAEFCFAAARQYGLDRHQFGRPLAATQLFQKKLADMMTDITLGLHASLRVGRLMDEGAFAPEMISIVKRNNVGKALDIARIARDMHGGNGISGEYQVIRHMVNLETVNTYEGTHDVHALILGRAITGIPAF

SEQ ID NO: 10494 - protein, 242 aa, Sphingomonas aromaticivorans
LFDLSGKAAIVTGSTRGIGRAIAEALVAAGARVVISSEDAADTARVAAELGMPGCACDVADDLQLAALVEFSLASLGRLDVLVCNAGITGKAGPFAEIDMDDYARVMAINLRSQVVMCNLALPHIAAGGGGAAILVASLSALRGNGRINAYALAKAGVAQLARNLAVEWGPRAVRVNAVSPGFIATELSGPLLADEGFMARRMSMTPLRRPGTPAEVAGAAVFLASPAGGFVTGHNLVVDGG

SEQ ID NO: 10495 - protein, 398 aa, Sphingomonas aromaticivorans
VEAALADIEQRGDDAVREMSVKFDGWDRDDYRLSQAEIDAAVDSLSPQERKDIEFAQAQVRNFAQIQRESVKDVEVETMPGVVLGHRNVPIQAAGCYVPGGKYPLLASAHMSVITAKVAGVPRVITCAPPFQGKPARAIVAAQAMAGADAIYALGGIQAIGAMAIGTQSIDPVDILVGPGNAFVAEAKRQLFGRVGIDLFAGPTETLIIADEIGCDPEMAATDILGQVEHGPDSPGVLLTNSEKLARETMAEIERLLRILPTADHARKAWETFGEVIVAESYEEMVRIADDIASEHVQVMTADPDYFLNNMTNYGALFLGPRTNVSFGDKVIGTNHTAPTKKAARYTGGLWVGKFLKTCTYQKVLTDEASALVGEYCSRLCALEGFAGHGEQANLRVR

SEQ ID NO: 10496 - protein, 526 aa, Sphingomonas aromaticivorans
  unsure (1)..(526): unsure at all Xaa locations
PXPARPAPERPNIVFIMADDLGYADTSATGSRHIRTPAIDSIGAGGVMLRQGYSSTPICSPTRTALLTGCYAQRFAIGVEEPLGPNAPAGIGVPLDRPTIASVMKALGYRTSLVGKWHLGEPPAHGPLKHGYDHFLGIVEGGADYFVHRMVMSGKPAGVGLAEDDAQTDRTGYLTDIFGDEAVRVIEEGGNQPFFLSLHFTAPHWPWEGREDEKLARALPSSFHYEGGNLAKYREMVETMDQNVAKVLAAIDRSGKADNTVVVFTSDNGGERFSDTWPFVGHKGEVLEGGVRVPLMVRWPRRIKAGSRSEQVMVSMDFLPTLLGMAGGDAARIGRFDGADLSAQLAGAAPVTRTLFWRFKASEQAAVRQGDMKYLRMAGKEYLFRPVAGRAGAGKPRPREPGQGQRDARAVGRLEPGNDALPGRRVLAGRAQEFFRQILRLIDAGGGDGRRWIRGPRDRLAPSGTRRRGDRDRQPGRWRALGRAGDRGRSGQRRRQDRGAXAGLRRADPPCHRSRGRCGSRSGGVA

SEQ ID NO: 10497 - protein, 272 aa, Sphingomonas aromaticivorans
  unsure (1)..(272): unsure at all Xaa locations
RMDGKVAIVTGGAGGIGEATARLLTARGACVVIADIAFERAEALAADLAGAIALPLDLEQEQSVETLVERTVAHFGRLDVLHNNAALLGPEIAQADGDVERMGTALWDRTFAVNVRGTMIACRAALPHLRETRGCIVNTVSNLALQGHLIQAAYSSSKAAVIQMTRAIAASHGKAGVRCNAVAPGMTMTPALREAFPPALRQVVEDETLRDRLGDPRDIAEAIAFLASDAARNVTGQVLVCDGGGASHVPGLAGFRSFFAGEQXDEPVRHRR

SEQ ID NO: 10498 - protein, 501 aa, Sphingomonas aromaticivorans
MGAGHNGLTAAAYMAKAGKKVLVLERKPHFGGGVSTRELLHPGFWHDEHSNVHIMIQGNPMLREDELGLLSRFGLEYIYPDLVHVSIWEDGTVIRSYKDLDRTCEELARVAGPKDAEAYRRFVKMSQTALPMLVSGLYSPPFPLGAFVAMMDQSDEGRFLLDLMQRSALDIVDAYFESDLLKLHIVRMVTENLQMPDELGTGMGAFVMPGIIHTYGCSMPKGGSGQLSRALVRAIEHFGGEVRCNAEVARVIVSGGKAVGLELTDGETFMARDGVIGAIHPHVLRKFVGETPEPGAGAGRARDPVHLLDQSHAHDAEGAARLKVGNDCNAMMTELMDFYSIREMLLEYDKLRRGEVSERLIAGGDNTIFDPSRAPEGAGVFYGVNFAPYDLHPGGSGSWDERKEEVADRALAQYRKFYANLADENITGRLIRSPVDHERDSPASFVRGDIHGCAPFFYQSAGHRPTPDLGSFRVPGVEGLYLVGPFMHPGGGVFGAGRATA

SEQ ID NO: 10499 - protein, 237 aa, Sphingomonas aromaticivorans
GRRALVPGPARGIGLRWPPPLAEPGAAVTLVARSAGEIEAAAAAIGNGAVAATLDVSDLDAVAAFFTAREPFHVLVNNAGTNRPKPMWDVTEADYDAVLDLNLKAAFFVAQACARRMIETGTQGSLIHMGSQMGHVGGPNRSLYCASKWALEGMNKSFALDLATHGIRSNTIAPTFIETPLTQPMFADPAFKASVLSKIKLGRIGRVEDLMGAVLFLASDASALMTGTSLVVDGGWT

SEQ ID NO: 10500 - protein, 256 aa, Sphingomonas aromaticivorans
LKGRSALVTGGGQGVGQGIARALAAEGADVMIAQRGLEAAEAEAVHLRATYGVNAIARQVDVTVRGEVDAMVDACAAAFGRLDILVNNAGGSFPKRLENHTDEDMEGSFLLNYWSAFWSMRAAFPLMKAQKYGRIVNLGSLNGVNAHMFTAAYNASKEAVRALTRTAAVEWGGHGITANVICPSALSPAARDYFDANPEMAQAILGQVPVGRFGESAGDIGPVAVFLAGEASSYMTGNTLYVDGGGHINGVAWRPE

SEQ ID NO: 10501 - protein, 248 aa, Sphingomonas aromaticivorans
MTGKVAIVTGGSDGIGLATARLLAARGATVVICARREDKLEAARAEIAKVGKVEAVKLDVSDEAAFTALVEDVAARHGRLDMLVNNAMSVHYAPIAKLRLDHWRKDFAVNADAVFVGTKAAMKVMAAQEQRGRQRGAIVNIASTCGIRAAPNMASYSASKAAMVHFTAAAAMEGAPLGIRVNAIVPGQVMTAATQEFADRAPEVAARTTGAIPMQRGGEPEELAEAIVFMLSEAASYVTGTALPVDGG

SEQ ID NO: 10502 - protein, 389 aa, Sphingomonas aromaticivorans
MKLGFSAEEEAFRAECADWLQGQMAGEFKDIRGITQLTAMPERRKEWEQQLGEHRWGCIGWPTQWGGRDATLAQQVIFAEEYARAGVPGRINHIGVELAGPTILTFGTEEQKRRFLPDIAAGRTIFCQGFSEPNAGSDLASVRTKGRIEDGHWVVNGQKIWTSLAHIADWIFVVTRTEEGSQGPKGLSFLMMPLDQPGIEVRPIRQINGDAEFNETFFTDARCPADSLIGAPGDGWKIAMGLLAFERGVSTLGQQMGFRNELDEIVAAAKANGRAADPVIRQRIAQAQIGLSLMRYGALRMLSNADHSRIDGAALTYKIQWATWRRNLGELAMDVLGQAGEIAAGDAYEWDVLPNLYLFSRSDTIYGGTNQIQRNLIAERGLGLPREPR

SEQ ID NO: 10503 - protein, 241 aa, Sphingomonas aromaticivorans
MAGVLEGKVVAVTGAGRGIGREIALLCAREGAAVVVNDPGVAQGGDGSDEGPAQTTVNDIVAAGGRAWANLASVADPMGATSIVEDAVQRFGRIDAVVNNAGILRDTIWHKMSYEDWTSVIDVNLTGAFNVSKAATPYFREQSSGSFIHFTSTSGLIGNLGQANYSAAKLGLVAMSQSIALDMARWGVRSNCIAPFAWSRMTASIPAETPEQKQRVERMKTMSADKIAPLVAYLASDLSQD

SEQ ID NO: 10504 - protein, 371 aa, Sphingomonas aromaticivorans
IEQLRRYVRERLIPAEDEVIAQDRIPDDILAEMREMGLFGITIPEEFGGAGMNISQYIETVKQLSYASPAFRSTISINIGMTGSAIKNFGTPEQKAEWLPRIASGEIACFGLTEPGSGSDSAAMQTMAVRDGNGYRLNGTKRYITNSPSAKIGLIMARTSKEALPRNAHVSAFIVDMTAPGISIGKPDKKMGQSGAQIADVIMEDVHVPGSALVGGEEGRGFQIAMQSLDNGRLSVAGMGVGMGRRALDTAIRYATERKAFGEAIANFQLIQAMLADSEAELYAAECMIADACARADRGESVQRKAAAAKLFSSEACGRVVDRCVQVYGGAGYLAEYPAERFFRDARILRIYEGTSQIMQLQIAKHLLREF

SEQ ID NO: 10505 - protein, 394 aa, Sphingomonas aromaticivorans
IVAPIRTAVGKFGGSLSPLTAGQLGATILTALMDRTRIDPARVDDVIFAQGYGNGEAPCISHWSWLLAGLPEEVPGYQLDRRCGSGLQSIVNAAMMVQTGVSDVVVAGGVESMSNVEHYTTDVRKGVRAGSLTLHDRLTRGRVMSQPIERYGVISGMIETAENLAKDFAITREACDAYAVRSHQRAAAAWANGLFDDELVPVSIPQKKGDPVLFAHDEGYRADASMETLGKLRPLEGGVVTAGNASQQNDAAAACLVVAEDKLAELGLEPIAWFHSWAAAGCDPSRMGYGPVPATERLFARNGLTWNDIDLIELNEAFAPQVLACLKGWGWSDDDSRHEMLNVNGSGISLGHPIGATGGRILANLTRELKRRGGRYGLETMCIGGGQGIAAVFE

SEQ ID NO: 10506 - protein, 382 aa, Sphingomonas aromaticivorans
SEDHGEIREGVRKLCAQFPGEYWRKLDEKREYPTDFVNALTEAGYLSVLIPEEYGGSGLGLGAAAAILETIQSEGGNGGACHAQMYIMGTILRHGSEEQKRAYLPRIAAGTLRLQAFGVTEPTSGTDTTSLRTFARREGDEYVVNGQKIWTSRAEHSDLMLLLARTTAREDVAKKTDGLSVFIVDMRDVVGKSLTIRPIRTMMNHATTEVFFDNMRIPAANLLGEEGKGFRYILSGMNAERVLIAAECVGDAKWFTRRSVEYAGERKVFGRAIGANQGVAFPIAKAYANMRAAELMVREAARMYEAGLPMGAEANMAKMLAADASWEAGNACVQTHGGFGFAEEYDIERKLRETRLYQVAPISTNLILSFLAEHVLGLPRSY

SEQ ID NO: 10507 - protein, 311 aa, Sphingomonas aromaticivorans
VSQALKHFLNLTDAGGDAIAAMLNDALDRKSARAGQPKGKADADAPLGGRVLAMVFEKNSTRTRVSFDIAMRQLGGSALILDAGTTQLGRGETIADTARVLSRMADAIMLRTDDHAKVEELARHATVPVINGLTDLSHPCQIMADLLTVIEHGKALPGLEVAWLGDGNNVLNSIVEAAGLMKFNVRIGVPEGYESDAGMIEAAVLAGAGIRVIRDPVEAVRGADVVVTDTWISMGQAHAEAKLAAMAPYQVNDALMAHAKPDAVFLHCLPAHRGEEVTDAVIDGPRSVVWDEAENRIHAQKSVLRWVFGQI

SEQ ID NO: 10508 - protein, 383 aa, Sphingomonas aromaticivorans
LMPVYPRCGVRPVRGEHCHLISEDGTRYLDFASGIAVNLLGHSNEHLIGAIQKQAATLMHVSNLYGSPQGEHLAQRLVDLTFADTVFFTNSGAEAVECAIKTARAYHSSVGNDHKYELITFKNAFHGRTMATISASKQEKMHKGFLPLLEGFKYVDFDDLEGAKAAMGPNTAGFLVEPIQGEGGIRDASDEFLKGLRALCDEHDLVLIFDEVQCGVARTGTLYAYEQYGITPDVMATAKGIGGGFPIGACLATEKAARGMVAGTHGSTYGGNPLAMAAGEAVLDVVANEEFLGEVRAKGERLRGRIEQFIGNYPDLFIGVRGRGLMLGLMMKVEPRPFVAHMRDNHQLLTVSAGDNTVRVIPPLVIDDSHIDEFMERLSAAAA

SEQ ID NO: 10509 - protein, 477 aa, Sphingomonas aromaticivorans
LERSDFLTGQPLVDGTEICAGSTYAVTNPATGKTLANVVKLGAAQTRRAIESNSRALIDWRKRPAQERARLLHDWLALVRLHRHDLGLLMTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGV

SEQ ID NO: 10510 - protein, 473 aa, Sphingomonas aromaticivorans
MTQIEHWIGGTAVAATGGAYFDDLNPVDDSVYSRVPAGTAEDVNRAVENAHQAYLQHRDLPAAVREGWIAKAAEIMERDTAKFADVLVDEIGSPIAKAGFETRFAVSFLRAAIGVPRRIRGETIPSDTPGRFSMSLRQPVGVVAGITPFNVPLIKGIKQSAMALATGNAFVLLPSEAAPMIADLLAKLWKEAGVPDGLFNVVYGNGAEIGDVLTGHPKVASITFTGSSRVGKHIAEIAARNLKKYTLELGGKSPLVICADADLDKAVNAALFSIFMYQGQVCMGASRIYVERSIFDQFTKAFAAATGRANSGDLRDPTTMLGPIISERQRDRVRRHIDDARSKGAAVLAGGEWSGNSCAATILSGVTAEMTVFEEETFGPVTSLFPFDTLEEALELANNTEYGLSASIFTRDLDKALAFAQRAEAGMVHINAPTLHDEPHVPFGGTKASGFGREGTEADLEIMTEWKWVTIQS

SEQ ID NO: 10511 - protein, 504 aa, Sphingomonas aromaticivorans
MFGRVKPLDAILATAEKKSLHRSLGPVQLTLLGVGAIIGTGIFVLTAAAAQKAGPGMMWSFVIAGFVCAVAALCYSELASMVPVSGSAYTYSYAVVGEMLAWMVGWALILEYAVAASAVSVGWSGYFMGLLKSLTGFELPAMLQAGPTWTMNGLLPHADFSTGLINVPAIVVALLVTWLLMLGTKESATFNAILVAIKVAALTMFIVLTLPAIEREHFAPFAPNGWFGPAGTTGMGIVGAASSIFFAYVGFDAVSTAAEETKNPQRNVPIGLIGSLAICTVFYLLVAAGAIGSIGAQPTALGVAPGSAEFTQQCAALLASGQEPLVCSNEALAHVLRAINYTYAGDLIGLAANLALPSVILMMLYGQTRIFFVMARDGLLPEKLATVHPKWKTPHIVTAMTGVFVAIAAALLPVGQLADISNSGTLFAFFMVAIAVMLLRARDPNRVRPFRTPAVWVVGPIAAIGCIFLYWNLPFEAKMVLPVWGAIGLVFYFAYGYRKSHVGQ

SEQ ID NO: 10512 - protein, 523 aa, Sphingomonas aromaticivorans
FDYVIVGAGSAGCVLANRLSADPDVSVLVLEAGGRDTSPFIHMPAGFFQLLQSGSNAWHYQTAPQEHLNGRVLADARGKVLGGSSSINGMCYSRGSPEIFDHWAELGNDGWSYKDVLPWFRKAEGNPGADPYFHGQDGPLSVTHASVTNPAQLAWLRAAQEAGFPYSDDHNGAAPEGFGPGEHTIRNGRRISTAVAYLKPAMRRRNLVVRTRAHATRVLLEGARATGVEYRQGRALQKVHASREVILCGGTFQSPQLLMLSGIGDGAHLQPLGIRTVVDLKGVGRNLHDHIGTQVQMTCPEPVSDFSVATNPLRMALAGLQYLVARKGPLARSGTDVVAYLRSGAPGHDELDLKFYFIPLLFNEGGGIARQHGFSNLVILTRPESRGELRLRSANPVDQPLIDSNYLAEGRDRDALRRGVGIVRRIFAQPAFARFRGVECTPGADIADDVALDGFFRETCNVNYEAVGTCRMGDDELAVVDPGLRVRGVEGLRVVDGSVMPRITTGDPNATIVMIAEKAAQMI

SEQ ID NO: 10513 - protein, 393 aa, Sphingomonas aromaticivorans
MANVTVIGAQWGDEGKGKIVDWLASRADAVVRFQGGHNAGHTLVVGEQVYKLSLLPSGIVTGTLSIIGNGVVLDPWALKAEIEKLTGQGVEINAENFAIADNCPLILPLHRDLDGLREQAAGAGKIGTTGRGIGPAYEDKVGRRAIRVCDLAHLDALDAQLDRLCAHHDALRAGFGQPPVDRAALIEELREIAPYVLQFAQPVWKRLNTVRKAGARILFEGAQGVLLDVDHGTYPFVTSSNTVSGTAASGSGLGPAQTGFVLGIVKAYTTRVGSGPFPTELEDETGQRLGERGHEFGTVTGRKRRCGWFDAVLVRQSCAISGVTGIALTKLDVLDGFEKVKICTGYRLRGKVLDYFPSHAADQAEVEPIYEEMDGWSGTTAGARSWADLPAQA

SEQ ID NO: 10514 - protein, 907 aa, Sphingomonas aromaticivorans
  unsure (1)..(907): unsure at all Xaa locations
RPVSNSSALVAAKPVPLIVPVMRMAPPGICVCKSPVAKMIRPAVPVAMLFPAVPPAVTLRLPMSMSVALPATSVAATSRRPVDIKPISVLPSAXPLPNSPSPINAGELAVDMRSTEPDSSVLRPERICPPVGEVAVPLSMIEISAERIVIELPPHCSWTVTSPPEVTSTEPKPTRLRPDIAPVEALRTLPPTAVLTVVVPPLATGAAANNALXSIAPGVAVEASIEELARMMRPVALVTALVTGSITSPPSTCWTAMLPPESSATSRAKIVPTVKPNAPLAVTSDPVFADARFSVPLDNSSILPPLERLAKVAFPPLVKPMEPGAEMAAVVTVPFVAPRIVFAVEVPLIPIAPLVATAGAAKTSSLSNTVAVWPSAVIETSAISTRLTALRLASVMLLPPSTSMSYPXRAPVLIVPPAEMPMSEPHXPPPRVTLPPAVRAIVLRSPFAPVGVPVPALRLPVEMLPCERAVIEVCATRLPVAMAAIASRSMDSPALASPIVMEPPAVRSMNPPAVSAPRSMRPGARMDKPASVFRLAXATISWPDERLIPFVPVSKPVFVGALAPSTQLPAPITTLSAVRNDWSSVSENALGVSKKSAPLMLAVLFRSEMKSAGAPAATLSADALSERLAAFSVPLTMSRSTASPAIDAIPAVEPVPPTASALKLRSPAVRLPVCAGWLKRLVTVSDAPDTWFVAPALPIVASPPAPTTGPEPPLPPMALTKALVVAPVTVMEAPRTNTVTPPPCAAPPAPPLPLVALPCPPAPPLPPEAPAVRLIDPXRADPVLIVPVSKPLAIPSCSSPPIAAPPSPPSPPRPPPPPDAEAXPVTDPTSIRPLPAVPKIWIEPPWAAPPAPPMSPGIAASLPKPPKADASALSELMVTRLAPSTALLAKIWISPPVALPPAPPESP

SEQ ID NO: 10515 - protein, 381 aa, Sphingomonas aromaticivorans
AGYKDWGRCDLTYVELSQGTAVAGVFTRNVCCSSEVELGRANVARGRARALVVNAGNSNAFTGYRGREAVEQIMTQVAANLGCAQEEVFVSSTGVIGVPLPKDKARAGIEAALAADECTWEEAARTIGTTDTFPKGASAKAQLGAVQVHFSAIIKGSGMIAPDMATMLGYVFTDAAVSPEFLQECLSAANRRTFSCITVDSDTSTSDTVLAFATGKAGNEPLTSFDSPGADAFAAALEDICRQLSHLVVKDGEGAQKFIAVAVSGAVSDESARKVGLAIANSPLVKTAIAGEDANWGRVVMAVGKAGQPADRDRLSIGFGGTWAARDGQPLADYDEAPVAAHLKGREISIEVDLGLGDGRATVWTCDLTHGYISINADYRS

SEQ ID NO: 10516 - protein, 407 aa, Sphingomonas aromaticivorans
TDMAKIKVKNPVVEIDGDEMTRIIWEWIRERLILPYLDIDLKYYDLSVQKRDETNDQITIDSANAIKQYGVGVKCATITPDEARVEEFNLKSMWKSPNGTIRNILGGVVFREPIVIQNVPRLVPGWTDPIVVGRHAFGDQYRATDFVVPGPGKLRLVWEGDNGETIDREVFNYPSGGVAMAMYNLDDSIRDFARASFNYGLGLGWPVYLSTKNTILKAYDGRFKDLFQEVFDTEGFKEKFAAAGIVYEHRLIDDMVASALKWSGKFVWACKNYDGDVQSDTVAQGFGSLGLMTSVLMTPDGKTVEAEAAHGTVTRHYRQHQQGKQTSTNPIASIFAWTRGLIYRGKFDETPEVVKFAETLERVCIETVESGKMTKDLALLIGPDQAWMTTEKFFEAIVEKLENEMKN

SEQ ID NO: 10517 - protein, 465 aa, Sphingomonas aromaticivorans
  unsure (1)..(465): unsure at all Xaa locations
LLGPKGLTTSAEDMAPWLTDWRGRYTGKALALASPASTAEVSALVRLCAEHGVPIVPQGGNSGMSGGATPFESGTELVLSLRRMNRILALDPAARTATCEAGVILQVLHEAAEKEGLRFPLSLGGKGSATVGGLVSTNAGGTQVLRHGSMRALVLGLEGVLADGSVLNQLTPLKKDNRGFDLKQVLIGSEGTLGIVTAATLKLEPGIAGRSVMWAGTASLHDARALLLLAGDMAGSLLEGFEVLPQHSLEAVLAYLPDARAPLAGPHEWHALIELVAGDAETAARLPEISERLLTEAFERGLVADATIAASEDQAERLWLIRETISPAERAIGPAMQHDISVPVEKMPAFVEAAVPQLEADWPGTQAVCFGHLGDGNVHFHVIAPPGSERAAWEAGDGKAISAQVHDMVTAWGGSISAEHGIGRLKRDELDRLGDPVMLATMRAIKRALDPKGLLNPGKLVXRGL

SEQ ID NO: 10518 - protein, 448 aa, Sphingomonas aromaticivorans
MKFADLGLSDELLKSVLDAGYDEPTPIQAQAIPAVLMMKDIIGIAQTGTGKTAGFVLPMIDILAHGRRRALMPRSLILEPTRELAAQVAENFEKYGKNHDLKMALLIGGVQMGDQVKALQEGVDVLIATPGRLMDLFERGKILLTGCEMLVIDEADRMLDMGFIPDIENICSKLPTTRQTLLFSATMPPPIKKLADKFLSNPKSIEVARPAATNTNIAQFKVRSTTRQKREVLRHLLRTDNVSTAIIFANRKTTVRELAKSLQRHGFAAGEIHGDMDQSARNAELQKFKDGEISILCASDVAARGLDVKGVSHVFNFDTPWHPDDYVHRVGRTGRGGATGRAFTLVSDEDSESIENVEKLQGTKIPEFKVELPGKEERKPRESGAERDEEPKRGSRRERPAARGTQAPRRTRISPRTRSPSGTRSPRRTAPRREPTPYRDQSEPPSKP

SEQ ID NO: 10519 - protein, 459 aa, Sphingomonas aromaticivorans
MSRLIVISNRVSAGGGAQGGLAVALSAALREHGGIWFGWSGNETSEFTGHINMERVDGVTTATVDLEEQDIEEYYDGYANRTLWPLFHYRIDLAEYERSFADGYKRANERFAETALPLIEPDDLVWVQDYHMFPLGKELRARGVENRIGFFLHIPWPPRRLLATLPEARALTESLLAYDLIGFHTEEWLQSFCDYVSHELGGTIGDDGWLSVGERRVRLIACPVGIDAKEFAALAASEKAKETYERVRVSAVGRTMIVGVDRLDYSKGLEERFLGYERFLVEHPEERKEVTLLQIAPPSRGTVDSYQRIRSTLEGLAGRINGAHAGLDWVPIRYVNQGYTRDMLAGVYRASKVGLVTPLRDGMNLVAKEYVAAQDPGDPGVLILSRFAGAAEQMPEALLVNPHSAEEISDALSRAITMPGEERIRRWRTLMNGVEQHDVTWWSKHFTDALKDCHEHACG

SEQ ID NO: 10520 - protein, 509 aa, Sphingomonas aromaticivorans
TYGDAARLSVELAGGLKARGIKKGERVGLIMANDPLTVPLLFAIWRAGAIAVPLNTLYRPDEIRFALAEAGCALLIAMDRFASRNFAQELEEGLPGWQAGACHDLPELRGGLIFDRAAPGRLVEKLSGQGGGAEDHERVEGGDTALILFTSGTTGSPKGVEISHDNLLRAMYAGAYHQAFEDGRRAVFSLPLYHGFGLVVGLLSGMVSGGAIIPLLRFDPHQILAATERHRATYLMGVPTMTIALLEQAKRQHYDLSSLNAIHSAAAPTPSWVWEDIRATFGCEEIITSYGQTEVTATVICTAPGDSIETVSETQGRIVEAGIAGMPDQGGRIAEFKIIDPETGADLPWGASGELCCRSPMNSKGYFRRPKATAALFLEGGWIRMGDLGQFRPDGNLFLTGRTKELYKSKGELVSPKELEQILTANPGVSQAFFIGMPDDQFGECGCAWVVRAEGSGICEGEVMDYLRERIPAYKMPREVWFIEDEALPKTGTGKVQKAELRNMALAML

SEQ ID NO: 10521 - protein, 310 aa, Sphingomonas aromaticivorans
MEGDRWRCLWDAKAILGEGTIWDERDGCIYWVDIEAPSVNWFNLETGSKGTWVPPKWVSAIAPRSSGGFIASSADGFVHIDPHADIYHPLVHPISDPRIARLNDGVVDRSGRYWSGSCDCSQWDESTTAEDKESTLGNLDARNTGELYRLAADGTVSSQEQNIVTANGPAFSPDGKTAYVNDSMPLVSWAYDVDADGNLRNRRDFLRFKPEDGYPDGMAVDVEGCIWMAFYESWMLRRFAPDGTLLEDRQLPVRRGLRPAFGGTDHSRLFLITGSQGYGAEQFAQQPLAGGLFEILDPPAAGVPNVPFAG

SEQ ID NO: 10522 - protein, 259 aa, Sphingomonas aromaticivorans
  unsure (1)..(259): unsure at all Xaa locations
LMGRLNGKVAIITGAARGMGESHARTFVREGARVVLTDLSEEAGKALVAELGDNAVFLKQDVTDPQSWNAVVETAVREFGTIDILVNNAGILGPMAPTDSLDDEGYRKVCAVNQDSVFFGMRAVLPVMVKARRGSIVNISSIAGMAANYGFPSLAYVASKFAVRGMTKATAVEFGKHNIRVNSVHPGFIQTPMMVEATDEVGGEALAQIPLGRIADPSEVSNLVLFLASDESSYITGSEHLVDAGMLAHXGRRTMASVE

SEQ ID NO: 10523 - protein, 320 aa, Sphingomonas aromaticivorans
MARKKIALIGAGNIGGTLAHLAAQKELGDIVLFDVVEGVPQGKALDLSQCGPVEGFDANIIGTNDYKGIAGADVIIVTAGVARKPGMSRDDLLGINLKVMKAVGEGIRDNAPDAFVICITNPLDAMVWALREFSGLPANKVVGMAGVLDSARFSTFLAWEFGVSIRDVNTFVLGGHGDTMVPVTQYSTVNGIPVPDLVKMGLSTQEKIDAIVQRTRSGGGEIVGLLKTGSAFYAPAASGIAMAEAYLNDQKRILPCAAYVDGEYGVNGLYVGVPVLIGANGVEKVIEIELDDEAKGNLQVSVDAVKELLEACKGIDPSLA

SEQ ID NO: 10524 - protein, 294 aa, Sphingomonas aromaticivorans
MSILVDKNTKVITQGMTGATGTFHTEQALAYGTQMVGGVTPGKGGTTHIGLPNFNTVAEAKAATGATASCIYVPPPFAADSILEAIDAEMELIVCITEGIPVLDMVKVKRALSGSKSRLIGPNCPGVLTPNECKIGIMPGSIFKKGSVGVVSRSGTLTYEAVFQTSNIGLGQTTAVGIGGDPVNGTNFIDVLELFLADDETKSIIMIGEIGGSAEEEAAQFLKDEAKRGRKKPMVGFIAGRTAPPGRRMGHAGAIVSGGQGGAEDKIAAMEEAGIRVSPSPSLLGETLAEVLKE

SEQ ID NO: 10525 - protein, 917 aa, Sphingomonas aromaticivorans
GPSWQSKRWPITDAAAGDDLTQAMDPMALRLVIQKSAKKGGAPLDEAALQQAAMDAIRAMTLIRTYRVRGHLAADLDPLGLARQKLPADLSPEYYGFTAADMTRKVYLGGALGLEWATVNELVAILRANYCGHVGFEYMHISDVEERRFIQDRIEGGDKSIDFTPNGKKAILAAVVRGEQYEKFLGKKYVGTKRFGLDGGESMIPALEALIKYGGQLGVREIVYGMAHRGRLNVLANVMAKPYRVIFHEFSGGSANPEDVGGSGDVKYHLGTSTDREFDGIKVHMSLVPNPSHLETVDPVVLGKVRAQQVFRDDIGDDVGPDARHKQVLPVLIHGDAAFAGQGIVWECFGLSGVKGYNTGGCIHFIINNQIGFTTSPQFSRGSPYPSDVAKGVQAPIIHVNGDDPEAVTFACKLAIDYRQKFGRDIVVDMWCYRRFGHNEGDEPSFTQPLMYAKIRQHPGVSDIYAKRLVAEGVIDANHKGEVESHFTATLETEFEASKGYKANEADWFGGRWSGLNKPADPVTARRNVATGIDQKMFDSLGRTLTTVPEDLTVHKTLGRVIDAKREMFTSGQGFDWATGEALAFGSLVMEGYGVRLSGQDCGRGTFSQRHAVWVDQKDERKYVPLTTLPHGSFEVLDSPLSEYGVLGFEYGYASADPKSLVLWEGQFGDFANGAQIVIDQYIAASEAKWLRANGLVMLLPHGYEGQGPEHSSARLERYLQLCAEDNLQVCNITTPANYFHVLRRQMHRPFRKPLIIMTPKSLLRHPMAKSVASDFIGEGHFMRILSDTNGAADKDTRRVVLCSGKVAYDLIEARNAAELADVQVIRLEQLYPFPGEPLALRLSRMPNLEEVVWCQEEPKNNGSWFFVEPLIEESLKAAKSKVARPRYAGRHASASPATGLASRHASEQGALVADAL

SEQ ID NO: 10526 - protein, 405 aa, Sphingomonas aromaticivorans
EVKVPTLGESVSEATVGQWLKKPGEAVALDEPIVSLETDKVAVEVPAPAAGVLGALVANEGDTVAVGALLALIEDGVAAAGAQAPAPRTEAPVPPASASEAPAAPAGDAAVLSPAVRRAVLEYGIDPSTVKGTGKDGRLTKEDVMAAAAAKQAAPAAAVSAQAATPAAAPAGGRNEERVKMTRLRQTIAKRLKSAQETAALLTTFNDVDMSAVMEARAKYKDVFEKKHGVKLGLMSFFAKASVLALKDIPSVNAQIQGDEIVYFDYVDISVAVSAPNGLVVPVVRDVDKMSFADIEKSIADYGKKARDGALTMADMAGGTFTISNGGVFGGLMSTPIINPPQSAVLGLHRIEDRPVVRNGEIVIRPMMYIALSYDHRIIDGREAVTALKTIKEAIEDPTRLLIDL

SEQ ID NO: 10527 - protein, 226 aa, Sphingomonas aromaticivorans
LHEATLFLDLDGTLFELVDNPEDVRADHRTQALIGQLLQHMDGRVAVVSGRSLAQIDDMLGDAAGTLWISGSHGCEYRWDGVIQSPSRPAALDDVAASFRNFAQNQPGVLVEEKSLGVALHYRTAPEAGASALALAQEMAGLHDLYLQHGKSMVELRAGSENKGSAILTMMAHPGLAGTTPVFAGDDVTDEPGFEAVLELGGHAILVGEPRPTLATFRLRSPEELR

SEQ ID NO: 10528 - protein, 241 aa, Sphingomonas aromaticivorans
MTRPLALVTGGWRRIGGAIARKLASEGWDLALHAHHDRSFDAEFKAQLEWLGATVFPVSGDLDDRDFPARLLAEVVGAAGRSPELLVNSASLFHDDRVETITPEELEQHFRVNLFAPLLLTRAFAEALGDRDGSVVNILDQRVLNPVPDQISYTISKQALHASVRTLARAMAPRVRVNGVAPGLILPTADYDAEQWRRLEEIMPLRRLPGADEIADAVHFLASARSVTGQTLFVDAGASLE

SEQ ID NO: 10529 - protein, 607 aa, Sphingomonas aromaticivorans
MCGIIGIVGKEQVADRLVDGLRRMEYRGYDSAGVCTVEGGRLIRRRAEGKLNNLVAELVRNPASGLIGIAHTRWATHGAPTTSNAHPHATDEVALVHNGIIENFKPLREALIARGRRFESETDTEVIAHLVSEQVEAGLSPQDAVKAVLPQLRGAFAIAVAFRSHDDMLIGARLGSPLVVGYGEGETYLGSDAIALAPLTQRIAYLEEGDWVVVKREGAQIFDAENKPVTRPIVASGATAAAIEKGNYRHFMQKEIFEQPAVVAQTLRSYLRRVEQTVALPQIDFDLASINRVTIVACGTSYYAGMVAKYWFEQFARLPVDIDVASEFRYRDPVLEPGGLALFISQSGETADTLAALRHCKAAGQTIAVVVNVPTSSMAREADLLLPTHAGPEIGVASTKAFTCQLAVLAALAAHLAVKRGRLTREEEAAIVEQLVETPAALNAALSHDEEIAGMAHLIAPARDVLYLGRGPDYPLALEGALKLKEISYIHAEGYASGEMKHGPIALIDEAVPVIVLAPSGPLFEKTVSNMQEVRARGGKIVLISDAEGLAEAGEGCLATIEMPKVHPLIAPLVYAVPVQLLAYHVAVAKGTDVDQPRNLAKSVTVE

SEQ ID NO: 10530 - protein, 215 aa, Sphingomonas aromaticivorans
PYAIVGFDLDGTLLDTSRDLGTALNHALALAGRPPVLLEEVTRHIGGGAAQMLRSALTESGGVDEEAFPRLQAELIAFYASNIAHHTTLFPGGEAMLDALDARGVKVAIATNKKESLAVRLFEELGMTHRFATIIGGDTLGPGTAKPRPDMLHAMVERCGGGPAAFVGDTTFDVGAARAAGLPVVAVRFGFNDLPADELNADAVIDHFDELVPAL

SEQ ID NO: 10531 - protein, 433 aa, Sphingomonas aromaticivorans
DIARVFALQQAHMWEAKASTAAERKEKLARLKAAVEAHADDIVAAVLEDTRKPVGEIRVTEVLNVTANIQRNIDNLDEWMKPVEVATSLNPADRAQIIHEARGVCLILGPWNFPLGLALGPVAAAIAAGNTCIVKLTDLCPATARVASVIVREAFDEKDVALFEGDVSVATALLDLPFNHVFFTGSPRVGKIVMAAAAKHLTSVTLELGGKSPVIVDDSADIDQVAAQLAAAKQFNGGQACISPDYVFVKEDKKAALVEGFRANVQKNLYDDAGNLKKDSIAQVVNKANFDRVKAMFDDAVAKGATVAAGGTFEADDLTIHPTMLTGVTPQMTILQDEIFAPVIPVMTYDTLDQAIGYIEARDKPLALYVYSKDEANVEKVLARTSSGGVTVNGVFSHYLENNLPFGGVNTSGMGSYHGVFGFKCFSHERAVY

SEQ ID NO: 10532 - protein, 394 aa, Sphingomonas aromaticivorans
KKVVLAYSGGLDTSVILKWLQVTYNCEVVTFTADLGQGEELEPARAKAKLMGVPDHHIYIDDLREEFVRDFVFPMMRANARYEGDYLLGTSIARPLISKRLIEIARETGADAVAHGATGKGNDQVRFELSAYALEPGIKVIAPWREWDLTSRTALIAWAEAHQIPVPKDKRGESPFSTDANLLHTSSEGKVLEDPWQETPDYVYSRTVNPEDAPDTPEYITIDFEKGDGVALNGEAMSPATLLAALNDLGRKHGIGRLDLVENRFVGMKSRGMYETPGGEIYARAHRGIESITLDRGAAHLKDELMPKYAELIYNGFWFSPEREMLQAAIDHSQARVNGTVRLKLYKGSASVVGRKSPDSLYSERHVTFEDDAGAYDQKDAAGFIKLNALRLRL

SEQ ID NO: 10533 - protein, 233 aa, Sphingomonas aromaticivorans
EASAVPSEASGGPRLRAEPDLVIDVRGLTKRFGGRTVVDEVSLQVARGSICGFLGPNGSGKTTTLRMICGLLIPDAGEGEVLGLDLRRQRGAIKGRVGYMTQKFGLFSDLTIAENLEFFARVHGLDRRRERVAEALEGLGLATRSDQLAGKLSGGWKQRLALAAAVLHEPEILLLDEPTAGVDPQARREFWDQIHDLAQGGMTVLVSTHYMDEAERCHEIAYIAYGRMLARGT

SEQ ID NO: 10534 - protein, 316 aa, Sphingomonas aromaticivorans
VVGAGAWGTALAQMLSSDGREVLLWARESEVVREINEDRRNGPFLPSACLNPTITATADLADMARIPVLLLVTPAQHLASVLGGIGRDGGDVVLCSKGIEAGTGRLMADVARDAAPDASIAVLSGPTFAHEVADGLPTAVTLACAGGEEQWLRLSTAIARPTFRPYYSDDVTGAEIGGAVKNVLAIACGVVEGLRLGQNARAALISRGFAEMQRFGLALGARPKTLSGLSGLGDLVLTCSSTSSRNFSLGKALGEGASATAVMADRATVAEGAFTAPVLADLARGRGISMPIVEAVVTLLEGAAPAREVVAGLLSR

SEQ ID NO: 10535 - protein, 299 aa, Sphingomonas aromaticivorans
PQRPLKLGTRRSPLAMAQAEEARARLCAAHGWAESQVELVPVTASGDKIQDRPLADIGGKALWTKELDAWLVSGEIDFAVHSMKDVETIRPENFAIAAVLPRADVRDVLIGAASIHAIPPGARVGTSAPRRAAQMLHARPDLTVVSFRGNVATRLAKLQAGEADVTLLAAAGLGRLGETGVGHPLSEYEWLPAPAQGAIGIECLASRADLCAWLGAIDDKPTHHAIRAERALLLALGGNCHSPIAVLTTHHESSLTLRAALFSPDGAERVEAHETFAAGDDAGPAHLAHRLLGEAPDAI

SEQ ID NO: 10536 - protein, 251 aa, Sphingomonas aromaticivorans
SLEGRIALITGASSGLGAHFARLFAAAGAAVVVGARRVERVAALADEINAGGGKALAVALDVTDEASIIAAFDAAEAALGVPDVVVANAGIVEAGRSVDLPAEAMRRVVDTNFNGVYLTAREGARRMIAAGSRQSEKGRIILTGSITAQMTATGDAAYAATKLAVQHLGRQFAREWARLGINVNVIQPGYIRTEIDGEWFDTEGGKAQIASWPRKRLTEVSALDDMMLFFASDASRQVTGTFISVDDGQSL

SEQ ID NO: 10537 - protein, 378 aa, Sphingomonas aromaticivorans
AINLPRVIRAGGGALAELPDAMAQCGLSRPFVVTDAFLVQSGMVARMLEVLDGAGIAATVFDATVPDPTVAVVEQALGALREAECDCVIGFGGGSPIDTSKAIAALALEPRAVQSMKAPATTDVPGLPIIAVPTTAGTGSEATKFTIVTDEATSEKMLCAGLAFLPTIAIVDFELTMGKPARLTADTGIDSLTHAIEAYVSKKANPFSDAMAISAMKLIAPNIRTACAEPGNRAAREAMMIGAHHAGIAFSNASVALVHGMSRPIGAFFHVPHGLSNAMLLPAITAFSAPSALPRYADCARAMGVALESEGDQSAVARLLDELAALNADLSVPTPQSHGISADRWFEVVPEMARQAIASGSPGNNPRVPDAAEIERLY

SEQ ID NO: 10538 - protein, 252 aa, Sphingomonas aromaticivorans
GSTRDFTGKTAFITGGVNGIGFGIARAFALAGMDLILTYRKDEDRDDAARWLADNGLAPARFVRLDVTDRARFAQVAAEVGKVHVLVNNAGVSVFGPTDEASYDDYDWIMGVNFGGVVNGLVSFLPGMKAHGEGGHVVNVASMAAYLSGPQAGIYTASKFAVRGLTECLRYNLAPHGIGVSLMCPGLTRTNAWTSALKRPDSFAESGFKPADATELEQFGTAFELGMDPFEVGQKTLAGMIENRGLILTHGE

SEQ ID NO: 10539 - protein, 1140 aa, Sphingomonas aromaticivorans
FAAFAPRHSVPSDLRRAITAATRRAERECMVMLLPEATLPQATRASAQALARKLVEALRAKPRGNGVEQLVQEYALSTHEGVALMCLAEALLRIPDNDTRDDLIRDKIAGGDWLAHLGGDRSLFVNAATWGLVVTGKLASSVDDTGLGAALTRLIARAGEPVIRRGVDLAMRMMGEQFVTGETIDEALKRARPLEDRGFRYSYDMLGEAAMTASDAARYHADYQAAIHAIGKAAARRGVYEGPGISIKLSALHPRYARAQQDRVFAELLPRLKALAYLALRYDIGLNIDAEEADRLELSLDLLEELAMDPELAGWNGLGFVVQAYGKRCPFVIDWIVDLARRSGRRIMVRLVKGAYWDAEIKRAQVDGQSGFPVYTRKAHTDVAYIACARRLLAATDVVFPQFATHNAQTLATIHEMAGPDFAVGRYEFQCLHGMGEPLYDEVVGKDKLDRPCRIYAPVGTHETLLAYLVRRLLENGANSSFVNRIANPDVPVDEIVADPVAQVAADADPGAPHPLIALPAALYPDRRNSSGLDLADESTLAALTDRFQAISAHSRHAHPSADLPHVNPRPVLNPANHRDVVGHVSEAAPAAAGMAASLAAASRWSATPVAARAMILERAADAMQAAMPELIALIVREAGKSVSNAIAEVREAVDFLRYYASQAPAMSGSRPLGVALCISPWNFPLAIFTGQVAAALMAGNPVLAKPAEETPLIASEAVRILHEAGVPDDALVFLPGDGAIGAALVAAPEIAAVLFTGSTEVGRLIQRQLATRLSAEGRPIPLIAETGGQNAMIVDSSALAEQVVADVIASAFDSAGQRCSALRVLCLQEDVADHVLAMLRGALAELTVGPTDRLSADIGPVIAAEAREAIEAHVARMEAAGCPVHRLPLGTATNEGTFVAPTIIELSAPDLLTREVFGPVLHVIRFRRADMDAMVERINAWGYGLTFGLHTRLDETVARVTAKAHAGNIYVNRNVIGAVVGVQPFGGHGLSGTGPKAGGPLYLRRLVASAPAAPALELTERELPGPVGERNIYALRPVGRVLVAAQSPERLAALTSRVERLGGTPIAADDGWQAQGPFARALVEGDAAFILSFQQAVAALDGPIAPVLASADDDTMLVAEVSLSINTTAAGGNASLMAM

SEQ ID NO: 10540 - protein, 451 aa, Sphingomonas aromaticivorans
HEPATGAEVWRGKVGDVEEVVARARRAWPAWAAQPLATRIELVRRFANEVRKDADNLATMISRETGKPLWEARTEVDSVVNKVEISIRAYADRTSQRKLDSALQGTAALRHKPHGVLAVLGPYNFPAHLPNGHIVPALIAGNAVVFKPSEKTPATGEMLAQCFHRAGIPAAVVQVLIGGPEEGQALVAHDGIDGVLFTGSAHAGIAINRKLASNPGKIVALEMGGNNPIVVWDTPKIEDAATLIVQSAFTSAGQRCTAARRLIIKASMFDEVIDHVKRLADRIIVGAPFDDPAPFMGPVIDNRTADGLTESFVYLLSSGGRPIKHMVRLQEDRPFLSPAIIDVTAVADRPDVELFGPLLQVVRVDDFDEAIAEANNTRFGLSASLIGGDPQDYNRFWANIRAGVVNWNRPTNGASSAAPFGGVGLSGNHRPSAYYAADYCAYPVASTEVDQ

SEQ ID NO: 10541 - protein, 436 aa, Sphingomonas aromaticivorans
KLFIANRGEIALRVIRTARAMGIETVLGASEADASSLPAKLADHVAIVGPGPSSQGYLSIERVVDAAVRSGCDAVHPGYGFLSENAGFARAVAAAGIRFVGPDIATLEGMGDKLAARALAVEAGLPVLPGGEAATRADVHARATETGYPLLLKAVAGGGGKGMRRVDRPEDLDAALDMAQAEAQAAFGNGAVYVERFVARGRHVEVQLLGDGTNAIHLGTRDCSIQRRFQKLVEEAPAPAMPLASREGIEQAAVRLARHLGYRGAGTAEFLVDAEDFSFYFLELNARIQVEHPVTEAITGVDLVEQQLLVAMGKPLSLTQAMVRPNGHAIEVRINAEDPDADFRPSPGRATRAAWPAGEGVRVDTHIGLGGEVPPFYDSLMGKLIVHGATREQAVERLRKALDSLHIEGLPTTAPLHRRIVLDPRFVAGGVDTGFL

SEQ ID NO: 10542 - protein, 879 aa, Sphingomonas aromaticivorans
VFHFGGGATSSEPRAKDKTIVGGKGANLAEMAGIGLPVPPGFTISTEVCTAYNASGKTFDDALRAGVAAGVSHIEKATGRTFGDAANPLLVSVRSGARVSMPGMMDTVLNLGLNDATVEGLAAGSGDPRFAWDSYRRFIQMYSDVVLGLDHHRFEDALEIVKEDNGFFNDVELGANHWQALVGEYKSIVEDQLGRPFPQDVHEQLWGAIGAVFDSWESDRAKVYRKLNDIPHDWGTAVNVQAMVFGNMGDTSATGVAFTRDPATGEKAYYGEWLVNAQGEDVVAGIRTPQYLTLAARERAGAKPLSMEEAMPGAYAELAAVFELLEKHYRDMQDIEFTVEQGKLWMLQTRSGKRTAKAALKMAVDMVGEGLIDEATAIKRIDPMALDQLLHPTLDPKAARDVLTKGLPASPGAASGTVVFDADTAQAKAERGDAVILVRVETSPEDIHGMHAAKGILTARGGMTSHAAVVARGMGRPCVSGASALSIDMASRTARIGNREIREGDVITLDGSNGDVMAGKVPTVEPELVGDFGTLMAWADKHRRMKVRTNAETPLDCQVARQFGAEGIGLCRTEHMFFEAGRISAVRQMILAEDEAGRRAALAKLLPEQRSDFQSIFEVMAGLPVTIRLLDPPLHEFLPHGETEFAELAEATGLGIEHLKRRAGELHEFNPMLGHRGCRLGITFPEIYEMQARAIFEAACDVAEQSGDAPIPEVMIPLVATKKELEILRALVRQGAARVLRREGRTLEYMVGTMIELPRAALMAGEIAEEAKFFSFGTNDLTQTTLGVSRDDAARFLNPYVDQGIYPRDPFVSLDIEGVGQLVELAAERGRKTRPDIKLGICGEHGGDPASIAFCEKTGLDYVSASPYRVPIARLSAAQ

SEQ ID NO: 10543 - protein, 368 aa, Sphingomonas aromaticivorans
PARKPARPFFSSGPCAKPPGYSPEKLATESLGRSHRAKIGKTRLQYCIDLMREVLQLPDTHRIGIVPGSDTGAFEMAMWTMLGARPVTTLAWESFGEGWVTDAAKQLKLDPTVLRADYGQIPDLNAIDWSNDVLFTWNGTTSGVRVPNADFIPADREGLAFADATSAVFAYDIDWSKIDVATFSWQKVLGGEGGHGVLILGPRAVERLETYTPAWPLPKVFRLVSKGKLAEGVFKGETINTPSMLAVEDAIFALEWAKGLGGLEGLQARSDANAAALNKIVEERSWLSHLAADEATRSKTSVCLSVEGADADFIKKFAGLLEKQGAAYDIAGYRDAPAGLRIWCGATVNAEDIADLGPWLDWAYETTR

SEQ ID NO: 10544 - protein, 466 aa, Sphingomonas aromaticivorans
MSGNSGSNQMWGGRFAGGPSAIMREINASIPFDKALWRQDIAASKAHVDMLGAQGIVSAEDAALIASGLDQVAAEYEANGVPENWDLEDIHMTTESRLAELIGPAAGRLHTARSRNDQVATDFRLWVRDAMDQAELGLKQLQVALVSRAGEHAASIMPGFTHLQTAQPVTLGHHLMAYYEMIGRDRSRFADARVRMNRSPLGSAALAGTGFPIDRFRTAEALGFDGPTDNSLDSVSDRDFALDYLMAAAQCSLHLSRLAEEFIIWASQPFGFVTLPDSLSTGSSIMPQKKNPDAAELVRGHSGRIVGCLTALMITMKGLPLAYSKDMQDDKPPVFEAASLLALSIAAMTGMVAEAKFRTDRMRAAAELGYATATDLADWLVRQANIPFREAHHITGSAVKLAESRGIALDQLSIEDLKAIDERIDERVYAALSVEASVAARCSHGGTAPDEVRKRVAQARVALGLE

SEQ ID NO: 10545 - protein, 418 aa, Sphingomonas aromaticivorans
MDHFEVSNGVLHAEDVALPVIAAEVGTPVYVYSRATLTRHARVFRDALSILPAVKIAFAVKSNPNLAVLKVLAAEGYGADVVSGGEMERALAAGMKPDGIVFSGVGKTEAEMRRGIEAGIGQFNLESEEEGLELAEIAASMGKVASAALRVNPDVDAGTHGKISTGKAENKFGVPFDRAAAIYARLADTPGLNMRGLALHIGSQLSKLDPLEAAFTKVGGLMRAIREGGHAVTHMDLGGGVGVPYKAGEVFPQPAEYAAMVAKVTADWGVTLMFEPGRVITGNTGVLMTQVVRVKEGAGHPWVVVDAAMNDLARPALYDAWHDFAAVEPTGETFVANIVGPICESSDTFAMARTIDKVGRGDLAVFRTAGAYGATMANTYNSRPLVPEVMVDGEKWAVVADRIDPATILAAERVPDFL

SEQ ID NO: 10546 - protein, 273 aa, Sphingomonas aromaticivorans
EGRVAIVTGAGGGLGRAYALELARRGAKVVVNDLGGSRDGTGHSDAALKVVEEIEAMGGEAMSNGGSVSEYEQMVEMVAKTKERWGGVHVLINNAGILRDKSFTKMDPADFEMVVRVHLIGSAFATKACWDLMREQNYGRILMTASSTGLFGNFGQANYGAAKLGLAGLTKTLYLEGAKNNIKVNTLAPVAATRMTEDIFPEEAFKLFGPENVVPAALFLVSDDAPTNAIVGAGGGAYHGAWVTMNKGVLLPPAERTVEGFAANWEKINDRTG

SEQ ID NO: 10547 - protein, 389 aa, Sphingomonas aromaticivorans
ITRKWRPATQAIRGGTWRSEMGETSEALFLTSGFTYDDAATVAARFAGEAEGMTYSRLQNPTVQMLEERIALLEGAEACRTQATGMAAMTTALLCQLSAGDHIVAAKAAFGSCRWLVDNLLPRFGVQGTTIDASDNAAWEAAIRPNTKVFFFESPANPTMDIVDLEFVCGLAKKHGITTVVDNAFATAALQRPMDFGADVVAYSATKMMDGQGRVMAGAVCGSADWINNVLLPFQRNTGPNIAAFNAWVVLKGLETLDLRIHRQSENALKVASFVEKRVPRLLYPGLPSHPQHALAQKQMKAGGTIFSFDLDGGRAQAHALLDALQLIDISNNIGDSRSLMCHPASTTHHGVGPETRADMGVGEGMLRLNVGLEDADDLIEDLDQALRK

SEQ ID NO: 10548 - protein, 527 aa, Sphingomonas aromaticivorans
DLPLIPMPASVVAGQGALRIGADTPVVAASGDAGAERAARFLAERAKAQRGLSLATASMASGPAIRFVRDNAIAGEEAYRLTVTAKGATVAASGDRGMIWGAATLVQLLSPDGRTGQPVQVPAMTIEDAPRYSWRGLMMDVARHFQPIETLYPVVDAMAEQKLNVLHLHLSDDQGWRVEIKRYPKLTEIGAWRTPPSAGEPTAAKVGGFYTQEQLKALVAYAGARGITVVPEIDMPGHAQAAVAAYPEEVGVLGDRPQVGHDWGVNPWLFSPSEGSMTFIRNVLDELVEVFPSPFIHVGGDEAVKDQWQRSPEVQAQMAALGLKTENQLQGWMIAELGKHLATKGRRLIGWDEILEGDVPTSASVMSWRGEKGAVEAANKGHDVVLSPAPDLYLDNLQSDRSDEPPGRIGIRTLEQVYRYEPTPSGIAPERLKHVLGAQANAWSEYLATAKQKEHAIFPRLSAVAEVTWTAPARRDWKSFVARLEPQMLRYSREGIAAADSAFAVNFRMKESRGEALRGGRLTLAMD

SEQ ID NO: 10549 - protein, 333 aa, Sphingomonas aromaticivorans
MRREAAEAGTAVTRFLAHNEKNLKALAERLRAYPPNVVVTCARGSSDHAATFGKYLVETRLGIPVSSAAPSVASVFASDVRRTGSVLVAISQSGRSPDLLATVESHRAAGAYVVALVNQPDSPLEKLADCFLPLCAGPELSVAATKSFVVSLAALAAIVAWWSEDEALKDALHGLPALLDQAYARDWTALVDALAPANNLLVVGRGYGLSVAQEAALKLKETCGLHAEAFSSAEVRHGPMAIVGEGFPILALATSDASGDDVRAVAGEFSGRGARVLLADCSQSAGTLPAVPAHPVIEPILLVQSFYSAVETLARARGMEPDNPPFLRKVTET

SEQ ID NO: 10550 - protein, 540 aa, Sphingomonas aromaticivorans
RRLWPWLRPHAPRLALVLLASLLATGLNLAQPWISKLMIDEALLKRDWDALLRIAGLMVAATVGGFAVNALVSYRYVAISAQMLFDMRVALLRHLQTLSPRFYGSFRLGDLMSRLNSDVSDVQRAAGDTLLSVLSNVLFFAGSVGMMLWLDWKLFLVGTLLVPLAVASFLHFQRRMTDLTRQMRERGADIGSLLVDTIMGMRTVNALGAEAHEADRFRAANAGFIHAMLRMQTVSFLTGALPGTIVTASTAAVIVFGGKQIIDGTMTIGALVAFLTYHGRLLAPVQALMGLTATLASARVALARIFELFDTSAEVADAPAPRPLPPVTRAIRLDGVTMHHGREPVLRDVSLTIPAGSLTAILGASGAGKSTLADLLVRFLDPVAGRITIDGIDLRDLALADLRRRALLVDQSPFLFNATIAENIAFARTGALPAEVAAAAGAAGLDPLIARLPEGLATRTGERGLALSAGERHRIALARALLRKPDVLILDEPTAALDEATERLVASGLRRALPDATLVVITHKPALADLADHVVRLEQG

SEQ ID NO: 10551 - protein, 253 aa, Sphingomonas aromaticivorans
RFDGKVMVVTGAAQGIGRGVAERAAAEGAQVLLVDRADFVTDVAAAIGPKAHAFVADLEGHAGAAAAVAHGLAVFGRIDILINNVGGAIRMRPYDQFTSEQIDAEIRRSLMPTLYCCHAVLPPMLAQGAGTIVNVSSNATRGIRRGPYSAAKGGINALTQSLAMEYGEQGIRVVATAPGGTSAPARKVPRNAEGDSAQEQAWMAEAVEQVTRSTFMKRYGTLEEQIAPILFLASDEASYITGTVLPVAGGDLG

SEQ ID NO: 10552 - protein, 405 aa, Sphingomonas aromaticivorans
FPKGFLWGASTAPHQIEGNNTASDLWFLENQQPTVFAEPSGDAANSLLLWERDLDLARDIGLNTYRFGVEWARIEPEKGRFSQAMLDHYRRVVDGCRARGLVPIVTYSHFTAPRWFSAQGGWTNPESAELFARYCTKVTQAIGDAIHSAITLNEPNILLILKPMAAAGGVGYPEADAETAGRRLGVEKFVCANVAAFEDLPALQHGLLAAHKAGRAAIKAVRPALPVGVSIAMLDDQAVGRNSIRDRIRSELYGAWLDVAKADDFIGVQNYERALWGDKGRLPAPQDAPRNWSGTEIWPGSLAGAVRYAHAMTGRPVLVSEHGVGTDDDAVRAALIPPALGALKQAMDDGVPVLGYCHWSLVDNFEWIFGYKPRFGLATFDPVTFERKAKPSARVYGAIARANAL

SEQ ID NO: 10553 - protein, 334 aa, Sphingomonas aromaticivorans
FSTDDHPHRRQNLLTGKWVLVSPHRAKRPWQGETGDPAPTGGPSHDPGCYLCPGNARTSGERNPDYPGAFAFDNDFPALMPDNPAPEGGDPVFRVAEARGTARVICYSPDHSKTMPDMDVAAIRSLVNCWAQESETLGAHFANVQIFENKGAMMGCSSPHPHGQIWASDFIPTEVADEDREQAAWHASRGRVLLDEVAERELASGERVVEANEHWLAVVPWWATWPFEILLVARDGVGRIEELSDASRDALASILRAVTRRYDALFNASFPYSMGWHQRPAGSSDPAAWRLHAHFNPPLLRSATVRKFMVGFEMFGESQRDITPETAAARLRAL

SEQ ID NO: 10554 - protein, 466 aa, Sphingomonas aromaticivorans
LTLPATHIRRLLGWGRTLARHGALRGIENDPNTPSPVRTLCRIARLGTIQPRDPDYAGAFRAIGPAAIKLGQTLATRPDLVGEDAAHNLLALQDNLPPVDYRLIRAEIERTFEKPLEALFAQFDPEPIGAASIAQVHRAVTTEGHKVAVKVLRPGVRDKLARDIDTYEWAAAHLEAFGGEAERLRPRLVIANFKRWTVRELDLRREAASASELADVMKAHAGYRVPAIDWDRTNGRVMTLDWIDGIKISDTAALEAAGHDRKALASRLVLAFLTQAISGGFFHADMHQGNLFVQPDGTIAAIDFGIMGRIDRRARQWLAEILYGLTTGNYRRVAEIHFEAQYVPSYHSVDEFATALRAVGEPMRGKPVSELSVGQMLDGLFAITRDFDMQTQPHLLLLQKTMVMVEGIATQLDPTINMWDVSAPFVRNWIRDELGPEAAIAERIREDTQTLLRIPDLIRRIEDRFP

SEQ ID NO: 10555 - protein, 354 aa, Sphingomonas aromaticivorans
NPLGLDGFEFIEFSAPEAGSLEPVFARMGFTHIANHRSKQVQLWRQGGINLIANHEPRSPAAYFAAEHGPSACGMGWRVRNAAKAYATAIERGAEPVEVRTGPMELRLPAIRGIGGSIIYLIDRYEGGQFGDLSIYDIDFEYLPGVDRHPVGAGFHTIDHLTHNVYGGRMAHWASFYERVFGFREIRYFDIKGEYTGLTSRAMTAPDGKIRIPLNEEAKAGGGQIEEFLRAYNGEGIQHIAFACDDLLGGWDKLKAIGTPFMSPPPATYYEMLDERLPGHGEPVAELQKRGILLDGSTEEGDPRLLLQIFSETQIGPVFFEFIQRKRDEGFGEGNFTALFKSMERDQLRRGVLK

SEQ ID NO: 10556 - protein, 901 aa, Sphingomonas aromaticivorans
QGEHGVTEEVMGVDLVEWMVRGGGGDFGFLDDDPPRPSGHSIQVRLYAEDPALDYRPTSGTLTAVTFPEGVRTETWCMAGTTVSTWYDPMLAKLIVHAESREAAVAAMQDALDRSRIDGFETNLRWLRDVVRSPAFTSGEVSTRALSHVAHVPRSITVVSGGTATMAQDWPGRQRLWAVGVPPSGPMDDLSFRLGNRLLGNPEGTAGLEVAITGPTLTFNTAARVCVTGADFGARLDGQPVPRGMAIDIAAGQTLALGRASGGGMRGYILFAGGLDIAPYLGSRSTFELGQFGGHAARRLLAGDTLHLGDEPAQPALPAANLPELSNEWALRVMYGPHGAPDFFTREDIDTLVAAEWQVHYNSNRTGIRLVGPKPQWAREDGGEAGLHPSNIHDNPYAIGAVDFTGDMPIILGPDGPSLGGFVCPFVVIAADRWKIGQLTPGDKLRFVPVNCADAAAANDQQRRFLETGKPAQGCPGRPMETLSPILAVIDESPRSPRTVYRQQGDRNILVEYGPIVLDIELRIRVQALMTELERLALPGVIDIVPGIRSLQFHFDGDAMTQEAALSVLIAAEERLGDLEDFTIPSRIVHLPLSWRDPATIETIEKYMGAVRDDAPWCPDNIEFIRRINGLPDVAAVENLIFEANYLVLGLGDVYLGAPVATPVDPRHRLVTTKYNPARTWTPPNVVGIGGAYMCIYGMEGPGGYQLFGRTIQVWNTHRQTDAFIDGKPWLLRFFDQIRFYPVSAEELEEWRRDFPAGRRSIRIEPSEFRLADYRRYLADNAEGIAEFEARRQAAFDEERAEWQRRGEFDRTDLVEPEAAEAGTVEVPDGADLVEAPFGGSVWKMLVSVGDEVEAGETIAIIEAMKMECRVESPGAGTVAALYAQERQSVQPGTPMLALTR

SEQ ID NO: 10557 - protein, 423 aa, Sphingomonas aromaticivorans
MTAIIDIHAREILDSRGNPTVEVDVLLEDGSFGRAAVPSGASTGAHEAVELRDGDKARYLGKGVTKAVTAVNSDIAECILGLDAEDQRDIDLAMIELDGTENKSRLGANAILGTSLAVAKAAADARGLPLYSYVGGVSAHVLPVPMMNIINGGEHADNPIDFQEFMIMPVGAPSLAEAVRWGAEVFHTLKKGLHEKGLATAVGDEGGFAPNLASTRDALDFVMASIEKAGFKPGEDMMLALDCAATEFFKNGKYEISGEGLSLSPDAMADYLAALCDAYPIISIEDGMGEDDFEGWAALTAKVGKRVQLVGDDLFVTNPKRLEMGIGKGLANSLLVKVNQIGSLTETLEAVSIAQRNGYTAVMSHRSGETEDATIADLAVATNCGQIKTGSLARSDRLAKYNQLIRIEEELGVSARYAGKTAF

SEQ ID NO: 10558 - protein, 1106 aa, Sphingomonas aromaticivorans
MPKRTDISSILIIGAGPIIIGQACEFDYSGTQAVKALKEEGYRIILVNSNPATIMTDPDMAHATYVEPITPEVVARIIEKERPDALLPTMGGQTALNTALALFNDGTLEKYGVQMIGANADAIDKAEDRQRFREAMDKIGLESARSGVAHTIDEALEVLERTGLPSIIRPSFTMGGTGGGIAYNKEEFVKIVKGGLEASPTTEVLIEESLLGWKEYEMEVVRDRKDNAIIICSIENVDPMGVHTGDSITVAPALTLTDKEYQIMRNASIAVLREIGVETGGSNVQFAVNPADGRLIVIEMNPRVSRSSALASKATGFPIAKVAAKLAVGYTLDEIMNDITGATPAAFEPTIDYVVTKIPRFAFEKFKGSEPLLGTAMKSVGEVMAIGRNIKESMQKALRGLETGLDGFNRVVELEGASRDEITAALARATPERLLVIAQAFREGLSVDEVHAVTKYEPWFLRHIHEIVSEEKAIQQDGLPNDAAGLRRLKAMGFSDKRLATLAVRSVGVAGGLGETQAKRSGLLHDTLRAMAGATSEDEVRALRHKLGVRPVFKRIDSCAAEFEAVTPYMYSTYEGALFGEPENEANPSDRKKIVILGGGPNRIGQGIEFDYCCCHACYALDEAGFETIMVNCNPETVSTDYDTSDRLYFEPLTAEDVLEILAVEQSKGELVGVIVQFGGQTPLKLAQALQDAGIPILGTSPDSIDLAEDRERFAALVARLGLKQPANGIARSRDEAVAVASRIGYPVLIRPSYVLGGRAMEIVDSQAQLDDYIATAVQVSGDSPVLIDQYLRDAIECDVDALADGDEVTVAGVMQHIEEAGIHSGDSACTLPPYSLPAEIVAEMERQAVLLARGLDVRGLMNIQFAVKDGEVYLIEVNPRASRTVPFVAKAVGQPIAKFAARIMAGEKLTDLPPIKREIDYMAVKEAVFPFARFPGIDPVLSPEMKSTGEVMGIDGTFAVAFAKSQLGAGVRLPQGGTLFVSVKDSDKPVVLPAVRKLAELGFRIVATGGTARYLSDEGVNVERVNKVAEGRPHIVDRIIDGEIALIFNTTEGWQSHKDSQSIRASALGAKVPYFTTAAASVATVEAIEALRTAELEVRSLQDYY

SEQ ID NO: 10559 - protein, 360 aa, Sphingomonas aromaticivorans
WGRGFGAAGAAVGEVCFNTAMTGYQEVMTDPSYAGQVVTFTFPHIGNVGTNPDDMESHDTPGAVGCVVREDVTAPANFRAAGTFQQWMEQQGKIGISGLDTRALTRRIRLSGAPNAVIAHDPKGQFDIPALIERARSWPGLEGMDLARVVTRDGQEAWEGSVWHLGEGFTKPQGTGRPHVVAMDFGAKDNIFRNLVKAGADVTIVPAETSLETILSLKPAGVFLSNGPGDPAATGAYAVPVIQKLLEMDMPVFGICLGHQMLALAAGARTTKMHQGHRGANHPVKRIEDGVVEITSMNHGFAVDNAPGALGDKVIETHVSLFDGSNCGIAVKGKKAFGVQYHPEASPGPQDSFYLFEKFV

SEQ ID NO: 10560 - protein, 141 aa, Sphingomonas aromaticivorans
DVRKVMAALPHRYPLLLVDRVASLTLNERIHAVKAVSINEQFFQGHFPGRPIMPGVLQIEALAQAAGVLAVESLGLAGSGKLVYFMAIEDAKFRNPVEPGVLLDLHVEFTQKRSRVCKFSGKAMIGDKVTCEVNFTAMIAD

SEQ ID NO: 10561 - protein, 265 aa, Sphingomonas aromaticivorans
IKGRSALVTGAASGIGLAYAEAMAEAGAAVTLTDIDAEGAEREAARLRAEGYEVRAEKLDVSDWDNVAAAFDAHDKAYGGLDICFANAGIDTGAGFWNPAGHRNPEGQVDTYDHKRWDRSIQINLNGVFYTVSNAVRIMKKEGRANGRTGGSIVTTASNAGLVTEPIVGLPYMPAKAGVLHMVRALGLELAEFGIRINAIAPGPFVTNIGGGWLKKDPVARAAWDAIVPLGSVAETDQIKPLALLLASDASDYMTGSHVVIDGGM

SEQ ID NO: 10562 - protein, 334 aa, Sphingomonas aromaticivorans
MRAAVMQGLHKPLAIDTIPDPTPGEGDVVVKVGRCGICGSDLHMTEDPAYGQGAGSVLGHEFAGEVVALGKGVEGLRTGDLVSVIPLQSCGQCHSCRTGEVQWCERFGLQGGGYAEFALTRPNQCVRLPASASMADGAIVEPLAVALHGLALSRMKIGDKVLVLGAGPIGLAVAFWARRFGAGRVVVQDLAEWQRDRALQMGAHDFVVDAADPVGSAGRALGGKADIVFECVGVPGLIAQAVEQVRNDGTITLLGLCTRPDTFNSFAMLSKQVKLVTSAFFTRQEYEAALDALVRGAVEPRLLVTDTISLDATPDVFESLRKRTHQCKVLINPG

SEQ ID NO: 10563 - protein, 299 aa, Sphingomonas aromaticivorans
  unsure (1)..(299): unsure at all Xaa locations
IETFAGRTAFVTGGASGIGLGIVKALARRDAFVVIADMRTDHISRALKALASAGLGESVAAVELDVTDRAAYASMARRMDEEFGGIDVLVNNAGVGVEGPILQATYPDWDFGLGVNLGGVVNGLQAMLPQMIAHGRGGHVVNTASLAATVVMPGHLAIYAAGKAAVLNLTENMRADLAGRGIGSSVLCPGFVRSNIHEAARNRPAHLREGSGFAASEQALSMRETGSEWMDPDAVGEMVADAILADQLYVITHGEFANRMRERAEALLAATPVCEMQFXPVRLKCRWWSLRCSRRIPTR

SEQ ID NO: 10564 - protein, 673 aa, Sphingomonas aromaticivorans
AWRHFGPRLTADGIRPIRDQRAPASYSLDDDVPFAVAPAAGLGWFGPSAMCLRRGSVALVPAMAGASVAGDAGSVRIITRDPVAGVELEQVFEAVGGAFVCRSVVRNIGSETFEVDWLSSALLPIAGSAREIVSWRGRHNAELVECREPMPQHSWVREGRRGISGHGGPPGLFVLDEGATYHAGTVRALQLAWSGDARIEVERDDEGFWTLNAGAVLQPGEASLAPGESWQSPDAIVTVSTSGRNGAAQAFHDAVRARIRWPDGAMRPRPVHLNSWEACYFDHDEERIVALAEAAASVGVERFILDDGWFRGRNDDTAGLGDWTTDPVKYPHGLRTLADRVNALGMEFGLWVEPEMINPDSDLYRAYPDWALALPGRKRPTARNQLVLDMRRRDVRDHLFGCIDALLRELPITYLKWDHNRDLAPAGGAAQMRGAYELFARVRAAHPAVEIEACAGGGGRNDAGMADYCHRYWTSDNIDAASRIGIQRGFLSFLPPEVMGSHIAASPAHATGRRHSLGFRAAMAMAGHLGVEMDPRTLGDAERAELADWIAFHKQWRGLLHQGTVWLGEGADAAFWQAQGNAAELLLFVIRADPPLDRRPQPLPLPFAGQDGTWDIRLLRIAGGEGGHAAHSAALFEAMKAAPQAFPADWLSANGLPLPPCKAETVTIFHLRK

SEQ ID NO: 10565 - protein, 343 aa, Sphingomonas aromaticivorans
PLIEAADVVRLFDDLDLWDCWPLAHEDGRTVEHLGRNWWFFLSAPVFPDPVERHGHARIRLVSLGEDGWKDHGNAFPDGLTPGSREWAGSAVLMDDGRTVQHFFTAAGRRGEAAPTFEQRIFVSEGTLTEAGPGGWQAPREIFEADGLRYVLDRQDSGAPGQIKGFRDPAWLRDPATGRAHILFTGSAAWSDHPFNGNVGIATLEGDTWVLGNPLVEAIDVNNELERPHILVRDGLYYLFWSTQTHTFAPAAVAGPNGLYGMVAESLAGPWRMLNEGGLVAANPDAEAKQSYSWWVTGEGEVWSFVDYWGMAGRTVEEQPELLRSNFGGTPAPRFMLNFDGER

SEQ ID NO: 10566 - protein, 270 aa, Sphingomonas aromaticivorans
PGRGDFYEKYLESLDYWHCEGWRVTALDWRGQAGSGRLSSDPMTGHVPDFGLWLDDLGAFWTDWVRDTPGPHVVVGHSMGGHLVLRALAERRIDPAAVVLSAPMLGFLTPGPNRVLHRVAEFMCRIGDPERSAWKSSEKPGATTAARNTLLTHDEARYGDETHWKTVRPELAMGPGSWRWVERAYASMLVLDRPGLLEAVDVPVLLLAARHDGLVSWRAIERAARRLPRAQLMTWGREARHELLREADPVRDKVMHAIDDFLDRLAPPTG

SEQ ID NO: 10567 - protein, 517 aa, Sphingomonas aromaticivorans
TVGDLLLRAADLHAERTALALPGVAVSYRELRDGAFRVARALIGLGIARGEHVALLMPNSVEFAEALFGIMLAGCVAVPLNARHRAAEIGYIIDNSQARILLTSRHDSDPVNFIEVIEQALPTPSAAPALRYVALLRGEGSGDVLGREAFLSQGVRTDPAEVEHTRRSVRVRDAALIIYTSGTTANPKGCVLPHEAVTRGPVERARYRLSANGVDVTWAGGPLFHIGSLAPFIGSVGVAGTFLADSYFEPGRAIALMEKHAVTLAWPWFAAIVQGIIDHPEFSAEKFAHLKYLFLIAPPTLVERVQDLLPHTEIIQACGMTETSGVFALCDTDEDRESRIFTQGKACPGIEIRIVDPETGQDLPDGTMGEILVRGYNVMDGYWDAPEKTSEALVGHGWLKTGDLYTRQPNGSLIFGGRCKDMLKVGGENVAAIEVEAFLCTHPAVKTAEVVGRPDPRLDEVPVAFIELYDGETINEEELIAFCRGRIASYKVPRAIRFMSAADWPMSATKIDKRALR

SEQ ID NO: 10568 - protein, 263 aa, Sphingomonas aromaticivorans
PGPELLIEHSGSISWIVLNRPAQANALSRTLIESFSAALRTLEDEGAPVIGIRANGKGFCSGMDLGQYGGAAVLDPTADSRRLNENVARWLAIWDHPKPVIAAVHGYCAGVAAQMCIFADLTVVADNVRISEPGVPIGGGFIAPTWVAQVGAKRAKEFAFLPGNSIDGPTAVEWGWANHCVPADRLVESVESLAARMALIPSDVLRIKKLSINRAAEAAGFRTATGGIAEMDSLLHAAPSVLAIRERMTTLGLKAVLDEYRGP

SEQ ID NO: 10569 - protein, 631 aa, Sphingomonas aromaticivorans
VRGVQDVMEARPMIKSLLVANRGEIACRVIRTARRMGVRTVAVYSDADANALHVRSADEAVHIGPAAARESYLVGERIIAAALTTGAEAIHPGYGFLSENAEFAQAVLDAGLVWVGPKPHSITAMGLKDAAKARMIAAGVPVTPGYLGEDQSAERLQAEADAIGYPVLIKAVAGGGGKGMRRVDAAADFAEALASCRREAASSFGDDRVLIEKYILSPRHIEVQVFGDAHGNVVHLFERDCSLQRRHQKVIEEAPAPGMDEATREAVCAAAVRAAKAVDYEGAGTIEFIADGSEGLRADRIWFMEMNTRLQVEHPVTEEITGVDLVEWQLRVASGEPLPKRQDELSINGWAMEARLYAEDPTRGFLPSIGRVDDFHFPHHHARIDTGVEAGAEISPFYDPMIAKLIVHRPTRTEAVSALRETLDEGIVGPLVTNSGFLWRLLGHAAFEAGVVDTGLIERNLETLATRPEPSREGLALAAMRLAGTPGATPWSSRSGFRMNAAPRRDVRLSDQFGRTFTTELPPEPAFDYWPGEDATTIDEGGERFRVRLARADGGSGGAASDGAILAPMPGKVISVDVSAGQSVTKGQKLMVLEAMKMEHALTAPFDGVVAELNAAPGGQVQVEALLAKIE

SEQ ID NO: 10570 - protein, 375 aa, Sphingomonas aromaticivorans
FGLTESALMIREAAGRFADEQIAPLAAEIDRNDRFPRELWEPMGALGLHGITVEEEFGGLGLGYLDHVIAVEEVSRASGSVGLSYGAHSNLCVNQIRRWGNDEQKAKYLPKLISGEHVGSLAMSEAGAGSDVVSMKLRADAVAGGFRLNGTKFWITNGTYADTLVVYAKTSPEAGSRGISAFLIEKDMPGFSIGQKIDKMGLRGSPTCELVFDDCFVPEENVMGPLHGGVGVLMSGLDYERVVLAGMQIGIMQACLDTVIPYVRERKQFGQPIGTFQLMQAKVADMYVAIQSARAYVYAVAKACDAGQTTRFDAAGAILLASENAFRVSGEAVQALGGAGYTKDWPVERYLRDAKLLDIGAGTNEIRRMLIGREL

SEQ ID NO: 10571 - protein, 559 aa, Sphingomonas aromaticivorans
FSVRSPRAEALTLCLFEDEAEQRIAMTRVGDNWIVEIPRDLRGIRYGYRASGEWNPPDGLWFDPAKLLVDPYAIELDGSFVQHTSLSTYGADTSKIVPKAVVTAPPVISHLSPLFRHGGLIYEVNVRGLTMLHPDVPQPLRGTVAALAHPAIIGHLKQLHVSAVELMPIVAWIDERHLPPLGLTNAWGYNPVAPMALDPRVCPGGVRELRETVATLRAEGIGVILDIVLNHSGESDVLGPVLCLRGLDDAAYTKAPDGRLINDTGCGNTLDFGNPAVRALALDTLRHFTRHCGVDGFRFDLAPILARSPGFAADAPIFREIAADPVLADRVMIAEPWDIGPGGYQLGGFPSNWLEWNDRFRDDVRRFWKGETGVGALATRIAGSSDIFGKACRTVNFLAAHDGFTLADTLAYEQRHNWANGEENRDGHGENFSWNNGMEGETDNLDVLSRRAALVRAMLGTLFISTGTILLTAGDEFGRSQRGNNNAYAQDNEITWIDWDRRDRALEAWTFGLSAWRHLRISSFTRFPEDGTWRDLNGTELHTSAWESDLTQGFFWQNG

SEQ ID NO: 10572 - protein, 542 aa, Sphingomonas aromaticivorans
MTRTVPSTPCSGQKPGTSGLRKKVKVFQQPNYAENFIQSVFDVVERAPGSALVVGGDGRYHNRTVIQQAIRIAAANGYGKVLVGRGGILSTPAASNVIRKYGASGGLILSASHNPGGPDEDFGIKYNIANGGPAPEAVTEAIYARTQTIDRWLTVDAPDVDLDRLGSTQVEAMTVDVIDSVSDYAELMESLFDFNAIRANVEGGFTMAFDAMSAVTGPYAIEILENRLGFPKGTVRNGIPLEDFGGHHPDPNMVHAHELFDTMFGPDAPDFGAASDGDGDRNLIVGRHRFVTPSDSLAMLAANAHLAPGYAGGLNGIARSMPTSAAADRVAEALGLPCFETPTGWKFFGNLLDAGMATICGEESAGTGSDHVREKDGLWAVLLWLNILAVRRIGVDQLAREHWARFGRNYYARHDYEALPTDRADALMAELNQSLSSLSGKPFGNLTISTADNFSYLDPVDGSTSSNQGVRILFEGGSRVVFRLSGTGTEGATLRVYLERYEPVGGDLDRETPEMLADLIRAADAIAGIARHTGRTAPDVVT

SEQ ID NO: 10573 - protein, 481 aa, Sphingomonas aromaticivorans
IKVLSVASEAVPLVKTGGLADVAGALPSAVAPHGVGMTTILPGYPAVMKALARPRALHTWNSLLGEKARLVSGKIDGHPLLVLDAPAFFQRDGTPYVDSSGRDWADNWRRFAAFGRAAADVAGGAVKGRAFDLVHAHDWQAAMALAYLRFAPPPGGRRVPSVMTIHNMAFQGHYGADLFPALGLPPQAWAMDGVEYHGGVGYLKAGLEAASAITTVSPTYAREIRTPEFGMGLEGLVVSRGNRVSGIVNGIDTAQWNPETDPALAARFGVKSLARRVTNKRALEAEFALEADDGPLFVVITRLTWQKGIDVLLECIDHLVGIGGRLALLGSGDKAMENAFHAAATRHPGKVGVRIGYDEALSHRMQAGGDAILVPSRFEPCGLTQLYGLAYGCVPVVARTGGLADTVIDANLAAVMAGVATGVQFEGVNYPSVSDAISRAVTLYRQPDVWRAMQRAGMKTDFSWSRSGKAYADLYAALIAE

SEQ ID NO: 10574 - protein, 418 aa, Sphingomonas aromaticivorans
MRDTYSQPLARDAMAYVLAGGRGSRLKELTDNRAKPAVYFGGKSRIIDFALSNAINSGIRRIGVATQYKAHSLIRHMQRAWNFMRPERNESFDILPASQRVSEHQWYEGTADAVYQNLDIIASYAPKYMVILAGDHIYKMDYELMLRQHVESGADVTIGCLVVPRIEATGFGVMAVDTSDTITAFVEKPANPPGIPGNEDMALASMGIYVFDTKFLFDILREDAADPSSSRDFGNDIIPKIVRNGKAVAHRFTASCIRAAEEIEEYWRDVGTLDAYFEANLDLTDVVPKLNMYDRDWPIWTDQIIAAPAKFVHDEDGRRGMAISSLISQDCIVSGAIARRSLLFTGVKMGSFSSCEEAVILPYCNIGRGARLSRVILDSGVRIPEGLVVGEDPELDARRFQRTESGVCLITKRMIDQL

SEQ ID NO: 10575 - protein, 797 aa, Sphingomonas aromaticivorans
KNSRAAEIDAQIIDVLRHRVGKDERAAKPHDWYTATVLTLRDAIIDRWMESTRKTYAESGKRVYYLSLEFLIGRLLRDALSNMGLTRDMELALREHGFDLSALEDLEPDAALGNGGLGRLAACFMESLASLDIPAYGYGIRYVNGMFRQRIDDGWQVELPETWLSHGNPWEFDRRESAYIIGFGGEVVEKADGVEWRPAEKVEASAVDTPVVGWRGKRVNTLRLWTAHAFDPLRLDAFNAGDHFGALAEQVRADSLVRVLYPADSTPAGQELRLRQEYFFTSASIQDIVRRHVQYNGDIRTLPEKAAIQLNDTHPAVAVAELMRLMVDVHGLEFNEAWEVTKATVGYTNHTLLPEALESWPLPLFERLLPRHMQIVYAINSRVLREARKAGLDDAAISAISLIDEGGERRVRMANLAFSGAHSVNGVAALHTELMKTTVFSDLHKLYPARINNKTNGVTPRRWLQQCNPGLTSVLKDAIGDCFLDDAEKLSDLNALADDPALGERIAEVKRTNKIALAKHVKELMGIRLDPDALFDVQIKRIHEYKRQLLNLIETVALYDQIRSHPERDWVPRVKIFGGKAASSYHNAKLIIKLANDIARRVNSDPSVGGLLKVVFVPNYNVSLAEKIIPAADLSEQISTAGMEASGTGNMKFALNGALTIGTLDGANIEIKDRVGDANIEIFGLTAQEVEDKRANGYNPREVIESSRELQQAIAAIATGVFSPDDPQRYAGLMGGIYDHDWFMVAADFDAYHAAQRNIDRRWEQQPSWRASAIRNIANVGWFSSDRTIGEYARDIW

SEQ ID NO: 10576 - protein, 482 aa, Sphingomonas aromaticivorans
VFARLHKLSLRFHLARRTGEVTKVIERGTKSIDTMLYFLLFNIAPTVIELTAVIVIFWLNFGLGLVTATILAVIAYVWTTRTITEWRTHLREKMNRLDGQALARAVDSLLNYETVKYFGAESREEARYASAARAYADAAVKSENSLGLLNIAQALIVNLLMAGAMAWTVYGWSQGKLTVGDLVFVNTYLTQLFRPLDMLGMVYRTIRQGLIDMAEMFRLIDTHIEVADVPNAPALVVNRPSVTFDNVVFGYDRDREILHGLSFEVAAGSRVAIVGPSGAGKSTIARLLFRFYDPWEGRILIDGQDIAHVTQTSLRAALGIVPQDSVLFNDTIGYNIAYGRDGASRAEVDAAAKGAAIADFIARLPQGYDTEVGERGLKLSGGEKQRVAIARTLVKNPPILLFDEATSALDTRTEQDILSTMRAVASHRTTISIAHRLSTIADSDTILVLDQGRLAEQGSHLDLLRRDGLYAEMWARQAAESA

SEQ ID NO: 10577 - protein, 499 aa, Sphingomonas aromaticivorans
AEAETYWTALAGLPRPTLKELFSDAGRLDRYAATLDLPGGPIRFDWSKTHLSAEVEAVFAALASAMDFEGRRAALIEGAKINNTEGRAAEHTAQRGIGNEASVEEAEALHARMRMLVDAIHAGALGEVRSLIHIGIGGSALGPALAIDALTRDGAKVAVHVVSNIDGCALEAAMKACDPATTMIAVASKTFTTTETMTNAASALEWLRENGVADPYGQVVALTAAPEKAVEWGVDETRVLPFSETVGGRYSLWSSIGFPVAMALGWEGFAAFLDGAAAIDRHFIDADLAGNVVVRAAFADLYYTQVRGCQTRAVFAYDERLALLPDYLQQLEMESNGKRVLADGSPLTRPSAPVTWGGVGTDAQHAVFQLLHQGTHLIPVDFLAVKTQGHDLDPAHHQILLSNCFAQGAALMAGKASDDGARAYPGDRPSATILCDDLNPATLGALIAFHEHRTFVSAVMLGINPFDQFGVELGKAIAKQIESGGGEGFDPSTEALLAA

SEQ ID NO: 10578 - protein, 214 aa, Sphingomonas aromaticivorans
VELSGKTVLVTGATDGIGAQIARQLRNKGATVIGQGRTPARVAAARADGFEIVEADLSLPQGVETLISAMAGRQIDVLVNNAGAGVDHDFRDGQPDAAAADRTIFLNLNAPIHLITALMPGLKARPEAMIVNVTSGLAIAPRAGGPVYCATKAALRSYTQALRAQLAGTGVHVVEALPPVVDTQLTAGRGNRKMPAAECARQIVDGMERNVTEI

SEQ ID NO: 10579 - protein, 498 aa, Sphingomonas aromaticivorans
ICRNPRMKRACVIGAGFGGLALAIRLQSGGVQTTLIEARDKPGGRAYFWEKDGFTFDGGPTVITDPACLEELWALKGHRMADDVELMPVMPFYRLNWADGTNFDYSNDDASLRAEIAKLEPADVAGYDDFLRYSAGVFEEGYVKLGAVPFLDFASMIKAAPALARYQAWRSVYSMVSSFVRNEKLREAFSFHTLLVGGNPMTTSAIYALIHKLEKDGGVWWAKGGTNRLIEGMVTHFRRIGGEVRIGDPVTRVETLGTRVTGVETRSGWSGKFDAVASNADVMHSYRDLLSDNSHAKRRAKSLGKKRFSPSLFVVHFGIEGTWPGIPHHMILFGPRYKGLLDDIYTHGVLPQDFSIYLHHPTVTDPSVAPEGMSTFYALVPVANMGKLPVNWDEVGPILEKRILDEVGRRLIPDIHTRIVTKFHYAPSDFSTDLSAHLGSAFSLEPLLTQSAWFRAHNRDDAISNFYLVGAGTHPGAGIPGVVGSAKATARLMLEDLS

SEQ ID NO: 10580 - protein, 438 aa, Sphingomonas aromaticivorans
RLDVVNPANEQVIACVPDAGAAELDAAVAAARKAFPGWAATPIAERKAMLDALADSIFANVDGFKRLLTAEQGKPHHEAQGEIMGAGYWLKAYTALDLPETVNEDSDERLSITRHVPLGVVGAIAPWNFPMILAMFKVAPGLLAGNTMVLKPSPFTPLCTLKFAELAKEILPAGVLNVITGGDHLGPLMTAHPGFDKISFTGSTQTGRRVMASAAPTLKRVTLELGGNDAAIVMPDVDVEKIAEQLFWAAFTNNGQICIATKRMYIHKDIYEPLRDALVAYARTVKVGDGSEQGTQIGPINNEAQYNRVLDLIQDAKDNGYKFLLGGEKAEVPGYFVPITILDNPPEDSRIVQEEQFGPVLPLIRFDDFEDVLNRVNASDYGLGGSVWGSDEDKAFELAQRVQSGTVWVNETQHLSPLAAFGGMKQSGVGVEGGLEGL

SEQ ID NO: 10581 - protein, 242 aa, Sphingomonas aromaticivorans
MMDDTDFTGRRVLVVGGSSGIGNGIAQAFRDRGAEVHVWGTRANAAGYDPAEGSDLAGLGYTCVDVGSPDAIEAAPAPFPALDVLVLCQGTVVYKRGEFEREGWDKVMAVNLDSLMHCSRKFRPQLAETGGSIIIVSSISGLKANIGNPAYAASKAGAISLTKSLGQAFAADGIRVNGLAPGLVDTKLTKVTTAHPQRLEGAIANIPQRRMGTPADMAGAAIFLASPLASYVTGHTLVVDGG

SEQ ID NO: 10582 - protein, 394 aa, Sphingomonas aromaticivorans
FEHSDKVKNLLARLEAFMDEHIYPVEQAYYDFVHDQQNLWAEWPGMEPLKEKARAAGLWNLFLPHEYGAWSPGLTNLEYAPLAEVMGRVPWSSQVFNCSAPDTGNMEVLAKFGSPEQQELWLKPLLAGEIRSAYVMTEPQVASSDATNLELSIIPDGDEYVINGRKWWISNAMHPRCEIMIVMGKTFFEGPRHSQHSQILVPRDTPGVTVVRHLKVFGSSNSPGGEVELRFDNVRVPKQNMILGEGRGFEIAQGRLGPGRIHHCMRSIGQAQRALEWMARRADSRVAFGKKLADQSSVRQDVARSFCEVEMARLLTLKAADAMDRLGNKAARDLIAAIKVVAPSMAQQVADRAIQVHGGMGVSEDGPMAYFFTLNRYVRLTDGPEEVHMSQLGK

SEQ ID NO: 10583 - protein, 356 aa, Sphingomonas aromaticivorans
  unsure (1)..(356): unsure at all Xaa locations
MKALRYYGARDIRHESMDDPTPQSDRDAIVKVDACSICGSDLHIYHGHGFSEDIGFCVGHEAVGEVVEVGRGVHRLKVGQKVMIPAAVGCGACRSCLAGVVNTCENNGSGCYGLSAKLQGSQAEAVRVPAADANAVAIPEGVSTEQALMMTDALATAWFGARQADIRPGSSVGIIGLGPIGLMAAESAFVMGAHVVYAIDPVPERRAIAESLGAIALHPDEASARIKEDTHGRRLDCVVEVVGSDATVDMALRLVRVRGTVSVIGVQQSRRFPFPLERAFAGGLTFRVGTCSVPEELPALFPLVASGRLRPERYISHRLPLSQGAEAYRMFEAREAGALKMVLVPDXLRAAQQTTD

SEQ ID NO: 10584 - protein, 249 aa, Sphingomonas aromaticivorans
MMRFDGKAVLVTGAATGIGRATALAFAREGASVMIGDIDERADETVALILSEGGRAAFRKTDVRRAADLDELVAQCLDRFGRMDAAFNNAGVLPPQRPIHEVPEDELDLAIDVDFKGVFFAMQAEIRHFLKVGGGAIVNTASVGALIADPNMSAYCAMKHAVSGLTKAAAVEYAQAGIRVNAIAPGFVVTPMTQHWADSNEFTQMFFAQNISGRAARPEEIAPTVLHLCSDGASFINGATFTIDGGQTA

SEQ ID NO: 10585 - protein, 847 aa, Sphingomonas aromaticivorans
MKDIRTTCAYCGVGCGIRATVTGDRAVSIKGDPEHPANFGRLCSKGTHLGETVGLEGRLLHPMVDAERATWNEALDLAAARMRECIERHGPDSVAFYVSGQLLTEDYYVANKLMKGFIGSGNIDTNSRLCMASAVAAHNRAFGEDLVPCTYDDLEAADLVLLVGSNTAWCHPVIWQRIEAARSARGTRLVVIDPRRTETAEQADLHVALAPDGDIALFNALLAEMRDRDLLDEAFMAERCAVPEGYVAGLDPRGHGIDPATFRALADLVAASPRMVTLFSQGANQSRCGTDKGNAIINLHLALGRISQTGAGPFSITGQPNAMGGREVGGLANMLACHLGFSSEERADAAIFWNAPNICAGPGLKAVDLFRAVHDGRVKFVWVMATNPAVSMPDAGFVREALARCETLVVSDVIADTDTARLAHIRLPALAWGEKDGTVTNSERRISRQRALFEAPGQARADWAILCDFAERMGWGRAFAFPTAAAIFREYAAMTALAGARGKALDLSHLAGLGDAAYEALEPTLWGGVHPTARTFSHPDGKARLVAVEAPVAAPADPEFPFRLNTGRYRDQWHTMTRTGLSPTLSQHRREPLLEIHPEDAALAGIEDGGLARLATRVGATVFRVLHSTAQRRGDLFVPMHWTDAMAGEGRANRLPLQETDPLSGQPGFKDTPARVEPVVPEWRAFLATRDEAALPSLLWWSRAKVANGWLCELAGNGAPDLEVILPKGTWLEAADMVRGMRRIIVLDKAGGLLAALYLTRNGELPPRDWVAAQIGNAEASALELLAGRPAVALPDRGPIVCVCHGVGVNEIAAAACAGAMTLEAIAGCTRAGSNCGSCRPAIARML

SEQ ID NO: 10586 - protein, 519 aa, Sphingomonas aromaticivorans
PHQQAFAQRGAWNLRTLADLARERAASDPDFVCFVDGEGQYTFAQVLAEAEALSASLHARGFRAGDVIAFQVPNWREAAVINLSAAMSGFVVNPIVPIYRDAEVTMMLGDCRAAAIFVPQVFRKVDYAEMARRCQKALPDLAHVFTVRGEGPDDFATLVAQGRALSFEVPTVDPMGVKMVLYTSGTTGRPKGVLHSHCTLQRIVAESGRHWGLGAGEATLMPSPVTHVSGYANGLEAPFICGIRSVLMEAWNAQDALALIEKHDLVGTVAATPFLVELAAAARAAGTGLPSFRFFACGGAAVPADLIPAANAAFENCRAFRVFGASEVPLVTFGWPHDERLAATTDGEVVDYEVRIVDHEDNDLPRGVEGEILARGPGMMMGYADAAQTAEAITPDGFFRTGDLGVLSEEGAVTITGRKKDLIIRGGENISAKEIEDVLHSHDAVKEASVVAMPHERLGEGICAYVILSAAVDAAVLAAHVAASGMAKQKIPERFEFVEDFPRTASGKVRKDQLRAMIR

SEQ ID NO: 10587 - protein, 253 aa, Sphingomonas aromaticivorans
RIMAGNSGRLEGKKAIVLGASSEGNMGQVIAQRLIDEGAEVLVAGRKDAVLKAFADKTGCHWTSCDITDEASVNALADTAVATMGGIDIAINSTGWGLLKPFLDVTREDLDAMTALQLVGPHQFFQAMVRKMARSLGGRGGSIITISSATATIMLNDHAIYMGTKAGTDHIVRCIAHEFGHEGIRANSISPGLTDTPMNEDAKQVPGLFESFRNSYPLGRWGTSEDVAAAAVFLASDECFMTGENLQVNGGLT

SEQ ID NO: 10588 - protein, 246 aa, Sphingomonas aromaticivorans
  unsure (1)..(246): unsure at all Xaa locations
LGLKGKKVILTGGSRGIGRATAELLAAEGADIAFCSRNPEQVAETVASLEKHGGKIYGSAFDMDSGHDAYRAWLTDAAEKLGGCDIFIPMISTSGSGQTGDWQKGLDHDIMGSVIGVEVLEQYLEKSSSPSVVILSSTAGLETFIVPQGYNALKGALIVYAGQLSQALGPKGIRVNTVSPGPIKSPAVAGTXSKARRPISTSRWRPALPSGRFGAPDEVAKAVVFLASPASSYTTGTNLVVDGGFT

SEQ ID NO: 10589 - protein, 477 aa, Sphingomonas aromaticivorans
LLIGNADVAASGGATFERTGPLGGEPTVAAAASAADAIAAADAAAAALPAWAALGPNERRRLLLAGADALEAQTGAFVEAMAAETGASNGWAGFNVHLAAGLLREAAALTTQVKGETILSDRPGCYAMTLRRPAGVVLGIAPWNAPVILGVRAIATPLACGNTVVLKASEHCPATHRLIGTALRSAGFPAGVVNVVTNAPADAGEVVAALVNHRAVRRINFTGSTRVGRIIAGLAAQQLKPCLLELGGKAPMIVLDDADLDAAVAAAGFGAYMNSGQICMSTERIILEDGIADAFVERFRARVDGLTAGDPRAGSAPLGSVVDEATGRRVRHLIEDAVGKGARAHGDWQTGGTLIPAIVVDGVTPDMLLYSEESFGPVTTILRAANEDVAVRIANDTEYGLTSSVFSQNIARALRVAERIEAGMCHINGATVHDEAQMPFGGTKASGYGRFGGEAGIAEFTELKWVTIDTQTPHWPI

SEQ ID NO: 10590 - protein, 508 aa, Sphingomonas aromaticivorans
AVLPAGVSATDMASAIAEFVAILGPQNVLTDADHIAPYTKVMIAESEDLHRPSAVLYAREVGEIQKILKVCNDYKVPIWTISTGRNFGYGSAAPQSAGQVVLDLKHMNRILEVDPVLCTALVEPGVTYQQLKDYLEEHDIPLWLSCPAPSAIAGPLGNTVDRGVGYTPYGEHFMMQCGMEVVLANGEVLRTGMGGVEGTSAWQVFKWGYGPYLDGIFTQSNYGIVTKMGMWLMPKPPVYKPFCIRYDNDEDIHDIVETLRPLRIANVIPNAMVFANVMWEAAALMPRSKYYDGTGTTPDSVLEEIKAKEGLGAWNVYAALYGTKEQVDVNWQIITGAIKASGKGKIITEEEAGDTQPFNYRAKLMRGDMTMQEFGLYRWRGGGGSMWFAPVTAAKGSETVEQTRLAKEILGEYGLDYVAEYIVGMRDMHHIIDVLYDRSDPEEMKRAHECFGKLLSEFGKRGYAVYRVNTAFMDQTADLYGPVKRKVDQTLKRALDPNGILAPGKSGI

SEQ ID NO: 10591 - protein, 504 aa, Sphingomonas aromaticivorans
  unsure (1)..(504): unsure at all Xaa locations
NLAEFLAAALARDPEGEAVVEGERRMTYAGLDRAARALAARMIALGVTPGDRVAVLLGNRIEYPVIVLACTFAGAIAVPMNIRQTAAETAHALAASGARLLFHEADARLPDRAQVPALAALVAIADDAPLAETLAPQDVPVSALPPLPGEDEPAVILFTSGTTGKPKGAVLTHCNIAHSILHFCHHYALREGERCLLAVPASHVTGLVALLATSLGLGGCLVIMREFKAGEFLRLMAQEQVGYTLVVPAMLTLALMQPQFESAALSNWRVCGFGGAPMPDATIADLALRLPGLALHNTYGATETTSPAVIMPADQAAARSRQLGLPVLCCDLLVMDDQGRECPPGEQGEIWMAGPMVIPRYWNDTAATAAAFVHGYWKSGDIGSRDADGHVSIHDRMKDMINRGGFKIYSVEVENALCAHPAVIEAAVVGRPCPVLGERVVAFVHAGAPASAEELRAHVAARLSDYKVPEDIRFETVPLPRNANGKLLKHALRDRLVGAXSRKL

SEQ ID NO: 10592 - protein, 264 aa, Sphingomonas aromaticivorans
RLEGKVAIVTGAGRVGNIGVAVARAFLREGAQAVVGTDFRREEAEAIADLVKADGSQGSFVLMEQDVTSEADWARVSRETVDRFGQIDVLVNNAGISIHGSIAGTSLDDLRKVMAVNHDALFLGIKACAPHLAGAVARFGGGGAIINNLSMASYMPNATNIGYHVSKAAGRMLTVCAALEYGRRKIRVNSIHPGVTMTPILREGLDAYVANGMWDSTEAAEQALAAMNPLGISSVPEDAANAFVYLASEEARFVTGAAICHDGG

SEQ ID NO: 10593 - protein, 251 aa, Sphingomonas aromaticivorans
VERDGPVVVATLNRPETRNAISETAHSEEIAAFCAEVTRDPGVRAVVLTGAGKAFCAGGNVKHMADKTGMFGGSPFSIRNQYRTGIQLIPAALYELEVPVIAAVNGPAIGAGLDLACMTDIRIASDNAVFAESFVKLGIVPGDGGAWLLPRVIGMARASLMTLTGDTIDAAKALEYGLVSEVVAPDQLLPRALEIAQSIAANPGHATRMAKRLLREGQDMKLGPLLELSAAYQALAHHTHDHHEAVSAFLE

SEQ ID NO: 10594 - protein, 324 aa, Sphingomonas aromaticivorans
MSVRSVIRGSGSALPRRAVSNAEMTTMVDTTDEWIVERTGIRNRYIAGEGETTSTLATEAARKALEAAGVDASRIDLIVLATATPDQTFPATATIVQHNLGCNGGIAFDVAAVCSGFLYALATADSMIRSGMARCALVIGAETMSRLLDWEDRTTCVLFGDGAGAVVLEAVDVDETDPKAPGILATRLHADGAHNELLYVDGGPSTTGTVGKLRMKGREVFRHAVTNLANVLKEVLETTGHDAEEIDWVVPHQANFRILDATARKLDLPADKVIVTVDHHANTSAASVPLAYDTAVRDGRIKPGDLVMFEAMGGGFTWGASLAR

SEQ ID NO: 10595 - protein, 300 aa, Sphingomonas aromaticivorans
RDLTGIGQLARHEILYLLDEAEQWVELNRQSQKTTDLLNGLTIINAFFENSTRTLLSFEIAGKRLGADVVNMHAATSSVKKGETLIDTAMTLNAMRADAIVIRHASSGAVRLIAEKVDCPVLNAGDGQHEHPTQALLDALTMRHAMKLPAGSDLNGLKVTICGDILHSRVARSNILSLTALGAEVRVCAPPALMPAEIEAMGVTPFHDFDAALKGANIVMMLRLQQERMSGQFIPSPREYRHLYGLTPERLARAEADAFVMHPGPMNRGIEIDSTVADHPTRSLITRQVEMGVAIRMACL

SEQ ID NO: 10596 - protein, 466 aa, Sphingomonas aromaticivorans
RLYIDGDWVEPARPDPPIPVINPATEMACGSIRPGSALDVDRAVAAGRRAFASFSVSPAQERIALLGRILSLMEERAEALAQAVTLEMGCAISFSRTAQVPFGVAHVRAALKVLHDFPFLTPQGSTAILREPIGVCGLITPWNWPLYQITAKLAPALAAGCTVVLKPSELSPFSAALLAQIVHDAGTPAGVFNMVTGTGPGVGEAIAAHGDIDMVSITGSTRAGVLVAQAAATTVKRVTQELGGKSPNILLDDADFERVVPLGIAAGMRNVGQSCSAPTRMLVPRHRLTEVEQLAANAANALVVGDPLAEATDLGPVANSRQFDKVQQMIAVGQAEGARLLCGGPGRPEGLDRGFFCRPTVFTCDDPAMRVAQEEIFGPVICVIPYDDDDHAVRIANDTIYGLGSHVQSADIDRARTVAARIRAGQVHINHPAWDGHAAFGGYKQSGNGREYGRFGLEEYLETKAV

SEQ ID NO: 10597 - protein, 462 aa, Sphingomonas aromaticivorans
IDGKWVDSEGGKRHEVINPTTEEPCCVITLGTQADVDKAVAAAQRAFKTFSKTTREERLALLERIVEEYKKRVPDLAAAMAEEMGAPVSFASTAQVGAGIGAFLGTMAALRNFSFVEDNGAFKVAYEPIGVVGMITPWNWPLNQIALKVAPALAAGNTMILKPSEECPTNAAIFTEILDAAGVPPGVFNLIQGDGPGVGTAISSHPGIDMVSFTGSTRAGILVAKAAADTVKRVHQELGGKSPNVVLPDADFAKYLPSTASGPLVNSGQSCISPTRILVPREREAEAAAFVSAMYSATPVGDPMQEGAHIGPVVNKAQFDKIRGLIQSAIDEGAKLETGGPDLPANVNRGYYIKPTVFSGVTPDMRIAQEEIFGPVATIMAYDSLEEAIEIANDTAYGLSACITGDPAKAAEVAPELRAGMVAINNWGPTPGAPFGGYKQSGNGREGGLYGLKDFMEMKAIS

SEQ ID NO: 10598 - protein, 303 aa, Sphingomonas aromaticivorans
VFIDGAAGTTGLEIAERLSGRSEFALIALEDARRKDDAARAEAINDADVVILCLPDDAARDAVAMIRNDRTRVIDASTAHRVADGWTYGFPEIVGRETVAQAKRVSNPGCYPTGFLGLLAPLVHNGLLPAAWPYSCTGVSGYSGGGKALIARFEQDRDIAWRGYGLTFGHKHVPEMQRYAGLAIAPMFSPAVVPAHRGMVVEIPLPLGVMPGNVPAELLRAALTQFYAGSPIVTVAQELPADGEMLMRASMEPWDGLELHVMGSSDGEQARLVAVLDNLGKGASGAAVQTLNLMAGLDETAGL

SEQ ID NO: 10599 - protein, 569 aa, Sphingomonas aromaticivorans
KASGNPSEKALGALAMSDEQNKPESYSYAKAGVNIAAGNALVKAIGPLAKSTARPGADAELGGFGGFFDLKAAGYNDPLLVAGNDGVGTKVKLAIDHDRHDQIGIDLVAMCVNDLIVQGAEPLFFLDYFATGRLDNGVAERVVAGIADGCKLAGCALIGGETAEMPGMYADGDYDLAGFCVGAVERGEQLTGDRVAEGDVLLGLASSGVHSNGYSLVRRLAADKGWKLDRPALFDNERLLIDYLIEPTRIYVKSLLPFIRSGRINALAHITGGGLLENVPRVLPRGLHARIDADSWEQSRLMAFLQAQGNIEPEEMARTFNCGIGMILAVNPAQADALAADLAAAGETVYRVGTIVKGEKGCTVTGSAETWSARSAWEAPTLAERTPVAVFISGSGTNMAALLYASRMAGCPYEIALVLSNNPDASGLRLAQAESVPTFCLPHKGIPRAEHDALMEAEVLKSGAQLIALAGYMRILSAEFVARWEGRMLNIHPSLLPKYKGLHTHDRAIEAGDTHGGCTVHLVTAELDDGPILGQLPVAILPGDTGETLAARVLFAEHQLYSRVLSTFA

SEQ ID NO: 10600 - protein, 140 aa, Sphingomonas aromaticivorans
MAVTRTFSIIKPDATRRNLTGAVTKMLEEAGLRVVASKRIHMSREQAEGFYAVHKERPFFGELVEFMISGPVVVQVLEGEDAVKRNRDIMGATNPKDAAPGTIRKELAESIEANSVHGSDSEENAAIEIAYFFKPEEIVG

SEQ ID NO: 10601 - protein, 284 aa, Sphingomonas aromaticivorans
SPIAWGMWRLAENGRTPADAAKLVHAALDAGINFLDTADIYGFDGSAGFGDAEALLGEVLAAEPALRERMILATKGGILPPLPYDQSADYLRKAIDDSLARLKVDVIDLWQIHRPDILAHPYEVARVLDDAVSSGKVRALGVSNFTKDQIAALNHFLGEKLATTQPEISPLRIDCFENGELDQAMMLGLTPMAWSPLGGGRLASPQTARDKAVADALDAVAQAQGVSRTVAAYSWLMAHPAGIVPIIGSQQAARIAEGAEALKVRWNRQDWYAVLVAARGERLP

SEQ ID NO: 10602 - protein, 482 aa, Sphingomonas aromaticivorans
DVAVIGGGVNGCGIARDAAGRGASVLLLEANDLASGTSSNSSKLIHGGLRYLEHYEFGLVREALSEREKLWAIAPHIIWPMRFVLPWVRGLRPRWLLRTGLFLYDHIGARKLLPATETIRLDRHPAGRPLKPEFVHGFVYSDGWVDDARLVVLNARDAANRGAEVRTRCPVTALRREDDLWSIETAHGRFLARSVINAAGPSVLAILGCSGEPPRQSIRLVRGSHIVVRKLFDHPHPYFFQLPDGRIFFAIPYEHDFTLIGTTDRDHRPGDPIEASAEEIAYLCEGASRFFRKPVVPADVVWTYAGVRPLVDDGSGKPEAATRGYRFDISDENEGAPILSVFGGKITTYRTLSQEAVDRMATRIPALEGRHWTDNSALPGGDFGVNEVDRLIADLRGRYPFLEPAWADRLVRSYGTLAFLVLGEAHTLNDCGRHFGHGLTEREVRYLLANEWAREAGDVLWRRTKLGLRLDAAEQADLAQFM

SEQ ID NO: 10603 - protein, 498 aa, Sphingomonas aromaticivorans
  unsure (1)..(498): unsure at all Xaa locations
MTDERRILVLDEGTTSTRAILYSARGEVLGCAQEELTQYYPAPGLVEHDAAEIWERTLRCARAMVAQAGGAGRIAGIGVTNQRETVVAWDRSTGKPLTRAIVWQDRRTEERCRELRDAGHEAAIQQATGLLLDPYFSASKMEWILRNVPEARALGSRLAFGTVESWLVWNLTGGLHVSDVTNASRTSLFPLEGASWDEGLCDLFGVPLSALPEVVPSAGAFGTTRADLLGGAIPVTGLAGDQQAATIGQGCFRAGEAKATLGTGAFILANMGTRPPRSAHRLLGTVLCEVDGVRTFALEGSVFAAGSVVKWLRDSIGLLGTSAESEALARSVPDSGGVVVVPALSGLGAPYWKPDARASIHGLSFATTRAHLVRAALEAMAHVFHDLGHAFAADGAGWQVLRLDGGMSANDWLAQDIADVLGIRCERPVDVETTARGAAILAAIGAGLCPSLDHARTIVAPSAAFEPGMAAQERHGRLVRWREAIGGXPPARSAERED

SEQ ID NO: 10604 - protein, 405 aa, Sphingomonas aromaticivorans
TLMLNHGYDPHLSEGAVKPPVFLTSTFVFPTAEEGRDFFDYVAGRKEPPPGQGRGLVYSRFNHPNSEIVEDRLAVYEGAEAGVVFSSGMAAITTALLAFARPGDVILHSQPLYGGTETLLAKTFANLGIGAVGFADGLGDEEIAAAADAAMGRGRVSVVLIETPANPTNSLVDIALARRVCDAIGEAQGHRPLLMCDNTLLGPVFQRPLDHGADVSLYSLTKYVGGHSDLVAGAALGSAAIMREIRLLRSAIGTQLDPHSCWMLGRSLETLALRMEKANANAAVAAAFLRDHPKVRHVSYPLFNEPDSPQARLFARQCTGAGSTFSFDIVGGQDAAFRFLNALQIFKLAVSLGGTESLASHPGTTTHSGVPADVRERIGVHETTVRLSIGIEHPDDIVADLAQAL

SEQ ID NO: 10605 - protein, 250 aa, Sphingomonas aromaticivorans
MELQGKIALVTGAASAAGLGFATARLLARRGAAVWLTDIDAAGAEARAAELAAQGFAARGMGHDVTSASGWAEVLFAIARQDGRGPDILVNNAGIAVLRWTPDLEPDEWQRQIDVNLTSVYLGCRAVLPAMRAAGDGAIVNISSVAGLVGIPGASAYAASKGGVRLYTKSLAMECAREGIRVNSVHPGVIWTEMQQVAIRDNPDQYDAINASIPAGRMGEPDDIAQAVAFLASPAARYITGAELAVDGGL

SEQ ID NO: 10606 - protein, 351 aa, Sphingomonas aromaticivorans
GEKARLRSLAPRRGVDFASNDYLAMSSSPRLAGAVQEAVTRGVPLGSGGSRLLRGNDPEHELLETEAARFFGSESALFFSSGYAANVALLSTLPQRGDLIIYDELVHASMHEGLRLTRATSVSAAHNDPQSFDDAALDWRAKGNTGRVWLAFETLYSMDGDMAPVAEMAQIAERHDAVMLIDEAHATGVFGVDGRGLAASLDGRADTIVLRTCGKAMGCEGALVLAPRVVRDFLVNRGRPFIFSTAPSPLVCAAVREAMRMMADEPERRENLRTLVAHAERALVRHGAEPTGSQILPLILGEDARTMAVAASLQASGFDVRGIRPPTVPQGTSRLRISLTLNATRDDVDAL

SEQ ID NO: 10607 - protein, 956 aa, Sphingomonas aromaticivorans
  unsure (1)..(956): unsure at all Xaa locations
MGYERQADFGTPEVRSETEVTCFIDGREVTVPSGTTVMRAAALTGGSIPKTLTRTDNLKQFGSCRLCLCRIDGMRGTPASCTTPVASGMKVHTQTPRLEKLRRGVMELYISDHPLDCLTCSANNDCELQDQAAAVGLRDVRFGYEGENHLGAATDTSNPYFDFDPSKCIVCSRCVRACDEVQGTFALTIDGRGFASKVSAGLGSDDYLSSECVSCGACVQACPTATLQEKAVKEIGKPERAVVTTCAYCGVGCTFRAEMRGEQLVRMVPWKDGKANRGHSCVKGRFAWGYAQHQERVLSPMIRESIDQPWREVSWEEALSHTAREINRIRETYGRNALGGITSSRCTNEETFLVQKLIRAGFGTNNVDTCARVCHSPTGYGLKTTFGTSAGTQDFDSVEDTDVILVIGANPTDGHPVFASRMKRRLRQGAKLIVIDPRRTDLVRSPHVEADFHLPLRPGTNVAVLTAMAHVIVTEGLADEAFIRERCDWDEYQHWAEFVSAARNSPEFLSPVIGVGADAIRGARGFMRPAATVRSTMGLGVTEHSQGSSTVMAIANLAMATGNIGRRGVGVNPLRGQNNVQGACDMGSFPHELSGYRHVSDAETRALFEAEWGVPIDPEPGLRIPNMLDAATDGVFKAIYIQGEDILQSDPDTRHVAAGLAAMECVIVHDLFLNETANYAHVFLPGSTFLEKNGTFTNAERRIQPVRKVMEPLNGYEDWQVTQELARAIGLDWNYTHPSEIMDEIARLTPTFAGVNYKRLDAEGSLQWPVNDKAPDGSPIMHIDGFVRGRGKFVVTDYVPTDERTGPRFPLLLTTGRILSQYNVGAQTRRTANTVWHPEDVLEMHPTDAENRGVKTGDWVRLASRSGETTLRALVTDRVAPGVVYTTFHHPATQANVVTTDYSDWATNCPEYKVTAVQVTPSNGPSDWQEDYEAQAARSRRIAGHEGAMEPAEXVR

SEQ ID NO: 10608 - protein, 858 aa, Sphingomonas aromaticivorans
MNLEKFTDRAKGFLQAAQTVAIRMNHQRITPDHILKALLEDSEGMASGLIQRAGGNAALAQTEVDKALAKIPAVSGSGAQATPGLDNDAVRVLDSAEQIAAKSNDSFVTVERMLVALTLATTTSAGQALKAANVTAQALEAAITQLRGGRTADSASAENAYDAMKKYARDLTEAAREGKLDPVIGRDEEIRRTVQILARRTKNNPALIGEPGVGKTAIAEGLALRIANGDVPDSLKDRRLMALDMGSLIAGAKYRGEFEERLKAVLDEVKGAEGEIILFIDEMHTLIGAGKSEGAMDAGNLLKPALARGELHCIGATTLDEYQKYVEKDPALQRRFQPVFVGEPTVEDTISILRGIKDKYELHHGVRIADNAIVAAATLSNRYISDRFLPDKAIDLMDEAASRIRMEVESKPEEIEKLDRRIIQMKIEEMALAKETDQASKDRLATLREELANQEQQSAELTTRWQNERDKIAAEGKVKEALDAARSELEVAQRNGDLAKAGELAYGRIPELERQLAEAQGVSQNAMLREEVTAEDIAAVVSKWTGVPVDRMMEGEREKLLHMEEALGKRVIGQKDAVLAVSKAVRRARAGLQDPNRPLGSFLFLGPTGVGKTELTKALAGFLFDDDNAMVRIDMSEFMEKHSVSRLIGAPPGYVGYDEGGVLTEAIRRRPYQVVLFDEVEKAHSDVFNVLLQVLDDGRLTDGQGRVVDFTNTLIILTSNLGSQYLANLEEGQDVQSVEPQVMDVVRAHFRPEFLNRLDEIILFHRLGHEHMAPIVDIQVGRVANLLKDRKIVLDLTDAAKRWLGRVGYDPVYGARPLKRAVQRYLQDPLAEKLLGGEVPDGSTVRIDEGDGALSFVI

SEQ ID NO: 10609 - protein, 359 aa, Sphingomonas aromaticivorans
VCNGRETILLGTYNYMGMTFDPDVIAAGKQALDDFGSGTTGSRVLNGTYAGHKACEEALKEFYGMDHAMVFSTGYQANLGIISTIAGKGDYIILDIDSHASIWDGCKMGDAEVVPFKHNDIEAMEKRLKRVPEGAGKLVVLEGVYSMLGDIAPLKEMIRIAKEHGAMVLVDEAHSMGFIGPNGRGVAEEQGVLDQVDFVIGTFSKSVGTVGGFCVSNHPKFEILRLVCRPYVFTASLPPSVVHTAATSIRKLMHAGNKRAHLWENSKTLHKGLRDKGFQLGTTEPQSAIISVIMPDLERGAAMWEALLHEGLYVNLARPPATPAGMTLLRCSLCAEHTAEQVQTIIGMFERAGKAVGII

SEQ ID NO: 10610 - protein, 174 aa, Sphingomonas aromaticivorans
QATAILAGGCFWCTEAVFRDVIGVSNVESGYIGGTVESPTYKQVCSGSTGHAEAIRVTFDPQVIGYGQILDIFFATHDPTQLNRQGNDIGTQYRSALFPLDDEQRSEAKAAIGRAQPDWPRPIVTTIEGPATWYPAEDYHQEYWEGEGQRNPYCLAVIPPKLMKLRKSFANKVK

SEQ ID NO: 10611 - protein, 461 aa, Sphingomonas aromaticivorans
MAIELKMPALSPTMEEGTLAKWLVKAGDEVRSGDILAEIETDKATMEFEAVDEGVIAEILVAEGTEGVKVGTVIATIQGEGEDAAPAAATPAVEQKVEMSEAAPSVEARAAPAVAIAPKVDAKPAVDPEIPAGTAMVPTTVREALRDAMAEEMRADDRVFVMGEEVAEYQGAYKVTQGLLDEFGPRRVIDTPITEYGFAGIGAGAAMGGLRPIIEFMTFNFAMQAIDHIINSAAKTNYMSGGQMRCPIVFRGPNGAASRVGAQHSQNYGPWYANVPGLVVIAPYDSADAKGLMKAAIRSEDPVVFLENELVYGRTFDVPQMDDFVLPIGKARIVRQGKDVTIVSYSIGVGLALEAAETLAAEGIDAEVIDLRTLRPLDKDTVLASLAKTNRLVVAEEGFPVCSIASEIMAICMEDGFDHLDAPVLRVCDEDVPLPYAANLEKAALIDAGKIAAAVRKVCYR

SEQ ID NO: 10612 - protein, 324 aa, Sphingomonas aromaticivorans
RYDASDAELLKFYEQMVLIRRFEEKAGQLYGLGLIGGFCHLYIGQEAVAVGLQSALKEGHDSVITGYRDHGHMLAYGIDPKVIMAELTGRGAGISRGKGGSMHMFSTDHKFYGGHGIVGAQVPLGAGLAFAHKYRGDDGVCMAYFGDGAANQGQVYETFNMAALWKLPIIFVVENNGYAMGTAVKRGSAETEFYRRGTAFRIPGMDVNGMDVLEVRQAAEVALEYVRAGNGPVLMELNTYRYRGHSMSDPAKYRSREEVQEMRDKHDPIEGAKAELLKRGVTEDKIKEIDKRIRQIVAESADFAETSPEPDMAELYTDVLVEKY

SEQ ID NO: 10613 - protein, 354 aa, Sphingomonas aromaticivorans
MAVIPVAIAGAPYEVRIEAGVLARAGEHCRPFLRKDRVAIVTDEHVAAEWRETVTASFDSVGVRSEWLVLPAGESTKSWEHLARLVDWLLEQEVERKDRIVALGGGVIGDLTGFAASIVKRGCGFIQIPTTLLAQVDSSVGGKTAINTPAGKNLVGAFHQPALVLADPLALDTLPLRDVRAGYAEVVKYGLIDDAPFFEWCEANGAKLLAGDLAARETAIAHSVAAKARIVAADEKEIAGIRALLNLGHTFGHALEAETGFTDRLHHGEGVALGMVLAARFSARQGLMSRQDAERVARHVEAVGLPATLRELGLSCDGRRLADHMLHDKKMDAGTLPFLLMRGIGQTFLAKDVD

SEQ ID NO: 10614 - protein, 481 aa, Sphingomonas aromaticivorans
IESSCSALLLFGATGDLSRRMLLPSLYALHEDGLIRPDLRIVGTARSEHDDAEFREFAREALAEFLPEDRRDEEKLASFLERLEYQTLDASNVDGFGELARKLGDTSCGLSIFLSTAPFLFEPTIEGLRRAGLAHENVRIGLEKPLGNDLASSTRINDAVAAAFAEEQIFRIDHYLGKETVQNLMALRFANMMFEPLWNAGGIDHVQITVSETVGLEGRKGFYDDTGALRDMVQNHMLQLLALTAMEPPASLDATSIRDEKVKVLRALRPVKAEEMVRGQYRAGAVKGTSVTGYQEDLGEVSDTETFVAIKAHVDNWRWTGVPFYLRTGKRLGERRSEIVVEFKPVPHNLFAERGGRLRPNRLVIRLQPEEYVRLQVMAKEPGLDRGGIVLRDVNLDLSLTAAFAKARRRIAYERLLLDLIEGEQTLFVRRDEVEAQWKWVDAIRKVWADTDMEAKPYAAGSWGPNAGIALTERDGRSWND

SEQ ID NO: 10615 - protein, 335 aa, Sphingomonas aromaticivorans
RCQYYLHNFLSSQPQVNAHNPEVQEALLGAMKFWLDRGVDGFRLDALNFLMHDPTLRDNPPAPDDGRRKTRPFDFQLKIYNQSHPDILKFIQRVRNLCDDYGAVFTVAEVGGDLAETEMKAFTAGDRHLNSAYGFDFLYADRLTPHFVEKAVAKWPDAPGMGWPSWAFENHDAPRALSRWCAPDQREPFARLKAMLFASLRGNIIVYQGEELGLTQVDIPFEQLQDPEAIANWPLTLSRDGARTPMPWLVQSGEGGFTSGAPWLPLGEENLSRAVDRQEGDPASLLNLTTRLLRLRRETPALRIGSFEVIHADECLLAIRRVLGEQSIAGLFNLS

SEQ ID NO: 10616 - protein, 311 aa, Sphingomonas aromaticivorans
RPLYHYAPAANWLSDPNGLVWQDGEWHLFYQYNPFGEDWGHMSWGHAVSRDLVTWQELPVALAEEDGTMIFSGSAVIDHQGSAGFGKGAMVAVYTGARTDRAHQFQSIAASTDRGRTFTKFTGNPVLDLQMADFRDPNVFWHGPSGRWIMSVVLSEENRAQLYASVDLRHWDLLSDIGRDGAPGHLWECPWMVELPVEGTDETRWLFKVDVLSGAAGQASPWRVGHFDGRRFVPETGWAVGDHGPDFYAAIGWNAAPDAEGRPVWIGWAGNHAYQKYLEPQGWRGAMTLPRRVSLRRDESGYALVQEVEPA

SEQ ID NO: 10617 - protein, 292 aa, Sphingomonas aromaticivorans
LKPALAAIAEDIDRSFDLLLPVPGDPRDRLVEAMRYAAIGGGKRLRPLLVCATGALHGVSREAAVRVGTAIEAIHVYSLIHDDLPCMDNDGLRHGKPTVHVAFDDATAVLAGDALHDFAFEVLSDPATSGDPFTRIELIRTLATASGMNGMCGGQMMDIVAETSSFDLPTVTRLQQLKTGALLGASVELGAILGKVPPEGRTHLRGYARDIGLAFQIADDLLDAEGDEAAAGKALRKDAAQGKETFLSLLGADRAREQARLLVNQAVEHLASYGPEADLLRELARFIVERNH

SEQ ID NO: 10618 - protein, 209 aa, Sphingomonas aromaticivorans
MISVRDLRKVYTTRFGKKLVLDGVSFDLNKGERLGVLGRNGAGKSTMVRLVSGAERPTSGSIDRRMSVSWPLAFGGAFQYNLTGLDNIRFISRIYDQDFERNLAYVEEFAELGPYMREPLRSYSSGMKARLAFAISMIIEFDCFLIDEIASVGDARFHDKCNHELFERRGDRAMIIISHDAAYVRDHCTRWGVLHDGRLELYGDFEVAY

SEQ ID NO: 10619 - protein, 473 aa, Sphingomonas aromaticivorans
VYLGIDIGTSGVKAVLVEERGAIAAQGTAAHDVSRPYQMWSEQDPAAWVRATEEAVLALPSTLRGAVKGVGLAGQMHGATLLGADDRPLRPAILWNDGRSFAECVELEAAEPHTRAITGNIAMPGFTAPKLAWVRKHEPEIFAQVRTVLLPKDYVRLVLTGDKASDMADSAGTLWLDGAARNWSDAMLAATGLARSMMPKLYEGSAATGVLSAEVAARWGMGRVPVAAGGGDNAAGAAGVGVVGDGDALLSLGTSGVIFVATRDFRPNPARAVHAFCHCLPDLWHQMSVHLSAASCLDWAAAAMGVDVPALLALAEQSGPASGPELFLPYLSGERTPHNDPAVRAAFLRMGNETGPGQLAAAVLEGVAFAHADGLDALREAGTDVAALSVIGGGARSRHWGRILASVLDVRLDYLEGGEVGPALGAAKLAQIAVTGADPAEVCQRPPLAHSIEPDRDLAERLAPKLAAFRAAY

SEQ ID NO: 10620 - protein, 272 aa, Sphingomonas aromaticivorans
MALKSYNPTSPARRGLVLVDKSALWKGKPVKALTEGKRKTGGRNNKGHVTSRGIAGGHKQKYRYVDFKRRKWDMPATVERLEYDPNRTAFIALVKYEDGELAYILAPQRLGVGDQVIAGEKTDVKPGNAMLLSQMPVGTIIHNVEMKPGKGGQIARSAGTYVQLVGRDRGMVIVRLNSGEQRYLRGDCMGTVGAVSNPDNGNQNLAKAGRNRWLGKRPLTRGVAKNPVDHPHGGGEGRTSGGRHPVTPWGKPTKGARTRHNKATDKMIIRSR

SEQ ID NO: 10621 - protein, 438 aa, Sphingomonas aromaticivorans
MEGVKKRNPYQPEFVQAVQEVAEDIFDFIEDKEEYHAQQILRRIAEPDRVVSFRVCWEDDNGNVRVQRGWRVQNNNAIGPYKGGIRFHPSVNESVLKFLAFEQTFKNALTGLPMGGGKGGSNFNPKGKSVREIMRFCQSFMTELYRHIGADVDVPAGDIGVGGREIGYMFGQYKRITNHFTGVLTGKGLEWGGSLIRTEATGYGAVYFLANMLATKGEDLRGKTAVISGSGNVATHAAEKIVQLGGKVLTLSDSGGFIHDPDGIDQEKIDWVKTHKTHRRGRIEEYVDAFPGASFHAGKTPWGVPCDVALPCATQNELLGEDARTLIANGCKGVAEGANMPTDLEGVHVFKAARILYAPGKASNAGGVAVSGLEMSQNSERRSWKEHELQQMLKDIMAGIHKSCLTYGDQGGGYIDYVKGANIAGFKKVADAMLAFGV

SEQ ID NO: 10622 - protein, 202 aa, Sphingomonas aromaticivorans
IIVHHLNNSRSQRVLWLLEELGVDYEIRHYQRDAVTNLAPPELKAVHPLGKSPLLEIDGRVIEESGAIVQVLCERYGNGKWLPRQGSDDALRHLELMHFAEGSAMTPILLQLYTSRLGEAAAPLQPRIAEQLAAHFGYMEQILRPSGHFVGDDWTGADVMLSFPAEIAVMQGQAGSLPKLSAFVAAVHARPAWQRAREKGGA

SEQ ID NO: 10623 - protein, 799 aa, Sphingomonas aromaticivorans
EVPMNLYPLLPLRDIVVFPGMVVPLFVGREKSVAALEAAMSGDKDIFLLAQLDPGCDDPDRDDLYDTGVIASVLQLLKLPDGTVRVLVEGRERAMLEGLREETTAQGAMLIAQVEPIEPVVSQGTEISAMMRSVVDQFAEYAKLSKKLPQDAGGQLGDIEDAGKLADSVAANLAAKVADKQAVLSENDPMKRLEMVLSFMEGELGVLQVERKIRGRVKRQMEKTQREYYLNEQLKAIQSELGGGDGEEANEIAELQEKIDKLKLSKEARAKATAELKKLKTMQPMSAEATVIRNYLDVLLGLPWGKRSKLKKDIPAAQAVLDADHYALDKVKDRIVEYLAVQARTNKLKGPILCLVGPPGVGKTSLGKSIAKATGRQFVRQSLGGVRDEAEIRGHRRTYIGSLPGKIVTNLKKAGTANPLFLLDEIDKLGQDFRGDPASALLEVLDPEQNAKFQDHYLELDIDLSDVMFVCTANSLNLPQPLLDRMEIIRLEGYTEDEKVEIAERHLVRKQVEAHGLKKGEFTLTQEGLRDLIRYYTREAGVRTLEREIARLARKSLRQILEGKTKSVTITSDNLSDFAGVRKFRHGVSDEENQVGAVTGLAWTEVGGELLTIESVTVPGKGAVKTTGKLGEVMSESVQMAFSFVKARSPAYGIKPSIFNRKDLHIHLPEGAVPKDGPSAGIGMVTAMVSTLTGIPVRADVAMTGEVTLRGRVLAIGGLKEKLLAALRGGIKTVLIPEENRKDLAEIPTNIKEGLEIVPVSHVDEVLARALVTTPEAIEWTEADDLATQPAPTVAGPAT

SEQ ID NO: 10624 - protein, 804 aa, Sphingomonas aromaticivorans
LPIHSVLPDLLAALRQRESAVLIAPPGAGKTTAVAPALLAEPWCTGQVIVLSPRRVAARAAAERMAEMLGEEAGGTIGYVTRLDSRRSARTRVLVVTEAIFVATILDDPELSGVSAVLFDEAHERHLDSDLGLALAVEAQGVLREDLRIVVMSATIDGSRFAALLGDAPVIESEGKAHPLAIRWLGARPDAKVEVAMASAIQTAWREEEGDILAFLPGVAQIERTAETLAERLPQALILPLHGQVEPGGQRAAIRRDPSGRRRIVLATAIAETSLTLDGVSVVVDAGLSRRAEFDKAAGVTRLVTTRASQASAAQRAGRAARQGPGVAYRLWEEASHAGRPAFDPPEMVTSDLAPLALTLAQWGAGDPATMAWLDPPPAAAMAAAQGALAALGALDKDRRITTHGRAMAKLPMEPALAHMLLFAAERGQAEEAARLALLLQERGLGGRGEDLARRLDRWASERGSRAEASRKLAGRWARMAERLAPRGRAGEVPTGVLLAEAFPDRIARARSVSGEEWLSSGGRGYRLDPASPLATARWLVIGDAQGEAKGARITAAAALEESDVTRHLAHRVEERHTLSWNAADGRVEARLERRLGAIVLARVPDPAPDAEAAARLLIDEVRSRGLDLLPLGEGAKALLVRAGHAGLAALSDAALLDDLEAWLLPLVKGRRDLAVGAGRLHDALLGRLDWNERQMLDKLAPAEFRSPAGTSHAIDYGHEGGPCVELRVQALFGIDRHPCVGQPPRPLLLSLTSPGGKPIQTTADLPGFWRGSWKDVCKDMKGRYPKHRWPDEPWSEDPSLKTK

SEQ ID NO: 10625 - protein, 309 aa, Sphingomonas aromaticivorans
MNSVNAVILDRMQSRIPLIPTLAGHLIAGGGKRMRPMLTLASAALLGYGGSRHYKLAAAVEFIHTATLLHDDVVDGSDMRRGKKTANIVYGNPATVLVGDFLFSRSFELMVEDGSLKVLRILSNASAVISEGEVDQLVAQRQIDTTEEMYLDIIAAKTAALFSAACRIAAVVAERPDADELALDAYGRNLGIAFQLADDAIDYDSDAAEMGKDQGDDFREGKMTLPVILAYARGDEEERGFWQQAIAGERSSDADLAHAISLIRRHDAVHATRERARMYAQRAIDAISGFPASAAKAAMTEAAEFAVAR

SEQ ID NO: 10626 - protein, 405 aa, Sphingomonas aromaticivorans
HVWLPYTQMKTARPPLPVASAEGVKLRLADGRELVDGISSWWATVHGYRHPHIEEAIRRQLETLPHVMLGGLAHEQAYTLARRLAGMLPGDLDHVFFSDSGSVAVEVAMKMAAQFWLNQGHRRVKFLCFRGGYHGDTFATMSVCDPDEGMHSLFRGALLEQVVVDLPRDAEGEAALGALIEQHRGELAGIVVEPLVQGAGGMVFHDPFTLQALRRLADEHELLLIFDEIFVGLGRLGDAMFACQIAGVQPDIVTLSKALTGGNLPLAATIASGRIYDAFLSDDPMHALMHGPTYMGNALGCAAANASLDLFESEPRLEQAQAIGRGLEQALEVLRGLPGVRDVRVRGAIGVIQLDRTAPADRLSAACIDRGVWLRPFRDILYTTPPLVTGEEDLARITSAMVEAV

SEQ ID NO: 10627 - protein, 418 aa, Sphingomonas aromaticivorans
RRVVVTGLGLVTPLGADVETVWKNLLAGKSGAGLITKFDTTDQKCKIACEVKPADHEYGFDAGKRVDHKIQRQVDPFIVFGIDAAGQALEDAGLADMDDDLKMRTGCSIGSGIGGLPGIESESIILHEKGPGRVSPHFVHGRLINLISGQVSIKYGLMGPNHAVVTACSTGAHSIGDAARMIKDGDADVMLAGGAESTINPLGVAGFAQARALNCSYNDRPTEASRPYDKDRDGFVMGEGAGVVVLEEYEHAKARGAKIYAEVVGYGLSGDAYHVTAPHPEGKGAELAMRMALRKAGLSAGDIDYVNAHGTSTMADTIELAAVKRVLGDDLSGASMSSTKSAIGHLLGGAGAVETIFCILAIRDQIVPPTLNLHNPDEGTEGVDLVPLKAKPRKVRAALNNSFGFGGTNASVIVKAVE

SEQ ID NO: 10628 - protein, 76 aa, Sphingomonas aromaticivorans
MSDTADRVKKIVVEHLGVEADKVTEEASFIDDLGADSLDIVELVMAFEEEFGVEIPDDAAEKISTVSDAIKYIDEN

SEQ ID NO: 10629 - protein, 409 aa, Sphingomonas aromaticivorans
VCVVGLGYIGLPTAAIIARAGCRVLGLDVSQKVVDTINRGEIHIEEVDLDGLVHGVVQRGLLRASTEIAPADVFVIAVPTPFEKDGHHTPDISYVLAAATQVAAVLKAGDTVILESTSPVGTTEQMRDLMAGLRPDLKFPGKTRETPDVSIAYCPERVLPGRILEELTNNDRSIGGITPRCARKALAFYKRFVRGTCVTTDARSAEMTKLVENAYRDVNIAFANELSMVADRMGLDVWEVIRLANRHPRVNILQPGPGVGGHCIAVDPWFIVAGAPDETPLIRTARNVNDGKMHHVVKKATELVEAHPGEKVACLGLAFKANIDDFRESPARYVAASLARRFGSRVHIVEPYAGTLPREFEGTGAVQIDVDTALEDCGVLIVLVDHDVFKVIPLAERAGKVVYDTRGIW

SEQ ID NO: 10630 - protein, 395 aa, Sphingomonas aromaticivorans
VTVLGLGYVGLPLAVALAKRFFVTGFDIDVERISELSEGHDRTREIEPALLSMSSLGLTCDAGVCPPSDFYIVTVPTPIDAANRPNLRLVEAASRTVGQMLPRAVAEGRQPIVVYESTVYPGVTEDICGPILEQVSGLRCGTDFFLGYSPERINPGDREHTIERITKVVSGQTPEVLDRVADLYGAITSGGVFRAASIKAAEAAKVIENAQRDINIAFMNEITQIFSRMDLSVWDVLAAAGTKWNFLPFTPGLVGGHCIGVDPYYLSARAEALGHDPQVILAGRGVNDGMAKWVAGELHARRGGKPGSVLVLGLTFKENVPDLRNSKVADVIAELKALGHAVDVHDPHADTAEALLEYGLELAGDAFEQTYDLVFLAVPHKYYLAAGADRIAALV

SEQ ID NO: 10631 - protein, 465 aa, Sphingomonas aromaticivorans
PVHFHPKYHATANPDRAAVIMGGSGEVMTYAELEARSNRFAQLMRARGLQIGDTIALCLENRADYFPIAWGAQRAGLVYVAISSRLAAPEIAYIAKDSGSRLLIGSAYTAPVLDEVAKLEPGVPQLRLDTDGPLSLDAAMAEMPDTPIDDERAGCDMLYSSGTTGKPKGVRIPLPEDPEIGAANSLMAIANQAFGIGGDAVYLSPAPLYHAAPLRWSMTIHRLGGTVVAMEKFDPEHALELIEKHKVTDSQWVPTHFVRMLKLPDEVRSKYDTSSLKLAIHAAAPCPVPVKQAMIEWWGPALREYYAGTEGNGFTFISSEEWLKRPGSVGRALLGTIRICDENGDEVPPRTEGQVFFEGGSPFSYHNDPDKTRDATNKHGWTSLGDVGWVDEDGYLFLTDRKSFMIISGGVNIYPQEIENLLVTHPKVADVAVIGAPDPDMGERVVAVVQPRDMAEAGPALAAEL

SEQ ID NO: 10632 - protein, 465 aa, Sphingomonas aromaticivorans
SQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAM

SEQ ID NO: 10633 - protein, 645 aa, Sphingomonas aromaticivorans
WLDGLNPPQREAVTTTEGPVLMLAGAGTGKTAALTARLANLLRQRLAWPSEILCVTFTNKAAREMRERVGNLIGPAVEGMPWLGTFHAIAAKMLRRHAELVGLQSNFTIIDTDDQLRLLKQLVVAEGIDEKRWPARQLAGLIDKWKNRGLNPADLDALENEAYANGKGQRFYALYQNRLRELNACDFGDLLMHMLNIFRREREVLEMWQQRFKYVMVDEYQDTNAVQYLWLRLLAQNRKNICVVGDDDQSIYSWRGAEVANILRFEKDFPGAKVIRLEQNYRSTPHILGAASGLIAENSERLGKTLWTEVDGGDKVRVIGVWDAPEEARRIGDEIERLEREGAPLDRVAILVRAQFQTRTIEDRFIQIGLGYRIVGGFRFYERAEIRDALAYLRIIASPQDDLAFERIYNTPKRGLGDKTLEKLHRHARARSIPLSLASVEILDTDELPARARGTLAALMRDFGRWRDASKSLVPAELARTILDESGYTAALQAEKTAEAAGRLENLTELARAMEEYETLGDFLEHVSLVMDNEAVADEEKVTIMTIHAAKGLEFDNVFLPGWEEGVFPSQRSLDEGGLASLEEERRLAYVAITRARRHCTILHAANRQIYGQWTSSIPSRFIGELPAEHIEEETTLSGGASMWR

SEQ ID NO: 10634 - protein, 435 aa, Sphingomonas aromaticivorans
  unsure (1)..(435): unsure at all Xaa locations
ISENPAVQAQLDRLGALSLPSGRLGLDTARELCARLGNPQDRLPPVFHVAGTNGKGSTCTYLRYILEAEGLTVHSATKPHLVRYNERIRLAGKLIEDELLADLLKEVLDAGADLEPSFFEVTTVATFLAYARTPADACVIETGLGGRLDATNVMPTAAVCGIATLGLDHEAFLLSPEDGVPTEPLARIAFEKASIAKPGVPLVTMAYPPLAADEVARTAARLGAPLIMRGRDWDAEIAGSILYRDERGELPLPLPAMPGVHQAENAALAVAMIRHQNAVQVHLGAVGKGIVDARWPARLQRLGHGPLGALAGNRTIWLDGGHNPDAGRAIARHLEGQPPVHLIMGMLANKDPSAILRPLADRALSISVVPAPGHDAHKPEDFAPFTSLAVGSFATVPEALAALPPEGDVLIVGSLYLAGEVLRLNEEIPDXPAVR

SEQ ID NO: 10635 - protein, 253 aa, Sphingomonas aromaticivorans
PVHQFTIETLFGTDHWSIGGYNIAFTNSALWMAITTAVLIVFVAGGAKRELVPGRWQMAVEGLTGFVDNLLQANIGKAGRKYLPYVFSLFAFILFANMLGLLPLALVGVHPFTATSHFTVTGVLAIMSFAIVLGVGFAKHGLHFFSLFVPHGTPVPMIPIIFPIELISFMVRPFSLGLRLFVAMMAGHVLLEVLSGFVISGTNAGVGTFFLAAVPSFLLMIGICALELLVAGIQAYVFALLTCVYLNDAENLH

SEQ ID NO: 10636 - protein, 253 aa, Sphingomonas aromaticivorans
MTLEIHQFPCLSDNYGFLVHDSDSGETACIDTPDAEAYLREANARGWRITQIWNTHWHPDHAGGNEAIKAATGCTVVAPEDDAGKIAGVDRAVAHGDTVQLGSFTAEVIDVGGHTMGHCAYHLPEASVAFVGDALFPLGCGRMFEGTPPQFWASLSRIKALPPGTTLYSAHEYTQSNARFALHADPDNAALRAYADGVEARRARGEWTVPTTLAAELAANPFLRADTPGMAARWGGSSPVDTFAALRAAKDTF

SEQ ID NO: 10637 - protein, 177 aa, Sphingomonas aromaticivorans
TTDDLKRLVRTVPDFPSPGILFRDITTLIAHGEGLSACIDHLAHKARAAGAQAVAGMEARGFIFGAAVAARMGLGFIPVRKPGKLPVKTIGIDYALEYGRDRLEIDPTAIREGQRVVIVDDLIATGGTALAAAELLRMAGAHVTHALFVIDLPELHGAERLRGAGLTVEALMDFPGH

SEQ ID NO: 10638 - protein, 511 aa, Sphingomonas aromaticivorans
YFAYFSATHGDKTFIVDGDLRLSFADVYKAARHVAGGLVEGIELQKGERVGIAARNSANWIIAYMAVLMAGGCATLLNGWWQGEELAHGIELVSCRYVIADSARAARLEGHAHGATVLPMSHDCGYEQGLAALLARGGGMETLLPDLTGDDLATVLFTSGSTGTAKGAYSDHRGVVQGTMNYVCQSAAMLAILTARGEAPAPDAQPTTLVNVPLFHVTGEVPVFLQSFALGRKLVLMAKWDAVDAMRLIEKEKVSYFVGVPLMSFEIATHPDRDKYDLSTCVSFAAGGAPRPVEHVDRLRKALPHAFPLLGYGLTETNGVGCGNLNENYLAKPGSTGTASRPLVDLAILDDAGNPLPTGEVGEVSIRSIANFLGYWDNEKATREAITPDGYFRSGDLGYLDPEGYLFIVDRKKDIIIRGGENISCIEVESAIYAHPCIAEASVFGLPDEKFGEVPAAVYLAKEGCSATDDELRTFLAEHIAPFKIPVRFWEVHEALPRLGTEKVDKRTLRE

SEQ ID NO: 10639 - protein, 371 aa, Sphingomonas aromaticivorans
MANAPQLPASPQPKDWILGIHAYVPGKSTGKDGQVLTKLSANENPLGTSAAALEARAHAGDPARYPDPDSKDLRAAIGEVHGIDPSRIVMGTGSDELLNLAAQAYAGPGDEVLYVRYGFSVYDIAARRCGAVPVVAPDADYGTDVDALLACVTERTRVVFLANPNNPTGSWLPREEVARLHAGLRSDILLVLDGAYAEYLDPANDDGALDLAVTACNVLVTRTFSKIYGLAGERIGWGTGHPAIVDMLNRIRGPFNISLTGQAAGLAAVRDQAFVEASRRHNAHQRTRFVGKLEALGNHGVRPLPSQANFVLILFEGKVTAEDVYLGLMDYGYITRWLPGQGLPQALRITIGTEAQMDEIADAIRRMCEAA

SEQ ID NO: 10640 - protein, 307 aa, Sphingomonas aromaticivorans
AMALAKLPQLESVFLTDAGLETDFIFNRGIDLPYFASITLLQSSDGKIALEEYFRGFLELARRMRCGLILESATWRASPDWAEPLGLSQQELDTLNTSAIAILRDLRDEFGSTMPAVVISGCLGPRGDGYDPGKIMSEEGAEAYHRHQAEVLASAGVDQLTAITMTNVPEAIGIAKAAKSLAVPVAISFTVETDGRLPTGDRLSDALRAVDQATASTPAYYMINCAHPSHFAAVLEDGADWVNRIGGLRANASRCSHAEVDAMSELDRGNPEELAALHSELRLRFPHINVLGGCCGTDLDHITAIAE

SEQ ID NO: 10641 - protein, 351 aa, Sphingomonas aromaticivorans
KIAVLPGDGIGPEVTREAVRVIEALGLGDIEMKEAPVGGAAYKAYGHPLPPETLEIARLSDGILFGAVGDPDCDSLERHLRPEQAILGLRKALTLFANLRPARVFKGMEDFSALRPEVAGAIDLLIVRELNGDVYFGEKGFRTAANGDREGYDVMSYSESEVRRIAHVAFRAAMGRKKRLCSVDKANVLETSQLWRDVMLEVAKDYPEVALEHMYVDNAAMQLVRAPGNFDVVVTGNLFGDILSDQASMCVGSIGLLASASLGERETEYGTFGLYEPIHGSAPDIAGKGLANPMATILSAAMLLRHSLGLEVAADRIEAAVAKALADGVLGRDLGGTAGTTEIGDAVLARL

SEQ ID NO: 10642 - protein, 259 aa, Sphingomonas aromaticivorans
QLLPGMDGDVRKEAAKIFKKQGMELKLGTKVTGVAVNGGTATLTVEPSKGGEASTIEADCVLVAIGRRPNVDGLGLDKIGLELNARGQIETDHDFATKIPGVWAIGDVIPGPMLAHKAEDEGIAVAENIAGLTGIVNHDVIPGVVYTMPEFAGVGLTEEAAKERGEIKVGKFPMLANSRAKTNHEPDGFVKVISDAKTDRVLGVWCIASVAGTMIAQAAQAMEFGATSEDIAYTCHAHPTHSEALKEAAMAVTGKPIHM

SEQ ID NO: 10643 - protein, 255 aa, Sphingomonas aromaticivorans
GCGNMGGAMLKGWLAGGLAPETFTVVDPYLEAAPHGVRLLEAAPAGEDAFDIVLLGFKPQQLPDAAQAVRPFVGPRTLLLSILAGVDLATLRRTFPEARAIVRVMPNLAAALGKSPIALFGDADEAARAETDALMAPLGQAEWLSGEDQMDLVTALAGSGPAFVYRFIDALAEGAAALGLPRDQADRLALSMVEGSAMLAAASEHSPGELARRVASPGGVTQVGIDILDAERRLARLVEDTLRGARDRSAEMTEQ

SEQ ID NO: 10644 - protein, 528 aa, Sphingomonas aromaticivorans
LGAMQDWKLRVTHLIDHAAREHGQREIVSRWADGSESRTTWAGIRHDALRMTQALRRLGVKPGDRIATLAMNHHRHLVSWYGSVGVGGILHTLNPRLFDDQLEYIVNHAEDRVMLFDKQWTPIIERMKSRWPTVEHYICFDSSEPALHFEEWIASEDGQTEWADGDERDPCMLCYTSGTTGNPKGVLYEHRSTVLHAMSAISPPIFGLDCRSVMLPIVPMFHAASWGLPWAGAAAGAKFVYSAVNDGAVLCDLMNREKVTCSAGVPTVWLALLQHVDAHNGGEIPPTLQTIVCGGSAMPRAMIERFMRAGRRVAHAWGMTETSPIGTTGAETWNWDDLSFDEKVTVKAMQGRPPFGVEIRCVDLGDPGKVLPRDGVTAGALQVRGPWIVKRYFKAEQDAVAAGQWFDTGDVGVIHPDGTLQLTDRTKDVIKSGGEWISSVELENAAIGHPAVAEAAAIGVYHPKWDERPLLVVIRKPGMDVNQEELRSYLQQHVAKWWVPDAVAFVDQIPHTGTGKISKKDLRDQFRD

SEQ ID NO: 10645 - protein, 245 aa, Sphingomonas aromaticivorans
DGYHELETLFAFVDAGDELTAKPAPADSLRVFGEFGGALDDPFGNIVARRSGPCRMAEGWAVTLEKHLPVAAGLGGGSADAGAVFRMVERSHGLPADWHARAARLGADVPACVESAACIGRGTGTELEPIPNDLAGTPVLLVNPRIPLATGPVFKAWDGVDRGALEGATAREVAFAGRNDLEAPALSLVPEIGAVLVTLRQTGGWLTRMSGSGATCFALYDTPEQRDLAQAAMPPSWWTLGGALR

SEQ ID NO: 10646 - protein, 336 aa, Sphingomonas aromaticivorans
LYAVKANPSADLLRVLWDSGVTHYDVASIAEVRLVRATLPEATLCFMHPVKAPAAIREAYEQHGVRVFSLDSFEELEKIKEACGFAEDLTLCVRLRVSSDYSELSLASKFGCDLTNAAELLQATRQAADSLGVCFHVGSQSMSPHAYVQALERVRAAIVDASVTVDIIDVGGGFPSIYPGMEPPPLEDYFGVIDRTYESLPISYSAELWCEPGRALCAEYNSMIVRVERRRGAELYINDGAYGALFDAAHVGWRFPVRVLREEVANDGVEIEMEPFSFYGPTCDDMDHMEGPFELPADMKVGDYIEIGMLGAYGAAMKTAFNGFGATEVFEVSDEP

SEQ ID NO: 10647 - protein, 344 aa, Sphingomonas aromaticivorans
MGQHPKVIAAMEEALHNVGAGSGGTRNIGGNTHYHIELEHELADLHGKDGALLFTSGYVSNDATLSTLAKILPGCVIFSDELNHASMIAGIRNSGAEKRVFRHNDVEHLEQLLAETDPALPKLIAFESVYSMDGDIAPIHAICDLAEKYNALTYIDEVHAVGMYGPRGGGITDRDEAAHRIDIIEGTLGKAFGVMGGYIAADTRIIDVIRSYAPGFIFTTSLSPVLVAGVLASVRHLKASSAERDGQQAAAAYLKKAFADAGLPVMPSTTHIVPLMVGDPVKAKKISDILLAEYGVYVQPINFPTVPRGTERLRFTPGPSHTEAMMDELTGALVEIWQRMEMEL

SEQ ID NO: 10648 - protein, 365 aa, Sphingomonas aromaticivorans
FYELLEVERTADDKVLKSAYRKLAMKYHPDKNPGCADSEARFKQINEAYACLSDPQKRAAYDRYGHAAFQQGAGGGAGGGGFGGGDFGDIGDIFETIFGGAFGGGGRQQPRRGADLRYDMEISLEDAFHGKDAEIEVEVSQKCDPCGGSGATPGTSARRCNLCGGHGKVRAQQGFFMVERPCPNCHGRGEVIEKPCKHCRGEGRVDAEQRLQVTIPAGVDNGTRIRLAGKGEAGPFGAPPGDLYIFLHIQRHRVFEREGTTLLTRCPISFTTAALGGEIEIPGLDGKVHAIEIPAGIQSGKQLRKRGAGMPVLQGRGIGDLVVEIHVETPTKLSARQKELLREFQATETGEECPQSKGFFERIKD

SEQ ID NO: 10649 - protein, 635 aa, Sphingomonas aromaticivorans
MAKVIGIDLGTTNSCVAVMDGGTPKVIENSEGARTTPSIVAFTKDGERLIGQPAKRQAVTNPDNTIFAVKRLIGRRFDDPMTQKDTELVPYTITKGKNGDAWVKAGGQDYSPSQISAFTLQKMKETAEAYLGETVTQAVITVPAYFNDAQRQATKDAGQIAGLEVLRIINEPTAAALAYGLDKQDGKTIAVYDLGGGTFDISILEIGDGVFEVKSTNGDTFLGGEDFDTAVVEYLADKFKAKEGMDLKTDKLALQRLKEAAEKAKIELSSAQTTEINLPFITARMEGGATTPLHLVETVTRADLEKLVAGLIQRTLDPCKKALADAGISAKEIDDVVLVGGMTRMPKVREVVKDFFGKEPHTGVNPDEVVAMGAAIQAGVLQGDVKDVLLLDVTPLSLGIETLGGIMTKMIDRNTTIPTKKSQVYSTAEDNQQAVTIRVFQGEREMAQDNKLLGQFDLVGIPPARRGVPQIEVTFDIDANGIVNVSAKDKGTGKEQQIRIQASGGLSDADIDQMVRDAEKFAEEDKKRRAAAEAKNNAESLIHATERQLEENGDKVDAGLKAEIEAAIAEAKTAVESGDIDAMNAKAQALTDKAMKMGQAIYEKEQATAASPGAEAPKADDDVVDAEFSEVDENK

SEQ ID NO: 10650 - protein, 140 aa, Sphingomonas aromaticivorans
VFVLNGPNLNLLGLREPEIYGSQTLDDIAGMLEDRARELGLEIDMRQSNHEGHLVDWLHEAQATGAKAVLVNAGAYTHTSVALHDAIKAIKVPVIEVHLSNPHTREGFRHKSYVGMAAKGTVAGFGANSYVVALEAVARL

SEQ ID NO: 10651 - protein, 442 aa, Sphingomonas aromaticivorans
IKRLLIANRGEIALRIHRAAHEMGIETVAVHSTADADAMHVRLADHAVCIGPPAAKDSYLNVAAIISAAEITHADAIHPGYGFLSENAKFAEIVEAHGITWVGPKPEHIRTMGDKVEAKRTAGALGLPLVPGSDGAVSEIDEAKKIADAIGYPVIIKAASGGGGRGMKVCNSADQLETLMQQAGSEAKAAFGDATVYIEKYLGNPRHIEFQIFGDGNGNAIHLGERDCSLQRRHQKVLEEAPSPVISADERARMGGIVAKAMADMGYRGAGTIEFLWENGEFYFIEMNTRLQVEHPVTEAITGVDLVREQIRIADGKPLSVTQDEIEFKGHAIECRINAEDPFTFAPSPGLVKSYHAAGGMHVRVDSGLYAGYKIPPYYDSMIAKLIVYGRTREGCIMRLKRALEEMVIEGPKTSIPLHQRLLSQPDFLSGDYTIKWLEEWL

SEQ ID NO: 10652 - protein, 250 aa, Sphingomonas aromaticivorans
LDNRAAVVTGAADGIGEGIARRFAAEGAAVVVADYDDERGPAVARDLRGLGARAEFIRCDVSRREDVIGAVDLCVERFGSVDILVNNAYRGEGPVRIEKKTDERFDEALRMCLFATKWAMERALPHMKAKGGARVINMASLNGVNAHMGSADYNVAKEAVRAYSRTAAREWAPYGICVNVICPAAVSAAYRRFAEMAPQVAAATAAANPMGRMGDPESDIGGVAAFLASEDARYLTGNTLFVDGGGHING

SEQ ID NO: 10653 - protein, 259 aa, Sphingomonas aromaticivorans
  unsure (1)..(259): unsure at all Xaa locations
LAGKAAIVTGGARGVAKGVAAAFVKAGAKVLIVDREAELGEATAAELSAFGEVAFMQVDLMDREALPGVVEEAVRRFGRLDTLVNAAQASQQLLLKDTTTEAMNLAFGTGFWATFLLMQAAYPHLVASHGSVINFGSGAGIEGMPTQASYGAAKEAIRSLSKVAATEWGPEGVRVNVICPFANSPGVELWRQHFPDAYAGQIAKVPLRRIGDCETDIGAAAVFLASEAAGYITGQTLMVDGGQVKSFXRCLLHVPGDRS

SEQ ID NO: 10654 - protein, 237 aa, Sphingomonas aromaticivorans
VITGGASGIGLACADALAAVGRPVAIWDINAQGAQREAERISEQYGCKAIGLAADLRDPQGVTPAALATREALGPVGGIVHAAGTAVQTGIMGATPEVFDAGMALHVRALLLLTQAFMEDLKANPGSAIVAVSSINAWFGNAMIPIYTAAKGAVISLVRSMADELAGSGIRINALSPGMIDTPILGEMRDGMEQVFGPRIFLGRFGEPHEIARTVRFLLSDEASYITATEIVVDGGI

SEQ ID NO: 10655 - protein, 249 aa, Sphingomonas aromaticivorans
MELNGKVILVTGGGSGIGAATCRLLGKAGAQVIVADRAGARAEAVAADIPGAWGVVVDVVDAAACEAMVEGIRERFGRLDGAFNNAGITEVTALGGAPIPETHALPLEVWRKVLSVDLDGVFNCLRAEIPLMLASGGGAIVNTTSLQAHISYPRTAAYTAAKHGVLGLTKAIAKEYGEQGIRCNSVSPGVVDTPLTAGVIHSPQYKDMLLAPIPLKRFATPEDIAKAALWLLSDESAYINGATLAADGG

SEQ ID NO: 10656 - protein, 256 aa, Sphingomonas aromaticivorans
MLEDKVVIVTGIGPGLGRTIATEAAKMGADVAMVSRSGGIMDEVAADIAAAGRRALTIRADITSDADCARVAQETVAAFGRIDGLVNSAYFPGRLAPVLDLDLDALGRAFEVTVMGTIRMIRAVVPQMEKQGGGSVVNVGSQVARKVVPQQGGYAATKAAQASLTRYLAAELGSKGIRFNTPAIGWTMSAPARAWLESEAEKGGPSFEEAEAAISATMALGRVPSDEECARGILVFLSDALSSVTGATLDINAGDY

SEQ ID NO: 10657 - protein, 253 aa, Sphingomonas aromaticivorans
MIHRFAGKRVLLTGGASGIGRATAERFAAEGARIVIGDVDLEGASTVAQSLGGKAFSYDARDPAAAGGLVTEAVEVLGGIDILLNVAGIMTWGRFEETSPQAWQRTMDINLSGPFFLIQASIPHLKASKGNVVSVASAGGLHPVYGTSAYGVSKAGVIAITQSAALEFARFGVRANAVAPGGVATPMHEKSSAGGGVDPAIFAEAAGRNMPKLTDRPACTPEEVAAAIAYLASDEARYATGTVLVLDGGQITG

SEQ ID NO: 10658 - protein, 265 aa, Sphingomonas aromaticivorans
MFHKLAVSRAVETLMLRHTREERFSGWWHPGEGQEAAPIGATAALEADDYVWYQGRGCAWAIGKGMDPLPILGDLLGKTNGATGGKGGGVPHWADYSLGIMGEGATLGSVYPLAAGSALASKIRKDGRVSLANFGDGTASRGTFHETMMHAAAWKLPLIYFCENNGLLVGTRTEQVSATADIANLAKGYGIPGVIVDGQDAVAVWEATREAAARARAGKGPTLIEAKVTRKHGHYAGDPQHYRDPDYLRDYRDPLDLLAARLAGN

SEQ ID NO: 10659 - protein, 351 aa, Sphingomonas aromaticivorans
  unsure (1)..(351): unsure at all Xaa locations
RCGSGCRLXSGQSLRPNPMSRXSRGTFTMSSETMGYNAAMGLGLVEEMRRDDSIFIMGQGVVTGGWFGMEKGLVAEFGNDRVLDCGIAEAFEAGLAAGAAIAGMKPVINMGFGDFALIAGDEIYHKLAKWRYMHGLDVPMTAVIIFPIGAMGGAGPEHSSCTEVLGMHFPGLKVVVPSTAEDAKGLMKAALREPNPVLFHSVQGLGWSRGDVPLDPDFVVPIGKAVTRRRGADLSIVTYGSMAPRSLKAAERLASEGIDAEVIDLRSLVPLDWEHVLESVSRTHRAMVVHEAFRTAGPGAEIAAQIQERAFFDLDAPVLRLGARDFPLCQNADLEQAAIPSVDAIAAEARR

SEQ ID NO: 10660 - protein, 403 aa, Sphingomonas aromaticivorans
ELRIPRMGSVENARLLNWRVQEGEAYEPGQVLYEIETDKTSVEVEAEGPGVLARHLAAVGDEFKVGDRIGLWALPGTAPATLRAALSPQPMPASEPAPSPSSTLPAAVSAPGLHALRPVSRDAAGGRRVSPLARRLAAQNGVDLATVTGTGMGGKISGKDVLAASAKPRPAPVPVSPPRPGSDGEIVPHSLRRRTIAQRMVEAAAIPTLTADMEVDLTALFARRRSVEGNGASVLGMIAEAAIAALLQHRRLNAHWREDAMVQFGAVHLGIAVDTPEGLVVPVVRNAESLNARGLTDAIAALADKARAGTLRPQDMEGGTFTISNPGSMGPVVRAEALLNPPQVALLGLPGIVRAPVAIKDGDAWAMAVRPLLRLSLSFDHRALDGGPVIAFLNTLKATLERP

SEQ ID NO: 10661 - protein, 252 aa, Sphingomonas aromaticivorans
ILKDKVIIVTGAGPGMGQAACKGAAREGAKVVVTARSKQAIEEVAQEIVAAGGEAIAVPLDVTDMDQCRAAAKAAVDKWGRIDGLVNSAYYHPDWAPLIEHDVDQVLRAFDVGAAGALRMCMAVYPTMKAQGAGSIVNISTLCTRKPMPGEGGYGMAKGALNHMTRHLAVEFGGSGIRVNTALMGWMMGAPLEGFMETLGKGAEAFRKQRASEIPVGHIPPDADCAKAVYFLLSDYSSEVTGAMLDVNGGDW

SEQ ID NO: 10662 - protein, 325 aa, Sphingomonas aromaticivorans
KDVGLAPERAAALFRSQALSRQLDRLSRKLQARGEGFYTIGSSGHEGNAVLAEVLRMDDMAFLHYRDAAFQIHRAHRVPGENPAWDMLLSFTASMEDPISGGRHKVLGSKRLFIPPQTSTIASHLPKAVGAAFSIGIARRMGFDDTVLSKDGVVLCSFGDASANHSTALGAINTACWAAFQGTPMPIIFLCEDNGIGISTRTPPGWIEANFSGRAGLNYIPCDGSDLVDTCAAARQALEIARRQRKPVFLHMKTVRLYGHAGNDVQLAYRSKEEIRAEEERDPLLASAALLIEEGVMSAAQVRGVYDEIEATLERQVELAIKRPK

SEQ ID NO: 10663 - protein, 330 aa, Sphingomonas aromaticivorans
HMAKLISWAMADLLLQYPNAIVCGEDVGPKGGVYAATQKLHARFGSARVINTLLDEQAILGLAIGAAHNGLLPMPEIQFLAYVHNAEDQIRGEAATLSFFSNGQYTNPMVVRIAGLPYQKGFGGHFHNDNSLAVFRDIPGVVLAVPSNGRDAVAMLRECVRLAHDEGRVVVFVEPIALYMTRDLHEPGDGMWSSVYQPPGEGEIAFGEIGVFDSGRGEGTDLAVVTYGNGFYLSLQAQKLLSERGVNVRVIDLRWLGPVNEAAVLDAVAPCSRVLVVDECRITGGQNEALMALLAERAPGKAIARMAATDSFIPLARAATHTLPSRDGIV

SEQ ID NO: 10664 - protein, 390 aa, Sphingomonas aromaticivorans
MATAYIVDAVRTAGGRRGGRLAGVHPVDLAARSLDAIVARTGIDPTAVDDVIMGCVTQAGQQAMQVGRNAVLASKLLPQSTPAVTIDRQCGSSQQAIQFAAQAVMSGVQDMVIAAGVESMSRVPMGSNATFHMKEGLGHYKSPGLEEKYPGVMFSQFMGAEMIVKKHGFTKDDLDRFSLDSHRKAIAATNAQAFANEIVPVEIETPEGPAMHTVDEGIRFDATLEGIAGVKLLSPEGSLTAASSSQICDGSSAVLVVSEAALKAHGLTPLARIHNLTVTAGDPVIMLEEPLFATDRALQRAGMKISDIDLYEVNEAFASVPMAWLKHTGADPEKLNVNGGAIALGHPLGASGSKLMATLVHALRARGGKYGLQTMCEGGGVANVTIIEAL

SEQ ID NO: 10665 - protein, 261 aa, Sphingomonas aromaticivorans
LPQMKLDNTVAAVVTGGASGLGAATARALAAKGVKVAIFDLQKEKGEAVAAEIGGVFCEVNVTSDESVDAGFAKARAAHGQERILVNCAGTGNAIKTASRSKETGEIKHFPMDAFNWIIQINLVGTFRCIAKSAAGMMTLDPCDEFGERGAIVNTASVAAEDGQMGQAAYSASKGGVVGMTLPIARDLMSEGIRVNTILPGIFNTPLLQGAPDNVKAALAASVPFPKRLGQPEEYANLALCMIETGYFNGEDVRLDGAIRM

SEQ ID NO: 10666 - protein, 292 aa, Sphingomonas aromaticivorans
FSGSIPALVTPFRDGAFDEKAFRRLVDWQIENGSSALVPCGTTGEASTLSNAEHHRVIEVCVEQAAGRVPVIAGCGSNDTMNALLHMNFSKKCGAQAALCVAPYYNRPSQAGIIAHFSYLAEHNDLPIVLYNVPGRTVTDILPETVCELAKRYPDKIIGIKDASGDLSRVTDHRMGIGKHFCQLSGDDELALPANAAGAVGCISVTANVAPRLCADFQAACAANDLEKARELNDKLYPLHYAMFEDASPGPVKYALSRVFADINEDLRLPMVPCNEAARKAVDAALVHAGLL

SEQ ID NO: 10667 - protein, 249 aa, Sphingomonas aromaticivorans
LFDLTGMTALVTGAAGGIGSSICHALARQGARIALSGTNPAKLRAFREELNDTYGNDHVEITCDLSNTEQVEHLVPAALDTLGKLDILVNNAGITRDNLAMRMKDEEWDAVIRVNLEAAFRLMRAATKPMMKARFGRIVTITSVVGATGNPGQVNYAAAKAGLVGMSKSLGQELASRGVTVNCVAPGFIRTAMTDVLPDGQKDALNARIPMGRMGEGSDIGAAVAYLASKEAGYVTGQTLHVNGGMAMI

SEQ ID NO: 10668 - protein, 309 aa, Sphingomonas aromaticivorans
AFVFPGQGSQKVGMGLELAEASAAAREVFEEVDDALGQKLFQIMKDGPEDALTLTENAQPAIMANAIAVLRVLEREGGITLADKADFVAGHSLGEYTALCAAGAFSLSDTARLLKLRGQSMQAAVPVGEGAMCALLGADIEKATALAEAAAEGEVCTVANDNDPTQVVLSGHKGAIERAVGLVKEHGIKRGVLLPVSAPFHCPLMQPAADAMAEAFEKTPPGPLRVALFANVTASIVTDPAEVQRLLVEQVTGRVRWRESAIAMREAGVDQFIELGGKVLGPMINRTVADVSITSVVGMADIEAILKEL

SEQ ID NO: 10669 - protein, 336 aa, Sphingomonas aromaticivorans
YRVVVVGATGNVGREMLNILAEREFPCDEIAAVASSRSQGTEIEFGETGRKLKVQNVENFDFTGWDIALFAAGSGPTQIHAPRAASQGCVVIDNSSLYRMDPDVPLIVPEVNPDAIDGYTKKNIIANPNCSTAQMVVALKPLHDAAKIKRVVVSTYQSVSGAGKEGMDELFEQSRAIFVGDPVEPKKFTKQIAFNVIPHIDVFLDDGSTKEEWKMVAETKKILDPKVKVTATCVRVPVFIGHSEALNIEFENEISAEEAQNILREAPGVMLVDKRENGGYVTPVECVGDFATFVSRVREDSTVDNGLNIWCVSDNLRKGAALNAVQIAELLGRRHL

SEQ ID NO: 10670 - protein, 719 aa, Sphingomonas aromaticivorans
MTATAAPAEAGALTFERVFASPSLNGLAPRAVKLSPDGRYLTLLRNRADDRERYDLWGFDRQTGEWKMLVDSLKLSSGRQLTEAEKMQRERQRIGDLKGIVSYEWSADSKSVLVPVDGDLLLAGLDGSVRKVEGTKGGELTPKLGPKGEHIAFVRDRRLWAGPVTGTAAVAITPEEANADVHWGEAEFVAQEEMNRFNGFWWSPDESRIAVERFDESMVGVVTRAAIGAEGTKTFDQRYPAAGTPNAEVSLYVIGPDGSNRVQVDLGANKDIYLARVDWAPDGKTLYVQRMNREQTVLDMLKVDPVTGKSSVLFSEKAAAKHWIDLSDSYRFLADGSLIWWSQRDGFGHLYRFKNGKWSQLTKGEWVVTGLVGVDEKGGKLYLAGTKDDVLAPQVYAMDLKAPGKLTRLTELGWVNGASMDKSGQTLMITRSSDAQPAQSYIADTAGKNLAWIEENKVAGSHPYAPYLASHRPAQFGTIPAADGTPLHYMMITPPLEPGKKYPVFTYHYGGPTAQVVTKGFQGALAQAIVDKGYIYFAIDNRGSENRGVKFASALHHAMGSVEVEDQLAGANWLKKQAFVDADKISTFGWSYGGYMSIKMLEANPGAYAAGIAVAPVTKWQMYDTTYTERYLGDPGKLPEVYEKANALADTGKISDPLLIIHGMADDNVVFENASAIIAKMQAEAVPFEMMLYPGYTHRISGPKVSQHLYETIFRFLDR

SEQ ID NO: 10671 - protein, 459 aa, Sphingomonas aromaticivorans
DYVVADIGLADFGRAEIRIAETEMPGLMALREEFGASQPLKGARITGSLHMTIQTAVLIETLVALGAEVRWATCNIFSTQDHAAAAIAAAGIPVFAVKGESLAEYWDYVGSIFDWGDQTANMILDDGGDATMFALWGARVEAGEPLFEPSNAEEIEFVRALKEFLKRKPGYLTMSVAHIKGVSEETTTGVHRLYQIAKDGKLPFPAINVNDSVTKSKFDNLYGCKESLVDAIRRATDVMLAGKVACVAGFGDVGKGSAASLRQGGARVMVTEIDPICALQAAMEGYEVVTMEEAVQRCDIFVTATGNEDVITAEHMKAMKPMSIVCNIGHFDSEIQISALNNYKWTEIKPGTDLVEFPDGKQIIILAKGRLVNLGCATGHPSFVMSSSFTNQVLAQIELFTKNAEYKNEVYVLPKHLDEKVAALHLEKLGVKLTKLSKKQADYIGVSQEGPFKPDHYRY

SEQ ID NO: 10672 - protein, 181 aa, Sphingomonas aromaticivorans
QDVQDAIRTLIRWSGDDPEREGLLDTPKRVARAWKEYCQGYGEDPAVHLSRQFEEVGGYDEIVLLKDIPFQSHCEHHMAPIIGKAAIAYLPRDKVVGISKLARVLHGFARRLQIQERLTAEVAQCIWDNLRPHGVAVVIEAQHACMTARGVRTPGVGMVTSRLMGTFLDDNRSRKEVLSLM

SEQ ID NO: 10673 - protein, 149 aa, Sphingomonas aromaticivorans
FDFTPYRRTTVGFDRLFDLLERQARANSGDNYPPFNIERSGDDAYRITLAVAGFKAEDIDITAQQNLLVVKGQKPEPQDREYLHVGIANRGFERRFELADFVRVEAADLADGLLTIDLVREVPEAMKPKKVLIGAHNPLKVIEGDNTAA

SEQ ID NO: 10674 - protein, 249 aa, Sphingomonas aromaticivorans
RPYIVGNWKMNGSRAMLAEARAIDRAAGRYPDVQVAIAPPFTLIGALREAVSAMGVGGQDCHTEVKGAHTGDVSAAMLVDTGADFAILGHSERRKDHGENDALVKAKAEAALTAGLDIIVCVGETLDQRDAGKAEAVVSSQVDGSLPSPETAAEAVAAGKVAVAYEPVWAIGTGRVAAVEDVVTMHAAIRARLVALYGESGSKVRILYGGSVNSGNAAELLAADGVGGALVGGASLTAEAFLPIVAAAG

SEQ ID NO: 10675 - protein, 470 aa, Sphingomonas aromaticivorans
VVTRFAPSPTGFLHIGGARTALFNWLYARHHGGTYLLRIEDTDRARSTDAAIDAIFDGLEWLGLGGDEPAVFQFARSDRHAEVAHKLLEAGHAYRCYLTQEELAARRELAQAERRPFRIDSEWRDATPDQWPADQSYVVRMKAPREGETTIVDKVQGSITVQNSELDDFIILRSDGTPTYMLAVVVDDHDMGVTHVIRGDDHINNAFRQLVIIRGMHAIEGGWPDPVYAHIPLIHGADGAKLSKRHGALGVDAYRDEMGLLPEAVFNYLLRLGWGHGDEEIISREQAVAWFDIGDVNKGASRFDLKKLLNLNGHYIREADDARLAALVAPRLATLAPGFAPDKGLDLLTRAMPVLKVRAADINELAAGSVFLFAQRPLAMAEKAASLLTDDARAILTKVAGVLEAENVWTTGVLEATVKQMAEELGIGLGKIAQPLRASLTGQTTSPGIFDVLALLGKDESLSRIRDQAA

SEQ ID NO: 10676 - protein, 735 aa, Sphingomonas aromaticivorans
VRLQVAGARQEESGHGIARISRHVMSQLGVTEGDVIEIVGKRATAARVIQPYPEDEGLELIRLDGLQRANADVGSGEHVEVRKIDSRPAQRVVFAPAQKDLRLQGPAVALKRNFAGRPLVTGDLVATAGQQQVNRTDMPPQLRQMLNAPAFALTQIRLTVVSTSPKGVVHIDENTEVELRPEYEEPRSSRADVNYDDVGGMGDTIRQLREMVELPLRYPELFTRLGVDPPKGVLLHGPPGTGKTRLARAVANESDASFFTINGPEIMGSAYGESEKRLREVFEEATANSPSIIFIDEIDSIAPKRSEVHGEAEKRLVAQLLTLMDGLHSRSNLVVIAATNRPDAIDEALRRPGRFDREIVVGVPDESGRREILGIHTRGMPLAEDVDLQELARTTHGFVGADLAALAREAAIEAVRRIMPRLDFEQQTIPQDVLDSLRVERDDFLEALKRVQPSAMREVMVQAPTIGWADIGGLDEAQEKLREGVELPLKNPEAFHRLGIRPAKGFLLYGPPGTGKTLLAKAVAKEAEANFIAIKSSDLLSKWYGESEQQIARLFARARQVAPCVVFIDEIDSLVPARGSGQGEPNVTARVVNTILAEMDGLEELQSVVLIGATNRPNLVDPALLRPGRFDELVYVGTPSMSGREHILGIHTRNMPLAPDVDLALVARATDRFTGADLEDVVRRAGLNAIRRGGGNVDQVKASDFDEALEDSRATVTEQMEEEYGRMKGELKKRA

SEQ ID NO: 10677 - protein, 290 aa, Sphingomonas aromaticivorans
MIKTVAVIGAGQMGSGIAQVSAQAGMKVLLGDVSIELADKARDKIAKGLSKLVEKGKVDATLAASTVANLHTFSDHAALAEADLVIEAATEREDIKHKIFESAGRHLAAHAIMASNTSSIPITRMAVSSPDPERFIGIHFFNPVPLMKLVEVIPGLATSVPTIEAVRDYVANIGKEIVLSQDEPGFIVNRIFVPFINEAAFVLGSGTGSIVDIDKGVKLGLNHPMGPLELADFIGLDTLLEIMKIYLASTGDPKYRPAPLLQKYVEAGWLGRKTGRGFYDYSGEVPVPTR

SEQ ID NO: 10678 - protein, 285 aa, Sphingomonas aromaticivorans
  unsure (1)..(285): unsure at all Xaa locations
MTVTRFAPSPNGPLHLGHAYSAIVAHDRAKRDNGEFLLRIEDIDGARSRPDLADEFRADLQWLRLDYREVAPQSQRIASYRTAANELRAMGILYPCTCTRAEIAAAAVAQGPDGPLYPGTCLRRGPVPGPDSPGGSTWNRPRXSPDRWNGRTSATACSQARPEMFGDVVLWRKDAPASYHLAATLDDATDGITHVTRGVDLFRATHVHRLLQHLLGLPVPVWYHHPVLVEADGRKLAKRRDAPALADRRRAGEDGRAVAAEVRATLFDTGISCPTPXIRAHELRP

SEQ ID NO: 10679 - protein, 484 aa, Sphingomonas aromaticivorans
  unsure (1)..(484): unsure at all Xaa locations
PSTNPRSTRKSREXSAVADATRFYIGGEWVAPSTSVTTDIVNPANRSVVGQVALGGPADAEAAIAAARAAFPAWSATTREHRLAVLERINAALIARADEIGDAIMAEMGAPLGLARGAQAGSGPQHFEETIRVLKDYAFETPLGTTLLQREAIGVCVLITPWNWPMNQIATKVAPALAAGCTMILKPSEVAPLDAAILAEIIDEAGLPDGVFNLVHGTGPGIGDALTGHPDVDMVSFTGSTRAGIAIAANAAPTIKRVALELGGKSANILLPDADLAKAVPASVRGCMLNTGQSCNAPTRLLVPRTTLSRVEHLAREAAEAIVVGMPTDNPHMGPVANEAQYRRVIALIEQACHEGTQLLCGGVEPPKSLEHGLFVAPTIFTDVAPDATIAREEVFGPVLAIIPYETVDEAIEIANDSPYGLSGYVWGDPDAARNVARRMRTGMVHVNGASLDSAAPFGGYRMSGNGREWGVWGLEEFLEVKSI

SEQ ID NO: 10680 - protein, 425 aa, Sphingomonas aromaticivorans
TNAELWTRREAAVPRGVSSMHQRFFARGENAEAFDAEGNRYIDFATGIAVCNTGHGHPRVLAAVQRQLDAFSHCSFQVTPYENYIELAERLNAIAPIDGPVKSIFFTTGAEALENAVKIARAHTGRRGIITFQGGYHGRTLLTLAMTGKVLPYKARFGPMPGDVFHARFPIPYHGFSEEEAIAGIEALFASAIEPSAVAAIVLEPVLGEGGFYTASYAFFRALREICDRHGILLIADEVQAGFARTGRMFAMDWVREATGVTPDLMTVAKAMAGGFPISGVMGRAEIMDAPDPGGLGGTYGGSPLGCAAGLAVLDVIADEDLCARAVAIGNRIKARLRRMRDNGMTAIGDVRGPGAMIAMELVHDGDPSRPNPDATRALVQEGAREGLLLLSCGLRGNVVRFLPALTMPDALLDEALDRLEIALN

SEQ ID NO: 10681 - protein, 476 aa, Sphingomonas aromaticivorans
  unsure (1)..(476): unsure at all Xaa locations
AAVLSNAIXTIGKSMLFATLAAGEGLDVLNPATQQRIATVKAYSTEEIARLIEAADAARGAWAARTAKERSVVLRRWYDLVMSHQEDLAALVTAESGKPLAEARGEVAYGAAFIEWFAEEGKRAYGDTIPTFANGKRVLTIRQGVGTCAAITPWNFPVAMITRKVAPALAAGCAMVVKPAEATPLSALALETLAHEAGVPAEVFRVVPTDDPAGVGTLFCTHPQVRKLSFTGSTRVGQLLMEQAAANVTRLSLELGGNAPFIVFDDADLDAAVDGLMASKFRNAGQTCVCANRILVQDSVHDAFLAKVQERVAALVVGDGAQPGTTIGPLINEAAVKKVGALVADACEAGARVLAGGGKSPVGTGFFEPTILADVTPDMAVASAEIFGPVVPVIRFADEPQAIRIANDTPYGLAAYFYARDVGRIWRVMEALEYGMVGVNDGIISTEVAPFGGIKHSGLGREGSRHGLDEYLELKY

SEQ ID NO: 10682 - protein, 465 aa, Sphingomonas aromaticivorans
HFIGGKRVSSPYTFETRCPFDWSWKLADISRGTVTTAAQAAQAATDAFPAWAALSAAERGAYLHRLADLIEANVEKLAMIECLDMGMLLESLRLRVILRGAANFRNYADLATGHEERVWSSRGTLNRVIRMPAGPALIITPWNAPFMLSTWKCAPALAAGNTVILKPADWSPLSASILADLIEEAGFPAGVFNIVQGLGAELGNALTSDPRIKRISFTGSVPTARVIGKAAAENIVPLTAELGGKSPLLVFADADIDAAAKKAAGQYDDSGQVCMAGTRIIVEESVKDEFLAKFHAYADAHVMGDSRDAATTMSALIHPVHVERVLGFIERARAAGDAIVRGGRLWKEGSNWIEPTLIEPKNNQSEVVQSEVFGPVLTFQTFRDEAEGVALANSTAYGLSGIVYTGSAERAERVGRQVRGGTVWVNTFLVRDLTAPFGGIGISGIGREGGDYALDFHSDLKTLQI

SEQ ID NO: 10683 - protein, 452 aa, Sphingomonas aromaticivorans
SITDPQAFWGEAARALDWTSPPSATFTQDDGWFPGGTLNTAYNCLDRHVEAGWGDAIALVYDSPVTDTIRRYSYSELLAESGRVAAMLAALGVEKGDRVIIYMPMIPETVFAMLACARLGAIHSVVFGGFAPLELAKRIDDAAPKVLLTASCGIEGARTIAYKPMVDEALELAHHAVERVVLFQRERHRADVIEPRDIDWDVLRADTASDPVPAPVPVASADPLYILYTSGTTGTPKGVVRENGGHAVALAWSMRNIYGIGAGDTFWAASDVGWVVGHSYIVYAPLLVGATTVLFEGKPVGTPDPGTFWRVIVRHGVKTFFTAPTAIRAIRKEDPDATFLARIGTGKCEAIFLAGERADPDTIGWLEDKSGLPVIDHWWQTELGWPAIASCFALGDVRRKRGSAGLPVPGYAFAILDESGHPVPVGHSGAVVIKAPLAPGAFRTLWNNHAGY

SEQ ID NO: 10684 - protein, 648 aa, Sphingomonas aromaticivorans
KGEPEMGEAVYPVPAEWAQNALVDEARYQDMYRQSVDDPEGFWAEHGKRIDWIRPFTKVKNTSFHEADFGIRWFEDGTLNLAANCLDRHLAERGDEIAILWEPDSPDEAHREITYRQLHADVCRFANLLKAKGVQKGERVTIYLPMVPEAAVAMLACARIGAIHSIVFAGFSPDALAGRITDCDSRIVLTSDEGLRGGRKVPLKANVDEALKQCPGVDTVIMLRRTGADVDFVEGRDIDWATAVAEQSADCQPEEMNAEDPLFILYTSGSTGKPKGVLHTTGGYSVWASMTHQYVFDYRPGQIYWCAADIGWVTGHSYVVYGPLMNGATTVMFEGVPNFPDASRFWQVVDKFKVEIFYGAPTALRALMREGDEWVKKTSRASLRLLGSVGEPINPEAWEWYHKVVGDSRCPIVDTWWQTETGGAMITPLPGATALKPGSASRPFFGVKPALVDNDGTFLEGATDGCLVVTDSWPGQMRTVWGDHERFFQTYFTTFKGLYFTGDGCRRDEDGYYWITGRIDDVINVSGHRMGTAEIESALVAHPKVAEAAVVGMPHDIKGQGIYAFVTCNAEIEPDDLLRKELIQWVRHEIGPIATPDVIQFAPGLPKTRSGKIMRRILRKIGENDVSNLGDTSTLADPSVVDNLLANR

SEQ ID NO: 10685 - protein, 270 aa, Sphingomonas aromaticivorans
GLVGRSILASRSPDLHQGEGRALGLEVSYELFDFTARDLPDSALAEVIGTLRDDGFAGFNVTYPFKQAIVPLLDELDESALAVGAVNTVAIREGRLIGYNTDMIGFRLSMEQGLPGARLERVVQLGAGGAGAAVANALLSLGVRRLVLVDVDPARAEQLRSELAARFPGQDVECGAPGTLDTTGADGIVNATPIGMNGKPGMPLPPEKIAARQWVADIIYFPRETELLRVAKSKGCATINGVGMVVGQAARAFEIITGHAADARRMRAML

SEQ ID NO: 10686 - protein, 393 aa, Sphingomonas aromaticivorans
MDFELDPADVAFREEVREFFTTGIPQEWRTRVRAGLRLHPEELIAYQKRLAAKGWGAPTWPAQYGGTGWSPIRQYIFWTEAAEADAPAQFHQGLELIGPIIFTYGSAAQKARFLPGIVNADDWWCQGYSEPNAGSDLASLRTRAVRDGDHYVLNGQKAWTSYGHVASHCFVLARTSDEAKRQQGISLFLLDMKTPGITIRPVATMDEKHHTNEMFLDDVRVPVENLVGEEGRGWEYGKVLLDRERMVTASVAVFLIQTVKAIRDAASRHTIGGVSLLDKPDFKDKLAQYEIEVIALQTMVLRVMADASAGVDSGPLGSMIKLRWSQLLQAGTALWIAALGPKAAHFAALDHASVLPTDMPYAMQGVLHSRVTSIYGGSSEIQHNIIAQRALGL

SEQ ID NO: 10687 - protein, 245 aa, Sphingomonas aromaticivorans
DHRCLLGESPVWDARGRRLWWVDAVGNSIHAATPEGVPLVSWRYEAMVGSIGLAETGLVAAFSDHFALIDGATGRATPFAAVPGNDGAMRLNDGKVDRGGNHYICGETRMAEGATGTLFQLAANGALAPVARGMRISNATCFSPEGSRLYFADSLDGAIRCHAYDPATGTVGARVGTIDLKSIGQAPDGATIDAEGNLWIALVLDQAVACVSPAGELIRRIDMPMPYPSCPAFGGPQLDTLYVTS

SEQ ID NO: 10688 - protein, 537 aa, Sphingomonas aromaticivorans
  unsure (1)..(537): unsure at all Xaa locations
NFGDLLDIAAANVPTDRPALVRGDRTIAWGEFDCRTNRLARAMLASGLKTGDRVAILARNIPEFIEIACAAFKARLTHVNINYRYTTAEIEYVLADCGAAALFHQDEFAGVVEPLPAALDHLRLVVQIGGEGSYDRMVEEGDGTPLGIARSPEDGYLLYTGGTTGRPKGVMWAAGDARAVQLEAPTVRNPVLTLEDHAKQVAANITPGRVLPACPLMHGAGLNSSMAELLMGGTAVLLEKDSFRADDLWDQVEGHQVTRILIVGDVFARPMLQALEAEPGRWDLSCLKVISSAGLMWSEEVKRGLVRQLPQLTLVDILGASEASGFGYAVTTATRETPTGYFEPGRQTVIIDVDTDRVLADDEPGTGWLARRPPFAQGYFGDPEKTAQTYRTIGGITYAIPGDMAERTVEGLIRLIGRGNLCINTGGEKVFVEEVEEALKRAPGIEDAIVVGVPDETWGKAVVALVRTGATYDEDAARTALAADLARYKLPRRIIVLDDLPRHASGKSDYRRATELAVAHLALAAXPVRPHALVTGG

SEQ ID NO: 10689 - protein, 524 aa, Sphingomonas aromaticivorans
RLVLVTGAARGIGLACAHRFARAGDRVVMADRDLAACTFEAERLGSRHVALQLDVSDEAAVEHAMDGLLQQFGAFDVVINNAGVVDRFARPLLDVPPEDIDRLIGVNLEGPYLVVRAALRTILAGRRGAAIVNVASGAALRALPGRAAYSMTKAGVIGMTRAMAIELGPQGIAVNAVLPGYIDTEILLALEREGKFDRAAAAGAIPMGRLGRTDEIAEAVHYLARGGYHCGSLLSVDGGVDAYGGSGKASTAVMPHRPVRAGDVACVTGGASGIGAVVADRLAGLGWLVAIIDSREIADGPHPAWQADIASEASVESAMAGIAGQLGPVTLLVNNAGIVEPMAKSADQALADFRRTIDVNVKGTIHASRAAARQMIGAGGGAIVNLSSITASLGLPGRNAYCASKSAVTMLTRSLACEWAAHGIRVNAVAPGYILTPAVQALLASGERDMNSVVRRIPVARLGQPDEVADAIAFLASDAASYVTGATLQVDGGYLASRASARWTDALKRLGANRICNSCPGVRW

SEQ ID NO: 10690 - protein, 351 aa, Sphingomonas aromaticivorans
  unsure (1)..(351): unsure at all Xaa locations
SSTGKISQVIGAVVDVTFDGELPAILSALETDNNGNRLVLEVAQHLGENTVRTIAMDSTDGLTRGQPVTNTGAQISVPVGPKTLGRIMNVIGEPIDERGPVGAEQTAPIHAKAPEFIEQSTEAAILVTGIKVIDLLAPYARGGKIGLFGGAGVGKTVLIQELINNIAKGHGGVSVFAGVGERTREGNDLYHEFLDAGVIAKDADGNPTPDGSKVALVFGQMNEPPGARARVALSGLTMAEYFRDQEGQDVLFFVDNIFRFTQAGSEVSALLGRIPSAVGYQPTLATDMGQLQERITSTTKGSITSVQAIYVPADDLTDPAPATSFAHLDATTTLNRAISDSHYPAVPAIXS

SEQ ID NO: 10691 - protein, 290 aa, Sphingomonas aromaticivorans
MASLKELKGRINSVKSTQKITKAKQMVAAAKLRKAQAAAEAARPYASRLAEVMGSLAAKVAGQDNGPLLMRGTGSNQRHLLVVVNTDKGLCGGLNSNIIKEAKLQARALEAAGKTVTFYLVGKKGRAPIRRDYPNGIAAGYDTSLVRTPGFDEAAAIAQELLALFEAGKFDVAHLVAPEFKNALTQLPVTTQIIPVPAPTNTVAIDAVVEYEPGEEEILEELLPRYVTTQIFGALLEREASEQGASMTAMDNATRNAGELINKLTIQYNRSRQAAITTELIEIIAGAEAL

SEQ ID NO: 10692 - protein, 509 aa, Sphingomonas aromaticivorans
MEIRAAEISKVIKDQIASFGTEAQVSEVGSVLSVGDGIARIHGLDKVQAGEMVEFSNGVKGMALNLEADNVGVVIFGSDSEIKEGDVVKRTGTIVDVPVGKGLLGRVVDALGNPIDGKGPIVDATRQRVEVKAPGIIPRKSVHEPVQTGLKAIDALVPVGRGQRELIIGDRQTGKTAVAIDTFINQKAVNAGTDEGKKLYCIYVAVGQKRSTVAQIVRQLEENGAMEYSIVVAATASEPAPLQYLAPYTGATMGEFFRDNGMHAVIVYDDLSKQAVAYRQMSLLLRRPPGREAYPGDVFYLHSRLLERAAKMNDENGAGSLTALPIIETQAGDVSAYIPTNVISITDGQIFLETGLFYQGIRPAINVGLSVSRVGSSAQTKAMKKVAGSIKLELAQYREMAAFAQFGSDLDASTQKLLNRGARLTELLKQPQFSPLGFEEQTCVIFAGTQGYLDAVPVNRVTEYEAELLSFLRSQHADLLGLIRDTKDLGDEAKGKLVAALDAFAKQFA

SEQ ID NO: 10693 - protein, 179 aa, Sphingomonas aromaticivorans
SGITASLSGRYASALFDLANDQGFVSAVEGDLEKLDAALRESADLKGLINNPQLGRDEAGRAMDAVAGLLGLGELTKKFVGVLAANRRLSALPDVIRAFGQIAAAQRGEVSAEVTSAHALDDAQVAALTEKLKARTGKSIKLKTSVDPEILGGLVVKIGSQMIDSSIRTRLNSLAQAMK

SEQ ID NO: 10694 - protein, 465 aa, Sphingomonas aromaticivorans
LYLNNKAVQPNADLEVTNKFNGKVAFRTALATPDVIDEAIAGAVRAAAPMARLASYEKRDVLDHCVSRFIERKDELAYALCIEAGKPIADSEGEVGRLIDTFRIAAEEATRNYGEIQPLDISPRAKGYMGMWKRVPIGPCSFISPFNFPLNLAAHKIAPAIAVGCPFVMKPASMTPLGAIIMGEVLAECDVLPEGAFSILPASRDGAELFTTDERLKLLSFTGSPGVGWDLKAKAGKKKVVLELGGNAAVIVDRDADLEHALARIIFGGYYQSGQSCIHVQRVIIHADIYDTFRDMLAAKVKTLKAGDPMSRDTFIGPMISAKEAQRLKKWIDAAVAGGARLLAGGSCEGNMLEATLLEGCSRDMEVYTEEAFGPVVILSKFTDWDAALDEVNDSKFGLQAGVFTSDLHKVLEAWDRLEVGGIVVNDVSSYRVDNMPYGGVKDSGLGREGIRFAMEDMTEIRNMV

SEQ ID NO: 10695 - protein, 238 aa, Sphingomonas aromaticivorans
FEGKVALVTGAASGIGRAAAIRFAEEGARVFCADLNLAGAEAVAAGIGKGASAVQVDVASYASNQAMVDAVMANAGQLDVAFLNAGFYGAAEGLDTVDEALFDRLVAINLKGAFNGIKAVQAVIATGGAVVVTASAAGIVGHPANPAYSAAKHGVVGLVKSCVDAFAARGARINALCPGGVETPLIGAPDVAIVPAADLPRVPARGMGRAQHVAEVALWLSSPAAGFITGQAQVLDAG

SEQ ID NO: 10696 - protein, 510 aa, Sphingomonas aromaticivorans
MLDPLPATIPHAAQAAAATWPDAPSVLENGEVWSFAELWQRSRAAASALIARGIKAGDRVAIWAPNSREWIVAAIATMACGAAVVTLNTRLKGREAGDILRRTNARLLFTVEGFLGIDYRALIVDEDLPALEGTVLLDREFDAFMRDGRGAGDPAVDAAMAQIDADTVSDILFTSGTTGSPKGVLMTYGRVLPQAAVWCANTRLTEGDRYLIANPFFHSFGMKVGWVACILAGAVAVPMLQFDVGQAIDLIERERITFMPGPPTIFQMLLAELDKRKWDCSSLRGGTTGAATVPPALVERIRNDLGMVDLITAYGMTECVNITTCVPGDDAETIARTCGKAFPGNEVRIADENGNELPRGEAGEVLVRGQGVMLGYLDNPEATAEAIDAAGWLHTGDVGTMDERGYVRITDRMKDLYISGGFNVYPAEVEKLLAEHPAIGMAAVVGVPDERLGEVGRAFVVLRPGASATEAELVAWSRENMANYKVPRSFVLVDDLPRNASGKVLKTELR

SEQ ID NO: 10697 - protein, 399 aa, Sphingomonas aromaticivorans
MREAAIVSTARTGVGKAYRGAFNDTEAPVLSSHVVNAAIERAGIDPARVDDVYLGVGNHWNTQSYNLGRLTVHGSVLPDTTAGFTLDRKCSSGLNAIALAARGIMCNEIDVAVAGGMESISLTINKHAPAFRNRSEFIKAADPHAYMVMIETAEIVAERYGVSREDQDRFAALSQQRAAAAQEAGRFDDEIVPITVTKALFDKEGNETGKEQVTLDRDEGVRAGTTYEALAGLKPVFKGGQVIAEGRHVTAGNASQLSDGASAQVLMDLDTARAEGRPVLGIYRGFQVAGCGAEEMGIGPVFAIPKLLDRAGLKVEDIGLFEINEAFASQAVYCQQKLDIDPERLNVNGGGIAIGHPFGMTGSRLVGHALIEGRRRGVKYAVVSMCVAGGMGAAGLFEV

SEQ ID NO: 10698 - protein, 303 aa, Sphingomonas aromaticivorans
  unsure (1)..(303): unsure at all Xaa locations
GKTVVVTAAAGTGIGFAVAKRAAEEGARLLISDFHERRLGEAADRIAAEVGCERPATVVCDVTNEAQVQDLRDAALEKLGKVDVLINNAGLGGEVDVVDMTDDQWSRVIDVTLTSLFRMTRAFLPAMYANKSGVMVNNASVLGWRAQKGQAHYAAAKAGVMAFTRCAALEAADHGVRINAVAPSLAMHPFLAKVTTEERLAELVKTEAYGRPAEVWEVANVMLFLASDLSSYMTGEIVSVSSQRAXGMTAIFERPADLIGKEGTRLGPTEWLAIEQDRVDGFAEVTGDHQWIHVDVERAKAGP

SEQ ID NO: 10699 - protein, 739 aa, Sphingomonas aromaticivorans
MEFAFTEEQAMIAETARAFFAENATSERTRKAMASDGVDRELWSSFCTELGLAGIGVPEEMGGVGLGMVEFALIAEAAGAQVAALPLLGNARVSHALVAGGTDEQRVRWLPALVAGEAIATATWSDDFTVGEGKLSGTFRFAPHGGAADLLVLAAGDRCWLVEADAPGVSVVQHVTMDQTRPLATITLDNAAAEPFADHAAALHALHVTGWLCLAAEALGGAQAALDRTVAYSKERVQFGRQIGSFQAYKHRLADMMIEIEQARSAVYWAACAVDEGSDEAQLALHSAKAFCADTFHMCAGNMIQLHGGIGFTWEHDAHLFFKRARSIGSMLGDSQWHREQIAGMGPGSGRMKLGFSAEDEAFRAECAGWLQAQMAGPFADIRGIPNLCDEIPRRKEWEQQLAAHRWSCIGWPEEWGGRNATLAQQVIFAEEYARAGAPNRINHIGVELAGPTILAFGTDEQKARYLPGIAGGTQIWCQGYSEPNAGSDLANVKTKARLDGGEWVVNGQKVWTSLAHYSDMIFVVARTEDGSVGPKGLSFLLMDMDQPGIEVRPIRQMNGEAEFNETFLTDARCASDAMLGAPGEGWKVAMALLAFERGVSTLGQQMQFRNELDAVIAAARANGKAADPVIRQRVAEAEIGLRLMRYGALRMLSNTDLSAIDGAALTYKIQWATWRRDLGELAMDVIGQAAELAEGDDYAWGALPNMYLFSRSDTIYGGTNQIQRNLIAERGLGMPREP

SEQ ID NO: 10700 - protein, 299 aa, Sphingomonas aromaticivorans
LGICDNRTVIITGAARGLGRAYALAFGAEGANVVVNDIGTSLGGEGRDTSAADAVVEEIRAAGGKAIANYEDITDWDAAKRIVDAALEAFGDLHVVVNNAGIVRDRMFVSATVEEWDATMHVHLRGHFCVSRHAVNYWRQKQKDGRDPDARIINTSSGAGLQGSIAQAAYATAKGGIASLTLVQAAELGRYGITANALAPSARTRMTEQTFADKMATEGQAFDVMDPANVAPTVVWLGSSASAHVSGCVFELEGGKIMLEDGWREGPFVDRQARWEPSDVGAAVDKLLSERVPPRKVWG

SEQ ID NO: 10701 - protein, 507 aa, Sphingomonas aromaticivorans
  unsure (1)..(507): unsure at all Xaa locations
SASPSAPTRRSSTTLPARRSRSSSRGRSYSLPRPRSAMPTCNPAPACPRRRSSRSRLPKRPRAPRSRFMAQWAIPGRSTSTSSSSARWRXPIRGARPLSTAIASPPASSASPSGPTRPLPARPNMPEAYIIDAVRTPVGRKKGGLAHLHPADLAAHPIRELMARHDFDPALVEDVVWGCTETIGGQAGDIGRTAWLVAGLAEDVPGVTVDRQCGSAQQAVHFAAQGVMSGTQDIVVAGGSQAMNRIPIMAAMTAGAAYGFESPFIGAKGWDARYGDQEVNQIRSAEMIAEKWNLSREEMDAFAYESHRRAQYATEQGWFRNEIVPLEGLDRDETIRPGTTLEGLASLSAVREGGRVTAGNASQNSDCAAALLIVSERAVKEHNLKPRARIHHMSVRADNPVWMLTGPIPATRYAMQKSGMKLSDIDLFECNEAFASVPMAWMKELDIPHEKVNVSGGAIALGHPIGSTGAKLMTTLLNALERTGGRYGLQTMCEGGGQANVTIIERL

SEQ ID NO: 10702 - protein, 381 aa, Sphingomonas aromaticivorans
MDLTYTPEQQAFRTEVRAWLEAHVPKEPLEHYDATREGFEAHRRWEATLKSGDWGMVTWPKEYGGRGVDLIQWLIFEEEYYRSGAPGRVNQNGIFLLGPTLMEFGTHEQKSRFLPPMASGEEIWAQAWSEPQAGSDLAGVRATAVRDGDEYVLNGHKIWSSRAAFADWAFGLFREPGSERHKGMSLIFFRLDQPGVTRNPIRKINGHVGFAEIFLEDVRVPAFNRLGQEGEGWHICMATAGFERGLMLRSPARFQEAAAALSHLWQARKHDCDPCLEAEVVRAHMNADAYALSIYQTASRLMAGAKIGPEASTNKIFWSEMDIHLHETALAILGPEAELVPPTGDHEWLDDYIFSLAGPIYAGSNEIQRNIIAERMLGLPR

SEQ ID NO: 10703 - protein, 253 aa, Sphingomonas aromaticivorans
QGADHIDLVGQVAIVTGGTRGLGRQIAEALVRAGAAVTVCGRTEPDDLPEGLHFHAADIREPDQATALVDAVVARYGRIDILVNNAGGSPQAPATASPRFFDAIVRLNLHAAMYMSQAAFAHMQPARRGSIVNIASVSGIRPSPMTAAYGAAKAGLLNLTQSLAQEWGPDGVRVNAIIVGLMQTETAGETYGDDEAQAAVGRSLPLQRMGTGVDIAGAVLWLCSGLASWVSGARINVDGGGERPYFLDLVKGN

SEQ ID NO: 10704 - protein, 525 aa, Sphingomonas aromaticivorans
FDFVIIGGGVAGCILANRLSADPATRVLLLEAGGSDRSPLIAAPGGLLPIMMSGAHAWRYVSAPQRHLDDRVLYLPRGKVLGGGSSINGMTYDRGFHSDYDRWAQAGNRGWSFEDVLPYFRKLENYLPSEDEWHGRGGPIQVTRAAQDHPFAKAFLKAGAEAGYPLTQDLNGASRDGFGAVDLTVGRGRRSSASSAYLRPAKGRPNLTVLTQAHTRRIVIENGRATGVIFRRKGADRLALAAREVILSAGAINSPQILMLSGLGPAAHLAEHGIQVLHDLPGVGQGLQDHLAAHVKYRSTKPWSMLRYLNPLRGALAMAQYALLRRGPLADPGMSVACMVRSDPSLDEPDIKMLLVSALFAQNGREMVPMHGFYAHINVARPQSRGSVTLASADPEVPPVIDQNYNAAQEDRRAMREGVRIARRIFAQPAFDIMRGEELAPGSGVESDAQIDAYIRATAEADYHSTSTARMGRDPMAVVDDRLRVHGVAALRVVDASVMPHLPGGNTAIPVAMIAEKAADLILSK

SEQ ID NO: 10705 - protein, 362 aa, Sphingomonas aromaticivorans
MKTRAMVCHAPGAPLVEEELDLAPPGPGEVLIEIMASGLCHTDLSQLEGVAAPYPFPIVVGHEGAGVVREVGPGVTSLRVGDHVVPLGIGECGECGNCRSGLTNLCEAFLADMASQPTPFSLGGKRVSAYSGVGSLAQFIVTAERNVALIRKDVPFELACTVGCCVATGVGAVLHTADVGEGATVAVFGLGGIGLNVVQGARLAGASRIIGVDINPLRDAQGRRFGMTDFIDARNADPVDAIRALTGGGCDFAFECAGNIKLMQQAFESTRIGWGCTVVLGVPPDGAALSLVPFQLQLGRRVQGSFMGNMKGRSQLPGLLDHYAEGRLNLDDLVTHRLPMREVNNGFALMKRGEALRTVVSF

SEQ ID NO: 10706 - protein, 494 aa, Sphingomonas aromaticivorans
IESRPHGTAEGWKRVVDNGALVAEGPAALPPGTRVRVEHLFEKIPARRKFLRSPRSEWAAASDVVRRLAMARPDVGFTLEHDGRRALHVQAGETLEARVAQLVARELAGNSVEVDLVRGDFHLTGIAGLPTFNRGVADHQYLFVNGRPVKDRLLIGAVRGAYADMLARDRHAVLALFLQVPASEVDVNVHPAKSEVRFRDPALVRGMVVSGLRHALSTGDQRSAQAPSASAMAAWQAEPIAPPPPSSPSSDWQGSIFSQQWKPEPRVSEAGQAWRGYEQAIMAPPSARAEPAAQPVVDAAQHPLGVARGQISNTYIVAEAEDGLVIVDQHAAHERLVLERLRAAGAGQGVAPSQALLIPEVVELDETACDRLEEASEKLAEFGLALERFGPNAVLVRAIPAALAKGDPARLVADVADDLAHHGDALLLGEKLDLVLATMACHGSVRAGRTLSVAEMNALLREMEVTPRSGQCNHGRPTWVKLAHGDIEKLFGRK

SEQ ID NO: 10707 - protein, 374 aa, Sphingomonas aromaticivorans
RRFTDAEILPNAHEWHLANALIPDGTVRAMAELGTFGVCIPEEHGGFGLGKLVMCVVTEELSRGWIGAGSLGTRSEIAGELIVLGGTETQKARWLPAIASGEVLPTAVFTEPDTGSDLGSLQSRARRGEDGGWIIDGAKTWITHASRSDLMTMLVRTVPDARGYAGLSMLLVPKPRGTQDDPFPAEGMSGSEIEVLGYRGMREYALQFDGMRAPGDALLGGEEGQGFKQLMRTFEGARIQTAARAVGVARRALELGLDYALSRKQFGKAIVGFPRVADKLAMGAVDIVMARELTYAAARAKDSGKRCDIEAGMAKLLAARAAWSNADAALQIHGGNGYALEYEISRVLCDARILNIFEGAAEIQAQVIARGLME

SEQ ID NO: 10708 - protein, 282 aa, Sphingomonas aromaticivorans
EIIDGKALATQVLARTAEDVAQMIAAGAGAPGLAVILVGNDPASEVYVGRKIAQCRKAGIRSIEHRLPADTPQEQVLALIDALNADEEVHGILVQLPLPRHIDAALVLDRIDPGKDVDGFHPVNVGRLSTGTGGLVPCTPLGVMMLLDSVIDDYRGLKVVVIGKSNIVGKPVSMLLLEREATVTVTHIETRDLPDVARKADIIVAAAGAPHLVRGYWVKPGAVVIDVGISRVTDHDGVTRIVGDCATHELDHAKAVTPVPGGVGPMTIACLLSNTVLAAKMR

SEQ ID NO: 10709 - protein, 242 aa, Sphingomonas aromaticivorans
MLFEGKNVIVTGAASGIGRATAIRFAAEGARVTIGDKNVAGLEETAAMMASAPVIQPFDAVDNASCRKLVEVGARNGLDVLCNISGVLKWGRSEDFSLEDFDLVMRVNTHSVFTLCQAALPHLVESKGNIVNTASAAALQGIAYTVAYVASKHAVAGMTKSLAVEFASRGVRVNAICPGDVKTPMTQQTAVPENVDWALVMRNAPKLLDGSCEPEDIAELFAFLASERARKITGALFSIDGG

SEQ ID NO: 10710 - protein, 494 aa, Sphingomonas aromaticivorans
MTSTSSSPVTETILNFIDGSYRKGSEGKSFPNVNPATGTAIGVVHEASQADVADAVAAAKAALTGPWGKMTTAERVKLIAAVATEIERRADDFLAAEVADTGKPRHVASHIDIPRGAANFRMFADVVSTMPGESFNTSTPDGGQALNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAAIGVRDISFELGGKNPAIVFADADLDKAVEGLSRSVFLNTGQVCLGTERVYVERPIFDAFVARMAAAAQGFKPGVTGDRAYLGPLISAEHREKVLGYYRRAVEDGATVVTGGGVPEISGAEAGGFFVEPTLWIDVAHGDTVMREEIFGPCCGIVPFDSEDEVIALANDTVYGLCASIWTENMSRGHRVAAAMDVGVCWVNSWFLRDLRTAFGGSGHSGIGREGGVHSLEFYTEITNICVKL

SEQ ID NO: 10711 - protein, 501 aa, Sphingomonas aromaticivorans
MATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 10712 - protein, 266 aa, Sphingomonas aromaticivorans
VTARLEGQVALLTGGATGIGAAVVARYLEEGAKVGVLVRDADQADMVRMRHGKGIVVVEGDVRNYSDNQNAVAATVATFGKLDVFVGNVGIWDYMTPLADMDPDKLSETLDEIFGVNVKGYFFGARAAIPELRKTKGSIIFTASTSSFYTGGGGTPYVASKHAVLGLIRQLAWELTPDVRVNGVAPGGTRTPLGGTKAGGTADVHMEDMEGLDAMIAGMTPLARIAEPDDHTGLYALLASRRDSAYMTGAVLLSDGGIGIGKRPEG

SEQ ID NO: 10713 - protein, 236 aa, Sphingomonas aromaticivorans
MPDRLSGKVAVVTGAAAGIGKGCARIFREEGAAVIGVDLAGADRACDLTDETQVSALFAAIVAEHGRIDVLVNAAAFAVFAWIEEMTLAEWRRTLTGELDTVFLPTRAAWAGLKASGAASVINFASANARHALDGSAALAHCAGKGGVLAMTRQLAMEGAPHGIRANSISPGFIRTEATGRHLAEVPDLRDRVLAKNMVKRLGEPEDIAWCATWLASDEARYVTGADIAVDGGATA

SEQ ID NO: 10714 - protein, 255 aa, Sphingomonas aromaticivorans
MDIQGLAAIVTGGASGLGAATAELLAARGAKVTLFDLNADLGNAKAAEIGGRFAAVNVTDEDAVANAIAEAEAVNGKARILVNCAGIGPPAKVLNRDGSPLPLADFARIININLLGTFNVLSKFASRIHDAEPLNEDGERGVIVNTASVAAFEGQIGQPAYAASKGGVVGMALPIAREFARYGIRVNTIAPGIFWTRLLGSLPQEAQDSLGRQVPFPSRLGKPAEYAKMVEAIVTNPMLNAEVIRLDGAIRMAPK

SEQ ID NO: 10715 - protein, 849 aa, Sphingomonas aromaticivorans
  unsure (1)..(849): unsure at all Xaa locations
PAAPIVNAMPDAETLPGLSSQEAAARLASEGPNALASGEARTFGRIVLDVVREPMLALLLVAGAIYLALGDLHEALLLVAFACLSILITAVQETRTERAVAALRDLTSPRALVIRDGERIRIAGSEVVRGDVVVLQEGDRVPADGWIARSSALLVDESLLTGESVPVRKTATDIEPTAAECRPGGEDLPFAWSGSLVVRGTGLCIVTATGSKSAIGAIGNALATIETEAPRLRQETRRLVYLFAAIGIGVSALAVMLYGLLRGSWLEAALAGIALGMSMLPEEFPVVLTIFLAMGAMRMSRIKVLARRAAAIETLGSASVLCTDKTGTLTQNRMRIERLWLPDGRTVHATNLRSAVSRASSTCLPNSASLPARNDRSIRWSLRSXTGPRTGRRPRARGHPRATAEWLDAATPLSARPGAAGHVSSLGRRTGWGQIVATKGAPEAIAELCALAPEDRAAMKQAVDAMAEGGLRVLGVAEARWKATDLPESHRAFAFAFRGLVGLADPLRPSVPDAVRQCREAGIRVVMITGDYPQTARAIARHAGIDATEVLTGADMEPLGDEALAKRLASVGVCARIMPEQKLRLVEAFKAQGAIVAMTGDGVNDAPSLKAAHIGIAMGGRGTDVAREAASIVLLDDDFGSIVAGVRMGRRIYDNLRKAMAFIVAVHVPIAGVALLPLLTGLPLLLGPVHIAFIEMIIDPVCSLAFEAETDERDVMKRPPRSPDAALFSRSLIGWSLVQGLMVLAVTALWIVIAARGGAGDGTIRATAFFALVFGIAALILVNRRFSPSFAHAMRRPNPALALVLGAVAAILGAAQLVPAVTRLFQFGAVGPERLTMIATGAVAMLIVL

SEQ ID NO: 10716 - protein, 230 aa, Sphingomonas aromaticivorans
GGASGLGEAIARAFAAEGASVVVADIDVAGGETLAAQIGAQFVPLDVTQEGSWAEAVAPFERIDVLVNNAGITTLGSVEEITLDQFRHELDIDVLGVFMGIQATLPRMKTHGGSIINMSSLSGVKASANLVAYNAAKAAVTLMTKSCALHFADKGYGIRCNSIHPGAIHTPIIDKVLAQSDDPDALYRSFVDVHPVKRLGKPEEIAAIAVYLASDASAFATGAEFRVDGG

SEQ ID NO: 10717 - protein, 299 aa, Sphingomonas aromaticivorans
GEVRVKVHACGVCRTDLHVADGDIHGLLPIVPGHEVIGVVDALGPGVTDVEPGARVGVPWLGHACGTCPYCDSGRENLCDAPLFTGFTRDGGYATHVIADARFCFPIPEGFDDLHAAPLLCAGLIGYRALRLAGDAPVLGFYGFGAAAHILAQVALWQGRTVYAFTRDGDAKAQAFARDIGCQWAGPSGAAPPQALDAAIIFASAGELVPTALRAVRKGGRVVCAGIHMSDIPAFPYADLWEERQILSVANLTRRDGVEFLPLAARAGVRTHVEAMPLMKANEALDRLRRGDVSGALVL

SEQ ID NO: 10718 - protein, 250 aa, Sphingomonas aromaticivorans
RLSGKIALVTGGASVPGLGSATAQRFAEEGAKVWLTDRDLAGAEKVAEGIRAAGGQARALLHDVTNEAQWDEVFAAIEAEDGKLDVLVNNAGIAVLRPIAEMTTADWNLQNSVNLDSVFQGTKRAVVLMRKTGTKGSIINISSVAGLIGVPACGAYAAAKGGVRLFSKTIAVETAKDGIRVNSVHPGMILTNIQGVAQEDNAANYDATLALVPMGYMGDPLDIANMNLFLASDESRYVTGTELVVDGGMT

SEQ ID NO: 10719 - protein, 231 aa, Sphingomonas aromaticivorans
SDRLLGRKAIVTGAGSGIGAATAARLRADGAQVFTADVQGDVDLVADLTAEGANARLVEQAVAAMGGLDTLVPCAGISAFHPLEGHDDAYFLKVLDVNLVAVFRLVRDAAPWLKAAGNGRIVTIGSTTSSHGDEGLCAYSASKHAVLGFTKSVAAELGPFGVTANCVQPGAIATPMTAPAFTRMPEFRTFWENKAALRRLGQPEDIADVIAFLCSDDARFMSGHGVWVDGG

SEQ ID NO: 10720 - protein, 469 aa, Sphingomonas aromaticivorans
VAEQYDVIVLGSGPGGYVAAIRCAQLGLKTAIVERENLGGICLNWGCIPTKALLRSAEVLNHMKHAAAYGLAADNIRADLDAVVKRSRGVAKQLNQGVTHLMKKNKITVHMGNGILKSATSVEVTGDKGSETISAKHVIVATGARARDLPFAKADGERVWTYRHAMTPKEMPTKLLVIGSGAIGIEFASFYNDMGAEVTVVEMMDRVVPVEDADVSAFLEKALTKQGMKIMTGAGVESLAVSASGVKAKIKGKDGKVAEGDYSHVIVAVGIVPNTEHIGLEALGVKAERGIIAIDGYGRTNVKGLWAIGDVTPGPWLAHKASHEGVIAAEAIAAELGNKEVHPHPMDRGNIPGCTYCHPQIASVGLTEAKAKEAGYAVKVGTFPFIGNGKAIALGEPEGFVKTVFDAKTGELLGAHMIGAEVTEMIQGYVVGKTLETTEAELMHTVFPHPTISESMHESVLAAYGRAIH

SEQ ID NO: 10721 - protein, 427 aa, Sphingomonas aromaticivorans
MPIAIKMPALSPTMEEGTLAKWLVKVGDKVSSGDIMAEIETDKATMEFEAVDEGTIVSIDVAEGSEGVKVGTVIATLAGEDEDASAPAPKAVAPAAAPVPVPAPKAEPAPAAVSTPAPAAASASKGDRVIATPLAKRIAADKGIDLKGVAGSGPNGRIIRADVEGAKPAAAAPVSTVAPAVASAAAPARAPAAVPDFGIPYEAQKLNNVRKTIARRLTEAKQTIPHIYLTVDIRLDALLKLRGDLNKALEAQGVKLSVNDLIIKALAKALMQVPKCNVSFAGDELRSFKRADISVAVAAPSGLITPIIVDAGSKSVSAIATEMKALANKAREGKLQPHEYQGGTASLSNLGMFGIKNFDAVINPPQAMIMAVGAGEQRPYVIDGALGIATVMSATGSFDHRAIDGADGAELMQAFKNLIENPLGLVA

SEQ ID NO: 10722 - protein, 394 aa, Sphingomonas aromaticivorans
MSFKTLDDIGDLTGKTVLVREDLNVPMQDGAVTDDTRLRATIATLNELSDKGAKVLVLAHFGRPKGQPSEEFSLKKLAAPLAHVLGRPVSYIDWESDKAAVAALTPGAIAVLENTRFFDGEEKNDPAVIERFASLGDIYVNDAFSAAHRAHASTEGLAHVLPAYAGRAMEAELKALQKALGEPERPVAAVVGGAKVSTKLDVLKHLVSKVDHLIIGGGMANTFLAARGVNVGKSLCEHDLTGTAEEILDNADKSGCTVHLPYDVVVSKEFTANPPSLRTCNVHEVAADEMILDVGPAAVEALADVLKTCKTLVWNGPMGAFETEPFDAATVALARTAAALTKEGSLVSVAGGGDTVAALNHAGVVGDFSYISTAGGAFLEWMEGKELPGVAALE

SEQ ID NO: 10723 - protein, 335 aa, Sphingomonas aromaticivorans
MAIKVAINGFGRIGRNVARAILERPDCGLELVSINDLADAKANALLFKRDSVHGAFSGEVSVDGNDLIVNGKRIQVTAERDPANLPHGANGIDIALECTGFFTNRDGGQKHLDAGAKRVLISAPAKNVDLTVVYGVNHDKLTGDHKIVSNASCTTNCLAPMAKVLHESIGIERGLMTTIHSYTNDQKILDQIHSDPRRARAAAMNMIPTSTGAAVAVGEVLPDLKGKLDGSSIRVPTPNVSVVDLTFTPKRDTSVEEVNGLLKAAAEGALKGVLGYTDEPLVSIDFNHDPHSSTIDSLETAVLEGKLVRVLSWYDNEWGFSNRMLDTAGAMAKFL

SEQ ID NO: 10724 - protein, 640 aa, Sphingomonas aromaticivorans
MANAIRALAMDAVQAANSGHPGMPMGMADVATVLWTQFLKHDPAAPKWSDRDRFILSAGHGSMLIYALLHLSGYESPTMDDIRKFRQLDSVCAGHPENFLIPGVECTTGPLGQGLAMAVGFAMAERHLNAQFGSDLVDHKTWVIAGDGCLMEGINHEAVGLAGTLKLGRLNVLWDDNKITIDGDTSLSTSEDILGRYAASGWHVTSCDGHDFADIARALAEAQADPRPSLVACRTVIGKGAPNKQGGHNVHGAPLGADEIAAAREYLGWTAAPFEVPADILANWRSSAEAGKTARAEWEKRAAANPNAAELARRMAGELPAQTGFDAYIQSLIASPPKVATRKSSEMALEAFTANVPEMVGGSADLTGSNNTKTKSTAPFTPESYDGRYVYYGIREFGMAAAMNGMALHGGIIPYGGTFLVFSDYCRNAVRMSALQHVRAIYVFTHDSIGLGEDGPTHQPVEHVMSLRMIPNLLVFRPADAIETAEAWAIALANKDRPSVLALTRQNLPPVRFDAEMKSAKGAYRLVAAQADRKVVLLATGSEVEVAIKVAAELEAKGLGADVVSVPCWELFDEQDAAYKADLLPADALKVSVEAGVTLGWQKYIGDGLAIGIDTFGASAPAEVLFDHFGLTAEKIVPQI

SEQ ID NO: 10725 - protein, 446 aa, Sphingomonas aromaticivorans
MGTYTFRLPDIGEGIAEAEIVAWHVKVGDTVEEDGRLADMMTDKATVEMESPVAGKVVSVAGEVGDVVAIGSALVVIETEGEDEAPAPAAAPAPKAAIVEERIEVETPEPPQPPSPPQPLFVSREVEAPPAVPATGSGVAPGPRASTAPDTIGGAGAKVLASPAVRQRARDLGIDLSEVRPSEEGRIRHADLDQFLSYNASGGYRAAGAERGDEVIRVIGMRRRIAENMAASKRHIPHFSYVEECDVTALEIMREQLNAGRGDKPKLTMLPLLITAICRALPQYPMINARYDDEAGVVTRYGAVHLGMAAQTPAGLMVPVIRNAQTLNLWQLAREIVRLAEAARSGSAKSDELSGSTLTVTSLGPLGGVATTPVINRPEVAIIGPNRIVERPMFVSDGMGGERIEKRKLMNISISCDHRVVDGHDAASFIQAVKKLIETPVLLLAD

SEQ ID NO: 10726 - protein, 336 aa, Sphingomonas aromaticivorans
TRRLNMIEAINDALDIMMERDPNVVVMGEDVGYFGGVFRATAGLQKKYGKTRVFDTPISECGIIGVAVGMGAYGLRPVPEIQFADYIYPGLDQLVSEAARLRYRSAGEFIAPMTVRSPFGGGIFGGQTHSQSPEALFTHVAGLKTVVPSTPHDAKGLLIAAIEDNDPVIFFEPKRIYNGPFNGYYDKPVEPWSKHADSAVPEGYYSIPLGKARVVRPGQAFTVLAYGTMVHVAAAVCAEKGVDAEIIDLRTLVPLDIETVEKSVEKTGKCLIVHEATRTSGFGAELSALVQERCFYHLEAPIERVTGFDTPYPHSLEWAYFPGPVRIGEAVDRLMK

SEQ ID NO: 10727 - protein, 401 aa, Sphingomonas aromaticivorans
LSLHVPEPKFRPGDKVDYSDLAISRAGEQPRPDEQCEASETHPLCLDLVRVLGDDDRAIGPWDPRLDADTLRRMLRTMALTRAFDDRMYRGQRQGKTSFYMKCTGEEATSVAPAMALADDDMVFPSYRQQGILIARGYPLVEMINQIYSNRADKLKGRQLPIMYSAREQSFFTISGNLATQYPQAVGWAMASAIKGDSRIAATWIGEGSTAEGDFHSAMTFAAVYNAPVIFNVVNNQWAISSFSGFAGAERTTFAARAIGYGIAGLRVDGNDPLAVFAATQWAANRARANAGPTLIEHFTYRAEGHSTSDDPTQYRSAQEREEWPLGDPVNRLKKHLVALGEWSDEQHEAMDRELVDLVKAATKEAEKNGILGHGLHHPFHTMFEDVFEELPWHLREQSEQ

SEQ ID NO: 10728 - protein, 316 aa, Sphingomonas aromaticivorans
SIQRRPINGRETNPIGLGCMSLSWAYGGRPSDEDGIRLLQHAVDIGYDHFDTARLYGLGHNETQVGIALKGRRDKVFLASKMGIFASGDKRGIDCHPDTIRSELEVSLRLLQTDHIDLYYMHRRDFTVPIEDSVGAMADLVKEGKIGGIGLSEMSADTLRKASAVHPIAAMQTEYSPWTRQAEIAVLEACRELGTTFVAFSPVARGVLADGVHDPAALEEKDIRRAMPRFMGDNWPRNYALVRQFNAIAAREGVTPAQLSLAWVLSRGEHVVAIPGTGKIAHLEENIARWDWEIPVAVAAEVDALINQQTVAGHRY

SEQ ID NO: 10729 - protein, 396 aa, Sphingomonas aromaticivorans
MNVHEYQAKELLAKYGVGIPAGIAALTVEEAVAAAKQLPGPLYVVKAQIHAGGRGKGKFKELPADAKGGVRLAKSIEEVEAFAKEMLGNTLVTVQTGEAGKQVNRLYVTDGVDIDKEYYLSMVVDRATGRVAIIVSTEGGMDIEEVAHSTPEKIATIVIDPAEGFMPHHGRAVGFALKLSGDLLKQAAKIAEQLYTAFVALDCSMLEINPLVQTKDGNLLVLDTKMSFDSNALYRHPDVVALRDETEEDPAEIEASKYDLAYIKLDGNIGCMVNGAGLAMATMDIIKLNGEFPANFLDVGGGANKEKVTAAFKIILKDPAVKGILVNIFGGIMKCDIIAEGIVAAAKEVNLSVPLVVRLEGTNVQQGKDILANSGLPIVPANDLGDAAKKIVAEVR

SEQ ID NO: 10730 - protein, 381 aa, Sphingomonas aromaticivorans
MVLGAAPAIASKRARRPNILYIMADDLGYADLSCYGRRDFETPVLDKLAAQGLRFTNAYANSAVCTATRVGLITGRYQYRLPVGLEEPLAFRPNIGLPPSHPTLPSLLAKAGYRTSLIGKWHLGSLPDFDPLKSGYQTFWGIRSGGVDYYTHATSNGQPDLWDGPTPVERAGYLTDLLADRAVSEIREASSGEAPWFMSLHFTAPHWPWEGPDDASESARIAKLKDPSALFHFDGGSAAIYAAMVRRLDYQIGRVLEALKANRAEQDTIVVFTSDNGGERFSDTWPFSGRKTELLEGGLRIPAIVRWPGVTRAGTTSDAQIISMDWLPTFLAAAGSAPDPGHPSDGVDVTPALGGGSLAERALFWRYKNRAQRAVRRGNLK

SEQ ID NO: 10731 - protein, 328 aa, Sphingomonas aromaticivorans
LPAMQTRTLGQSGLAVSALGYGCMGIDFGYRNKLSREDGISIIRAAAERGVTFFDTAEVYGPWTNEDMVGEALEPFKDKVVIATKFGFDIDPDTGAISGTDSRPERIRKVCEASLKRLRVDAIDLFYQHRVDPKVPIEDVAGTVRDLIAEGKVKHFGLSEPGAPTVRRAHAVQPVAALQNEYSLWTRQVESNGILDTCRELGIGLVPYSPLGKGFLAGGVTSAEQVANGDFRGTLPRFQAAAFAHNLQLLDLVKRIAAERDATPAQIALAWLLAKAPFIVPIPGTTKLHRLDENLGAADVVLTGTDLTEIEALLATVTVVGTRYPPER

SEQ ID NO: 10732 - protein, 440 aa, Sphingomonas aromaticivorans
RKFFGTDGIRGRTNSGVMTAEIAMKVGQAAGTYFQRGTHRHRVVIGKDTRLSGYMMESAMTAGFTSVGMDVVLLGPMPTPAVAMLTRSMRADLGVMISASHNPFEDNGIKLFGPDGYKLSDEAELTIESMLLQELPLADAAQVGRARRIEDARGRYIHAVKASLPDNVRLDGLRIVVDCANGAAYHVTPSALWELGAEVIAIGVEPNGKNINAGVGSTHLDAIKAKVRETRADIGIALDGDADRLIVVDEKCQTVDGDQIMALIGTQLAARGELRGGGVVATVMSNLGLERHLNAHGLTLERTAVGDRYVLERMRSGGFNVGGEQSGHMILTDHATTGDGTVAALQVLAALVSSGKPASELLHLFDPVPQLLKNVRFTGGKPLEAKSVKEAIAEAEARLAGKGRLVIRPSGTEPLIRVMAEGDDADEVEAVVDQICDAVR

SEQ ID NO: 10733 - protein, 286 aa, Sphingomonas aromaticivorans
RKGIILAGGSGTRLYPLTRGVSKQLMPVFDKPMIYYPLSTLMLAGIRDVLIITTPEDAVQFQRVLGDGSAFGIAISYAVQPSPDGLAQAFHIGADFVKGSPSALVLGDNIFYGHGLPQLLQNANNRPTGASVFAYRVNNPEAYGVVAFDAEGRASSIEEKPESPKSNYAVTGLYFYDETVVERARDLKPSPRGELEITDLNRLYMDEGQLSVEIMGRGYAWLDTGTHGSLLDAATYVRITEERQGLKICCPEEIAWRQGFIDDAGLERIAQPLRKSGYGEYLLQLL

SEQ ID NO: 10734 - protein, 445 aa, Sphingomonas aromaticivorans
YTAVLGAEWRWLSGQSSASHAARIVGEADRVGSLGEDALSVATWAITGVVLIATAFAISWQLTAVSLFAAGVVAIAVVLLRARKLREGERYGEAYQAMQEQVTNGLFHLRAARIGGAEVSLASRFARTARAVEESELRFHRSVSLAHVAFQAIAAAMLGALIYVALLRFHTPLTVLVPVLVIMARLVPIASGIQHSVRRWTFNRPALDALHGLVAQARAHQEHADDGSPPPVLRERLELRGVSLRYPGRQRPVFDDFDLSIAAGCVVAICGPSGVGKSSLADMLGGLISPDAGEVAIDGEVLRDGARVRWRRRVAYVEQVPYLFDGTIAENLCWGLPGHDDAALERALDRAAALSFVQALPLGLQTRVGEAGRQFSGGERQRLALARALLREPDLLILDEVTAALDGANENAVRGTIRALKGSCTILILGHRAGLLELADQIVDL

SEQ ID NO: 10735 - protein, 621 aa, Sphingomonas aromaticivorans
EDIDQYLKVHEHKTMLRFITCGSVDDGKSTLIGRLLYDSKMIFEDQLAALENDSKKVGTQGQDIDFALLVDGLAAEREQGITIDVAYRFFNTEKRKFIVADCPGHEQYTRNMVTGASTADLAVILIDARKGVLVQTRRHSYLCHLIGIRNIVLAVNKMDLVDYDPVVFDAIVKDYTEFARSIGIESFTAMPISGFKGDNITTRSANTPWYNGPTLVDHLETVEVLSSLDADKPFRMPVQWVNRPNLDFRGFSGLVATGSVKPGDEIRVLPSGKTSKVTRVVTLDGDLDQAVAGQSVTLCLADEVDCSRGDVIALADNPPQAADQFEATLVWLNDEAMLPGRAYWLKLATQTVSATVQQPKYVVNVNTMEHLAAKTLELNAIGVAELATDKPLVFEPYADSRTLGGFVLIDKITNATVAAGMLHFSLRRAQNVHWQALDVSREAHAALKHQKPAVLWFTGLSGSGKSTIANLVEKRLHAVGKHTFLLDGDNVRHGLNKDLGFTEADRIENIRRVGEVAKLMTDAGLIVLTAFISPFRAEREMVRSLMADGEFIEVFIDTPLEVAESRDVKGLYKKARSGQLKNFTGIDSPYEAPQNPEIRVDTTEETPENAAERIVNQLLGW

SEQ ID NO: 10736 - protein, 434 aa, Sphingomonas aromaticivorans
MKIAMVGSGYVGLVSGACFADFGHDVVCIDKDEGKIESLRQGVMPIYEPGLAELVAANVKAGRLSFSTDLAASIEDAQAIFIAVGTPSRRGDGHADLSYVYAVAQELAENLKTPAVIVTKSTVPVGTGDEVERIIRESGTAVRFEVVSNPEFLREGAAIGDFKRPDRIVIGAEDEWAQGVMKEVYRPLFLNRAPILFTSRRSSELIKYAANAFLATKITFINEMADLCEKVGADVQDVSRGIGLDNRIGAKFLHAGPGYGGSCFPKDTLALLKTAEDYNSPVRLVEAVVKVNDSRKRAMGRKAIEALGGEARGKRVALLGLTFKPNTDDMRDAPSIAIVQTLLDAGAEVVAYDPEGMEAAAAIMPEVTMAPNAYAAIEGADAIVLVTEWDAFRALDFARIRRLANAPVMVDLRNVYDPAEVRAAGFEYTSVGRP

SEQ ID NO: 10737 - protein, 219 aa, Sphingomonas aromaticivorans
DWRASLEPLLASPPLRALGDFLDAEERAGKTIYPPATQRLAALEMTPLDNVRIVILGQDPYHGPGQAHGLAFSVQDGVKVPPSLANIYKELEADLGLPRPPHGNLARWARQGVLLLNSALTVEAASAGSHQGKGWEALTDAAIAAVAARDVPTVFMLWGSHAQKKAARVARLASGPHLVLEAPHPSPLSAHKGFLGCRHFSKANAFLEAHGRRAVDWRI

SEQ ID NO: 10738 - protein, 228 aa, Sphingomonas aromaticivorans
MPRLILIRHGQSQWNLENRFTGWWDVDVTEKGAAEAFAAGKLLKDKGVLPTLAFTSLQTRAIKTLHLALEAAGRLWVQEDKDWRLNERHYGGLTGLDKAETAAKHGDEQVKVWRRSFDVPPPPLEAGSEFDLASDPRYDGIAVPATESLKDTIARVLPCWEEKIAPALRAGETVIVSAHGNSLRALVKHLSGISDEDITGLEIPTGQPIVYELDNDLAQVERYYLSER

SEQ ID NO: 10739 - protein, 243 aa, Sphingomonas aromaticivorans
EAVLITGGARGLGEVLVRAFHGAGWRVAVSDIDGDAAHGLAISLDASGKTALGLALDVRMQTDFEAARDVMLDRWGVVHALVNNAVVTRAQPVLDIAPDDFSAVVEVNLRGTFVGSQVFGRLFKTCGYGRIVNIASLAGQNGGTATGAHYAASKGGIITLTKVFARDLAPFGVAVSAIAPGPLDLPSVRELVPAEALTALTETIPVRQLGDPGFIARTAVHLAGRDAAFANGATWDANGGLFM

SEQ ID NO: 10740 - protein, 466 aa, Sphingomonas aromaticivorans
AASGARRDVLDPSTGLVVTDVAEGGAADVDAAVAAARATFQSAEWRDMRPLARERLLHRLADLIERDADILAELEVIDTGKILPMARHGDLVIALDSLRYMAGWTTKIEGTTIDPSFSYIPPIRFSARTVRQPVGVVGQIIPWNFPLVMAIWKIAPALAAGCTVVLKPAEDTPLTALYLGRLIAEAGFPAGAVNIVTGGREVGMAIVEHPGIDKIAFTGSTAAGQDIQRRAAATMKRLSLELGGKSPVVILEDCPVPMAVEGAAGAIFFNHGQVCTAGSRLLVHRSIYEDVVQGLAHAANGMVLGEGMDPAGQMGPLISARQRDRVAGYVQGALDQGARLLAGGEAPDRDGFFYRPTVLADGTPSMTIFQEEVFGPVVIAMPFDTEEEALALANDSCFALGASVWTQNLAAANRFAGALRSGNVWINAHNILDPAVPFGGWKMSGYGRELGHSAVELYTEAKSITM

SEQ ID NO: 10741 - protein, 393 aa, Sphingomonas aromaticivorans
DAVRTPIGRLNGSLSGIRADDLAALPLRALMERNPQVDWAALDDVVLGCANQAGEDNRNLARMALLLAGMPEAVPGATINRLCGSGMNAVGIAAQAIRSGDADLMIAGGAESMTRAPYVLGKAGSAFGRDQKIEDTTLGWRFVNPAMKRAFGVDTMPQTAENVAAQWNVGREEQDRFALASQDKTAAAQARGRLALEIVGVSVPSGKGQTREFTQDEHPRSTTLDVLSGLRPVVHKEGTVTAGNASGLNDGAAAMIVASEQAAAANGLVPRARIVAMASAGVAPRVMGIGPVDAARRLFARTGLSMERMDVIELNEAFAAQAIPVLRDLGVDPLDPRVNPNGGAIALGHPLGMSGARLVQTAVQELQETGGRHALAMMCVGVGQGIAMILERV

SEQ ID NO: 10742 - protein, 355 aa, Sphingomonas aromaticivorans
MRRYSIASIPGDGIGREVVPAAIEVLTAAAAKCGFVLEFRHFDWSCQTYLETGKMMPDDGLDRLRDHDAVFLGAVGFPGVPDHISLWGLLLPIRREFEQYVNLRPVRLLPGIASPLRDKAPGDIDFWVVRENSEGEYSQIGGRTGTGENEIVVQQAIFSRRGTDRILRYAFDFARRSGRRHVTSATKSNGLYHSMPFWDERFAAIGAEYPDVAADQYHVDILAARFVMSPERFNVVVGSNLFGDILSDLGPGITGTIAVAPSANLNPERRFPSMFEPVHGSAPDIAGQGIANPIGQIWSGAMMLEHLGEAEPAALVMRALETALIAPDIARTPDLGGNGTTAGFAQAVRSTLLGL

SEQ ID NO: 10743 - protein, 320 aa, Sphingomonas aromaticivorans
MEYDRKDAKAWATKTVRGFYQCPITPMTADYKFDVDGIRYNIDKYVEMGVDGLAVGGFIAECWNVSASDWFRYHEIVAEANAGRLDLWTIVLDPSVYTAIEKMQFVEKLGYNGAEVINPVVQLKRDDEIYSWFKFLTDHTDLAVCLYRTPVSGTVLSWDLMRRLADIDTVIGVKQGAMSRAETIKIRQLMPEGFNTMEPFEYFFLDDLRLGGTVCWGELSYMLYGKKRHFAKEYIRLAHEGKWEEARAASDQLSEVREFYHDNFLWDIARTATYASALANVKAWYEAIGLKAGPILPPVADVTPEKKEQIRAKLVELGIA

SEQ ID NO: 10744 - protein, 882 aa, Sphingomonas aromaticivorans
VFSFGSGVLVAGQIGLDKRVLGGKGANLAEMARIGLPVPPGFTISAGECLAYLDHGRASLDRIRDEVSAALGLVERATGKTFGNPRDPLLVSVRSGARVSMPGMMDTILNLGINDATVTGLGQSSGDERFALDSYRRFIQMYSSVVLEIEHGVFEAALDRIKEDRGVDEDIDLRVEDLRGVIATFKDLVLAHHGAAFPQDVQEQLWTAIEAVFRSWDSPRAKVYRRLNDIPGDWGTAVNVQAMVFGNLGETSATGVAFTRNPATGEKAYYGEWLANAQGEDVVAGIRTPQYLTRGCPRSRRARLPSMQEAMPKAYAQLAEVFELLERHYRDMQDIEFTVERGRLYLLQTRSGKRTAKAALKIAVDMVEESLVDEVTALLRLDPASLDQLLHPSLDPNAPRVLLGKGLPASPGAASGGVVFDAETAARWAELGEKVILVRHETSPDDIHGMHVATGILTARGGMTSHAAVVARGMGRPCVAGTASLKIDPVARVAEIGGQRLEEGAFITIDGSTGEVFLGELPTILPKLSGDFATVMAWADKHRRLKIRTNAETPLDCEMARRFGAEGVGLCRTEHMFFDESRILAMRQMILADSEKERRSALDQLLPEQRTDFRRIFEIMEGLPVTIRLLDPPLHEFLPHTDSEFTELSRAMGIDVEQVRHRAIELAETNPMLGHRGCRLGVVYPEIYEMQARAIFEAALEVAGEAGMAVCPEIMIPLVGLPRELESLKDTLYRVAEVVFAEKGERIAFSVGTMIELPRAALVADEIAASGEFFSFGTNDLTQTTLGISRDDAARFLGAYVEKGIIAKDPFVTLDIEGVGKLIEMASRKGRETRPDLKLGICGEHGGDPATIAFCEEIGLDYVSASPFRVPIARLAAAQAAL

SEQ ID NO: 10745 - protein, 322 aa, Sphingomonas aromaticivorans
DIASGGELAIVRDAGIDPAMVSFAGPGKRDAELEAAIAAAVTLNLESEGEATRALAIAGRLGIVPRLAIRVNPDFDLKGSGMKMGGGAKPFGIDAERVPALARKLISAGAEWRGFHIFAGSQALSADAIIETQAQTIGLAARLAEETGAPLPKCNLGGGFGIPYFPGDEPVDVVAVGAALGDQFAALPDVLRDTAFCIELGRYLVGEAGIYLATVIDRKESHGEVYLVTDGGLHHQLAASGNFGTVVRRNYPSAIATRFGAAVEEEASIVGCLCTPLDRLADKGGFPRTDTGDLVVIFCAGAYGASASPQRSSGRVRPGKCL

SEQ ID NO: 10746 - protein, 622 aa, Sphingomonas aromaticivorans
MCGIAGIVHTEGPKPVDPDRVRRMCDAIAHRGPDGEGVWTAPGIGLGHRRLSIIDLAGSPQPMKAAEGDAVIVFNGEIYNFRDLRKELQALGAQFRTDGDTEVILQAWRQWGTACLPRLHGMFAFALYDLRQRTTLLARDRLGVKPLFTARLADGAVIFGSELKALLAHPSLRREIDPLAVEDYLAWGYVPDHRSMLKGVEKLPAGHYQLLRHDAPPAAPVQWWDVSFADRANGSAEDLGAHLLHHMRDAVTSRMVADVPLGAFLSGGVDSSSVVALMAEASATPVKTCSIGFDVAALDETAYADRIAARFATEHRKRLVSPDDFSLVDRLAGMFDEPFADASALPTFRVCELAREHVTVALSGDGADEAFAGYRRQTFQHREEQARALLPSALRKPLFGTLGRLWPKADWAPRPLRAKTTLLSLAASGEEGYARALSVTSPELRETLYTPDFKRLRGDYRAEQPLIELMRKAPARSGLDRAQYADLKFYLPGDILTKVDRTSMAVGLEAREPLLDHRLVEFGASLPERLRVRGATGKWLIKQTMRRYLPEDVLFRPKMGFVTPLAQWLRGPLAHEARALASDGLLARTGWLDAARIDALADAHVSGRADHSRLIWQLLMLR

SEQ ID NO: 10747 - protein, 258 aa, Sphingomonas aromaticivorans
MATFSLPKNSKITGKARHHAAATNGKVRKFKVYRYDPDSGENPRYDTFEIDLDQCGPMVLDALIKMKGEQDPTLTFRRSCREGICGSCAMNMNGRNGLACTTAIEDLSGDIRITPLPHMEVIKDLVPDFTHFYAQYASIRPWLQTVSPTPSGKERLQSPEQREKLDGLYECILCACCSTSCPSYWWNSDKFLGPAILLQAYRWLADSRDEMTGERLDELEDPFRLYRCHTIMNCANVCPKGLSPARAIAEIKKMQAER

SEQ ID NO: 10748 - protein, 390 aa, Sphingomonas aromaticivorans
SDPVVILSYARTPMGAMQGALAEVAATDLGATAVKAAVERAGVAPDKVERIYMGCVLPAGLGQAPARQAAIKAGLPKSVQATTVNKVCGSGMQTIIMGAEALAAGSADLIVAGGMESMTNAPYLLKKHRSGARIGHDMAYDHMFLDGLEDAYDAGRAMGTFAQDTANAYQLTREQQDAYSIESLRRAQAAVADGSFKDEVVAVTVKTRAGEVTVDTDEAPGKGRPDKIPSLKPAFAKDGTITAATSSSISDGAAAVVLARQSVAAAAGLAPVARIVALAAHAQEPKDFTTAPVGAIQKVLDKAGWSIADVDLFEVNEAFACVAMFAMHDLGIPHEKINVHGGATALGHPIGASGTRIVTTLIAALRKHGKTKGVASLCIGGGEATALAIE

SEQ ID NO: 10749 - protein, 450 aa, Sphingomonas aromaticivorans
QAMKDTTRGEMLAQLERQKAAFTQARPEPLSTRNDRLERCARLLLQHGEDFARAMSTDFGHRSHEQSMLTDIMPALSLVRYSQKRMKAWSKPEKRHVNFPLGLLGARAEVRYEPKGVIGIVAPWNFPVGLTLAPLAQAFAAGNRAMLKPSEFTERTSELMAELFPKYFGEDEVAVVLGGPQAGQDFCSLPFDHLLFTGATSIGKHVLHAAADNLVPVTLELGGKSPTILGRSANVEQAAQRIALGKMMNAGQICLAPDYMLVPEDMEERAIGAVSASVAQMYPTLLANDDYTSVINRRHRDRLVGLVDDAVAKGAEAIVVNPGGENFEGSNGNKLPLTILRNVDDGMKVMQDEIFGPVLPVKTYRGIDEAIDYINAHDRPLGLYYFGEDAGERERLLTRTISGGVTVNDVIFHVSADDLPFGGVGPSGMGSYHGIEGFRSFSHARAVYRQ

SEQ ID NO: 10750 - protein, 484 aa, Sphingomonas aromaticivorans
MPKVKVDGVELEVPAGATVLQACELAGKEIPRFCYHERLSIAGNCRMCLVEVKPGPPKPQASCALPATEGQEIRTDSEMVKKAREGVMEFLLINHPLDCPICDQGGECDLQDQSVAYGRGASRYHENKRAVTEKYMGPLIKTTMTRCIHCTRCVRFSEEVAGVDEIGALYRGETMQISTYLEKAAAHELSANVIDLCPVGALTSRPYAFEARPWELKKTLSIDVSDALGSNIRLDSRGREVLRILPRVNDDVNEEWLSDRGRYMVDGLTRRRLDKPWLRRDGKLVAATWAEAFEAVAKVNPGSSVAVIAGDLVDCETMFAAKKLAGALGSSLLEGRQTGLAYDTSNLTAVNFNSTLAGIEDADAVLIVGSMIRDEAPLLNTRLRKAAKKGAKVFIVGPHWDPTYPATFLGDDLAVLGNLPAEVSDAFGAAQKPAIIVGGAALGKGALAAGLAFAEKFNLVREGWNGFNVVHMAASRMGGLMLGY

SEQ ID NO: 10751 - protein, 466 aa, Sphingomonas aromaticivorans
MANIRPFCMPKWGIEMTEGTIAEWMVKEGEAFNKGQVLCLIETAKITNEVEAEYDAVLKRLLTPASDEAHPVGALLAVFADADTTDAEVDEFIAGFKPAETSVAAKSGGGSAPAPAPAAAAPAPAAPARTPTKIVTNRAISPEALKLAEAEGVDIEPIEGSGRNGRITYQDVVQALRPERALSYKGSAQLVEDSPEAFASPLARRIAAQHGIALAGIKGTGARGRISKADVMALVKPTTAAAPVFGAPFELVANQPQVQPFDKVRKVVARRLTEAKQTIPHFYLRVSASVDALMDLRKTANLVLGTKASINDYLVKAVALALVRHPDVNVQVHGDSVHSFPHADVAIAVASPKGLVTPIVRQADRMHIAQIAATTRALIDKAQAGRLGYEDMDGGTFSVSNLGMFGIEQFDAIINPPQGAILAVGGVNRVAVEAANGDIAFENRIQLTMSVDHRAIDGAAGAKFLQ

SEQ ID NO: 10752 - protein, 334 aa, Sphingomonas aromaticivorans
MAKMMYRDAVVSTIAEEMERDENVVMLGEDIVGGMGTPGGPEAIGGIWSTSTGLFGKFGADRVIDTPISESAIMGAAAGLALSGKRPIAELMFADFIGVSLDQIWNQLAKFRYMFGGKTKCPAVIRMAYGAGYNAAAQHSQAVHQILTGMPGLKVVMPTTPADVKGLLRTAIRDDDPVIFLEHKALYGVSGEVPDDPDFMIPFGHARLSRAGQDVTIVSTGLLLGFCEAVADKLAAEGIGCDVIDLRTTSPIDEETILDSVEVTGRLVVVDEAPPRCSLASDICATVAEKGFAALKAPPQAVNPPHTPIPFARELESAYLPSVDKIEAAVRKVL

SEQ ID NO: 10753 - protein, 322 aa, Sphingomonas aromaticivorans
LSREALLRAYRQMKVIREFEERLHVDIQTGEIAGFTHLYCGQEAVAVGVCEHLSVEDKIVSTHRGHGHCLAKGCDVNGMMKEIWGSREGLCKGKGGSMHIADVDKGMLGANGIVGAGAPIAVGAGIAAKIDGKGKVAITFSGDGACNQGTTFEAMNMAVVTKAATIFVFENNHYSEHTGFEYAVGTTKDIASRAEAFGMKVWRGDGTDFFSVFETMREVLDYVRVPGNGPAAVEFDTERFFGHFEGDPQRYRGPGEIDRIRETRDCLKKFRESVTAAKLLTHEDLDALDAEVMEAIEESVRQAKAADRPTAEDVLTDVYISY

SEQ ID NO: 10754 - protein, 409 aa, Sphingomonas aromaticivorans
  unsure (1)..(409): unsure at all Xaa locations
MDIELSPEDQAFRDEVRAFLAANLPREVIDGAASSPTVFVEPDIGQRWNAILAAKGWLAYQWPKEAGGTGWSPVQRYIFEKECALAGAPNLTVLGLKLVAPVIYTFGTPEQKAKYLPRILSGEDYWCQGFSEPGSGSDLASLQCRATLSEDGTHYKLNGSKIWTTHAHWANRMFALVRTDATVKKQAGISFVLVDMNQPGVSVRPLLTLAGDHEVNQVFLEDAIVPVEDRIGEEGDGWKLAKFLLENERGGSCHSPKLEYDLGQIEKDAAAEPDGRGGRLADDADWKRRVAKVRLGIQSLEMIELKILSEVAKGRPPGPQTSLCKLLASNLRQDVDLLAVDLYGTAGLQLDFARPFYGDNAPAAIHSRGAQVASARYLNSRAWTIFGGTNEVQAGIIARTVLGLXGSKR

SEQ ID NO: 10755 - protein, 379 aa, Sphingomonas aromaticivorans
VCIVGIGIHPFGRTDGLSGLEQGVFAVRQALGDAGIEWGDVQFAYGSSDSAGNPDTMVDRLGLTGMQFINVRNGCAAGGSALFSAQMAIKSGEFDIGLAVGFDKHPRGAFNAMPSEYNLPDWYGEAGYMITTQFFANKIMRYMHDHGISQQTLGRVAEKAFRNAVHADHAWRREPVDLETILEAPLVSDPYTKYMFCSPAEGGVALILASEKKARELGKPLVRLKAATMRTRPPKSFEVFAPSIDIGGGKATATQIASADAFRMAGIGPGDIAVAQLQDTEAGAEIMHMAENGFCKDGEQERWLAEGLTEVGGKLPVNTDGGCLACGEPIGASGLRQVYENVVQLRGDGGGRQVPGNPKTAYSHVYGAPGVSAVTILER

SEQ ID NO: 10756 - protein, 532 aa, Sphingomonas aromaticivorans
GWDYIVVGAGSAGCVVAERLSADGRHRVLVLEAGGENDGFWVTLPKGVARLVTNPDHIWAYPVAQPRAAGMPANEVWIRGKGLGGSSAVNGMIWSRGEPADYDAWEQAGATGWNGAAMTEAFLALEDHAAGPGPMRGSGGLVHVDPAIYTYPLADRMIAAGESCGMARVADLNERGGPRVGLYSHNIRKGRRQSSGRTFLAAARRRANVRVVTGAIAERVVTRDGRAVAVEARVNGVLTRFDCAGEVIVSGGAMESPLLLQRSGIGDGARLRAVGIEPLVQSPDVGERLVEHLGFSMPHRLVGERGTGGLLRGPGLVAAVLRYALTRGGIMATGPFEVGAFCNVAHPDGRVDAQLYLGGYTFEVSDDGNPVPLDKISSRPGMTIYGQLLRLTSEASVRAAGPDAATAPVILPNWLSTEHDRKSAVAMVRAMRRFVRTAPLAEVVGEEMIPGAAVESDEAILDAFRHLASCGLHAIGSCRMGSDQRAVVDPRLRVRGVDGLRVVDCSVMPGHITGNTNAPAMALGYRAGNLIL

SEQ ID NO: 10757 - protein, 331 aa, Sphingomonas aromaticivorans
VNFDLNEDEEMLKALAERFVDDHYDLDRRRGYLADPNGFSPAMWSLLAELGLVAAPLSMESGGLSLDATAIATVFEALGRGLVVEPLTENILVAARLLERVAPADLAEGWMESLAMGTRRVALAHAEHGARGGLTFVECAVRTDGSLCGVKSCVPAGAGVDAFIVTARESGSATDEAGIALFLVEANAPGVAVNPWRMADGSIAVTLTLDAAPATRLVGSLADVRENDLLASLARSAEAIGIMQLLFDATLDYLRTRRQFGVSLGSFQAIQHRMSAQYAAIEQARALTQSCHGLARVGRIRLRRPRPARLRRPGLGRLGHEMIQFHGGMGV

SEQ ID NO: 10758 - protein, 257 aa, Sphingomonas aromaticivorans
LSKRLEGKVALITGGTTGIGAATVARLTQEGAKVWFTGSKEEAAAALCAETGAVFRKLRVQDAAGWPGLIDEIIAAEGRLDIVFANAGTESGDGSIEDVSIEGWDNVVAVNQTGVMLTVQNAIKGMKRNPEGPRGSIVINSSMNATRPLGNYVTYSVTKAAVCALAKSAAVHCGQQGYAIRVNAILPGVVETPLIQQIMNAQPDPAAARAMYEGMAPMKRMAQLNEVAGLVAYLSSDEAGFISGAEYAIDGATTAGM

SEQ ID NO: 10759 - protein, 265 aa, Sphingomonas aromaticivorans
AQRLKGRVAFVSGGLRGIGLACAERFLAEGAEVVLSDLDAEASDTARDVMARLGQAASYISANVAREEDWERAVALVKERHGKCHVLVNNAGIDLTGPVETLSMEGWRRIMSINVDGVFLGTKHFVPLMAESGKDFRGGSSIINVSSIMGLVGMNEVSAYNASKGAVRLFTKGIAIEFAQKKTPIRANSLHPGFVETPLLKAGFQRWVDQGFADKPDDLVAGVVGATPIGRLAQPSELASAAFFLASEDSSYMTGAELVIDGGWT

SEQ ID NO: 10760 - protein, 250 aa, Sphingomonas aromaticivorans
AVVTGAAGGIGRELVKAMKAANAIVIATDMAPSADVEGADHYLQHDVTSEAGWKAVAALAQEKYGRVDALVHNAGISIVTKFEDTPLSDFHRVNTVNVDSIIIGTQVLLPLLKEGGKARAGGASVVNFSSVGGLRGAAFNAAYCTSKAAVKMLSKCLGAEFAALGYNIRVNSVHPGGIDTPMLGSIMDKYVELGAAPSREVAQAAMEMRHPIGRMGRPAEMGGGVVYLCSDAASFVTCTEFVMDGGFSQV

SEQ ID NO: 10761 - protein, 246 aa, Sphingomonas aromaticivorans
GKVAIVTGAGVGMGAATARLLAARGARVVVSDINPDTAAATVETIRADGGTAHAVRTDVSDEAQVEALVAETVATFGRLDCAVNNAAITPDVLPIHEADMAVFDRVLNVDLRSVMLCMKYEIRQMLAQEGPGSIVNIGSVSSFRPQPNNAAYVAAKHGVIGLTKTGSLEYAGRGIRVNAVLPGAIDTPMLRGALETTGFTEADFAPALSLFGRFGKPEEVAEASAWLCSDAASYVTGHSLAVEGGY

SEQ ID NO: 10762 - protein, 242 aa, Sphingomonas aromaticivorans
QMDGKVALVTGGASGLGAEDARVLAREGARVVITDMQEDLGQKVASEIPNCVFLKQDVRDEARWGEVVAETLRLFGRLDTLVNNAGLVRFGTVEDLSWDDYKLQTDVMAGGTFLGCKAAIPHMSKDGSGSIINMASVGGIKGISAIPAYAAAKAGIIGMTRSIAVHCREQGYRIRCNSIAPGGIVTPMTAQALAELPADNAGLDQAHNHGMGQPIDIANMVLYLACDDARHITGTNIVIDNG

SEQ ID NO: 10763 - protein, 473 aa, Sphingomonas aromaticivorans
RVGRFTGMREDGVLAFKGIRYGRAARFERALPEPWNGNPAKAQTFAPIAPQRGNPDLPQSEDCLFLNVWTPDANPRAGRAVMVYFHGGAYSNGTVTDPLTHGGKLAAQGDVVVVTVNHRLNALGHAWLKPFGARFADSGNLGQLDLVLALEWVRDHVRDFGGDPARVMVFGQSGGGAKIATLMAMPAARGLFHCAATMSGQQVVASGPNNAWKRTQALFAALGLQPRDVELLRTLPVERIVDALGATDPVMGGGLYMGPVLDMTNLPRHPFWPDAAPQSLEIPMILGNVREETRAFIDPRGPRLRGLDWDNLAARIAPEIKIDLDVDWVVAQYRRQHPQWTPEQVFYAATTAGRSWPGQVIEADERARAGATKTWVYQFDRPSPLDPLRGAAHTDDIPYVFGTLDAPGSMSGTDLGARMTRDLMMGAFAGLARTGRPGLADWTAYTLPDRATLVVGDGTASIASDPRKWEREL

SEQ ID NO: 10764 - protein, 258 aa, Sphingomonas aromaticivorans
GHSMSIFDLSGRVAVVTGANTGIGQGIAVALAEAGADIAAVGRTPAEETAAKVRALGRKCELVSADLSTIAPVQDVVDEVLSSLGGLDILVNNAGIIRRADAVDFTEEDWDAVVDTNLKSVFFLSQAAGRHMIANREATGRRGKIINIASMLSFQGGIRVPSYTASKSGVAGLTRLLACEWAARGVNVNAIAPGYIATNNTSALQADETRNRQIMERIPEGRWGDPADIGGAAVFLASGAADYVQGHVLAVDGGWLAR

SEQ ID NO: 10765 - protein, 417 aa, Sphingomonas aromaticivorans
LKIAILGLGYVGCTAAGCIASQGHHVVGIDVNLGKVETLNTGKSPVYEPGLDDLIAKARAEGRLHAVTEIGSALDDCDIAIVCVGTPSGVDGAHNMSFIVQVSRAIAASVRPDRKTPLTVVYRSTMRPGTTEQMILPIFRSVIGEDCEKLIELVYNPEFLREATAIEDYFHPPKIVLGTIDGAPSEKMVALHEGIEAPIFHVGIREAEITKFVDNTWHAVKVAFANEVGRVCQNLGISAKQVHEIFVSDTKLNISAYYTRPGGPFGGSCLPKDVRALQHIAADTGAQTHLVDSLLRSNDAHKHHQFLQVTKDLQPGARVLLVGLAFKADTDDLRESPAVDMARKLLDAGYALDIYDPQLRPESLVGQNLGYAYAILPSIDGLLVDKTTAEARDYGVVIATNRLIRDLALPGRRIVDV

SEQ ID NO: 10766 - protein, 238 aa, Sphingomonas aromaticivorans
MSRVAVVTGGTRGIGQAICLALQAQGRTVVANYAGNEEKARTFTAETGIPAYRWDVGDHEATLEGCARVAAEVGPIDIVVNNAGITRDGVLHKMSFDDWNEVMRINLGGCFNMAKATFSGMRERGWGRIVNIGSINGQAGQYGQVNYAAAKSGIHGFTKALAQEGAKYGVTVNAIAPGYIDTDMVAAVPPQVLEKIVAKIPVGRLGHADEIARGVAFLTADQGGFVTGSTMSLNGGQH

SEQ ID NO: 10767 - protein, 262 aa, Sphingomonas aromaticivorans
ISVATWNINSVRLRADQVERFLLQEAPDVLCLQEIKCAESVFPHEVFEKLGYTHRAIHGQKGYHGVATVSRIPFRDFSRHDWQDNGEARHIGVELLGPGNGLILENVYIPAGGDVADREVNPKFGQKLDFLERMTRWAEKIERPTLIVGDFNIAPLECDVYDHKALLKVVSHTPLEVETLQRFADAHGWVDLGRKHIPAPERNYSWWSYRSYWRAKDQGRRLDHMWASPEAAAQTRGHRFVEETRKWDQPSDHIPLITELDL

SEQ ID NO: 10768 - protein, 253 aa, Sphingomonas aromaticivorans
RYTAQEHAIWDELYARQMELLPGRACSAFLQGLERLDLGRGGVPDFARLSSELGALTGWSVVPVPMLIPDHVFFWHLANRRFPAGNFIRTRETFDYIQEPDVFHDVFGHVPMLTDPTYADYMQEYGRAGWKAMRYNRLKALGALYWYTVEFGLVIEDGAPKVYGAGILSGPREAVFALEGQSPNRIMLNVDRVMRTDYVIDDLQPTYFVIESFADLYHQTVERDFDRLYRALGAGFTYANTAVIDVDDVLHRG

SEQ ID NO: 10769 - protein, 492 aa, Sphingomonas aromaticivorans
RWFQYLLLIVLVLAIGTACRFYFVSWLGERVVADIRLKVQANLLRLPPSFFETNSPKEISSRMTSDTAVIEQVVGTTVSVALRNTITAIGGLGYLFYLAPKLTAILMIGIPLVVGPIVFFGRRVRNVSRSSQDRVAVIGVIVSEVLGAMKIVQAFGQEKRELERFGEKVEATFQTALRRISLRAVMTAIVILLVFGGITMLVWQGAVGVAEGRISGGTIFAIVITAGLVAGALGALSEVYGDLLRGAGAAGRLNELLREQPEIAPPARPTALPIPPRGQIAFQNVSFRYPSRPEVLALDDFSLTVEPGETVAIVGPSGAGKSTLFLLAQRFYDPHGGTIRIDGVPLTSADPAEIRQRSALVPQDATLFAASARDNLRYGNWGASDEAIWEAARAANAEQFLRDLPQGLDTFLGEDGARLSGGQRQRIAIARAVLREAPILLLDEATSALDAESERLVQEALDRLMKERTTLVIAHRLATIRAADRIVVMDAG

SEQ ID NO: 10770 - protein, 695 aa, Sphingomonas aromaticivorans
RQGELDMTLRSRSAGVSLMVLAFVACPAFAQEVRTVSALESGWRFLDGDVAGAVAPDFADAAWEQVEVPHTWNRVGFYRHDMGGANTEANVRKRQGVGWYRLRFSPAPVRPGDRSWLEFDAASRTAQVWLNGTYLGEHRGGFSRFRLDATAVLRAGAENVLVVRVDNTQPAAGAPTADVLPLTGDFFVHGGLYRPVRLVTTAPLHIDMTDHGGAGIRAATVSASTGSARVKVAVRVANDGRGSTRAIARVALFDRDGREVAAARVPATVASGKVAEVEAELSVAAPHLWQGTKDPYLHDLVTEVLDKDGKVVDRISQPFGIRTMTFDPERGFVLNGQPYRLKGVGYHQDRDGKGWAISRADVAEDVATIREMGANTIRLTHYQHGQDIHDLADRAGIVVWDEIPLVSAWTLGGKLDPDPALVANARQQLTELVRQNQNHAATAIWSIANEVDFGNSMPIFLTADAQGRVADPMALLKELDGLAKALDPSRPTALATCCEGNRQAPGTQIPITATAADLGGANRYFGWYYGKPSELGAHLDKLRAGRPDQPLSLTEYGAGGGLTIHTDNVLGGPADSRGFAQPEEYESWVHEQTLPQLDARPWLYATWLWNSFDFATRIRTEGDAQDINTKGLVAYDHKTRKDAWYFYKANWNVEPMVHITAKRYKERAYPVTEVKVYSNTASTELLLNGRSLGTK

SEQ ID NO: 10771 - protein, 262 aa, Sphingomonas aromaticivorans
  unsure (1)..(262): unsure at all Xaa locations
GRLSGKVAIVTGGARGMGAATSRLFVAEGAKVAIADVLDEAGEALAAELGDAARFFKLDVTSEDNWASVVSEVEAALGPVDVLVNNAGILMFKSLLETTKADYEKVLGVNLVGEFLGIKAVAPGMIARGKGSIVNISSVDGMKGANSLVAYASSKWGVRGLTKVAAMELGHKGIRVNSVHPGGVDTVMSNHSGAAREDVDKGYANVPLQRIGGPEEVAAASLFLASDDASYLHGAEIVVDGGMTVGTYYMGFPGSPGMXSGP

SEQ ID NO: 10772 - protein, 246 aa, Sphingomonas aromaticivorans
DFSGKTVLVTGGGVGIGRAIAEAFAGAGARVVIAEIDPANAEAVEQAIPGARVIRCDVRQRGVGQMLAERIAAETGKLDVLVNNVGHFVHARPFAMLSEEEVEEILDTNLGQLLRVTRAMIPLLRKAGPGANIINVTSIEAHRGIPYCSVYAAAKWAVTGFTKSLALELGPEGIRVNDIAPETTDTPQVALDYMIPPENRVHEERWIPLGRFGRPADCAGAALYLASPLAAWVTGTALHVDGGALA

SEQ ID NO: 10773 - protein, 539 aa, Sphingomonas aromaticivorans
FDFIVIGGGSAGAVLAARLSEDAQSRVLLLEAGGANTSLLVRMPAGVGTLIKKKSRHNWGFWSDPEPHMDGRRMWHPRGRGLGGSSAINGMVYIRGHARDYDQWRQMGLEGWSFAEVLPYFRRAEDFCDGADAFHGAGGPLRVSWGERSDHPLYRGVIEAGRQAGHKVTPDFNGADQEGFGRYQLTIHDGERWSAARGYLAPVAGQRANLTIVTGARVHRVVVEGGRATGVEYSLGKGKPVRRAHAAREVLVCAGALQSPQILQLSGIGDPEELARHGIAPVHPLPGVGANLQDHLDVTLNWACTQPITIYNEIKGLGQLKVGLQYLLTGKGAGRQNGLEAGAFLKSRPDLDRPDLQIHFVLAIMQEHGKRSVKRDGFTLHVCQLRPESRGRVSLASADPYADPSILANFMAAEEDRRAVRAGIRIAREVAAQPALAPYRGEEIWPGNDVQTDEEIDAWVRRTGETIYHPVGTCRMGTQGDAMAVVDSQCRVIGLEGLRVVDASVMPNLIGGNTNAPTIMIAEKISDAIRGRAPLAPVE

SEQ ID NO: 10774 - protein, 245 aa, Sphingomonas aromaticivorans
LDGKVALVTGAGGGIGRAAAQVFARSGASVMVSDVNEAGGAETVALIEAAGGKAAFVRCDVSNADEVKAMVKATVDTFGGLDCAFNNAGINRVTDDQYDDAIWERDIAINLSGVMRCMREESAVMLERGGGAIVNTASINGLVGNGSQPAYTAAKHGVVGLARHGALRWAKNGIRVNAVCPGVIETPMTAPLVQNPEIKALMDSMTPMGRMGSAMEIAEAVVWLCSPAASFVTGHAMVVDGGATA

SEQ ID NO: 10775 - protein, 238 aa, Sphingomonas aromaticivorans
FAGAHVLVTGGTSGIGAASAALFRDAGAQVTITGTRGSAAEYDADLSGYRYLQLDIEDKDRIDAVAAALPRLDVLVNNAGFALPSIGLDEWEPDVFDRAVNMLLNAAFRMARRTVDLLAQSAVPGGGSVIGVASMSSYFGIPVVPGYGAAKTGLVGLTRTMAANWGPRGVRANAVAAGLTRSKMTAGTFEQEAWTAPTLSRTPLGRLGEADDIAQAILFLASPAASWITGQTLAVDGG

SEQ ID NO: 10776 - protein, 180 aa, Sphingomonas aromaticivorans
EVEEAIATLIRWAGDDPTREGLLDTPRRVARAWRECCSGYAEDPAHHLSRQFEEVGGYDEIVLLKDIPFQSHCEHHMAPIIGKAAIAYLPREKVVGISKLARVLHAYARRLQIQERLTSEVAQCIWDNLRPHGVAVVIEAQHGCMTGRGVRTPGVGMVTSRMMGTFLDDNRTRKEVLGLM

SEQ ID NO: 10777 - protein, 250 aa, Sphingomonas aromaticivorans
EFSGRRTIVFGGSGGIGRGVSLEFAREGSDVAVVYRSKQDVAEAVAEEMRALGRRVSIHKADVRNRAEVQAAFAAAVAEHGRVHTVVWGAGPVVPQVPIAEWTEQMFRDSMEIEAFGFNNAVHTALPHMRDSGGGSFVHLGSAGHDWWPQLDGLSVAPKACNEALIKGIAKEEGRHEIRANSILVGVIDAGQFKIGQEAGTFTPEWEAAVKAMLPLKRWGSPRDIGQAAVFFASDRGNYVTGQTISVGGG

SEQ ID NO: 10778 - protein, 1142 aa, Sphingomonas aromaticivorans
MQFRRLKLSGFKSFVEPAELRIEPGLTGVVGPNGCGKSNLLEAIRWVMGESSPKSMRGGGMEDVIFAGTATRPARAFAEVMLTAETDPSGPFGGELEVVRRIERGAGSAYRVNGKDVRAKDVALVFADAATGAHSPALVSQGRIAAVIAAKPAERRMMLEEAAGIAGLHVRRRDAEQKLRATEANLGRLVDLLSGLESQIATLRRQARAAERYRAVSEKIRLAEARLVFARWRDAAAAAEAARKQAVAAEDAVKAAALLANQAQAAQHKSAATLAEARDDSSTAARTPPPMASAWPRSPRSLEAAEQRLRDIDRQLSRIEEDRASADRLTEDAAAAMARLEQDLAAAETALAGDEARRPTLAAAVDDADRAARAAEVALAQRVAEQAGIDAEWRVAEAAVSAARQRLARLDADATRLAQQAEALSREADPEAQIAEAEAKRAEAAATLADAEAQRADLLRQREDLTTRRDAASNALAQARADLAGVEREADALARDKAAREKAAAAKGLGKAAIAGTRAAAGYERALAAVLGRDAAAPVGAAPADAEGRFWTGAEAPEPLADSLVRHIPTCPPELAARLALVRVAEADEGQVLRPGEWLVTRSGRLRRWDGFVARGEGAAEAAALEAENRLAELQALLPARREALAAAEAGFEDVRVTLGAVQVTLSQTEKTLSAAADAERAALRALDAAEAARARLDQRKAEISRTQTDLAEQRQSAQAELSAAEDKRSSLPDPAAGRAALDAARARNDAARTSLQSASAAAASIEQQIAVGKERLAGIKGDIRAWQARAGDAAKRLAEMTGRREELEAERAVSAVKPAGFIAEIEQGETIRQRLATDLAAAETALAEAESASKQADSALSAANEALATAREARAGATARAENEDARRQEMAGISGERFQCPPPLLPERFGFASAEVAAAGDESAAMDRLVAERERIGPVNLVAADELAEAEERHGTSIAEQAELTEAVHRLRGSIGNLNREGRERLRAAFEAVDGHFRRLFARLFGGGEAHLALVDSDDPLDAGLEIFAQPPGKRLQSLTLLSGGEQALTAVALIFALFLTNPAPICVLDEVDAPLDDANIERFCDLLDAMVQETSTRYLIVTHNAVTMSRMHRLFGVTMVERGVSRLVSVDLGGAVELL

SEQ ID NO: 10779 - protein, 441 aa, Sphingomonas aromaticivorans
MATVTRFAPSPTGKLHVGNVRTALHNWLLAKKTGGRFLLRIDDTDAERSREEYVESIRADLQWLGLIPDGEERQSLRTELYEREFQRLVEAGRIYRAYETAQELDLKRKILLGRGLPPIYDRAALKLTEADHAAKAAAGERPHWRFLLDHDQPITWDDGIRGPQSFDPRQMSDPVIRRADGSWLYMLPSAIDDIAMGITDVLRGEDHVSNTATQIQMFTALGAEPPRFAHEALLTGSEGKLSKRLGALGMADFREQGIEPEAIVALLARLGTSDPVDAALDAAALATSFDLSRFGRAPARFDEADLHRVNAQIVHRLPYARVAHLLPQGMGEAAWEAIRPNLAHIDEARDWWNVVTGPVTAPTFDDETRAFLAQAAKTAASLDWSADPWRALTATLKDGTGRKGKALFLPLRQALTGHDHGPEMAALLPLIAQDEAVRRLS

SEQ ID NO: 10780 - protein, 311 aa, Sphingomonas aromaticivorans
MKIMAGNSNLPLARAISAYLEMPLTDASVRRFADEEVFVEIHENVRGEDVFVVQSTSYPANDNLMELLICIDALRRASAKRITAVVPYFGYARQDRKPGPRTPISAKLVANLITQAGADRVLSVDLHAGQIQGFFDIPTDNLFAAPVMAADIQTRYGAQELMVVSPDVGGVVRARALAKRLNNAPLAIVDKRRDRPGQSEVMNIIGEVKGRMCILIDDIIDSGGTLCNAAQALMDAGAVGVSAYITHGVLSGGAVARVAGSALKELVITDTIMPTEATASCDRIRVLTIAPLIGEAVRRIADESSVSSLFD

SEQ ID NO: 10781 - protein, 452 aa, Sphingomonas aromaticivorans
EGTVAKNWTADSWRGHEGRHLPTYPDAEKLNEVETTLTSFPPLVFAGEARALKADLAQVAAGKGFLLQGGDCAESFAEFHPNNIRDTFRVLLQMAVVLTFASKQPVVKVGRMAGQFAKPRSSPVEKIGDVELPSYLGDNINGIDFTPESRIPDPERMLRAYSQAAATLNLLRAFAGGGYANLRQVHQWTLDHIGKSPWAAKFSEMADKIGESLDFMEACGVDPSTVPQLQGTSFYTSHEALLLQYEEAMTRQDSLTGEWYDTSAHMLWIGDRTRFEGSAHVEYLRGVGNPIGMKCGPSLTPDALLRMLDTLNPGREAGRITLISRFGHDKVEAGLPPLVRAVTREGHPVVWSCDPMHGNVIKADNGYKTRPFDRILTEVKGFFAVHRAEGTHAGGIHIEMTGRDVTECTGGAVAITQEGLADRYHTHCDPRLNAAQSIELAFLMAEALNQER

SEQ ID NO: 10782 - protein, 359 aa, Sphingomonas aromaticivorans
KAAVLVEPGKPLDIQHLSVSKPGPHEVLIRTAACGLCHSDLHFIEGAYPHPLPAVPGHEAAGIVEAVGSEVRTVKVGDAVVTCLSAFCGHCEFCVTGRMSLCLGGDTRRGAGEAPRLTRTDDGSAVNQMLNLSAFAEQMLVHEHACVAINPEMPLDRAAVIGCAVTTGAGAVFNAAKLTPGETVCVVGCGGVGLATVNAAKIAGAGRIIAVDPMPEKRELAMKLGATDVMDAGPDAAAQIVEMTKGGVHHAIEAVGRPASGDLAVATLRRGGTATILGMMPLAHKVGLSAMDLLSDKKLQGAIMGRNHFPVDLPRLVDFYMRGLLDLDTIIAERIPLEGINDGFEKMKQGHSARSVIVF

SEQ ID NO: 10783 - protein, 409 aa, Sphingomonas aromaticivorans
FEPTERQKYWRDRVRQFVEDNIRPRHGDYKAEAGTADRWKVIQTIEQEKARAKAAGIWNLFMPPRNSGHHHVDETFAFEGPGLTNLEYALCAEEMGRIGWASEVFNCSAPDTGNMEVLHRYGTLEQKERWLRPLMNGEIRSAFLMTEPQVASSDATNIETSIRREGDEYVINGRKWWSSGAGDPRCEIAIVMGKTDFEAKRHQQQSMVLMPLDAPGVNIIRHLPVFGYDDAPHGHMEIELKDVRVPVTNMLLGEGRGFEIAQGRLGPGRIHHCMRTIGVAEEAIAKMARRLQSRVAFGKRVSEQSVWEQRIAQARIDIDMTRLLCLKAADMMDKVGNKAAALEIAMIKVQAPNMALRIIDDAIQAHGGGGVSADFGLAESYAHMRTLRLADGPDEVHARAIARIEFARH

SEQ ID NO: 10784 - protein, 252 aa, Sphingomonas aromaticivorans
FDGKTVVVTGAASGIGRAAALAFAAEGAKVYAADIDEAGLAETAAQSNGAIRTARCDVTRCEDIKALMDRAGTETGGIDTVFNNAGAGGDRAPIDEIEPEGWDRTMDLLLRSVAFGIRYAVPHMKGRHGASFVNTSSVAAVGPGYSPTAYAVAKAGVLHLTKVAAADLAKHQIRVNAVQPGFINTNIFTSSLEMPEELEAQAKGAIAAMSQQAQPVARGGQPEDIAQAVLFLASEAAGFVTGTSLIVDGGIT

SEQ ID NO: 10785 - protein, 321 aa, Sphingomonas aromaticivorans
WPKPYGGAGMSPAEAKVWREECARIGARPPLSSFGIWMLGPALLKFGTEEQKVHYLNQIARGEIRWCQGYSEPGSGSDLVSLQTFGEDKGDHWVVNGQKIWTSYADKADWIFCLVRTDKSNKYQGISFLLFDMTTPGVTTKPIKLISGNSPFCETFFDNVVVPKSQIVGELNRGWDVAKYLLGHEREMISGAGGGDRLNAIGAVVARNGLEDPILRAELAQFDVDALAYACMGEKFLDEAKVGRAHPAQPNMMKYAGTELNKRRHELLMAAGGATALEWESDRTSGGTPARSWLRTKANSIEGGTSEVMLNVISKRILDLP

SEQ ID NO: 10786 - protein, 379 aa, Sphingomonas aromaticivorans
  unsure (1)..(379): unsure at all Xaa locations
GAXSMPLYHTEDQAMLAETVTGFMADEGAIKKQLRHYRDMNCQDGFGHALWKQFAEMGLTGMLASEADGGLAMGHVEAGIVLREIGRNLTPSPFLTTSVMGVTALSGGSDELRGRWLPGVIAGDSVLAVAIDESPKHRPERIACRAEKAGNGFRLQGRKAFVVHGASADAIIVAARTSGSDTDVDGITLFAVPKDAAGIAHENLRLVDSTMASNVTFDNVELDGDCVIGEVDGGRELLNRVLNVGRIGSAAEMTGVGQGAFDITTAYLKTRKQFGKLIGEFQALQHRAAHLYSELEIAEAAVIKAQQLLDGNSEKADLMISVAKAKAGKACNLAVREGVQMHGGVGMTDEFDIGLYMKRDRSLSEFMGDQYYHAERVAQ

SEQ ID NO: 10787 - protein, 245 aa, Sphingomonas aromaticivorans
FSLEGRVAVVTGGSRGIGEMIAEGFIAAGCSRVYITARKAAVVEETAARLGEKCIALPGDISNVAGIEQLAADLAAREDKLDILVNNAGAAWGADFEDFPELGWDKVMDLNVKTPFFLTQKLHGLLKAAASKEQPAKVINIASVDGLRLNPWETYSYQASKAAVVHLTKRMAARLVKDQIIASCICPGAFPSEMNKAAAKNPEASSRGIPLKRIGTIEDMAGGAIFLASRAGDYVVGTPLPIDGG

SEQ ID NO: 10788 - protein, 193 aa, Sphingomonas aromaticivorans
SITRKTEETDIAVSVNLDGTGTYKVDTGIGFLDHMIEQFSRHSLIDIECRVKGDLHVDQHHTTEDSAIALGQAISQALGDKKGITRYGHTYSPMDEALCRVALDISGRPVLVWKAAFTQPRLGEMDTELFEHWFQSISQAAGITLHIESLYGSNNHHIIEGIYKGFARAMRAAIAIDPRKADAVPSTKGILGG

SEQ ID NO: 10789 - protein, 264 aa, Sphingomonas aromaticivorans
  unsure (1)..(264): unsure at all Xaa locations
VRVRVIPCLDVADGRVVKGVNFVDLRDAGDPVEQARAYDKAGADELCFLDISASHEGRGTLLDVVARTAEVCFMPLTVGGGVRAVEDARALLLAGADKVAVNSAAVARPELVRDIAEKFGAQCVVGSVDARRVSEPGAPGRWEIFTHGGRKATGIDALAHAVNLATLGAGELLVTSMDGDGTQKGYDLELTRAIADAVPVPVIASGGVGSLEHLVEGVTKGHASAVLAASIFHFGTYTIAEAHAALRAAGLPARGXNAPCPAMG

SEQ ID NO: 10790 - protein, 100 aa, Sphingomonas aromaticivorans
ILARLEATIAERRLGDPSASYVAKLNAKGLAKIAQKVGEEGTETVIAALAGDRKELVGEAADLIFHLMVLLSAKDVPFAEVLAELARREGTSGIAEKASR

SEQ ID NO: 10791 - protein, 278 aa, Sphingomonas aromaticivorans
TDHTARARTWFESLRDRICAEFEAIEREAGSDARFAYTPWNREHEGETVENGGGGVQGLMKGRVFEKVGVNVSTVQGEFSKEFAGTINGASADAPGFTATGISLVAHMANPHVPAVHMNTRFLTTSKAWFGGGGDLNPPIPYEEDTVEFHAEYKAACDRHDPEYYPRFKKWADDYFWIPHRKVHRGVGGIFYDHLECADDAAFEANFAFTRDVGEAFINVFPRLVRRRMGMDFTPAEKLTQLEYRGRYAEFNLVWDRGTLFGLKTGGNIDAILMSLPP

SEQ ID NO: 10792 - protein, 543 aa, Sphingomonas aromaticivorans
MYQYDSYDQAMVDARVAEFRDQVQRRLAGDITEDQFKPLRLKNGLYLQLHAYMLRVAVPYGTLNSRQMRMLGDIADKYDRGYGHFTTRQNIQYNWIKLEDAPDILADLASVEMHAIQTSGNCIRNTTADQFAGAAADELVDPRPYAELLRQWSTFHPEFDYLPRKFKIAIIGSETDRAAMKLHDIGIQLVKNDAGEIGCRFYVGGGMGRTPMIAPVIGDFVPPLQMISYAEACLRVYNRYGRRDNKYKARIKILVHEIGADEYRRQVEEEFKHILTLGLEPPAAELERIKGFFEQPGFDANASDELDLSDPDFALWVDQNVHAHKAKGYAIVNISLKPVGGIPGDATADQIRLMADLALEHSFDELRVTHAQNIVLPHVKKADLHAIWQKLDAAGLANANLDLIGDIIACPGLDYCSLANARSIPVAQKISERFADLGRQRELGELKLKISGCINACGHHHAGHIGILGVDRKGVENYQLLLGGCEGADTSLGTITGPGFNEDGIVDAVEKATDVYLAQRAEGERFVDTYRRIGMAPFKEAIY

SEQ ID NO: 10793 - protein, 202 aa, Sphingomonas aromaticivorans
GWRATSRVVSSFGAESAVLLHLIAEVDPSVPVLFLETGKHFRETVAYRDELIGFLGMTNLQIIEPDAAVIAKKDENGLRWSWDPDGCCEIRKVEPLARALLHFDASITGRKGFQSKTRAGLPRFEIDRSDAQGRLKINPLASWDKTMLEAYFAEHGLPPHPLVAQGYPSIGCAPCTSKVAPGEDPRSGRWKGWDKTECGIHS

SEQ ID NO: 10794 - protein, 689 aa, Sphingomonas aromaticivorans
LAVPGMHCAGCMGKVERALGAVEGVASARTNLTARTVEVIHAPAIETPALVAALAATGFEAQPREIEAEPVSAVKPLLAPLGVAAFACMNVMLMSVSVWSGADGTTRSLFHWVSALIGVPAIVYAGRPFFASAWKVLRHGRTNMDVPISIGVTIATGLSFYETLTGGAEAWFDGVLMLLMFLLAGRVLDAMMRDRARSGVDALLRQVATGTMVVDADGSTRWVEAKSLEPGMIMRVASGERLAADGAIVRGTSRFDQSLLTGESEPVNAGPGSIVHAGTLNVELPVDVRVTAIGRDTALSEIARLMEAAGQSRSKYVRIADRASRLYAPAVHTLAALTFVGWMIAGAGVYKSLVIAIAVLIITCPCALGLAVPVAQVVAAGALMKRGVLVKDGSALERMAEVDRLLLDKTGTLTLGRPVPDEAALDALSGAEASVALALASHSRHPLSLGLVQALGARGVLAAALEDVVEEPGKGVSGKWNGLAVSLGRPQSAQGMATALHVEGGPVRVIAFADRLRPDAEAALGQLSSMGVPASILSGDSIPAVAAVSRATGLTAQAAASPMEKQEAIERLQAAGRTVLMAGDGLNDGPALAAANASIAPGSASDVGRQAADMVFTGDSLLAIPRAVRVARATMRVVRQNFVLAIGYNALAVPLAILGHVTPLIAAIAMSTSSLVVVANSLRLAGEAK

SEQ ID NO: 10795 - protein, 521 aa, Sphingomonas aromaticivorans
LAILTMTFANLPQPLAAALEGHGYTALTPVQSAVTEAEAHGRDLVVSAQTGSGKTVAFGLAMAGELLGDEATLPFATAPLALVVAPTRELALQVSRELTWLYAPTQARIATCVGGMDPSRERRALSHGAHIVVGTPGRLRDHLERGALDLSALRCVVLDEADEMLDMGFREDLEELLDATPEGRRTLLFSATMPKPIEALARRYQRDALRISTVGEARGHGDIAYRAVAVAPAEIEAAVVNLLRFHEAETAMLFCATRDNVRRLHATLVERGFTAVALSGEHSQSERNNALQALRDRRARVCVATDVAARGIDLPSLSLVVHVEIPRDAETLQHRSGRTGRAGKKGTAVLIVPFPRRRRVEMMLRGARINADWVDVPTPEAIRAQDRERLLETILAPVETDEADMEIARTLLEQRTAEELAAALVRAHRAALPQPEELLSGTDEGRKQATHRAGFEDVVWFRMDVGRRQNADPRWILPTLCRRGHASRQEIGAIRIAPNDTWFQVPRAIADRFADAVRRTA

SEQ ID NO: 10796 - protein, 263 aa, Sphingomonas aromaticivorans
VIGDPIAQSKSPVIHGFWLEALGLEGDYRRAHVRAGELADYLAARRADTDWRGCNVTMPHKQAVIPLLDRLDPLAARIGAVNTIVPEDGALVGYNTDAPGFLEPLRPLLDQVHYFRMARVLGTGGAARAIIAALADEHMVIVLAGRNVEKARALLDELHPEGEHHVAPLEHFSDETDFVFDDREGCLDLVVNASSLGMTGQPPLAFDMTHAPPGSVFYDIVTSPLETDFLKTAKAAGFRTVDGLSMLIGQADHAFRRFFGAVP

SEQ ID NO: 10797 - protein, 476 aa, Sphingomonas aromaticivorans
METPYDLAVIGGGVNGAAIARDACGRGLSVLLLERGDLAQGTSSASTKLIHGGLRYLEHREFALVAEALHERETLWRQAPHIIWPMRFVLPIVPEGRPWWMLRAGLWLYDRIGGRKALPPASRVRLDGRMGLQPEIRRGYEYSDCWVDDARLVVLLARDAADRGAEVRTRCPVTALRREGHLWRIEAGGDVFHAAMTVNAAGPQVGEIMDRAHAPRPALLRRVRGSHIVVPRLHDDPRALFLQLADGRIYFAIPWQYAFTLIGTTDSEEGADADPPHATEEEIAYLLDAANHYFRRSLRREDVVWTYAGVRLLADDGSGRPEAATRGYRLEVDRGRDRHSAPMLSVLGGKITTHRTLAEAALERLGVTDNAGWTASAPLPGGDFTPDGLDEADNLAPVEQEIAAQAQQLSRPTIHRLARAYGTEALGFVRGDMGRHIGQGFTEAELDHLTGREWAQTAEDVLWRRSKLGMWFSAEE

SEQ ID NO: 10798 - protein, 483 aa, Sphingomonas aromaticivorans
VLVIDAGTTSTRALLFGRDGRCHGVMQSEFAQHYPRPGQVEHDADEIWRATLGCMREVVGVVGIERIAAIGVTNQRETVVAWDRTTGQPLARAIVWQDRRTAPMCDRLRSEGAEPLVQSRTGLLLDPYFSGTKMRWMLDNEPAVAGAARDGRLALGTVESWLVWKLTGGARHVTDASNASRTLLLALDGADWDEELLDLFGVPRAVLPEVTDSLGEFGAALPEWLDASVPVRGLAGDQQAATIGQGCLAPGEVKATYGTGAFVLAAMGDAVPRSGHRLLGTVLVQDKGVRSFALEGSVFVAGSLIKWLRDAMGLVGSAAETAALAASVPDSGGVVLVPALSGLGAPHWRPDASAALTGMTFSTTRAHVVRAALEAMAHQTLDLMDAFAADRAPWTSLRIDGGMSANDWVAQDLADILDLPVERPVMVETTALGAGMLAAVASGWFGSLGEAEAMRGSVTRFEPRMAPGVRAARIARWREALAK

SEQ ID NO: 10799 - protein, 735 aa, Sphingomonas aromaticivorans
ILTSLHEVMASRSGAQAKLNQIVEVIGENLDSEVCSIYLLREGMLELFATRGLNQAAVHVTRLAVGEGLVGTIAGNVETLNLAEAAAHPDFAFRPETGEEKFHSFAGVPIVRRERAVGVVAVQHVEPRRYEEVEIEALQTVAMVLSELIANAELIDDEETLGVPAHLTGPDRLKGLTLVKGLASGVAVYHQPRVTIEHVVAEDTEAERQRVYLAFDKMREQIDRMASQAEFGVGGEHEEVLETYRMFAYDEGWSRRINEAIDSGLTAEAAIERVQQRTRMRMRQIDDPLLADRMHDLEDLSNRLLRIVSGQLGTAASMGLKGDAILIARNLGPAELLEYDRRRLKGVILEEGSLTAHVVIVARAMGIPVVGRMRALRGKVREGDQLLLDGDQGVVDVRPAPSLVEAFEARFAKNRERQAHYAAMREVEPVTRDGRRITVLMNAGLRDDTPMLNLTGADGIGLFRTEFQFLVSATLPSRERQTRLYRDVIDAAGDRPVVFRTVDIGGDKVLPYLRHNDGETEENPAMGWRALRVALERDGLLKVQARALLEAAGGRTLNVMFPMVTEPWEFDAAKAVFEGQLAFLRRQKKLLPEAIRYGAMLEVPALAECLDLLAPKLSFLSIGTNDLTQFLFAADRANPKLAERYDWLSPAILRFLRRVVRTLEPFGTDVTVCGEMGGRRLEALALLGLGINRLSITPAAVGPVKELVRKVDLGEIRAAMDGWLADPPHDLRSAI

SEQ ID NO: 10800 - protein, 625 aa, Sphingomonas aromaticivorans
NPWIKSLLVWGGIFLALLLVVSMFGSRVDQTAATIPYSAFRSQVSDGLVRSVEIAPERITGTLKNGGQFATIPVPGDSDLPKLLQDNGVQYAGKAAEQPNMLMYILVNSLPFLLILGVAFFALRQVQKGGGSGAMGFGKSKAKMLTERSGRVTFDDVAGIDEAREELQEIVEFLRDPSRFSKLGGQIPKGALLVGSPGTGKTLLARAIAGEAGVPFFTISGSDFVEMFVGVGASRVRDMFEQAKKNAPCIVFIDEIDAVGRHRGHGLGNSNDEREQTLNQLLVEMDGFEANEGIIIIAATNRPDVLDPALLRPGRFDRQVVVPIPDIEGREKILSVHMKKVPLAPDVNPRTIARGTPGFSGADLANLVNEAALLAARRNKRLVAMQEFEDAKDKVMMGAERRSMVMTDDEKKMTAYHEAGHAIVSVHEPASDPIHKATIIPRGRALGMVMRLPERDSYSYHRDKMHANLSVSMGGRVAEEIIFGHDKVSSGASSDIQYATSLARSMVTKWGMSDKLGPLQYEDQQEGYLGMGGSQRLFVSDETNKLIDMEIRGLVDGAHERARDILKTNEDKLHLLAQALLEYETLTGDEIKELLETGHIDRPQSPSGPSRPVTAQGSAVPRAGK

SEQ ID NO: 10801 - protein, 340 aa, Sphingomonas aromaticivorans
  unsure (1)..(340): unsure at all Xaa locations
LRXLRGRRRGSSHPAMTSYPMTRLRRTRATAWSRAMHREVLVTPADLIWPLFVTEGEGVEDPISSLPGVSRWSVDGIVARAREAVALGIPCLALFPNTQPDRRSEDGREALNPDNLMCRAIRAIKDACGNDIGVLTDVALDPYTSHGQDGLIDGEGYVLNDRTVEVLVGQSLNQAAAGADIIAPSDMMDGRIGAIREALEDAGHVNVQIMSYAAKYASAFYGPFRDAVGSRGLLKGDKKTYQMDPGNAEEALREVEMDLAEGADSVMVKPGLPYLDIACRVKQAFGVPVFAYQVSGEYAMIEAAVAAGAADRDAMVLETLVAFKRAGCSGVLTYHAAHAA

SEQ ID NO: 10802 - protein, 748 aa, Sphingomonas aromaticivorans
QSLEKTLHTALANASERSHEYATLEHLLLALIDDPDAAQVMQACGVDLGDLGDVVRQYLDQEYQSLKTQEKADPQPTAGFQRVIQRAILHVQSSGKDTVTGANVLVALFSERDSYAVYFLQQQDMSRLDAVSFISHGIGKGGRQVDGRTPKGAEEDVPKQQEEKADAKGQKKETALDQFCVNLNEKALAGKVDPLIGRGPEVDRTIQILCRRSKNNPLYVGDPGVGKTAIAEGLARKIVEGEVPEVLSEAVIYSLDMGSLLAGTRYRGDFEERLKQVVSELEKMPHAILFIDEIHTVIGAGATSGGAMDASNLLKPALSGGTIRCIGSTTYKEFRNHFEKDRALLRRFQKIDVNEPTVEDTIKILKGLRTAFEEHHKVKYTPDAIKTAVELSARYINDRKLPDKAIDVIDEVGAMQMLVPPSKRKKTITAREIEQVIATMARIPPKSVSSDDKKVLEHLERDLKRLVFGQDKAIEVLSSAMKLSRAGLRDPDKPIGSFLFSGPTGVGKTEVARSLAQIMGIPLQRFDMSEYMERHSVSRLIGAPPGYVGFDQGGLLTDAIDQQPHCVLLLDEIEKAHPDLFNILLQVMDNGRLTDHHGKTVDFRNVVLIMTTNAGASDMARQGIGFGDVSKADAGDEAVKKMFTPEFRNRLDAIVPFAYLPPEVVSRVVDKFVLQLELQLADQNVHIQFDADARAWLAKKGYDRLYGARPMARVIQEKVKKPLAEELLFGKLANGGEVHVSLKQEEGQ

SEQ ID NO: 10803 - protein, 323 aa, Sphingomonas aromaticivorans
MTAMGWDAPGGPEVLRPENVRVPQPGPGQVLVKVAFAGVNRPDVIQRQGFYPPPPDASPLPGLEIAGQVVAMGQGVTWPFIGTAVCALVAGGGYAEYCIAEADQCLQVPTGLPMAQAAAMPETLFTVWHNVFERGMVAEGETILVHGGTSGIGSMAILLGKLFGVKVIATCGGPEKCEQALAIGAAHAIDYKAADFVEETLRLTEGRGVHMVLDMVAGDYVARNLKCLADDGRHVTIAVQGGVRAEINMAEVMRRRLTLTGSTLRPRSRAFKGALASEIRDTVWPLVVEGALRPIMDQTFPLAEAAAAHVRMEQGAHIGKIVL

SEQ ID NO: 10804 - protein, 681 aa, Sphingomonas aromaticivorans
MPQVHHRTCHICEANCGVLVEVDGRRILSIRGDPDNPLSRGHICPKGTALQDLQEDPDRLRRPLKRVGDTWHEISFEQAFAEIGERTRAILAKDPDSAAVYIGNPNAHSYGNALNADFLGKALRTRNKFSASTVDQMPHQVANLRLWGHASMFPIPDIDRTRTLVILGGNPMASNGSLWTVPDFRARVRDLKARGGELIVIDPRRTETAKIADRHLFIRPAGDVYFLIALLKAVRARSPARVVQDFVTGLDRVDEALQRFDAEACAASCGVPLPEIEALAERFLAGPAALYGRMGVATQAHGTLNAWLISLVNIASGQLDREGGWVFGLPAVDTVNVLPPGSIGKFASRVSGHRSVLGELPAAAMAEEIETPGEGRIRALFVVAGNPVLSTPNGARLDKALECLDLLVSIDIYRNATSRRAHYILPPAGPLERDHYGLFLLPMAARTIAVYSRPTLEQEEGSLHDWEILRGLAHAISGEPVQAPTPREALDGLLRSGPYGLTLEQVEASPSGIDLGPPPTGQLPGRLRTPDKRVTCDVEELVEALGALDLPGQEDPQGGLRLIGRRHLRTNNSWLANSRRLIKGPDRCTVMIHPDDATPRGIADGATVTVRSVAGSIALAAEVTDDMMPGTVSIPHGWGHGLPGVSMENALGRPGVSVNDITLETAMDPLSGNAAFSGVEV

SEQ ID NO: 10805 - protein, 204 aa, Sphingomonas aromaticivorans
MKLYHHPLSGHAHRARLFVSLLGLDAELVEVDLLAGEHKQPAFLALNPLGQVPVLVDDDGTVVSDSNAILVYLARKHDRTDWLPEDPASLAAVQRWLSVAAGELAFGPAAARLVTVFGSRHNPQEVITRAHGLLANLERHLEHRDWLVGAAPTIADVSLYSYLSSAPEGNVDLAAYPNVRALLARIEHLTGFVPFVRTAAGLRA

SEQ ID NO: 10806 - protein, 373 aa, Sphingomonas aromaticivorans
LRQELDAAECASAAKSRYLASVSHEIRSPLNAIYGYAQLVEREGTVDPRDAARVIRRSAEHLTNLVEGLLDIASIEQGVVRIDSTVARLDALVEQVAEMFRPLAVQKGLAFRCDLPARLPEFVRMDERRVRQVLINLVSNAVKFTQAGEVVLAVRWSGEIATFEVRDTGPGISPAHQETVFSPYQTGGVECGGGAGLGLAITRAIVDMLGGDLRLESRLGEGSLFRVVLMMPHVSGMVDCAAPRPRPVGYRGARRSLLLVDDDADHLAVLRCTLESCGFDVSLAPDGAAALALAHARAFDAVVLDIAMPGLSGWEVAERLRAAHGQSFRLVMLSANAEERHGPRGKEPDHDLFLMKPVELSALVDSLGKLLGL

SEQ ID NO: 10807 - protein, 464 aa, Sphingomonas aromaticivorans
FERINPMTGAVASQAEAMKASDIPSIAARAGQAFPAWAAMGPNARRGVLMKAAAALEARADAFVEAMMGEIGATRGWALFNLGLAASMVREAAALTTQISGEVIPSDKPGCISMALREPVGVILGIAPWNAPIILGVRAIAVPLACGNAVILKASETCPRTHALIIEAFAEAGFPEGVVNVVTNAPADAAEVVGALIDAPEVRRINFTGSTNVGRIIAKRAAEHLKPCLLELGGKAPLIVLDDADLDEAVKAAAFGAFMNQGQICMSTERIIVVDAVADAFADKFKAKVASMAVGDPREGTTPLGAVVDAKTVAHCRSLIDDALAKGARLLTGGETTHNVLMPAHVVDGVTQDMKLFRDESFGPVVGVIRARDEAHAIELANDSEYGLSAAVFTRDTARGLRVARQIRSGICHVNGPTVHDEAQMPFGGVGASGYGRFGGKAGIDSFTELRWITMETQPGHYPI

SEQ ID NO: 10808 - protein, 264 aa, Sphingomonas aromaticivorans
TVAFTVEDGIAWVKFNRPEKRNCMSPKLNRRMKAVLEELEFRDDVKVLVLTGEGDAWTAGMDLKEYFRETEAQGLGAVRKSQRESYGWFERLRWYEKPTVAMINGWCFGGGYGPLFGCDIAIASEDAQFGLSEINWGILPGGGASKVAQELMPFRKAMYHAMMGENLTGKQAEEQGLVTEAVPADKLKARVLEICEALKKKDSHALRATKWTMRRMVDMTYDNGLEYQIRAQEALHSFGGAAARKEATRQFLDEKSFKPGLGTF

SEQ ID NO: 10809 - protein, 521 aa, Sphingomonas aromaticivorans
YDALIIGGGHNGLVCAFYLAKAGMKVRVLERRDVVGGAAVTEEFHPGFRNSTASYTVSLLRPKVIADMKLHDYGYRVIERTISNFFPFPDTYLKLGGGPGRTEAEFARFSKKDAESYPRYDAALEKVANVLRDISLQTPPNVGGGIAALKSAATQGWPIAKLDIATQRDLLDIFTKSARDFLDGWFEDDHVKSAFGFDAVVGNFAGVSTPGSAYVLLHHVFGEVNGKLGAWGHSVGGMGAITQAMAKACVDAGVEISLEAPVSRVLVNNGKAAGVKLEGGEELYAPIVAANVGPAMLYRQMVDASDLDEDFRRRMKNYKTGSGTFRMNVALSELPDFKVLPGKQLAEHHTAGIIIAPGMDYMDQAFIDAQQFGWSKKPIVEIKIPSTVDDSLAPPGQHVASLFCQQFAPQLPDGRSWDDCREEVADLIIDTVNDHAPNFKASVIARQIHSPLDLERKFGLIGGDIFHGTMGLDQLWAARPVLGNGDYRSPIKGLYMCGSGTHPGGGVTGAPGHNAAHEIIR

SEQ ID NO: 10810 - protein, 434 aa, Sphingomonas aromaticivorans
VINPATGEPFCTVPRASAAQADAAIAAAKAAVPGWSAVPWAGRQAKLIELADAIAARKDEIARVLTMEQGKPLAEALGELAWTDGYLRHYATLELPDRVIQDDESGYIAVRHRPLGVVVGIIAWNFPLLVACWKIGPAVLAGNAIVLKPAPTTPVCALILGEICRDVFPAGVVNIITDANDLGPHLTAHPDVAKVGFTGSTATGKRIAASGADTLKRVTLELGGNDPAIVLEDVDVRETAQAIFGNAFLNNGQVCLAVKRAYVHSDIYDAMCGELARLAQAAVVDDGLQQGTQIGPIQNAMQFEKVKGFLDAAREEGTIVAGGEVMERAGYFIRPTIVRDVTDGDRIVDEEQFGPILPLIRFDDVEDVIARANASDYGLGGSVWSKDVARAADIASRIESGQVWVNQHIAIGPHIPMAGFKSSGLGVEQSVEGL

SEQ ID NO: 10811 - protein, 519 aa, Sphingomonas aromaticivorans
LLEKTIGQALRDAAALWGDELALVSRHQQIRWTWAQLDAEVDRIATGLLDRGVAKGDRVGIWAPNCAEWTVLQFATARIGAILVTINPAYRTSEVEYALNKVGCTFLVTAARFKTSDYVAMLRELGPDKLPGVSCMVVLGADRHDGFEPWEALRAEPDAARLAAAEAALNQNDAINIQFTSGTTGFPKGATLTHRNILNNGHFTARTIKLTQRDRICIPVPLYHCFGMVLGNLAALASGAAMVYPGEAYDPQLALAAVAEEGCTALYGVPTMFITILAQPDLDRYDVSTLRTGIMAGSPCPVSTMRQVMDRLNMTEVTIGYGMTETSPLTTQTATDDPLEERVGTVGRVHPHAEAKIVGLDGETLPIGQQGEYCSRGYAVMLGYWDDPEKTAEAIDGEGWMHSGDLATMDEHGYVRITGRIKDMIIRGGENIYPREIEEFLLTHPAVQDAQVFGVSDEKFGEEVCAWVIARSGHALSHDDILAHCKGRIAHYKVPRHVRVVEAFAMTVTGKAQKFEMRK

SEQ ID NO: 10812 - protein, 464 aa, Sphingomonas aromaticivorans
ARRASRMHRIETDSLGEVRVPADAYWGAQTQRSIENFPFGEMERMPIGIIRALALVKRAAAGVNRAHGLDPTLADAIERAAAEVVDGKLDDQFPLVIWQTGSGTQSNMNANEVIAGRANEILTGKRGGKSPVHPNDHVNMGQSSNDTFPTALHVAAVEALNRDLLPALGRLRGALAGAALAWKDIVKIGRTHLQDATPLTLGQEFSGYAEQLRGIEAHLKAAETHLLRLAQGGTAVGTGLNAPEGFGDAMAAEIAALTGRPFVSAPNKFEALASNDALVQFSGTLSTLAVALTKIANDIRLLGSGPRSGLGELELPANEPGSSIMPGKVNPTQAEMLTMVAAQVIGNHQAVTVGGMQGHLELNVFKPMIGAAVLRSVHLLSTGMTSFATRCVEGIEPNRRRIADLVERSLMLVTALAPEIGYDNAAKIAKHAHEHDLSLRQAALALGLVDEATFDRLIRPGDMV

SEQ ID NO: 10813 - protein, 378 aa, Sphingomonas aromaticivorans
ALEIADRVERFVREEVIPYESDPRRDDHGAPLDEMVMEMRGKARAAGVLTPHILSDGRHLNQRETAVVLIRSGLSPLGMLACNTQAPDEGNMYLLGKVGSPELKERFLKPLVSGEARSAFFMTEPAEDGGAGSDPSMMQTTCRRDGNHWVINGRKAFITGAKGAKVGIVMAKDEDGGACMFLVDLPDPAIEIVRVPNTIDSSMPGGHAVIDIKNLRVSSDQMLGEPGEGFKYAQVRLSPARLSHCMRWLGGCMRAQEIATDYACKRMAFGKHLIDHEGVGFMLAENRIDLKQAELMIDWCAGVLDTGSLGTVESSMAKVAVSEALMRVADKCVQVMGGTGVTTDTIVEQMFREVRAFRIYDGPTEVHKWSLAKKIRRE

SEQ ID NO: 10814 - protein, 471 aa, Sphingomonas aromaticivorans
VATGSGAVKGVTAGTVSAFKGIPYAAPPVGENRWRAPQPVATWIGERDASRYGPTAPRPRFPPDAAPITTTPSEDCLYLNVWKPASAKAGAKLPVMVWIHGGGFVNGGSSPASYSGENFARDGVVLVSLNYRLGRFGFFAHPGLAAEGFGGNFGFLDQIAALKWVQANVAAFGGDPANVTVFGESAGGMSMHMLLQSPIARGLFHKAIVESGGGRDRALPMPTIAVAAKAGEAFAPGLDAAGLRALPAEKVTGDLSMMTMGKPDYSGPMVDGRTILGSSVDGIAGGLYARVPVMVGANSADGFPFVTDKDKIFATYGDKADEARKLYDPEGKLTGLVVGTMTSADRTFIEPARAVARALAARGQPAYLYRFAYAHPDMQAAMGGAPHASEIPYVFDTVATRTQWKMVPAEPAVATVTHKLWIEFARTGKPGASWPAATVDDTRVMLIDAKGAAHVEDPYRARLDFVEALVT

SEQ ID NO: 10815 - protein, 257 aa, Sphingomonas aromaticivorans
RVQGKKALVTGAAQGLGAAHAWMLAREGARVLLTDINGEGATATAAAINAELGAGTAFAMRHDVTSADDWDAAIAFAAEKLGGLSVLVNNAGVGVRGNIETCTLEEWHRGFAINVDSVFLGCQKALPLLRDSQPASIVNISSIAGLIASDTMPGYNASKAAVWMLTKSVALYCAKRGWDIRCNSVHPTFVDTPILDGISANANLEKSVVMGKLARQIPLGRVGEPDDIAAGVLYLASDESRFMTGAELKLDGGISAM

SEQ ID NO: 10816 - protein, 368 aa, Sphingomonas aromaticivorans
MKTRAAVAFAPKQPLEIVELDLEGPKAGEVLVEIMATGVCHTDAYTLDGFDSEGIFPSVLGHEGAGIVREVGPGVTSVKPGDHVIPLYTPECRQCKSCLSGKTNLCTAIRATQGQGLMPDGTSRFSYKGQTVFHYMGCSTFSNFTVLPEIAVAKIREDAPFKTSCYIGCGVTTGVGAVINTAKVQVGDNVVVFGLGGIGLNVIQGARLAGAGKIIGVDINPDREEWGRKFGMTDFLNSKGMSREDVVAKVVAMTDGGADYTFDATGNTEVMRTALEACHRGWGTSIIIGVAEAGKEISTRPFQLVTGRNWRGTAFGGAKGRTDVPKIVDMYMTGKIEIDPMITHVMGLEEINTAFDLMHAGKSIRSVV

SEQ ID NO: 10817 - protein, 376 aa, Sphingomonas aromaticivorans
PINRVGVIGAGTMGGGITMNFLTAGIPVTIVEMTQEALDRGVATMARNYENTVKRGKMDAADAQAAMARLTPTLDFGALAEADLVIEAVYESMDVKKDVFGRLDKVAKPGAILASNTSYLDIDEIASVTSRPEAVMGMHFFSPANVMKLLEVVRGKATGKAQLATVMALSVKIGKVPVVSGVCHGFIGNRMLSPRQAQAQALIMEGANYWDVDEALLEFGFPMGPWQMADLAGVDIGWHRDPSRIETLRDALCAVGRWGQKTKKGFYDYDDNRQRTPSDEVKAIIADFAKKAGKPQREIGKDEIRERLLYPMISEGALILEEGISQRASDIDTVWLNGYGWPAWTGGPMFWADHIGLDTVVAGLKKHGLPVAPLLE

SEQ ID NO: 10818 - protein, 488 aa, Sphingomonas aromaticivorans
AARRGAAVALADENRTVGWAEMDALLDRIAVALQREGVEKDEPVAIAAMNSVTTGLAFLGAIRAGAVAAPLTSTAAPDTIVAMLEDSGSRVLLLDKDIAERLEGLDLPAGVKRIALDDSDAGEPFSSWMAEEGAKPEERAVAPGDPFNIIYSSGTTGAPKGIVQSHKMRHEYARRTIVAGYDDDTAAICSTPLYSNTTLVSFLPALTAGGKVVLMRKFDARTFLELSERERVTNAMLVPVQYRRIMELPDFDSFDLSSYRLKSCTSAPFPAWLKADVLKRWPGGLTDGYGMTEGGATTILLAHKFPDKLHTVGQVAPGHVMKIIDEDGNELPQGEVGEIVGHSPIMMNGYHGKPDKTREIEWHDSEGRRYIRHGDIGKFDEDGFLILMDRAKDMIISGGFNIYPSDLEAELTRQGAVKEAAVVGVPSDAWGETPLAVVVLADPAADPAAILAEANSRLGKTQRISAIEVIDELPRSPIGKVLKRELRD

SEQ ID NO: 10819 - protein, 390 aa, Sphingomonas aromaticivorans
MRDAVIVSAARTPIGRAYKGAFNATPGATLGALSLEAAVARAGIDPAEVDDVLWGAALQQGAQAGNIARQVALRAGLPITTSGMSMDRQCSSGLMTIATASKQVIIDRMDVVAAGGQESISLVQTKDMRVAPDKSLMAMHKAIYMPMLQTAEIVGQRYGISREACDEYALQSQQRTAAAQAAGKFDDEIVAVDTTMGVQNKETGEVTFQDVHLTKDEGNRPSTTIENLQALKPVIEGGIVTAGNASQLSDGSAAVVVMEAALAAKKGLAPLGRYVGMAVAGTEPDEMGIGPVFAIPKLLQRFGLKMDDIGLWELNEAFAVQVLYCRDKLGIPNDLLNVNGGSISIGHPYGMTGARCTGHALIEGKRRGAKYVVVTMCVGGGMGAAGLFEV

SEQ ID NO: 10820 - protein, 373 aa, Sphingomonas aromaticivorans
FALTEDQIAIQDMARRFTADAITPFAAQWDEDHTFPRDTIKAAAELGFAAIYVSEESGGIGLGRLEAALIMEAMAYGCPATSAFISIHNMAAWMIDKFGGDEIKSRYLPSLVTMDQIASYCLTEPGSGSDAAALKTTGLRLEGDHYVVNGTKQFISGGGVNDLYVTMVRTGDNGAKGISCLVIEKDMPGVSFGAPERKLGWNASPTAQVIFDNVKVPVANRVGAEGDGFKFAMAGLDGGRLNIGACSLGGAQRCLDEAVAYVKDRSQFGKAIAEFQNTQFQLADMATDLEASRALLYLAAAKVTANAPDKTRFSAMAKKLATDNGSSIVDRALQMFGGYGYLRDYPIERFWRDLRVHRILEGTNEVMRMIVGR

SEQ ID NO: 10821 - protein, 494 aa, Sphingomonas aromaticivorans
IDHFIVGGPGGAPARKSPIFDPNNGGVQAEVALGTAETLERAVQAALKAQPAWAATNPQRRARVMFRFKELVEANMDSLAHMLSSEHGKVIADSRGDIQRGLEVVEFACGIPHVLKGEYTHGAGPGIDVYSTRQPIGIGAGITPFNFPGMIPLWMSAIAIATGNAFIIKPSERDPSVPVRLAELFIEAGLPEGICQVVHGDKEMVDAILDHPAIGAISFVGSSDIAHYVYNRGVAAGKRVQAMGGAKNHGVVMPDADLDQVVNDLCGAAFGSAGERCMALPVVVPVGHDTAERLRAKLIPAIHALKVGISTDPEAHYGPVVTQAHKEKVEGWIDKCIEEGGELVVDGRGFPCRGHENGFFVGPTLIDHVTPDMDSYHNEIFGPVLQIVRAENFEQALELPSKHQYGNGVAIFTRNGHAAREFAARVNVGMVGINVPIPVPVAYHTFGGWKRSAFGDTNQHGMEGVKFWTKVKTVTQRWPDGSPDGGNAFVIPTM

SEQ ID NO: 10822 - protein, 491 aa, Sphingomonas aromaticivorans
GDRVALVAETGPDFAAIFCGAMYAGAWPVPLPLPTSFGGKESYIDQLAVQLSSSDPKMLVYPGEIAEMASAAAARQGCAGLSWDEFHAGAAADGPLPTPDPDAISYLQYSSGSTRFPHGVAVTHRALMANLAGHSHGMKIADPDRAISWLPWYHDMGLVGCFLSPIANGVSVDYLKTEDFARRPLAWLDLISRNTGTTLSYSPTFGYDICARRISSQSHVSDRFDLSRWRVAGNGADMIRPDVMQNFVNAFAEAGFKAEAFLPSYGLAEATLAVTIMPPGEGIRVELVEEERLSGTPRDLSRPARYRAMVNCGVPVRGMEVAIRGENGNEIGHHHIGKVWCRGSSVMHSYFRDPEATDACMVDGWLDTGDMGYVDENGYLFIVGRAKDMIIINGKNHWPQDIEWAVEQLPGFHQGDIAAFSVETENGEEAPAVLVHCRVSDPVERVKLRDQIRDKVRSITGMNCVVELVPPRTLPRTSSGKLSRAKAKKLY

SEQ ID NO: 10823 - protein, 437 aa, Sphingomonas aromaticivorans
QTAEAIRAQHGGSESHFPTVLPDAVVFVRDTKDVVDCVDLCREGGVALVPFGAGTSLEGHTLPLAGGISLDLSRMDTVLAVNEADFDCTVQPGIRREALNAHLRDTGLFFPIDPGANATIGGMAATRASGTNAVRYGTMREAVLGLEVVTPQGKVVTTGRRARKSAAGYDLTRLYIGSEGTLGIITAITLRLHPVPEAVMAATCPFATLEGAVDTVVQAFHAGVPMARIELLDAMQVHAVNLRAGLGLPEAPTLFFEFHGSETGVAEQVEMVRTLAGANGGGDFHWATRTEDRTRLWRARHEAYYAAVGLRPNAIGWTSDVCVPMSRLAQCILETREDLDRASVPATIVGHVGDGNFHAIFSIDPAAPHELDEVAEINRRMVARALAMGGTCTGEHGIGIGKQDMLVDELGEDAVDVMRALKRALDPQNLFNPGKIF

SEQ ID NO: 10824 - protein, 672 aa, Sphingomonas aromaticivorans
FKKILIANRGEIACRVIKTARRMGIQTVAVYSDADARAPFVQMADEAVHIGPAPAAQSYLIADKIIAACKQTGAEAVHPGYGFLSERTSFAEALAAEGIEFIGPPVGAIAAMGDKIESKKLAKEAGVNVVPGFVGEIEDTEHAVRISDEIGYPVMMKASAGGGGKGMRLAYNEKDVREGFEAVKREGLNSFGDDRVFIEKFILNPRHIEIQILGDKHGNILYLNERECSIQRRHQKVVEEAPSPFVTPKMRKAMGEQCVALARAVGYYSAGTVELIVSGADPSGESFYFLEMNTRLQVEHPVTEAITGVDLVEQMIRVAAGEKLALTQDEVKIDGWAIENRVYAEDPYRGFLPSTGRLIRYNPPVAGWTDDGAENGRRGIDGVRVDDGVYEGGEVSMFYDPMIAKLITWGKTRDEAADKQIEALDAFEIEGLGHNIDFVNAIMQHPRFRSGELTTGFIAEEYPEGFTGAATSDELKQTLAALAAFLATARADRARQVDNQLGHDLDPPSEWSVKVGGSTFAVELTEEEISVDGTPVDIALEYTPGDRMVHCEVDDKPLSVKVETTRAGFRLTTRGAIHDVQVLPARIAHLTRHMIEKVPPDLSKFLICPMPGLLVSLNVGEGDTVEAGQPLAVVEAMKMENILRAEKAGKVKSVNAKAGDSLAVDAIILEME

SEQ ID NO: 10825 - protein, 426 aa, Sphingomonas aromaticivorans
DVMTQKLETLTVHAGCEPDPTTKARITPIYQTASYVFDSAEHAANLFALAEFGNIYSRIMNPTNAALEAKIAALEGGVAALGVASGHAAQFIVFHTLMEPGCEIVAAKKLYGGTLNQFAHGFAKFGWKAVFVDADDPAAVAAAITDKTRGVFIESLANPGGVVQDIAAIAEVAHAAGVPLIVDNTMASPALCRPIEHGADIVVHSCTKFLNGHGNSIGGLIVDAGRFDWAASDKFPSLSQPNPSYHGAVLTEALKPVGPIAFIIGCRVLGLRDLGPAMAPMNAFLTLTGMETLALRIERHCANALHLAQWLQNHPKVAWVSYAGLPEDPYHQLAKQYLGGKGGAVFTFGVKGGYEAGVKLVQSVKLFSHLANIGDTRSLIIHPASTTHSQLGEEELVAAGAGPDTVRVSVGIEHIDDIVADLAQAL

SEQ ID NO: 10826 - protein, 390 aa, Sphingomonas aromaticivorans
DIYIVSGARTAIGSFGGGLASLRPAESGAIVIKEAIARAGIAPDKVQNVVIGTVVPTQPKDAYVSRVAAVNAGIPIEAPAMNVNRLCGSGLQAIVSAAQGIALGEQDIAIGGGAESMSNAPHMVLTARNGQKMGDQVLMDAMLGALHDPFEGIHMGVTAENVAERCQITREEQDSLAVESHKRAAAAIAAGYFKEQIVPVEIKTRKGVVVFDTDEHVRADASVEAMAGLKPVFKKDGTVTAGNASGINDGAAAVVLASGKAVEEHGLKPMARILGWGHAGVEPNVMGLGPVKAVPVALQRAGLDLDQIDVIEANEAFAAQACGVAKELGFDPAKTNPNGSGISLGHPIGATGAILTIKTMYELHRTGGRYGLITMCIGGGQGIAMVIERV

SEQ ID NO: 10827 - protein, 403 aa, Sphingomonas aromaticivorans
VAAATPRSPEAVAAAALKSAPVFDGHNDVPEQLRDRRKDVLEGFDFRDTRATGDAATGTPPMMTDIARMRAGRVGAQFWSVYVSANLPEAQAVQATLEQIDVTRRLIAQYPADMQFCTDSRCVDEAWKRGRIASLIGMEGGHSIGGSLGVLRQMHALGARYMTLTHFRNTAWADSATDAPQHDGLTPFGEKVVREMQRLGILVDLAHVSEATMRDVLALGGPPPIVSHSNARAINHHARNVSDETLKAIGAAGGIVMVNFYPPYVLEAARQWSAARDAEVARTKSLNRGDPSAEKAALDAWDKANPMPRGSVQDVADHVDHIARLTGTDHVGLGGDLDGVEATIAGLDDAASYPALFVELARRGWSQGDLEKLANGNMMRVLRVAEAYASQHRADGPLESPVG

SEQ ID NO: 10828 - protein, 466 aa, Sphingomonas aromaticivorans
MIIDGARVSGGGRRTHAVVNPATGETIGELPLAEVADLDRALEVAAKGFRIWRDSTPQQRAAVLQGAARLMLERQEDLARIATMEEGKTLPEARIEVLMNVGLFNFYAGEVFRLYGRTLVRPAGQRSTITHEPVGPVAAFAPWNFPLGNPGRKLGAPIAAGCSVILKAAEETPASALGVLQCLLDAGLPKEVAQAVFGVPDEVSRHLLGSSVIRKLSFTGSTVIGKHLMRLAADNMLRTTMELGGHGPVLVFGDADIDKALDTMAASKYRNAGQVCVSPTRFIVEESVFERFRDGFAERVGRIKVGNGLDQDAQMGPMANARRPEAMDRLIGDAVTRGARLHTGGERVGNAGYFYAPTVLSEVPLDAAIMNEEPFGPVALINPFGGEEAMIAEANRLPYGLAAYAWTDSAARAKRLAREIETGMLGLNSTMIGGADSPFGGVKWSGHGSEDGPEGVMACLVTKAVH

SEQ ID NO: 10829 - protein, 469 aa, Sphingomonas aromaticivorans
FIGGEAVVGRGRSFEVLRPSDGQLLGELRAADEQQLCAAVENAAMAQKASGWGAMEPRGRMKLLRRWADLIEADAETLVPLEAVGSSRTLAEVRAWDLPYTAECIRFFAEFADKHGGEIAATTPDKLGFTLTEPYGVIGAIAPWNLPLVMAAWKLGPALAAGNAVVLKPSELTPFSVVRLAELAVAAGIPAGVFNVVQGGGGDIGDALVRHERIAKVSFTGSTRTGQAIMAACAMTGPKPSTLELGGKSPQIVFADADLAKASALVARAITLNSGQVCVAGSRLLVHEKARDEVVERLTTAFEAHRLGTTWDAATTMGPIISEGQLATIDGIVQRARAAGAEAVTGGARAVSPQSGSYYQPTLLAGMSDDNEAVQGEIFGPVLTVQSFADEDEAFALANGTRYGLAAGVHTTDISRALRAVRALEAGTVWVNRYGRSDDFILPTGGFKQSGVGKDLGREAYLGSCKVKT

SEQ ID NO: 10830 - protein, 464 aa, Sphingomonas aromaticivorans
LIDGAWISGDLPKVEVLDPASGEVVGVVPDCGVAETEAAIAAAEASWAGWRRRTANERAALLEAWHALVLANLDDLARIMTAEQGKPLAESQGEIRYAATFIKWFAEEGRRVGGRNIPSPERDRRIIVMTEPVGVSAAITPWNFPAAMITRKCAPALAAGCPVVIKPSEMTPFTALALVELALRAGFPKGTINLVTGMPQAIGAAITASPVVRKLSFTGSTRVGALLMRQSADTIKRLSLELGGNAPLIVFDDADLDLAVKAAMASKFRNAGQTCVCANRILVHAPVYEEFASRLGAAVSALNSAPGMEAASTVGPLINAAAVEKVSAHVEDALAKGGKVLFSGKGREGGNFLRPLVIGNASSDMRLASEETFGPVAPLFRFETEDEAIALANDTPYGLASYFYTSGLDRAFRVAEALEAGMIALNTGSIAMEMAPFGGIKQSGLGREGGLAGIEEYLETKAFH

SEQ ID NO: 10831 - protein, 352 aa, Sphingomonas aromaticivorans
SYSIAVIPGDGIGKEVMPEGMRVLEKAASIFGFEIEQKWHDFACCDYYARHGKMMPDNWKEEIGRPDAIFFGAVGWPDTVPDHVSLWGSLLQFRREYDQYVNLRPVRLMPGVPCPLAGREPGDIDFWVVRENTEGEYSSVGGIMFPNTDREVVIQETVMTRIGVDRVLRYAFDLAQKRERKHLTSATKSNGIAITMPYWDQRVEAIGAEYPDVSHDKYHIDILTAQFVLNPDRFDVVVGSNLFGDILSDLGPACTGTIGVAPSGNINPEGIHPSLFEPVHGSAPDIAGQGIANPVGQIWSAAMMLEHLGEAEAAAAIMRAVEQVLATPSARTRDLKGAASTDACGKAIAEAL

SEQ ID NO: 10832 - protein, 452 aa, Sphingomonas aromaticivorans
TLTNRSLVDIDRDHLIHSVTSFRGHEQHGAIVLESGDGMWLTDAEGNRILDAFAGLWCVNVGYGQESIVEAAAAQMRKLPYATGYFHFASEPAIRLAGELTAAAPSGLDHVFFTQGGSDAVDSAIRYIVHYWNAAGKPSKKHFIALEWGYHGSSSLGAGLTALGNFHRNFDLPRPWQHHIASPYPYRHPQGDDDAAVIASTVAALEAKVAELGADNVAAFCCEPIQGSGGVIVPPRGWLKALREACTRLGILMLVDEVITGFGRTGPLFACEEEGVSPDFMTTAKGLTAGYIPMGAMFMADHVYQTIADAAPAALPIGHGQTYSGHPVAAAVGLEVLRLYREGGLLENGRKTGERFAWHMERIRAHPLVGDVRYRGLLGAIELTPDKATKAIFDASLDIGGRLSKLTYANGVIVRCFGNAVLGFAPALCCTLEEMDMIFERVERSLDQLLDQ

SEQ ID NO: 10833 - protein, 415 aa, Sphingomonas aromaticivorans
RAFARLVKERRESDDNVARDVQTIVEDVRLRGDEALAEYTARFDGHAPADDDWRISPEACREAFDALKPDLRAALELAAERIREYHKAQLPGDRDYTDATGMRLGARWRPVDGAGLYVPGGRAAYPSSLLMNAIPAKVAGVERLVVVTPTPKGEANPLVLAAAHLAGADEVWRVGGAQAVAALAYGTKRIRPVDVITGPGNAWVAEAKRQLFGVVGIDMVAGPSEILVIADAKNDPQWIAADLLSQAEHDPVAQSILITDDAAFADQVADMVGVEIAMLPTAKVAKASWDAHGVIIVVDSLDEAPALANALAAEHVEIATDDPQALFDRIRHAGSVFLGRMTPEAVGDYVAGPNHVLPTGRRARFSSGLSVLDFMKRTSFIAATDAALAAVGPAAVALAEAEGLAAHARSIELRL

SEQ ID NO: 10834 - protein, 216 aa, Sphingomonas aromaticivorans
LVFALPKGRILDEALPLLEKAGIVPEAEFFDKSSRALSFATNRPDVKIIRVRAFDVATFVAHGAAHAGIVGSDVIDEFDYADLYAPVDLDIGHCRLSVAEPVSMVESGANARESHARVATKYPNLTRRHFEKLGVQAEVVKLNGAMELAPSLGLASRIVDLVSTGRTLKENGLVETSRILPVSARLIVNRAALKTDSARLGALVDAFRAMVAAKDA

SEQ ID NO: 10835 - protein, 713 aa, Sphingomonas aromaticivorans
PAATAPATPMSNRDWWPNRLDLSPLRQHGVESNPMGGKFNYAEEFKTLDLAAVKKDIEALMTTSQDWWPADYGHYGPFFIRMAWHSAGTYRTADGRGGAGGGQQRFEPLNSWPDNVNLDKARRLLWPIKQKYGRKISWADLMVLTGNVALESMGFKTFGFAGGRADDWEADQVFWGPENKWLADQRYHGDRKLQNPLAAVQMGLIYVNPEGPNGNPDPLLAAKDIRETFGRMAMNDEETVALIAGGHTFGKAHGARKPEGCVGVDPAAGAVEDQGLGWNNKCGKGNAEDTVSSGLEGAWTANPIAWTTQYLDNLYAFEWVQTRSPAGAIQWVPKEDATFVPDAHVKDKLHKPIMFTTDLALKTDPAYRKITTKFRQNPDAFADAFARAWFKLTHRDMGPRWRYLGAMVPAEELIWQDPVPKATYAMIDAADVSALKGRILATGLTGPELVRAAWASAASFRGTDMRGGTDGGRIRLAPQKDWAANNPAELARVLKALEGVATEFNRAAKDGKKVSVANLVVLGGNAAIEQAAAKAGVTVEVPFTPGRTDASQAQTDVASFEFLKPAADGFRNYYDASANRLSPSEMLVERANLLTLSVPEMTVLVGGLRALDANAGGARHGVFTDRPGTLSNDFFVNLLGMETKWQKAATDGVYEGLDRKTGKTRWTATPVDLVFGSNSELRAVSEVYGSADANAKFVNDFVAAWTKVMNLGR

SEQ ID NO: 10836 - protein, 511 aa, Sphingomonas aromaticivorans
LFANLGTAPLVEHAVRNGEGLLCVDGPLVVETGKHTGRSAKDKFIVRDAETENTVWWGKTNVAMSPEHFAALKADFIKALGEKDRLYVADLFGGSQPEHRVKVRVINELAWHNLFIRTLLVRPTTDELASFVPEYTIIDLPSFRADPARHGSRSETVIAVNFTEKLILIGGTAYAGEMKKSVFGILNYLLPVKGVMPMHCSANVGPDGKTAVFFGLSGTGKTTLSADASRTLIGDDEHGWSDTAVFNFEGGCYAKMIRLSAEAEPEIFATTKRFGTVLENVVIDPVTRTIDLDDNSLAENSRGSYPIDFIPNASEENLGPVPANLIFLTADAYGVLPPIARLTPDQAMYHFLSGYTARVAGTEIGVTEPEATFSTCFGAPFMPRHPSVYGNLLKERIAKGGVKCWLVNTGWSGGKATQEGIKRMPIKATRALLNAALDGSLNSATFTKDPNFGFEVPVEVPGVDTKLLDPRGAWADGEEYDKTAQELVRKFVDNFQQFADHVDQSVRDAAP

SEQ ID NO: 10837 - protein, 239 aa, Sphingomonas aromaticivorans
FRDRCVAILGGNAGIGLAAARLFAAEGAKLAITGRNAETLRAVAEELDALCIRSDMGDLNDTERALEEIEDALGGIDVLFVNAGVGGFAMVPDVTPEFWDQIHSVNLRGAFFAIQRALPLMRDGGSIVITGSIGSMAAVPGNVAYAAAKAGLRAMARIVGKELLPRRIRVNMVSPGPTDTEIFKRDASAEEIQGMKDMLSSVVPIGRMGTSEEVARAVLFLASAEASFINGVDLCVDGG

SEQ ID NO: 10838 - protein, 706 aa, Sphingomonas aromaticivorans
  unsure (1)..(706): unsure at all Xaa locations
PYRMPSPWDLLXCASFSPPCSLASPPAPSAAATVLTEGAGREWPGPGGDAGKTHHSRLTAINAENVGRLGLAWQVELGTLRGQEATPVVVDGVLYTSGTTGRAYAFDAATGKELWRFEPEVDMQVNRTVCCDMVNRGVAVGRGKVFVASLDGWMYALDARTGAVVWKSDFIENRAKGDNSTGAPEIAGDVVVIGMGGAEYDVRGYVTALDLDTGKLRWRWHVVPRDPKLGPQETPELEAALKTWDPNSRWDIGGGGSPWDAINYDPETGLVLVGTGNGGPYATSKRSPAGGDNLYLASLVALDPKTGRMKWHYQETPGDNWDFTATQPMIFTRMKIDGEDRPVVLHAPKNGYLYILDRRDGKLLRANPIVRTNWAKGIDPGTGRPILDPAAADYTTGPKIVFPATTGARNWHPASYDPATGLYIGAVLDMGNLIFMTPGAKPLKARGLNNDAALIFTPDVKEALAAFPPEFGDAVRKLPAYQEALKQPATAQIRAIDPLTGKTVWAADTAGWQDRGGVLTTSSGLTIHGGVTGKLFVRDTKTGKLLKEIDTGTPIMAAPMTYEVGGVQYIAVMAGWGGGGYPFVPRYSAAYTRGNMNRLLVFKVGGGKVPLPDLLPPLEVAPEPPAQAAGVTAATIARGQGLFFGNCAICHANQPRSITPDLRRMQPATHEMFREIVLEGLLTPNGMPRWNDILSTDDADAIHAYL

SEQ ID NO: 10839 - protein, 516 aa, Sphingomonas aromaticivorans
YFDRGHDRDPQRLAIVDTETGLKLTFAETKALSERIAAALQKGGFENQDLLGLYGPNDGMLLVVLLAMWRANGKWIPVNTRNAIDANAAYINYVRLKWLVYHSSKADEVAELKALCPTLQHFVCLDKRMGDDPSLEEFMAGVSEADFVEPEIDAFGNLMDMVGIFPTGGTTGPSKGANVTNLGWGTMIETAADGMGGRTDSPVALVSAPITHAAGPIALSTLSLGATQVILPGFDAERVLRTIAEYKVTHMYLPPTALYQLLASPELGDHDYSSLRIFILVGSPCSPEKLRQAVEVFGPAMCQSYGQVECPMIVAWFPPEDVARFATSAPEKLAACGKPTRSIKVKLLDDDGNEVPLGEAGEICVRGALVTHSYFEKPEETAEIRKFGWHHTGDVGKFDKDGYLYIVDRKKDMVVSGGFNVFTAEVEAAVTELAAVKEACVFGIPHEKWGEQVHAVVVADGITEAEIIAYAKERLGGVKAPKSVTFIDSIPRTAAGKMDKKALRKPWWGNADRMVN

SEQ ID NO: 10840 - protein, 717 aa, Sphingomonas aromaticivorans
  unsure (1)..(717): unsure at all Xaa locations
RELDMRLKVLGLMAALLPLAACNIKSEGGGDAVANAGVTDALIAQAPEGEWLSYGRDYGEQRFSPLTQINDGNVGQLGLAWFHDLETARGQEATPLMHDGTLYISTAWSMVKAFDAKTGALKWSYDPEVPRETLVRACCDAVNRGVALYGDKVFVGTLDGRLVALDQKTGKVVWSKVVVPNQEDYTITGAPRVVKGKVLIGSGGSEYKARGYIAAYDVNTGNEVWKFHTVPGNPADGFENKAMENAARTWAGEWWKLGGGGTVWDSITYDPATNLVLFGTGNAEPWNPAAAGREGDSLYTSSIVAVNADTGDYVWHFQETPEDRWDFDSAQQITLADLTIDGQRRHVILHAPKNGHVYVLDARTGQFLSATPFVMVNWATGIDPKTGKATVNPEARYEKTGKPFVSLPGAVGAHSWQPQSFSPKTGLLYLPVNNAAFPYAAAKDWKATDIGFQTGLDGYVTSMPADAKVQGAAMKATTGTLVAWDPVAKKAAWKVELPSPSNGGILSTAGNLVFQGTAGGDFVAYNADKGKQLWSFPAQSGILAAPMTYAIDGEQYVAVMVGWGGVWDVATGVLAHKAKKQRNISRLVVFKLGGKATLPAAPPMAKMVLDPPPFTGTPEQAKAGGELYGRYCNVCHGDAAVAGGVNPDLRHSAALNAPEAIRSVVIEGALQHNGMVSFKSALKPEDADNIRHYLIKRANEDKALEAKGGXAISLCPE

SEQ ID NO: 10841 - protein, 472 aa, Sphingomonas aromaticivorans
FINNEWVDSSHDAVIEVEDPSNGRIVGHVVDASDKDVDRAVAAARAAFDDGRWSNLPPMVRDRTMNRLADLLEANADLFAELEAIDNGKPKGMAGAVDIPGAISQLRFMAGWASKVAGETTQPYTMPNGTVFSYTVKEPVGVCAQIVPWNFPLLMASLKIAPALAAGCTLVLKPAEQTSLTALKLADLVVEAGFPAGVINIITGNGHTAGDRMVKHPDVDKVAFTGSTEIGKLINRNATTTLKRVTLELGGKSPVVVMPDVDVAQTAPGVAGAIFFNAGQVCVAGSRLYAHRSVFDSVLEGMTQTAPFWAPRPSLDPEAHMGPLVSKEQHDRVMGYIEAGKRDGASVVMGGDCPSADGGYYVNPTILADVNPQMSVVREEIFGPVVVAQRFDDLDEVAKMANDTCFGLGAGVWTRDVAVMHKLASKIKSGTVWGNCHALIDTALPFGGYKESGLGREQGRAGIDAYLETKTV

SEQ ID NO: 10842 - protein, 242 aa, Sphingomonas aromaticivorans
VTDLSGKHVVITGASTGIGRATATRCVAAGARVTLIARRADLLEQAARELGGSTAFAAADVADKAALKAALDHAVAANGPIDGLFLNAGIGGMFAPVEDYGDEAFDAVLAVNLKSVFWAIQHALPAMKERGQGAILVTGSLASERGLPMNAGYVASKHAVLGLSRAVANEAAEAGVRCNCILPGLIETPMLDGLPPEAASQMARAVPQGRTGSSDEVAQVAAFLLSDAASHVTAQALAVDGG

SEQ ID NO: 10843 - protein, 377 aa, Sphingomonas aromaticivorans
RTAYNEDHEAFRQTVRRFLQEEIAPNAEKWGDDGIVPKSIWPKAGELGMLCPTVPEEYGGLGLDFGYNAIVDEESSYYGRVATGFSLQSDIVANYLVSYGSEEQKKKWLPKMVSGEVITAIAMTEPGTGSDLQGMRTTAKKDGNHYVINGSKTYITNGQNADLILVCCKTDTEIQPAWKGVSIVLVEADREGFKRGRNLDKIGQDEADTSELFFEDVRVPITNCLGEEGKGFIYLMSELPQERLSIAVGAQASAQKAFDDTVEFTRERKAFGKPILDFQNTRFTLADIKAKLQVGWAHLDWALSRHLRKELTPEEGAAAKLWHTELQWEVMDKCLQLHGGAGYMNEYAIARAWRGARVTRIFGGTNEIMKELIGRKL

SEQ ID NO: 10844 - protein, 323 aa, Sphingomonas aromaticivorans
YDVIAIGNAIVDVMAPCEDADIARLGLAKGGMTLVDTARAKELYDAMGPAREISGGSAANTLAGLAALGANCAFIGQVADDQLGEVFAHDIRAGGIAFDTPTRADEPPTARCLIFVTPDGQRTMNTFLGASQFLPAEALDDATIAAAQVLYLEGYLWDPEEPRKAMRRAIAAARNAGRKVAFTLSDAFVISRHGDDFRALIDAGQIDILFANEHELAALTGIEDFHVGIEQLAAKVPTVVVTRSENGAHAISQGERAHVPAEPIAKVVDTTGAGDLFAAGFLYGYVRGRPLAESLTLGAICAAEIISHYGARPEADLKDLVAQ

SEQ ID NO: 10845 - protein, 391 aa, Sphingomonas aromaticivorans
YRERRARLMSVLKDGVAVIHGAPRDQTGGPVSPPFHQSGDFAWLTGIADEPGAVLVLAPDERTFREFLLLPSRDIETERWDVERLPLGSLIEARTGMQRVRRTGSLDALVTQIAARSRTLHFMGPSSAPRRRSRPRWTSTAASWPGCPAARLKDQSALLPSLRTVKEPRELDLMRKALAATQAGHLAAMKAVRPGMTERQLTAVLEDGFRQGGGEGLSYDSIVATGRNAASLHYAHGNATIGSQDLVLIDAAASVGGYACDITRTFPASGRFTAAQRADYELVLAAQDAAARLLKPGVIHEDMTEAANAVFRKAGRIDEFTHGLGHFVGLDVHDAGDYAKPIPAGAVLTIEPGLYNQQMNQGIRIEDLYLVTANGCERLSTGIPRTVQEIE

SEQ ID NO: 10846 - protein, 251 aa, Sphingomonas aromaticivorans
LKVASFNINGIKARLPRLLEWLEETRPSVACLQEIKTQDEGFPAEEFEKIGYRAIWHGQKGFNGVAILADGEQPVEVQRGLAGDPEDEHSRYLEADVFGLRVVCIYLPNGNPQPGPKFDYKLRWMERLRARMADIASEEVPALVIGDYNVIPEDKDTFSVKAMASDALMQPESRDAYRRLLNDGWTDAIDLFNPQGGVWTFWDYQAGAWQRDHGFRIDHALLSPELADRLVAAGVDKDYRGREKASDHAPV

SEQ ID NO: 10847 - protein, 179 aa, Sphingomonas aromaticivorans
APGRKVAIFAGGCFWGVEGVFSHVKGVTSVVSGYHGGEKKTASYDVVGTGRTGHAEAVRVTYDPAKVRYDQLLRIFFAVVTDPTQLNYQGPDDGTQYRNALVPMDKEQARVAAGYLAQLKRLDLWKRPIVTAVEPYKTFYPAEGYHQDFMANNPDHGYIRRWDAPKVQALKRMFPDLYK

SEQ ID NO: 10848 - protein, 629 aa, Sphingomonas aromaticivorans
MSQEPATPLLDTVKTPDDLRKLAPTQLRQLADELRVEMISAVGQTGGHLGSGLGVVELTVAIHYVFNTPEDRLVWDVGHQAYPHKILTGRRDRIRTLRQAGGLSGFTKRSESEYDPFGTAHSSTSISAALGFAIANKLSGRLGKGIAVIGDGAMSAGMAYEAMNNAEAAGNRLIVILNDNDMSIAPPVGGLSAYLARLVSSGPFLGLRDIARRLSRKLPRPLHEAARKTDEFARGMAMGGTLFEELGFYYVGPIDGHNIDQLIPVLENVRDAAEGPCLIHVVTQKGKGYAPAEAAADKYHGVQKFDVITGEQVKAKAAAPAYQNVFGETLAKLADADPTICAITAAMPSGTGVDKFAKAHPDRTFDVGIAEQHAVTFAAGLAAEGMRPFCAIYSTFLQRAFDQVVHDVAIQNLPVRFAIDRAGLVGADGATHAGSFDVTYLATLPNLVVMAAADEAELVHMTYTAALHDSGPIAFRYPRGNGVGVPLPEVPERLEIGKGRIIRQGSKVALLSLGTRLAEALKAADQLDARGLSTTVADLRFAKPLDVALIRQLMTTHDVIVTVEEGSIGGLGAHVLTMASDEGLVDGGLKIRTMRLPDLFQDHDAPEKQYDEAGLNAPHIVDTVLKALR

SEQ ID NO: 10849 - protein, 601 aa, Sphingomonas aromaticivorans
LSDFAAYPNLVAMFLDRAGTRGDSPFLWAKHDGQWRPISWAETVRQVCLLAEALRGLGLNPGDRVALVSENRPEWCVADLAIMAAGLVTVPTYITNTERDHLHILENSGARAVIVSTAKLSQPLLPAALSAPCVEHVIGMEPLRQMQAGKLSFHDWDTMMTGDAAAARRAVDERLRTVDRADLACIIYTSGTGGSPRGVRLHHGSILQNVEGAAHILAEDFGWDEEVFLSFLPLSHAYEHTGGQFLPIGMGAQIFYSEGLEKLASNIEEVRPTIMVVVPRLFEVLRTRIMKQVEKQGRVANYLMDRALSIGGRKAAGKGRLIDAPMNLVLDRTLRPKIRARFGGRMKAMVSGGAPLNPDVGVFFQSMGLTMLQGYGQTEAGPVISCNRPRVGLKMDTVGPPMKGVEVKIAEDGEILVRGELVMHGYWQNEAETARAVPQNGPNAGWLHTGDIGHLDKKGRIVITDRKKDMIVNDKGDNVSPQKIEGMLTLQPEIAQAMVSGDKRPYIVGLIVPDPEWALDWSRAQGEHFDFKKLQDLPAFRNAIRAAVDRVNKDLSVIEKVRQFTFTDEAFSIDNGEMTPSLKIRRHKIRERYGARIDGLY

SEQ ID NO: 10850 - protein, 335 aa, Sphingomonas aromaticivorans
  unsure (1)..(335): unsure at all Xaa locations
EPAHRLTIKALGLAQGGTTLAPTPSLAQRIAGLAFPNPVGMAPGFDKNAEVPDAMLGLGFGFVEVGTVTPRPQEGNPKPRLFRLVEDRAVINRMGFNNEGAQAVTNRLVRRRETGKHGLPGIVGVNIGANKDSADRIADYALMTRLMAPLASYLTVNISSPNTPGLRALQDEGALAALLDAVIEARGNMTTPVFLKLAPDLEPADIDSICRIAIEKQLAALIISNTTITRPVLRSAHAGEAGGLSGAPLRELALQRLRDFRKASGGAIPLVGVGGIATVDDAWERIRAGASLIQIYSAMVYEGPGLARRLVAGLERKVREAGLTSIAEAVGSEXR

SEQ ID NO: 10851 - protein, 264 aa, Sphingomonas aromaticivorans
  unsure (1)..(264): unsure at all Xaa locations
MNDTEQHLKARERWPSVLWLIRHGQSAGNVARDMAMAAGDLRIALDHRDVDVPLSGLGREQARALGHWFASGEEGGRPEIVLASPYARAVQTAELFREAGGCSPALRICVDERLREKEFGILDGLTTLGIREFQPEQADFRKVLGKFYHRPPGGESWVDVIFRLRALLDTVSLHYAGKRVMIVAHQVVVLCLRYIIEHMTEADILAIDREGDIANCAITQYRLERGGPGDGELVLERFNVVAPMIREGTPATREPDQMVAARGX

SEQ ID NO: 10852 - protein, 281 aa, Sphingomonas aromaticivorans
KPIRKAVFPVAGLGTRFLPATKAIPKEMLPIIDRPLIQYAVDEAREAGIEQLIFVTGRGKTAIVEHFDTAYELEHTMRDRGKVLDILAPTRIQPGNLVTVRQQVPMGLGHAIWCARAVVGDEPFAIFLPDEMMIGTPGCMKQMVDAYEDVGGNLISVLEVPAAEVSSYGVIAPGARVSDTLTEVKGLVEKPKREDAPSNLIISGRYILQPEVMRTLECQESGAGGEVQLTDAMARMIGRQPFHAVTFAGRRYDCGSKAGFVEATLALALEREDMAEDVRAI

SEQ ID NO: 10853 - protein, 427 aa, Sphingomonas aromaticivorans
MDKIIIRGGKRLSGAVPVSGAKNSALTLLPCALLTDEPVTLRNLPRLADIDGFQHLMNQFGVSTSIAGARPEDFGRVMTLQATRLTSTVAPYDLVRKMRASILVLGPMLARAGEATVSLPGGCAIGNRPIDLHLKALEALGAQIELAAGYVRAIAPDGGLPGGRYSFPVVSVGATENALMAAVLAKGKSTLHNAAREPEIVDLCNLLVAMGAQIEGIGTSDLTIHGVDRLHGATYMVMPDRIEAGSYACAAAITGGEVMLNGARIEDMEATVQALRDAGVHVEPRKGGIYVAADGPLKPVTISTAPYPGFATDMQAQLMAMLCLAHGSSVLTETIFENRYMHVPELNRMGARIETKGRTAVVHGVEKLTGAEVMATDLRASMSLVIAGLAAEGETQVHRLYHLDRGYERLEEKLSLLGAEIERVGGD

SEQ ID NO: 10854 - protein, 845 aa, Sphingomonas aromaticivorans
LPRVAHPSHYAISITPDATNLTFTGTSSVDLEVTEASPVLTLHALDLKIASATLTPAGGAAMPVTVTMDAASQTARFAAAQPLAPGKYRLDTTYSGVINTQANGLFALDYPDKVTGKDVRGLFTQFEAPDARRFAPMFDEPIYKATFDLSAVVPSNRMAISNMPTIKEEDLGKGLKRVTFGTSPKMSSYLLFFALGDFERMAKEAAPGVQAGIVAPRGSGEQPRFALDELAPLIPYYSEYFGQPYPLPKLDNVAAPGQSQFFSAMENWGAILTFERILLNDPAITSASARQNIVTTQAHEVAHQWFGNLVTMAWWEDLWLNEALPAGWKPRRPPISTPDWFPLLGRVEGREAAMGLDGFKTTHPIVQEIKTVDETNQAFDAITYQKGEAVISMLESFAGETVWRDGLRAYMRDHKFANTRSRDLWQAVEKAGAPGLTSVATDFTTKPGIPLVKVTGLTCRKGVSTVMLEQGEFSIDRKDQVAGQPQQWKVPLLVSAGGEATRTILDGGKGTVTVNGCGPVVINAGQLGYYRSLYTPKMLASLKTAMPSLQPVDQMGLIADNLALSTSGYQPYAPALDLLAAVPGNANPVVASSAFGRYVGAWRTLEKDPATQKRLAAKVAATWKPRLMTLGFDPKANESLPDADLRSTLISGFGTMGDPDVVAEARRRFAMLASNPKALDGPQKTTWLNIVARNATKADWDAIRQMAAASNSAVERQFLYTLLGRPADPALAAAARDLALTDVPGKTTSAAMIVAAAGLHPDATYDFAVANRAKIEGLVDAQSRVTFIASLANASNDPAMLAKLEAFKATVPAEASRPVDRVIGGLTERAKARPLFVKGLTDWLN

SEQ ID NO: 10855 - protein, 467 aa, Sphingomonas aromaticivorans
PRGRKVKILATVGPASRDPEMLEKLFRAGADAFRVNMSHGEHAIHAETIANIRALEKKVNRPITILCDLQGPKLRVGKFKDGRAVIRHSGHFTLDRNPEPGDETRVCLPHPELFGVLHKGQRLLIDDGKLRLRVIRADENEILCSAEVGGVISDRKGVNVPDAVVPVPALTDKDRRDLSFAVEQGADWIALSFVQRPEDVAEARRLLGGHGSLMAKIEKPAAISRLEEIVELSDGIMVARGDLGVELNPEEVPPLQKRIVETARRQGKPVVVATQMLESMIEAPTPTRAEVSDVANAVYDGADAVMLSAETAAGAWPEEAVTIMHRIAAQVEADPGYGARVHFLETLPDPTTADALAQAAASITETLPISGIIVFTGSGSTARRVARERPGVPMLVLTPSHKTARKVGLLWGAHAVSTKDIGSFEEMIAKGKRMALRHGFGSAGSKLVALAGVPFGTPGATNLLHVV

SEQ ID NO: 10856 - protein, 149 aa, Sphingomonas aromaticivorans
IRAATPDDLPLVARLVRALAEYEKLAHEVRFDEAVLGEKLFGPRPYAEVAIGEIDGEAQGFALFFHNFSTFEGKPGIYLEDLFVQPAARGSGLGKALLSHLAALATERDCARLEWSVLDWNEPAIGFYKSLGARLMDEWTVMRVDGDAL

SEQ ID NO: 10857 - protein, 884 aa, Sphingomonas aromaticivorans
DTLGTRSTMNVGGKEFAYYSLKKASEKFGDISRLPFSMKVLLENLLRFEDGGFTVSTDDVKAVVDWQKNPAESNNEIQYRPARVLLQDFTGVPCVVDLAAMRDAIATLGGDTSKINPLVPVNLVIDHSVMVDEFGHPKAFEENMEIEYQRNMERYDFLKWGSKSLNNFYAVPPGTGICHQVNLENIAQTVWTSTDQNGATVAYPDTCVGTDSHTTMVNGLGVLGWGVGGIEAEAAMLGQPVSMLIPEVVGFKFTGELKEGVTATDLVLTCTNLLRKHGVVGRFVEYYGPGLAALSLADRATLANMAPEYGATCGFFGIDEKTLDYMRLTGREEAQIALVEAYAKEQGFWIDPSVEPIFSSTLELDLGTVVPSLAGPKRPQDRVSLPEVDDVFNADMANTYKKTPTRVPVEGKDFDIGDGDVTIAAITSCTNTSNPGVLVAAGLVAKKANELGLKPKPWVKTSLAPGSQVVTDYLNKAGLQEHLDAVGFNLVGYGCTTCIGNSGPLAEPISKAINDNGLVAAAVISGNRNFEGRVSPDVRANFLASPPLVVAYALKGTVIEDFTTTPIGKSKDGADVYLKDIWPSNSEVATTMAGCMDRAMFQARYADVYKGDAHWQAINVTGSETYSWRAGSTYVANPPYFEGMSMTPAPVSDIIDAKPLLILGDSITTDHISPAGSIKADSPAGKWLMEHQVAKADFNSYGARRGHHEVMMRGTFANIRIKNEMVPGVEGGFSRYGDEVGSVYDVAMKHKADGTPTVVIAGKEYGTGSSRDWAAKGTNLLGVRAVIVESFERIHRSNLVGMGVLPLQFKEGQNRTSLALSGDDTFTIKGVANLQPRQDVEVEVTRKDGTKLTFTALCRIDTANEVEYFMNGGILHYVLRKLAS

SEQ ID NO: 10858 - protein, 292 aa, Sphingomonas aromaticivorans
GGKLALDGVSFDVPQGQIFGLLGPNGAGKSTLINTLAGLVMKTSGTVEIWGHDIDRDVRNAKASIGIVPQEIVFDPFFTPAEVLENQAGLYGVPKAMRRTMELLRAVHLADKADAYARSLSGGMKRRLLIAKAMVHQPPVLVLDEPTAGVDVELRRQLWELVGELNRDGVTVVLTTHYLEEAEELCDRIAIINHGRLIANKPTRELVDMAREKIVVLTLDRDVDVAPQHPVFLKSVISGERQIEIGYDKDRMNAGEVMSLVQGQGYAIVDVSTREADLEDVFVTLTSQPRED

SEQ ID NO: 10859 - protein, 514 aa, Sphingomonas aromaticivorans
DVLIIGSGAAGLTAALVLAETCRVLVLAKGGLDGGSTNWAQGGIAAVLDAGDTFEDHIRDTMIAGAGLNRRETVEFVVEHAPAAIRRLVDLGVPFNAEAGSLHLTREGGHSHRRIVHVDDATGAAVQKALLKAAREHPNVTLLPGRTCIDLITGRHEAARYSGSGRVWGVYALDEASGTVEAHTARATILATGGAGRVYQFSTAPRGATGDGIAMAWRAGARVSNMEMMQFHPTCLYNLEVKNFLITEAVRGEGGRLINPRTGARFMEFYDPQRLELAPRDVVARAIDAEIKKFGLDFVHLDISHMPADFVRGHFPNIHEKLLGLGIDMTTQPIPVVPAQHYTCGGVLIDLDGRTDLPGLYAAGECTESGLHGANRLASNSLLECFVFGDAAARDILRRWDSFEAPPEVRAWDESRVTDSDEEVVIKQNWTEIRRFMWNYVGIVRTNKRLERAAHRIQMLSDEVNDYYGHFRVTTDLIELRNLLQSAELIVRSARARHESRGLHYTLDYPQTNE

SEQ ID NO: 10860 - protein, 882 aa, Sphingomonas aromaticivorans
HAQPVDAVLRSLQAVPNGLSSEEASRRLEKYGTNRLPEQAARSPFLRFLRHFHNILIYVLLASAVITALMGHLVDTGVILAVVMANAIIGFIQEGRAEGAMAAIRQMLAPRSAVLRNGVRATIDASELVPGDIVLLEPGDRIPADLRLIEARGMKVEEAILTGESVPVDKDCSPVPENASLGDRASMAFSGTLVVSGTARGVVAATGGGTEIGQISGMLSRVETLTTPLVHQMDIFARWLTAFILLVGAAILAFGTFVRQLPFDEMFMIVVGLAVAAIPEGLPAVLTITLAVGVQAMAKRNAIVRRLPAIETLGSVSVICTDKTGTLTRNEMMAAALVSSGREYTIEGAGYAPAGMLQAGGEPVEASGDPVLVEFARAAALCNDASLVRSGDDWRVEGDPMEGALLALAGKISDGSLRAFEHLTRTDVIPFDAAWRYMAVLCHDHQGQAFAYVKGAPEAILTMCGDQQDCNGETEPLDEAYWSRSVETLAGDGQRVLALAVRTMRQDDTVLNTSDLEGKLTLIGLVGLMDPPRAEAIEAVSECHAAGIRVKMITGDHAATARAIAAQIGLRNTGRVLTGADISDLADDQLAEAVMETDIFARTSPADKLRLVTALQSQGLIVAMTGDGVNDAPALKRADAGTAMGIKGSEAAKEASELVLADDNFASIAAAVRQGRTVYDNIKKVISWTLPTSAGEAMTIVVAVLAGLSLPVTAVQILWVNLITATTLGIALAFEPSERKTMLRPPRARDAPLLTGELIWHIVLVSGLFVVAVFGIFAYALDKGYSLALAQTMAVNTLVVLEIFHLFFIRNIYGSSLNWRAVKGTPIVWLAVIVVTAAQFAITFLEPLQRVFGTQSVPIRDGLLIIGVGAAFFGLIEIEKQL

SEQ ID NO: 10861 - protein, 261 aa, Sphingomonas aromaticivorans
GLMQGKRGLIMGLANDKSLAWGIAKKLHEQGAELAFSYQGEALEKRVRPLAESLGSDFLIECDVSDMAALDQTFETLKARWPTIDFIVHAIGYSDKNQLRGKFYDTTLDNFLMTMNISAYSLVAVTKRAAEMMPAGGSILTLTYYGAEKVVPHYNVMGVAKAALEASVKYLANDCGPAGIRVNAISAGPIKTLAASGIGDFRYILKWNELNSPLRRNVTIEDVGGAGLYFLSDLSSGVTGETHHVDAGYHTVGMKQEDAPD

SEQ ID NO: 10862 - protein, 547 aa, Sphingomonas aromaticivorans
MAAKDVKFGRDARERILRGVDILADAVKVTLGPKGRNVVIDKELRRPPHHQGRCFGRQGNRAQGQVREHGRPMLREVASKANDAAGDGTTTATVLAQAIVREGMTAVAAGMNPMDLKRGIDIAVGKVVENLKARSTPVAGSSEIAQVGIISANGDTEVGQKIAEAMEKVGKEGVITVEEAKGLEFELDVVEGMQFDRGYLSPYFITNPEKMTVELENPYILIHEKKLSSLQAMLPILEAVVQSGRPLLIIAEDIEGEALATLVVNKLRGGLKIAAVKAPGFGDRRKAMLGDIATLTAGEMISEDLGIKLESVTLAMLGQAKKVTIDKDNTTIVDGAGSAEEIKARVEQIRAQIEVTTSDYDREKLQERLAKLAGGVAVIKVGGATEVEVKERKDRVDDALHATRAAVEEGIVPGGGTALLYATKALEGLKGANDDQTKGIDIVRRAIQAPIRQIAANAGHDGAVVSGNLLRENDENQGFNAATDTYENLKAAGVIDPTKVVRTALQDAASVSGLLITTEAAISEKPDDKPAMPPMGGGMGGMGGMDF

SEQ ID NO: 10863 - protein, 94 aa, Sphingomonas aromaticivorans
MTFRPLHDRVLVRRVEAEEKTAGGIIIPDSAKEKPAEGIVVAVGSGARAENGTITPLDVKANDRVLFGKWSGTEVKVDGEDLLIMKESDILGVI

SEQ ID NO: 10864 - protein, 428 aa, Sphingomonas aromaticivorans
LRIALAGLGTVGGGVIRLIEANADLIARRAGRPIVITTVSARNRDKDRGFDVSRYAWEDDMVILGERPDVDVVVELVGGADGPALALARTTFEAGKALVTANKAMIAHHGVELATKAEAAKVALKFEAAVAGGIPVIKGLKEGVAANEIARVYGILNGTCNYILSTMEDTGRDFADVLAEAQAKGYAEADPTFDIDGIDAAHKLSILSSIAFGTAVDFKPVAATGIRRVLAADIAQADVLGYYIRLIGMAETEMDAAGNRRLFQRVHPHLVHRDHPLAHVDGATNAVVAEGNFVGRLLFQGAGAGDGPTASAVVADLIDIARGDIGAPFSIPVAELERAAPAETGHRRGKAYIRFNVADRPGVLAEITAAMRDAGVSIESFIQKGGQDDAPVMVSMVTHEGPESAIAEALRLLDGSPVLAEPPLVMHI

SEQ ID NO: 10865 - protein, 353 aa, Sphingomonas aromaticivorans
MSLNSFGHIFRFTTWGESHGPALGAVVDGCPPGLALTEAQIQPFLDARRPGQSRFTTQRQEPDQVRILSGVFEGRTTGTPISLMIENVDQRSKDYGDVAKAYRPGHADYAYDAKYGFRDYRGGGRSSARETAARVAAGAVARLVIPEVSILAWVSEIGGDRIDMDHFDAAEIARNPFFCPDSWAAARWEKLVDDARKSGSSLGAVVECVATGVPAGWGAPLYAKLDAELAHAMMGINAVKGVEIGDGFAAARNTGEGNADPMRPGAGVPEFLANHAGGIAGGISTGQPVTVRVAFKPTSSILTPMPTITREGEATELLTKGRHDPCVGIRGVPVVEAMMALVLADQKLLHRGQ

SEQ ID NO: 10866 - protein, 399 aa, Sphingomonas aromaticivorans
LTLYILIGMLLGIVVGYALNTAYPKGDETLAYTADTLKLLPDVFLRLIKMIVAPLVLATIVTGIASMGDSAALGRIGGRSLAWFITFSFVSISLGLLLVNLLRPGVGLELTPTGELGELATGDFTFRHFVLSVFPASPIEAMAKNDILQVLVFSLFAGIALSAVGEKGAPLVRGAEALAQVMLTVTGYVMRFAPFAVFGAISSVIAVRGLGIIVTYGKLVGSFYLAMLILWVVLLSAGAIFLRGRIFTLIRYIREPLLLAYSTASSEAALPKLFEQLDRFGIPRRISGFVLPLGYSFNLDGSMIYTSFAAIFIAQAYGIELPVTSQIVMLLTLMVTSKGIAGVPRASLVVIAATLNQFGLPVEGIALVLGVDHFLDMGRSATNVVGNAVATSVVTKWEG

SEQ ID NO: 10867 - protein, 242 aa, Sphingomonas aromaticivorans
MARIGIIGSAGRMGNALQAAVAAAGHDFAGGIDKGGDPLELAKASDVLVDFSAPGALEFNLDAAIHAGVPIVVGTTGLEERHHWLIDAAAVSVPVLQTGNTSLGVTLLAHLVREAAARLGEDWDIEIVETHHRMKVDAPSGTALLLGEAAAKGRGVSLAEEAVRGRDGITGARKAGTIGFAALRGGSVAGDHSVHFLADNERLTFSHLAENRAIFAKGAIRAAQWLLDQEPGRYTMPEVLGL

SEQ ID NO: 10868 - protein, 334 aa, Sphingomonas aromaticivorans
PADHPTVLTGKVGVLLVNLGTPDAPDAGAVKRYLKEFLSDRRVVEIPALVWQPILRGIILNTRPRKSAHAYAQVWTDEGSPLAAITAAQARALQARLGESAIVRHAMRYQSPAMAKELDALLQAGCERILVAPLYPHYSGATTASALDAVADWIKARRRLPALRTLPPYHDDPAYIGALHADLSRQIDALDFAPELLLLSYHGMPERTLHLGDPYHCHCRKTSRLLGERFAQSNPALRLETTFQSRFGKAKWLEPATDAVLVDEARKGTRRIAIAAPGFSADCLETLEELAIRGKEDFVAAGGTHFASLACLNAGDDGMDMIEALVRRELSGWI

SEQ ID NO: 10869 - protein, 446 aa, Sphingomonas aromaticivorans
ILREYDIRGVFGETLEVEDARAVGRSFGTMVARRGGHRVVVGRDGRTSSPLLEHALVEGLVASGIDVVRIGVGPTPMLYYAEASMPEVQGGVQVTGSHNPADHNGFKLVFEGSALFGTDIFDLGRLAGEGDWISGSGRVEEADVLPGYVERLLQGLDGVDRAALSVLRIAWDAGNGAAGPAIEALVARLPGEHVLLHTIVDGHFPNHHPDPTVEANLSDLREAVARGSLDFGLAFDGDGDRIGAIDSTGRVVWGDQLLAIFAEDLLRNRPGATVIADVKASSALFHRIAELGGRPEMWKTGHSLIKSRMKQTGSPLAGEMTGHICFGDPYYGFDDAIYAAVQLMAATVRLGRSLTELRDAMPEMKNTPELRFAAPPGRRLAVVEEVLGRLRAAGARVTDIDGARVDTPDGWWLLRASNTQDMLVVRAESRSEEGLARLLAQVDAQL

SEQ ID NO: 10870 - protein, 476 aa, Sphingomonas aromaticivorans
GMLIGIDLGTTNSAVALWHEGEARLVPNSLGALLTPSAVSVLQDGTTLVGAAAFERMAAKDGAAATSFKRLLGTDRKVRLGRKEFSAEDLSALVLQSLCADVEAHTGERPTEAVITVPAYFNDRQRKATRRAGELAGLSVRRLINEPTAAALAFGLKDKAEREPFLVFDLGGGTFDVSIVEMFEGIVEVRASAGDNRLGGDDFNGALAMAVKGRLDPDERLATLGEARAQALLLQAAERTRRALTDAPEAEFAVTAGDERLSTTVTASEFEAQAEGLLRRLRDPVVRALRDSQIDAASLSEIVLVGGATRMPLVRKAITRLFGRFPNASVHPDHAVALGAAIQGGLIARDGGLEEIRITDVCPFTLGIETAEHSVRGTIQQGLFSPIIERNTPVPVSRSGVYSTMGDGQKQIAVHIYQGEAREVSGNVKLGTLSVPVPSRPAGEVSIDVRFSYDSSGLLEVDVEVPLTGTRHNLVI

SEQ ID NO: 10871 - protein, 410 aa, Sphingomonas aromaticivorans
IVMKFGGTSMAGTERIRRVARIVQRQQAAGHEVAVVVSAMAGETDRLVNFCREANPLYDPAEYDVVVASGEQVTSGLLAMHLQALGCKARSWLGWQLPIHTDDAHSKARIEGIDSEALLASMGAGEIAVIPGFQGLTADNRVTTLGRGGSDTSAVAVAAAVKADRCDIYTDVDGVYTTDPRIVAKARKLKNVTYEEMLELASVGSKVLQTRSVSLAMKEGVRVQVLSSFIDDDAPAADTIPGTMIVSDEELEGLDMERQLITGIAADKNEAKVTLTRIADRPGAVAAIFGPLAAANINVDMIIQNIAKDKGETDVTFTVPISDLARTQALLEERKDTIGYYRMLANSKVAKISVVGVGMRSHAGVASTMFRALADRGINIQAITTSEIKVSVLIDEDETELAVRVLHTAY

SEQ ID NO: 10872 - protein, 284 aa, Sphingomonas aromaticivorans
MTAAVIDGKAFAATLRGRVGDLATAFEARAGRKAGLAVVLVGEDPASQVYVRSKGKSTLEAGMASFEHKLPADTAEADLLAVVEQLNADPAVDGILVQLPLPRHMDEQKVIAAINPDKDVDGFHVINAGRLAVGQPGFVPCTPLGCLMLLKDRLGDLSGLDAVVIGRSNIVGKPMAQLLIAESCTVTVAHSRTKNLPEVVRRADIVVAAVGRPEMVKGDWIKPGATVIDVGINRVPGKEEGKTRLVGDVDYASAAEVASAITPVPGGVGPMTIAVLLRNALVAA

SEQ ID NO: 10873 - protein, 287 aa, Sphingomonas aromaticivorans
LTEALPYLQRYAGKTFVVKYGGHAMGDPELAQDFAEDIVLLKAVGINPVVVHGGGPQIGRMLKALGIESRFVDGLRVTDKQTAEVAEMVLAGAINKELVSWIARAGGKAIGISGKDGGMVIARKVEAKKAPKAVADAESGDPIVVDLGFVGEPDRIDTTVIDTICKAGMIPVIAPIGVGEDGETYNINADTMAGSIAAALGAARLFLLTDVPGVLDKDKNLLTDLRPADIARLAEDGTISGGMIPKLETCVHAVEAGCEATVVLDGRVPHAMLLEIFTARGAGTLIR

SEQ ID NO: 10874 - protein, 857 aa, Sphingomonas aromaticivorans
TPMMAQYLALKDQAGDCLLFYRMGDFFELFFDDAKVAAQVLDIALTSRGEHGGAPIPMCGVPVHSAEGYLARLIKAGCRVAIAEQVETPEEAKKRGGSKALVARDIVRFVTAGTLTEEALLEPRRANVLAAVCEVRGLIGIAACDISTGRMELEECAADQIGAALARLGASEIVAPDSWDDRPFDCVPRPNRTFASEEGEARLKAVHGVSTLDGFGQFTRAMLSAAGGLVTYLDHVGRGALPLLLPPVAREAGTHMAMDEATRASLEILNSSTGTRRGSLVEAIDRCVTGAGARLLAEDLSAPLTDARAINRRLEMVSWLHDDPLLRGDIRAILRSLPDVGRALGRVVAGRGSPRDLGQLRDGLSEARRLHGLLHARADRPEPVHALLPSLAGHGALCDLYARALVPAPPTERSQGGYIAEGYDAALDELRRISGNARRAIAALEAKYRDDTGITALKIRHNGVLGYFIEVPAKHADRLMAPDSGFTHRQTMAGAVRFNALALHEEASRIAESGGHALAAEEAHFEDLVGHAVRAKEAIAATAAALARIDVAAGQAERAAEGGWALPRVVDEPCLEISGGRHPVVEAALAAKGERFVANDCALGPQDRLWLVGGPNMGGKSTFLRQNALIVLLAQAGGFVPARSATVGLVDRLFSRVGASDNLARGRSTFMVEMVETAAILSQATDRSFVILDEVGRGTSTYDGLALAWAVAEAVHTINRCRCLFATHYHELARLAESCDALSLHHVRAREWKGDLVLLHELADGPADKSYGLAVARLAGVPAPVIKRAKSVLEKLEKGRAATGGLAAGLDDLPLFAAAIEAAEEKVDALRERLNGLDIDALSPREALDLLYELKAQ

SEQ ID NO: 10875 - protein, 461 aa, Sphingomonas aromaticivorans
FSDLGLAEPILRALETKGYNDPTPIQRQAIPALLEGRDLLGIAQTGTGKTAAFALPSLHRLAANPQPRKPASCRMLVLSPTRELAAQIADNMKGYARNLNLIVDCVFGGVPIGKQARRLVPGVDILVATPGRLLDLIDNRALTLGRTEIFVLDEADQMMDLGFIHALKRVANLLPKTRQSLFFSATMPKAIEDLGKQFIVNPVRVEVAPNSTTAERVEQYVTFINQAEKQALLTLRIRDLLKTKELDRALVFTRTKHGADRVVRHLSSAGIDARAIHGNKSQAQRTAALEAFRQGSCPVLVATDIAARGIDVSGVSHVFNFELPNVPEQYVHRIGRTARAGADGIAISFCAPDEKPYLKDIERLTRVKVDALPLPENFTAEAAKLPAPSRKPAEQEQDARRDARDARGNGGRGGQGRGQAHGGRAQGRDGRPRDASPRQDRREGDRGPVRNPLHTDRTDRP

SEQ ID NO: 10876 - protein, 568 aa, Sphingomonas aromaticivorans
RSSLVLVIAASVLLNLLVFAGTIYMMLVYDSVLPSRSIPTLVGLFAMIVLVYLFQALFEAIRGEAMLSVANGVHDDLFAAVHHATVSRPLRAAADKGDGLQPIRDLDAIHTFLAGPGPTALIDLPWVIVFLFVLTALHWWLGLTALVGVIVLSAIALWSNRRTASATRQLQSVIGQRSASAQAEIRNAETAVAMGMQERLLTRTRGWEADFLESQSRLSRLVSRFGGAGRTFRVFLQSLILTVGALLVIDDKASGGVILASSVLSGRALAPVDSAIANWRGLVAASTGWERIVQLINAFQKAPPRSIELGAPSAELSIRDLWVAPPGVQRMTVQGAALSLTPGQALAIIGPSAAGKTSLMKAMLGIWRPQRGEVRLDGATLDQWAAESLGRHIGYVPQTVELVDGTIGENIARFDPDATSDGVIAAARAAGMHETILAMPDGYDTRLTGGGLELSAGQRQRVGLARALYGEPFLVALDEANSNLDSAGDAALAKAVEDVRKRGGIVVMITHRPATLGPISHVAVMAGGRIIDLGERDEVMKRLSTANPGEPKDGQTVAARTGPAKVGA

SEQ ID NO: 10877 - protein, 395 aa, Sphingomonas aromaticivorans
DLRERAAKVIPNGMFGHEATHLLPASFPQFFSRAKGAYIWDVDGNRYLDFMCAYGPNLLGYGDELIDAAATRQLALGDTMTGPGPVLVDLCETLVDMISHADWVMVCKNGTDATTMALTAARAQTGKRRVLVAEGAYHGAAPWCTPMPGGIVPEERAFISKYKYNDVASLEAAVAAAGDDLAAIFASPFKHDAFEDQALPDPAYARRARELCDQTGAMLIVDDVRAGFRLVRDCSWELVGVRPDLSSWGKSFANGHPISALLGSNSCRAGAEAIYATGSFWFSAVPMAAAIETLRILRESDYLERTIRLGERLREGLAAAAARHGFSLRQTGPVQMPQILFNDDPDFRIGFAWAEAMLERGVYVHPWHNMFLNGAMSETDIDFAIEAADGAFAQV

SEQ ID NO: 10878 - protein, 196 aa, Sphingomonas aromaticivorans
  unsure (1)..(196): unsure at all Xaa locations
RTSQSHPLLIASVEPFPGFGSIGITFCPGKFQPDAMSGSWARDLASDLDAVRDWGATAIVTLVTQRELQRLSVPMLGAEVVARHIDWHHLPIKDCGTPDPSFEAEWETVGEELRNRLRNGFNVLLHCKGGLGRAGTVAARLLVELGWDANKAVSSIREVRPNAIETLDQFNHVLSAAPRARMPTRHQPXCHARPGG

SEQ ID NO: 10879 - protein, 323 aa, Sphingomonas aromaticivorans
MPLLEARNTYKPFEYPWAYEFWKRQQQIHWMPEEVPLGEDCRDWAQKISEHERNLLTQIFRFFTQADVEVQNCYHEQYGRVFKPTEVKMMLAAFSNMETVHIAAYSHLLDTIGMPESEYGMFLEYEELKAKHDYLQTFGVETDEDIARTLAMFGGFTEGLQLFASFAMLMNFPRFNKMKGMGQIVSWSVRDESLHCEGITRLFHAFVKERGCLTKAVKEDIIDCCQKTVRLEDAFIDLAFEQGPVPGMSAKEIKRYIRYIADWRLSQLGLPAIYMIEDHPLPWLAPLLNGVEHANFFETRATEYSKAATKGDWNTVWSSFDKR

SEQ ID NO: 10880 - protein, 597 aa, Sphingomonas aromaticivorans
RFTIVTDDSRDVNLTDFGKDTLDDRYLLPGEKYQDLFARVADAYADDQEHAQRLYDYISKLWFMPATPVLSNGGTGRGLPISCYLNSVDDSLEGIVATWNENVWLASRGGGIGTYWGKVRGIGESVGLNGKTSGIIPFVRVMDSLTLAISQGSLRRGSAACYLDVSHPEIEEFLEIRKPSGDFNRKALNLHHGVLLTDEFMEAVRDGAEFHLRSPKDGSVRSTVDARSLFQKLVETRLATGEPYIVFNDTVNRMMPKHHRDLGLKVSTSNLCSEITLPTGRDHLGNDRTAVCCLSSLNLETWDEWNGDKRFVEDVLRFLDNVLQDYIDRAPDEMARAKYSAARERSVGMGVMGFHSFLQKKGIAFESAMAKAWNLKMFKHVAAKADEASILLAQERGACPDAAEMGVMQRFSCKMAIAPTASISIICGGTSACIEPIPANIYTHKTLSGSFVVKNPYLQKLLADKSKDSTNVWNSILEHGGSVQHLDFLSVEEKAVYKTSFEIDQRWLLEFAADRTPYIDQAQSLNLYIPADVDKWDLMMLHFQAWEKGIKSLYYLRSKSVQRAGFAGGVEADNTAEAPKIELATAETDYEECLACQ

SEQ ID NO: 10881 - protein, 395 aa, Sphingomonas aromaticivorans
EADDNIRFFDHRREWARTDFENGGLPRHEWEALLVEATRRADAAGHWRFSAPKKYGGKDGTNLWMAVIRDHFAARGLGLHNDLQNEHSIVGNFPFVNMFEHFGTPEQQDEFINGGFARTRRTAFGLTEPRHGSDATHMETRAVPETRDGVPGWRIDGEKMWTTGMHVATHCATFARTSGADGDARGITCFLVPNPTEGLVIEEYLWTFNMPTDHPRVSFTNVWVPDSAILGPVGGGLAIAQSFVHQNRIRQAASSLGAATFCVEESVRYARERKPFGEELARNQAIQFPLVELATQCEMLRLLIRKTAWDMDRLEAEEGGHKRIERELSDKVSMCNYWANRLVCEAADRAMQVHGGIGYSRHKPFEHIYRHHRRYRITEGAEEIQMRKVGAFLFG

SEQ ID NO: 10882 - protein, 397 aa, Sphingomonas aromaticivorans
TDYLFTSESVSEGHPDKVSDQISDAIVDLFLSKDPEARIACETLTTTQLVVLAGEIRCKGVYENGEWAPGAQDEIEKTVRDTVKRIGYEQDGFHWERLEFINRLHGQSAHIAQGVDAADNKDEGAGDQGIMFGYATDETPDLMPATLYYSHKILERMAADRHSGAAPFLEPDAKSQVTLRYEGSLPVAATAVVVSTQHAPGYDEGGKEAELHEYVKRVVAEVIPPVLLRETKYYINPTGSFEIGGPDGDAGLTGRKIIVDTYGGAAPHGGGAFSGKDPTKVDRSAAYITRYLAKNVVAAGLATRCTIQIAYAIGVSEPLSLYVDTHETGTVGDDKIEQAILGIAKLGGLTPRAIRTHLGLNKPIYRPTAAYGHFGRKADGDFFPWERLDLVDDLKAA

SEQ ID NO: 10883 - protein, 219 aa, Sphingomonas aromaticivorans
EARAYRKGDVVFEKNDPGSSLFAIASGSVHVRLDPKDPSKVIPIPAGTIFGEVGLISGRRRGATIVAAEDAVCVEISRNAALKLQSQVPTAKRTIERISTERQILQMFGSGLTSADIAEVVETSKIVQVRAGDAIIKEGDEDKDIYVIRVGSMIVEKEVGGKPVFLSYLPAGSYVGEMALIDGGRRTATVRAAIKSEVIRIDGDAFGRVLAAKPALLDR

SEQ ID NO: 10884 - protein, 325 aa, Sphingomonas aromaticivorans
MNSFSFHGGRLADAMAQFGMGKAPWIDLSTGINPHGWPGADNLAVDWQALPDTGALNDLEAAAAACFGTDPAHVCAVPGTEIGLRMLGDILPGAAIHAQPSYRTHGEMIPRSRPVALTELTGTEEATIILANPNNPDGRIMSPATLLGWLAARRDSAAWLVVDEAFADAAPHSSLAAHVQDGQRLIIFRSFGKFFGLAGVRLGFVLGPRALIAQYRQRLGSWPLSAAALAIGTAAYQDVDWTAAMRMALREQADALDAVLARRGYSAIGACPLFRLIETDDAAALFERLARHSILTRPFDYDPRWLRLGLPADRQALDRLDAALA

SEQ ID NO: 10885 - protein, 1093 aa, Sphingomonas aromaticivorans
MHVIFRETHGMEETAVPQDLGQEPADLVVLSFSDSDLGAFAAAWHQARADDATFPSLRLANLAALMHPLSVDTYAERTLSGAKAILIRLIGGTPYWSYGLQQVEALARSRGIVLAVLPGDGFEDARLDAASTVPVTALRELAQWCDAGGARAAQAALAALSQLAGLIDAPARTFDPLLMAGGWHPGRGVIDLEAFARDPARPLVLIVFYRSYLTAHDLDPFAALHTAFEQRGFDALSIFVPSLKAPQVREQVDRWVRGLGPAAIINATAFSARGDDGATPLDGAGVPVFQLALATSGRAGWAAASRGLSPADLAMHVVLPEIDGRVFAGVASFKEAGTRDPALGFARTIHRADAGRVGAITARVAGWIALAQTPVAERRVALVLSTYPGKTYQMAHAVGLDALASAEAILADLAEAGYATDAQAGLAALLQCTHQHWPMAEYRKALAALPDTLRAELFAAWGEPEADAAAADGAFRFAALPIGNALVALQPERGERAHRDGDYHDLSRCPRHGYVAFYLWLRQRSVDALVHIGAHGTLEWLPGKSVALSDACWPEALTGAMPVIYPFIVNDPGEAAQAKRRISAVTIGHVPPPLVQTQSGAGLARIEALLDEFSNAGGLDPARRDRLQVNIRDEARVLGLEAELGLDDAATLVEAITRIDRFVCDVKDSQFGDGLHVFGRGDQGAAERAGLLAALDGRRVPPGPSGSPFRGRSDVLPTGRNLYAIDPRAVPSRAAHAQGVTLAEELIRRHLQDHGDYPRGLVVDLWGSATMRTAGEEFAMALHLLGAKPLWDTASERVTGIEILPLALLDRPRIDVTLRISGLFRDAFPALPILFGQAVRALCLRDEPADWNPFAGQAAAPRVYGPAPGSYGLGLGDAAEVYTEAARRAAGEAWLAASDHAFDAASDAIGTFADPAGLRQRVEGADAFVHLQDLPETDLLLAADYAAHEAGFAAAKALIGGSAALYHLDNRDPGRTVARTLTEEIARVVRARAAHPGWVAGMMRHGFRGGAELAATLDHMGAFAHLSGSVPPHLFDLYHDATLGQTDVRAFLERENPAALAAMEARFAALHAAGLWQTRRNSILASLPRLEDR

SEQ ID NO: 10886 - protein, 202 aa, Ferroplasma acidarmanus
VIRYSGYTSNSDDMENLFQYIYSKESRVDFLVNNAGIYFYKDIENSSLQDFNNIVSANILGEFNMTKYCTKLLKNSTHPSIVNIASVSGQRTEEGHTLYSTTKGATLAFTKALAADFGKYKIRVNSVSPGNIKTPMNDLDIEAQSKIKGRSFAETEKEYSSESILRRRGTADEVASVVLFLLSSASNYINGEDIIIDGGLYL

SEQ ID NO: 10887 - protein, 265 aa, Ferroplasma acidarmanus
FRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKK

SEQ ID NO: 10888 - protein, 351 aa, Ferroplasma acidarmanus
MKGIILHGGAGTRLRPLTHTGPKQLIPIANKPMSQYVLEYLTDAGINDICMILGDISPEKVKDYYGDGSEFDCNIQYIDQGAPLGIANAVSLTSNFVGNDKFVVILGDNLIEGKIKTFMDKFEKSNYDAFIVLTKSMHPKDFGVAEFRDNKLINLIEKPENPPSNYVLTGIYFFTPLIFDYIKKLKPSWRNEYEITEAIQLLLKDNKNIGYDIIDGWWKDTGTVDDILAANMLILDRGKNIEERANVKGKVAIGKNVVLSDDSLIRGPAIIGDNTVIQDKTFIGPYTSIGDNCTIKKASIENSIIMDNSNIDTENTIVDSIIGENSVIMNANLLKPAGKRLLLGENSRIYI

SEQ ID NO: 10889 - protein, 358 aa, Ferroplasma acidarmanus
MEAIIVKPPEAGITFQNLDYKNNGIKIKILENGICGTDREIVKGQLNSAAIPAGSNYLILGHEAIGTVMEDGTIFKKGDIVMPVNRRGCGKCLNCLVGRPDFCETGNFVEAGIKGMQGFMGEYIYDDEKYLVRVPAGIKNMAILAQPLADLEKSMDEIINIQKRMIWRCSDNTFHCRNALVIGTGTIGVLFSLLLKTYGFSVTIANRRYAHDKESKICNIADIKYYNSATGYKFDDNSFDLIIEASGSSADVISQTMGFLKNNGIFGLFGFIRSGELSINSHMLQDFVYKSIAMVGLINGQKPHFEMAMDHLMQWKYMYPGIEKLLITDEIKISDREKITTVLTEKSKDEIKTRILWD

SEQ ID NO: 10890 - protein, 568 aa, Ferroplasma acidarmanus
  unsure (1)..(568): unsure at all Xaa locations
GDKMIEVKVNSLDEALQKSYPPWVRRTIEITDISIYRAFSDSVEKNKDNIAIDFMGKKITYSSLKENNRSISVRLGELGITKGDRIAVMLPNIPQYITYFFAIVKLGAIIVQVNPLYTMRELEFEIKDSGANTLIVMDDFIDKALPLYPAKLKRILVVKVQYYLPPVVSQLYTLIKKEHKKIPVADNIYLCKVPKKSKLPSKEADIDPENDPALLQYTGGTTGLPKAAILTHKNLISNAYQIIEYMPDKYKKNISYLSSIPFFHVYGMMTAMLTPLLQGSKIILIPDPRGYKTALKIIDKKKPVAFPGIPTLYHGIITYKDVKKYHIDNVKICISGASPLPVELQKNFESMTGAILVEGYGLSECSPVANVTPLVEDDREKYRRFGSVGLPVSNTYEKIVSTEDGVTEMPLNEPGELVIKGPQVMKGYWNRPDENAKTMVDGWLHTGDIAKMDEDGYVYIVDREKDLIIAGGYNIYPREVEEVIYENPKVSECAVIGVKDAHRGETVKAFIVKKDSSLTDAEIINFCKERLAVYKVPKIIEFRDELPLTLVGKVDKKALRGGDNGKXK

SEQ ID NO: 10891 - protein, 354 aa, Ferroplasma acidarmanus
DPSAMILTSGTTGRSKVVVESNSQFIATALDMIDAGGVASDSRIYVYLPLFHIMALDLAIISSILSNSTVYLVEKFNPSTFWKDIVGYQITHFHAVGPIFEMLIKQNPSAEEKQHGTIIAIAYSSREVWTTAENRFGIKITGGYGGTEAGIPVTSPYSEVVNGINPPGSCGKATPPYEVAIIDESGFPVVTGAIGEIVIRPKLPWVTFLEYYKMQKESLQAFTGLWFHTGDLGKYDNNGYIYFVDRSKDSIRRRGENISSFEVEQTILKMDGVLEVAVYPVPSNLGEDEVMVALSRNNSELKPENIIEYCLNNMPPYWIPNYIRFLDSLPKTPTGRIEKYKLKNEAVTTDAYHM

SEQ ID NO: 10892 - protein, 308 aa, Ferroplasma acidarmanus
GIENVKIVDKDLSGEGIKVKIVKAGLNPLDYNLIAGNIVYNVNPMPHIPGSEVMGIAMEDGKRIRKGDRVIVYNRIFDNGCDMCYSGNEHLCYNGGIWGVITNGGYADYIKIGEQNLFRVPESIDDNTAVSIGIGALTSYRSLKRARAGINDKILVYGAGNTGIFTVQIARQMGMDVYVYSRNRELESLGIKVLDSVPDDFKADIIVNPLGGKLFGDSIKHLKRRGKIVTYGVLTGRNADLDIANVYTNELEIIGSTGGTRKDLTELLQILEKSNFRLPVYKEYSLWDIKDALHAFKDRVNGRIVFNL

SEQ ID NO: 10893 - protein, 169 aa, Ferroplasma acidarmanus
DDEADDYNERGISYFNVTQYPDAVKEFTKAINLIKTDPDYYINRALAYYSMHMYNEAIKDCKSAIALSADRGDYHNTLGSIYDDMNRFDDALGEFDAAIKIEDDVPDYYYNRGNVYWRKGDKDLALEDYNKAVYLNSADPVFLYKRSQIYTEMEKYEDALGDLEDCIKL

SEQ ID NO: 10894 - protein, 316 aa, Ferroplasma acidarmanus
KLNECDDTRIKDIIIKLRDFTLNGGKRLRPILMIMGYNMFSGQDERIIKASISIELAQSFLLIHDDIMDQSDMRRGKPSFHKAVEGSLDGNDATRIAENLAISAGDLIDTFSHEALLRSGFELENLLDADFEFSRIIEDTGKGQILDIYSSIENLYSEERLTKLHFLKTARYTVQGPLLMGAYLSGNKKYIQEIKDFGKYAGIAFQLYDDMLGIFGVEEKTGKPVKGDVNEGKKTLLIIKAYENSGKEDREFIESCLKCGDVSDSDFNRLRELIKSTGSYDYTKQKIDEYNNIARSALEKIDGDKEVIKMLDFLLE

SEQ ID NO: 10895 - protein, 380 aa, Ferroplasma acidarmanus
LTSVGWAEENGVNRLALNEYDIQARKNLEGEMRAVKADIKHDDAGLIFGTLGSGKDNTAIGSHMDSVPNGGRFDGFYGVMSGMQLLKDLGSTLKNRKITAIDFTNEEGARFQPSLLGSGISTGVFTKEFAYSRKDSDGITFEDALEKSGYMGEEQNRVKNQDISRYIELHIEQGPVLELENYQIGIPKGIVTMVVDNISFTGESNQAGPTPMKVRKDALVAASRFTVAVRDIAKSSGKELTMTIGKINNFPNAYNVIPGKVTMNLDTRSPDKKTAEEYSKMAKEISERIASEEGVPVDFKNQWTTETTLFDEDMRKEIIKSCRALNLKYKELYSWPGHDAQYMNRVVPTAMIFIPSHNGRSHTKEEYSSDRDLINGYSVL

SEQ ID NO: 10896 - protein, 410 aa, Ferroplasma acidarmanus
LQKQREMESSTVIYPDSFPIAIKRAENSLIEDLDGNIFIDWVSGISVLNLGFNDNIRKAVKNQVDDIWHALEIPTEVRINFLEALRNSFPPEMRNYKTIFGISGADACETAINIAHAIRKKNAPTIAFEGAYHGVSGGIIAATAGRKYREAVYSDGFKVIRVPYPYKLWYDYDVSDIISIMKKIMDDGEAGYDRPDSVIVEPVQGEGGYIVPPDGFLKAIREFCTEYDLTMIVDEVQSGVGRTGKMWAFEYENITPDIVCVSKSIGGGLPVSLVYYRDDYDKKLPKPFHLGTYRANPLAMAAGITVINEVPKYFDKVKSSGKEMLNKFNKIDSNLIGEVRGKGYMIGIELVDNGKPVNSKHMMELKHELLKNGLLMHTCGHYGNVFRFMGALNIEEELLNRGVEIFSKAV

SEQ ID NO: 10897 - protein, 385 aa, Ferroplasma acidarmanus
VGAVIAGYMGDNLGRRFLYSFNLGIYAIGALISALSVNYSMFLFGRIVVGLGLGGEVAIGLTLISEIMPTRVRSQLTGAVNVGPGFGIFAVAILALIFIGPYEQIFGGSKLAWRWFLGILILPALLILLYRRYIPETPRFLISKGRQDEAFAVIKMLSENKLIPLKKLKNYYKVDDLRQQYNYIGLKPINEKPKTRELFAGKYARRSLLLFILSFITFGTSASFTIIYPEIFTSVATALHLSSTFTLTTIVNFGTLLGTFTAVFLATKNRKILISTLGILAIIGAGLTVTFHSYAYIVVISLFIFAIFSYASNTTIWLYSPEMYPTRIRNIGTGFILATSLGGVAIMEVLTSYVYALYNLTGIGLVAIGAFVVYVILAFFMADDT

SEQ ID NO: 10898 - protein, 572 aa, Ferroplasma acidarmanus
LNGRLETFVRMLEPANIVVITDPDFYEKKLVGEMATDHELIELNRKYYSNSYLYRSNPDDVARTEKDTYISSLDEKNAGATNNWMEPEHLKSRIFNLIKGSMKNKTMYIVPFILGPAGSKYSEAGIQITDNPYVVINLIKISLVGKEAINRIENTGKYVVAIHVTGTLDKNNRYIAHFTDEDLIISVNTAYGGNALLTKKGYALRIASVHARDNSRMAEHMMALEVTSPSGRKYGISGAFPSASGKTNLSMIRTPTDMAGWDAQLLSDDIIWMHINNDSLYAINPEYGFFGVAPGTNATTNPNAMKAFNRDTIFTNTALTTDGKPWWYSLDPSVSEVYDWHGNLTTDLKNAAHPNSRFTTPIKNYPYLSSKFYDNEGLKIDAMLFGGRRSDLIPLVRQAKSWAQGVLFGAMIRAETTAATTGKVGILRNDPMAMIPFCGYNIGDYFQHWLDMGKLVQHRPEIFYVNWFRKDSDGNFIWPGFSENFRVIEWIASRLDAKANAIETPVGLIPDIANFASGNLGKNKLEQLFEIDYPGWLKELNEIEPFFKKIGDSFPEELWREFHNMKDGVEKQ

SEQ ID NO: 10899 - protein, 609 aa, Ferroplasma acidarmanus
INYVDKSYDPMEDFSIYSYGKWVKSHPVPEDKYVYDASTELMEWNNFILGKILESCARNSQNPAERALGDFYISIMDVDGIEKNGFKPVSRFMEIIDRIDSKNNIIETFGEFNTMGISGLFSFDSMPDEKNSSVYACYLNQDGLSLPNRDYYFDDSFKEIRAQYINHIKNMFILYGFDDKTSENMGNTVLKIETSLALKSRSPVELRDPDKNYNRFQFNDIEKEFPGLRHREYFSKIGLTGLDYIIIGQPEFFRDLDSIIQQYTLDDWKIYMKWNVLNSAAPFLFGDVEMEHFDFFQRKLLGQQLPAKRWKKAVSIIDSFMGEALGKIYVEKQFGEDSKRRMDDMIEDLKEVFIERINNLSWMGRETKEKALEKFSKFRAKVGYPSKYIDYSSIKISQDRLFENIINCNKFELERETKRIGKPVDKELWEMTPPTVNAYFSPTDNEIVFPAGILQPPFFDPEMDDAVNYGATGATIAHEISHGFDDEGRKYDLNGNLNDWWTPEDDKAFTEKAKSVVELYNSIEALPGIHVNGPLTLGENIADIGGVSIAFEALEHRLKKNPELRKVIDGYTPEQRFFMGWAQSWRTTVKDEALKWQILNDVHSPEKIR

SEQ ID NO: 10900 - protein, 331 aa, Ferroplasma acidarmanus
MKYVNVGKSGLKVSTVAIGTWHLPGSGQFVNKVESVNEEEFKKIFKKAYDFGINFYDTADIYHGRVENNEDCIECTGNSERVLGNIIKDYDRESLVISTKVAGPMNYYVNSSGLSRKHIMHGIKSSLERLKTDYVDLYQFHWSDNDTPLIETLKAMSHIVDLDLSRYIGMSNVNACDIPEFMNLSEKYNLNNFITMQEAYNILDRKIENDKILYAQRYNLGLLAYIPLDQGILAGKYLNNYGKGSRITYYSGLQNEIDRTLNTVKKLKEFADENDITLSQLAIAWLLKRGAELNIKIIPLLGITNIKYLDDNINALNVNLKDEDMKYINEI

SEQ ID NO: 10901 - protein, 622 aa, Ferroplasma acidarmanus
MSKYFEEYERSLKDVNGFWNENGRIIDWFKPFDKVLDDSKKPFYRWFINGKTNLSYNCLDRHIQNEKRNKVAFIWVPEKGEEKVVTYFGLYRRVNAFARGLLNLGVKKGDKITIYMPMILEAPIAMLACARIGAVFNVVFSGFGEQALAERINNSNSKTIITADGGYRKGNIIQLKNIVDKAIDLSNGVDNVIVVKNTHTEIDMEPDRDYYYDDIIEDGYVEPEQMDSNDPLFILYTSGTTGKPKGILHANGGYPVWIANTLKWAFNPKDEDRWWCAADIGWITGHSYIVFAPLLLGLTSVMYEGAIDYPKPDRMWEIIERYGVNLLYTSPTAIRLLMKYGEKYPLSHDLSSLKTLGTVGEPINPAAWHWYYEVIGKSRCPIIDTYWQTETGGFTISPSARLGLPDLKPGSATFPMPGIDAEILDENGKNVKPGEKGYIVIKKPWPGLMLTVNNDDKRYIDTYFSKFKGKYFMGDYAIQDDDGYYWLLGRSDEVLKVSGHRIGTIEVEDGLVSMKEIAEAAVFGKPDTVKGDTIVAFATLKDGYEKSPELIENIKKRIRNNLGPIMVPEEIHIVSTVPKTRSGKIMRRVIKAVYLDQLPGDISTLENEASVEEIKRAVDIIK

SEQ ID NO: 10902 - protein, 248 aa, Ferroplasma acidarmanus
MYNDLKGKNVLVTGGTKGIGKAISLGFAVEGARVISISRHTPEDTDDRITYYNCDVSSSNDVKSTIENILSKFNTIDILVNNAGIEEYASLDKTDEGMWDRIMDINVKGVYNVSKYCIQEMIKNHGGNIINISSVQANIITKNAAAYVTSKHAIIGLTKSIALDYAPEIRCNAVLPATIDTPLVRKAAILEVGNNEEKIKEKIREWGLQHPLGRIGKPEEVANTVLFLASNQSSFITGASIMVDGGLS

SEQ ID NO: 10903 - protein, 309 aa, Ferroplasma acidarmanus
EEIYLDKNENPFNVPEKVKKEFINYAKDADFNRYPEKGLPSLIKKLAGLTGFSSENIIAANGSDELLDILIRRAEGDIVVSSPTFEMYSFYARNYGHKAIDVPLRSDFSLDVNGILAQKDAKLVVICSPNNPTGNLIDRESIKKILDSGVTTILDNAYYEFSGEDYTDLIAKYSNLIILRTFSKAFSLAGMRIGYGIAESKFISEIKKLQAPFYMNILSAKMAEIMIDNYSLIVEKIKYIVEERERVYNEIKDIAYPSSANFLLLKKDLYGYMEENGIHIRKLPLVKDRSRLTIGTKDENKRAIEAIKK

SEQ ID NO: 10904 - protein, 350 aa, Ferroplasma acidarmanus
VIGAGITGLFSALNLALDGYDVTLFDREYILSGTSGKFHGMLHSGSRYSVNDAESAKECIHENALLSNTASSFIKNTGGYYLALNDADAEYGDKLLQKNKENGIPTEELGIDEMLDLEPNINKNILRAFRVPDKVISAHPFAAAVAVEAQLMGAKLRFKSEVLKAEVDGKTVESIKYRSHSRIVNEKFDYIINTTGPWSGQLLKSFGIGDFEVMPTLGYMASYDYLFSHGILNRMREPSDGDILLPYGSMSVAGTVAIISDNVDNNDIDPEDLDTMLSEVSEMVPSLSRHRYKKLYSSMRPLIREGYSRATRDFRIYENMNNLFSIIGGKFTTSRLMGQAVSQKLSKITG

SEQ ID NO: 10905 - protein, 394 aa, Ferroplasma acidarmanus
  unsure (1)..(394): unsure at all Xaa locations
KIVILSAFGMLLDGYQLTVIAFAVLLIPDYIHLSDYSLDYGLLIASVIIGAIIGTILVGYLSDLVGRRRVYLSTLMFFILFDMISVFSVNFYMLFISRVLLGVVLGAEYPVANSYIAEVTPSDKRGFYLAFATVFFSVGSISSAIVAVFMFPLGNIGWRLMLGVAVIPAIIVEFMRFSLPESKLWEEKKEKTGFLEMFSKKYSKNIILAALIWFLYDIVAYGLSLTLPTILKLGHFVTNVDNALLTTFFLVIGIVSGVFVMIKVDKFGRKGIQITGFLLMAVLFLILPHFYYLAGIITIVSFLELFNAFGGATVGIIPAEVTITRFRGTSYGFSSMMGKIGAVIGVIAMSLLITSKNYFNAYIFLAVIMIIAILLTLLLPETKNIKLEXKXKNI

SEQ ID NO: 10906 - protein, 284 aa, Ferroplasma acidarmanus
YHSIIYSSMFKENLLKDKNILITGGGTGLGKQMTETFLKLGATVSIISRKEEHLTAAKEYFNNMGYKIEAVKCDIRNPDEIKNAVDLIESKTGKINVLINNAAGNFISRTEDLTPKAFDTVMGIVLHGTAYASLEMGKRWLSNSMKGTILSIVATYAWTGSGYVVPSAISKAGVLALTRSLAAEWGHKGIRTVAIAPGAFKTEGAWSRLLPGDDYEKQIISGNPERRLATKEEIANIAAFLISDMAAYINGEVVTADGGQALYGSSMFNMMESLPDDIWKMMRQ

SEQ ID NO: 10907 - protein, 376 aa, Ferroplasma acidarmanus
YMLNENETNVLKYVRELAETKIKPRAREIDEKMEVPEDIIQAMRDMGLFASYIPEKYGGYGLSFPFLVNVIETISEACPSTALVLDGALTLFAEPLIMFGSEELNKKYLTEIAKGAVGGLAITEPGSGSDAASISTRAEKCEGGYKITGTKTFISNGRIAKFFVMDASTDKSKGYKGITTFVVDGNAPGLEISRDIHKMGIRGSSTVELNFHEVFVPESNIVGEYNKGFSVIMDTLDAGRIGIAAQALGIARSAFHEALEYINTRKQFNKKIIDFQGIQFMIAEMESRIKASDLLIREAAEKWQNHEDTVELSSIAKMYASDTAVYVAERSLQLFGGYGYTTDFNAERHMRDAKITQIYEGTNEIQKIIISREIMK

SEQ ID NO: 10908 - protein, 527 aa, Ferroplasma acidarmanus
  unsure (1)..(527): unsure at all Xaa locations
KTIELRVYGMTCDDCPKHVSTVXESHGVKEVSVSLTDGMHISELLIQLIPXSHKLDSXGQYRAQXGVLKMTEYDLAIIGWGAAGFAAAIKASELTSNQMKIALIGTGELGGTCVNVGCVPSKFLIEASKNYKEAKSPAYAGITSSATLDFSEFMESLNQFVSGERETKYTSVMKNFENIDLIEGLAKFIDNDTISVNNTELKATNFIIATGSRTFIPEVRGLTDYYTSDTVWKMRKLPGKLAVIGSGEVALELAYAFSNFGSEVHIFNRSNRILKGFDDDVNSQLMAALKSNGIVFHLGVNFYEIKNEEGKKDIVTWTGTFGDFDEIIVATGRMPNIDGLDLRAGGITADNGIVVNPDFRTTNPKIYAAGDCVRQSLKLETLAGKEGVIAVENILGGNRKINMQEVPWVVFTEPNVASVGYTEAELKKKHIEYDVRTVELKNVVKANILNSYTGIAKIISGKDKKILGIHVIAPMAAEFITEGVYLIKNGLTYDDLIDTIHVFPTVAESIKITGQAFIRDISKMSCC

SEQ ID NO: 10909 - protein, 967 aa, Ferroplasma acidarmanus
IFIDGIPLNIKGEETILQAMMDNNIDIPHVCYNPALGAIESCDTCIVNADGKYVRACTTQAKNNMKVLFNSPDVKARETEAVNRILHNHDLYCTVCENNNGDCALHSAVDTLQVTRQKYPFTSKGYEPDYSNPFYRYDPDQCILCGRCVEACQDVEVNETLHIDWSLERPRVVWDDNKAINDSSCVSCGHCVTVCPVNALMEKSMLEEAGYFTSLTRKAKYNLIEFGKDLEKPVGNGMIMKISNIEAKMREEQIKKTKTVCTYCGVGCSFTMWTKGRKILKVQPEVESPANGISTCIKGKFGWGFVNSEERLKYPLIRKNGKFVQASWDEAIDFAAKGLKKVGEKYGNESLMFIASSKGTNEESYLLQKMARQIFHNNNVDNSSRFCQAPATTGLWRTVGYGGDAGSIQDIYKSELVMIVGANTAESHPVLATRVKRAHKLNHQKLIVSDLRKNEMAERADIYLHPSPGTDIVLLSALSKYIIDQGWHDREFIEKRVNGFDEYYKSLEPFTLENASSITGIPEKQIIETAEMIHSVKSMCILWAMGITQHSAGSDESTAISNLLVLTGNYGRPGTGAYPLRGHNNVQGASDFGAMPTYLPGYQPIKDKEVIKKFEKAWHTELPTKPGIDNVSCIENIDNDKIKAMYVVGQEIASTGPDSNMIRDSLEKLDFLIVEDVFFSETAKYADVVLPATVSLEKEGTFTNTERRIQRIYQVMEPYEQTKPDWEIIQGIANPLGYDWNYKHPSEIMDEAASLSPMFHGVSYERLEGFKSLQWPMKENGEGSEYLYEDRFNFPDGKARLYPLSYRPPLTVSEEYPLHLNNGRMLEHFHEGNETFKTEGIKEKVPDTFLEISEKLAAEYKIQTGDFVRVTSKWGSIKARALITERVSGNELYMPMNAASDDATVNLLTSYTRDPDSDTPAYKELPVKIEKLKKNGGSPLPANNSRYGKPEPQIGILVSEKWKRKDY

SEQ ID NO: 10910 - protein, 343 aa, Ferroplasma acidarmanus
MKTALITGITGQDGAYLAKLLLKKNYKVYGLYRRVSTPNFWRLQALDIYDRVNLISGDLSDLSSILNAFKASQPDEVYHLAAQSFVEASFESPLSTADVTGLSVTRILEAVKLFSNSTKVYFAGTSEMFGSSYTGEPLNENHPFNPMSPYAAAKLYGYWISKIYREGYGIYVASGILFNHESPLRGMEFVTRKIANEVAKINLGLEKKIHLGNINARRDWGYAPEYVEAMHSMLQLDKADDFVIATNETHSVEEFVKYAFDYIKEDYRDYLEIDKRFIRPLDVPALQGDYSKAEKTFKWKPETKFRELVNMMVKAEIDRWKRYTEGEKFAWDVPNYPNENNLL

SEQ ID NO: 10911 - protein, 850 aa, Ferroplasma acidarmanus
HEIEDVESILKSLGVDVENGLTESEATRRIQSYGLNAIPEAKKHGILQIFLDQLKEPLILVLVVIGIIYFLIGTPFESFTVIIIVFAVIVIEVYNVKKAQISIQALHSMVTPKTWVLRNGSLLEKSTSVLVPGDIVYLRTGDMVPADGIVVSSSGLYIDESLVTGESYPVNKVSFDEPETKPGANMHRVVSGTLVVQGNGKFAVTSTGLKTEIGKISESVKNHKDIPTPLEKSLNKTARLLIVIAVFFSALIPLIGYVHGDPLDQMILMGLSMAFATVPEEIPILITITLAIGAYSLSKKKAIVKGLTAAQTLGSVTVIATDKTGTITENAMKVNHILVGEKLYEAAQKGNTSFLKSAVLATGNLEIEQKFSEGYKDPMEVAILKYAINSGLDIHELESEYLITGRFGFDSNIKRASYVYSGHDGYVAYTSGAPEVVLSRCTSIMMDESSNKVKSESDLKIIRDAINEVAKVGERTIAFAYKRINGQAEERDFVDSDMIFIGMISFIDPPGKGVKNAVKLCQNAGIRVIMLTGDYPVTAETIGKMVGIKNAESTLTGDQIRAMPDDELSKAIEKTSIFARITHDQKLRIVKALQKNGEIVAVTGDGANDASALRAAEIGISMGKRGTEVAKEASDIVLEDDNFHTIAEAVFEGRKMQYTLKKGIRYYIAVKISLILILLVPILLIIPFPFMPIQIIIMEMFMDVGALWGFLKERDEPGILHAAPQKRGADFMDRPMIISILTSALGVFLAVTFIYLYIYYSEGDIIQAQTAAFATWILSQVILAQNLRTEREPVSQRPFFSNWVILSWGLIVVGALIVITVFPPLHAIIDTSTIEYRNWVLIIIVSVLSS

SEQ ID NO: 10912 - protein, 379 aa, Ferroplasma acidarmanus
MKVLILGIDGYIGFPLALRLLDRGYEVYGADNFYTRRRVKNVGSKSAVKINSFATRNKKLNNAIKFYMGDVSNPKFVYDIIRDSGADAIVHLAEQRSAPYSMISLKTATETLDKNIESTMNIIYAVKDLNRDIHIVKLGSMGEYGTPNIDIPEGFLDVQFHGRSDKLPFPRMGQSWYHLSKIFDTYNLMLANRIWGLNVSDVMQGVVYGTRTPEITKYKLFTRFDIDQIYGTVLNRFISQAVIGYPLTVYGKGDQKRAFLSLEDSVECLNLILDHPAEKEYKVYNQFDEYYPLNYLAETVKNRYESIYGKKVSINHVPNPRVEMEDHYYNPANQNLKDIGYRRQRSLEDEVPVMIKDVRNNINTVYSLKNVIKPSTNWR

SEQ ID NO: 10913 - protein, 403 aa, Ferroplasma acidarmanus
FYTMDDFDFNGKRVYLRIDINSPINPITGEVVDDTRFIHYLRTINELKNSKVVIIAHQGRPGDSDFVSLRQHAGHLGRLLGRDVLFVDSLIGSAVETAIRNMKNGDIIMLENSRFYSEEILIKDDGAAQKNTFIVRNLSKLFDYFIIDAFPAIHRDQTTLTGFKDIKPNIAGRLMETEINSIDRFMNSKSHPKLAIMGGAKIRDAIKVTGPFLEKGIVDNIIFGGVAANIFLWASGIDIGKRNMEFIEKQDKNYKKLLEECKSLLSRFSDRIYLPEDFMLNPLQTEIKTGEKVPDGQLLADIGFESIKTFSSIIEKAKNIFLNGPMGMYEINEYSLGTREIFNAVSQSPASKIVGGGHTINAINEFGLSDSMGYISTGGGALINYLSGEPIPVIDSLVYNRKK

SEQ ID NO: 10914 - protein, 400 aa, Ferroplasma acidarmanus
QPSVNIGMVGHVDHGKSTLTFALTGKKTDVHSEEVKRGISIKLGYADTPIYRCTDETGKEFYSNKKNSDNCQLSRVISIVDAPGHETLMATMLAGSAIMNGAILVIAANEECPQPQTREHLTALEIMGIKEIIVVQNKIDLVTRERAMESYKEIKDFLKGSIAENAPVIPVSAYHNTNIDVVFEAIEKIIKTPPFNDNDAPMMYIARSFDINKPGTKPSKLKGGVLGGALIRGKLTVGDEIEIAPGVQITKGNKTTWDNVTTKITSLMAGSSSYESILPGGLAAVGTELDPFLTKGDSFTGRIIGLKGNVPKTVFNMEMDIHLLNRVVGFDEEVNVEPLKSNEMIMLTVGTANTIGTVTSIKDKRVGVSLKYPVAASINDRMAIGRRISNRWRLIGYGSI

SEQ ID NO: 10915 - protein, 443 aa, Ferroplasma acidarmanus
DVVTIGAGGASYPAAFRLKKAGFSVIMIDDKGIMSGNCLAEGCVPSKAIIETVHTYKRISDFGDFRINYRDILKRKDKVQILRNGLHRKELEEAGIEILKGVAKIIDSSTVEVKTEAGNIKLNYKHLIIGSGAYTYMPQIKGIEYAITSADLFRIDPKIKDLPESIAIIGGGYIGVETASYMSIMGSRVELIERSDRILMDMDPEIVGKLEPLLPDMRVHFNNSVISIEPDGDGYKTTIIDNNGKSDSVITACVMMATGREPLIPEGTEEAGIKFNRKGIIVNSSMQTNIPNIYATGYVNGIAPLFHAAKRQSLIAANCIMSGDMPVDRFQDNCVPFTVYTIPNMSFTGITPEKAKELGIKYIKSKYKMADDSLAEIYNEPGGELDLIFDEDMKIIGGYVIGNDAGNIINEISMGLSKGLTARDFAELPHQHPMTFEGLDSAA

SEQ ID NO: 10916 - protein, 442 aa, Ferroplasma acidarmanus
LDNARINSLHKKITALSVGGTFLDGYDISIISVALIVMSKTAFGLDTDFGKAMIAASTTIGMLVGAILFGYITDLYGRRTMYMYDMALFIVLTAAEAFSWSFASLFIMRFILGLGLGADYAIGTTIIGEFSPVKYRGKLLVTNVLSWFLGAAVAAVTGYLLLPLGNESWRYMFLLGIIPAAIILVLRRDVPESPRWLSNKGNASEAEDIERRLTGTSDNLTAIKRDNKNPLKELLSRKYIKSLLFVGIFWFTFDAAFYGISIFSPTILELLGLKARLAVLGSAVFDTFAIIGSLIAILLIDRIGRKGITIIGFSGMVISLLSLGIITFYVPDRSAFITDGILIFALFLIFYITEAIGPGSTDFVYPVELFPTEDRASAQGFGTSVSRIGAILGITTFPFIVSIYGFSTSLFFFTGLSVIGLLATIFLATETKGKTLEQVNEI

SEQ ID NO: 10917 - protein, 359 aa, Ferroplasma acidarmanus
TIQERIKEIEDEIKKTQKNKATEKHIGLLKARMSKLELEEESHKKSGGYGFSVSKSGDATMALVGYPNVGKSSLLNALTNKKSTVGNFEFTTLTVIPGTLNYNGAQIQILDLPGIIDNAALGAGRGREIISTIRNVDLIVLVTDIQLKGLDRIIAELYKAGIVLNRKKKNIAFKRTNYGGLRIHKPRNVDIDNGDIRDIAKEFKIVNGDIYIRENIDMDDLIDFFKGNIVYIKSFMVVNKIDMPHDEEQLKRKLKDFGNYIEVSAETGHNLESMKNMIYKTLDMVRVYMRNKSGEVDYERPLILSEGATIRDVSRKISREMISTFRYAIITGPTRKIEARVGLDYKVNDEDVVTLISKY

SEQ ID NO: 10918 - protein, 891 aa, Ferroplasma acidarmanus
MIIESIKIINFLSHENTEITFEQGINIITGKNGAGKTSILDAIKFALFAESRNNEKNNELIKKGKNYFEITLNFNVNGEHYEVYRHFGLKKAKNAERLASVKKNGVIVAETYEGVNVEITKILNVSREVFKNSVFVEQGQMDSLISGTPKERKTIFSDIIGLTSLSRSADRLREIIGAFREEMILLQNSSERLDQAKKDIEKFKEEKKTAFESMSRAKIESEKYYGELEELKAKQKERDRYITVIENIKANISKYLDEIKEREGQSVELSAKISEITSIEKRVTELQENPYYKKMDFINRYFLEKSGMDSAAKDMEKANKRLSEYSDYAGKLEKLSEYHKKYSDMHDKYTLNSEKIKESRKMHEEYLSASSNIQSMVDRLNKMKNYVDNYLKSSGLSLEDIQNFRPIREKINREISEKTSRISEIKSNVASYSKTLTEVRENMETLKGKSTCPLCGTNLTPDHMESISKEYDEKAGQIIGDIEKLKLEKNSVESDQEKLKDRYKIFGSQEIETAASYINEIKSLETEKKELENTIENASKGHELFNVLSAENENLEKAIKELQQYENEYIRYSSIISGMDPGAIKKEIEAAGESFTTFKNRINELLSQIGFVPEYNEYQNTGKISSEINRLKTEVERSREMKSKLESIKDEIENRKKSIEGLRIEMENKQSAMHQYDGIDEQAGNIESRYKSAYQENIKMKTLVDSYTERIEETEENAKNLEQDAEKYKKTREAISTLGKIREAFDYNGIQSIIRKDASASMTNLTRKYLQSFNLDFDDISIDENFDIKVTQNSMEQTLESLSGGEKTALAIAIRLSVTEYVLEIISIIIMDEPTNFLDEDRRNNLKDIILYSLKGENIVPQMIMITHHSELISVADASYEIIKTAGTSRV

SEQ ID NO: 10919 - protein, 485 aa, Ferroplasma acidarmanus
NLSIEDVNAVASGSEKVGIAESAIKQIQYSKKSLMKILDSGKPVYGVNTGFGSLLNVNVDRKNIVQLQTNLIRSHSSGIGEPLDIETVRAIMLVRANTLVKGYSGVSENMIDFLLFMLNNNIIPAVPRYGSVGASGDLAPLAHIGLALMGEGDVFYKGKIQNAGTVFKSLGKEPYSYGEKEGVALINGTSVICGILALEIKRSEKLVSEALGSFALAFEGLSGTDKAFTEWALASRPHEGQQMIGKAFRKLFNGSMIIENANKSKVQDAYSLRCTPQVYGAVWDTLQYARKVLTTEINSATDNPLLLGNEYISTGNFHGEPVAMVSDFVAIAMTDFGNMVERRLARIVDTNLSGLPPFLVKDYGLNSGYMIPQYTAAALCNVNKTLVHPNSADTIPTSANQEDHVSMGTNAALKLIEINKNVKSIIAIEYLLGAQSLEFRKHEPSPATLSIYKKIREIVRPLDSDRPSTGDIGAITSMMDTEEFL

SEQ ID NO: 10920 - protein, 434 aa, Ferroplasma acidarmanus
ISTFNPFTEKELGRYKVASLEDVKETIRNLKENQLKWRENIDKRIDMLKESKKNFEKNVESLATLMSSEMGKPISQSIAEVQKTLRLFDYYIENGEKFLENEYIHTEAKKSYIRFDPLGVIIIIMPWNFPLWQVARAAIPALLAGNAVLLKHASIVSGSSLKIQELFNLDTFRSTITTGKIIDDAIKFSDGVSFTGSTAAGSIIAAEAGKNIKKFVMELGGSDPYIVLDSSNIDEAVKNSVYARLQNNGQSCIASKRFLINDSIYDEFSRRMLEEYSRVKVGDQLDKDTYIGPLSSVSQKDIITKQLKELKSMGTVISTGDNFGNVIRPALVKMDKDYGEEVFGPIAMLSRFKTIDEAIKLANDTPYGLGCSIWGDPDNAEKLVPYIESGTVSINKIVASDPRLPFGGTKKSGIGRELSRYGILEFTNIKTVWV

SEQ ID NO: 10921 - protein, 246 aa, Ferroplasma acidarmanus
NKNAIVTGGSRGIGNGIAKALADNGANVIITYGNNDNAADETVKYIRSKGVSGEKYKIDQSDIGEIDGLMKFIKDKFKTVDVLVNNAGICPFMDFFNIDQNLFEKVWKVNVESHFFITQRVSQMMIENNTKGKILFISSISAIVGGKFQAHYTTTKSAMNGLMHSLAIILGEHGIMVNSLEPGTILTDINTEDLSNKKKREYMENRIPLRRLGNPSDIASPALFLVSDENTYINGAELLVDGGMLV

SEQ ID NO: 10922 - protein, 791 aa, Ferroplasma acidarmanus
IYNYILDLDINSKNYTYTCHETIKFNGNEEKLILSSVNLKIKRIKVNNSIKNFKEFIKNQEIVVDGIITKDSIAEIDFSGEIPEELQGFYRAHTEEGDMFTTQFESTGARRFFPCIDNPSYKAAFDITVRVDEGLEAISNMPVETKENVDGKTVIKFMQTPVMSTYLLYLGIGKFDERSLEFNGNKKLILAAQKGHLTESNYPLEIGKKAIEFYQDYFGIDYPLPKEHLISVPEFAAGAMENWGAITFREIYLNISSSTGSSVKKAVGEVIAHELAHQWFGDLVTMNWWDDLWLNESFATFMSYKAMNKLEVDYDMFADFLVSETAGALEGDSLVNSHPIEVEVKHPDDISQIFDEISYGKGGSILRMINAFVTDDVFKKGLHLYLENFKYKNASGSDLWEFIAKVSDRPVRKVMESFIQNVGYPIIEAKEEGGKIKLTQYRFLLNGKKQNVQWKIPLTAKYAGEVKSILFDSESMEIDLQGFIKLNDSETGFYRVLYSDSLYENIIKNIAILDNKDIFGLLNDSHAFLMAGKLTLQEYLSRINKFMELNDSLIIREISNELFSLYLIDPKNSEILGTNMEYLADKLKILGDKQKSENINISLARGIVANRFATINRGYAEELSKFAGSLEQVDPDMRLAVLTSYAIVHNDSEKMLDMLSKFKQDEDKVKTIQAMAMLTGDNNFNAVEKAISERKIKAQDSLRYYMLAAANPGAKEYIYNNLENIMEKIQAIFAGSGYSSRVIEMVVPFIGLNHMEEIEGKLAKINIQEISRGIKKGMEYLNINHDLVERL

SEQ ID NO: 10923 - protein, 337 aa, Ferroplasma acidarmanus
  unsure (1)..(337): unsure at all Xaa locations
KIKVSLLGATGMVGQKMIKLLADHPYIELVKLSASDSRIGKKYSETVKWIENGSIPEKFRDMKLVSTSPEDNKDVDYVLSALPPEAAEPVELKLVKNGINVISNASPYRLSKDIPLINPEINFEHLRILEGKDTKFVKNPNCTSAIMAMPLVKLLGFDYDRISLVSMQAISGAGFSGLPYMSIDDNIIPYIHGEEEKIPAEISKMYGTVQDGKINGKNIRMSVTSVRVPVKVGHMGVLNMEIKKGVDVEELIKNLNNFSPLKGFNGLYNAPAHPIVVHNEADRPQNAIDTYNGMEVHVGRISYTDESEMVILGNNLVRGAAGITILTLELMEQXIII

SEQ ID NO: 10924 - protein, 258 aa, Ferroplasma acidarmanus
VVKIGGSILKNKEDLNLIKQKLIDCHNCIIVTSALKNVTNMLIEAYETKNTGIIDSIYHMHTDMIQLDNSIISTLAGIREELKKLVVRENSPSLRDHIISYGERMSTLVLYNFFKDNGFNVSYIIEPLLVTDNNYGDSSCLMDETARKIKNCVFGDFTIVPGFYGATIEGKITTVGRGGSDYTAMVLASILNCDVRIITDVPGIMTSDPKLFKNSRTLAEVSLSEVLKMSYFGVKNFNYKTFMPVLGTDINITVESLY

SEQ ID NO: 10925 - protein, 456 aa, Ferroplasma acidarmanus
QELIDKLGKDIILTTKEELIPYMKDASYIKGKMPLAVCLPENADQISSILKICNKFKINVTARSGGTSLTGSSVESFDGIIISTMNLNRLLELDLSSRYVVCEPGVRIDILNAELKKHNFFYPPDPASSRASTIGGSLSTNAGGLRAVRYGATKEWVLGMEVVLPTGEIIRTGEYTLKRSAGYDLTALMIGSEGTLGIITKAILKIEPLPETTAKIMGFYRDILSVGKSMDTIKSQGITPIIAEFMDLPTINSIKKAMGIEVPAYTQYLLMVDIDSAPEALERKLASAKDIMGKFSEDVIVIRDQKRMDEIYAARKGAYSALLEQRDNSNQLIVIGDVIVPSSQLADALGQIEGYARTDGLKTTLFGHIGDGNIHANIFMDNTEEGRKKMAKLQMDIARVAIRHRGSVSAEHGIGTEKNELLYEEYKERNSLYTLEVMRLIKKAFDPNNILNRGKI

SEQ ID NO: 10926 - protein, 369 aa, Ferroplasma acidarmanus
MWFFRSPQIIFGDESLGFLESLSIKRAVIVSDKNIRKAGIVDLVIKNLHGTELLIIDDIPEEPEYRAIAKHLDEINQFKPDYFISVGGGSVIDSSKILFFKYERPDLEFYDVTPLVKLNLRQKSKLISIPTTSGTGSECTWAAVISDEMENRKDELASPEIMPDYAILDPQMVKSLPKTQTINTATDAITHAIEGYTSRWNNPYSDAMAEKAIELIIPSIVKLVKDPENLELRNNVHIGASMAGLSFSNSQIGLAHALGHSLGAMFHVAHGKSVGIFLPGVIKFNYAAAGEKYQRLNLLIPEMYRGKTLYESIVIILKALGQTIRISETGIDEKAFRNNLDKLVSLASESTGIVTNPADASRDDITRLF

SEQ ID NO: 10927 - protein, 240 aa, Ferroplasma acidarmanus
IKDKVCIVTGSGRGIGKAIAIKLAQAGGKIVVNVRTHEDEGMQTLEEVNKASSGILSMADVSTEEGRKKLFRDAIEKLGKPDILINNAGVGILEPFENIDEKHMQLMFNTNLYSPVWLSREFVSKYDNGVIINMASLAGISPFPGLSVYGMTKAALISMTKYLSLEAAGHHIRVNAVAPGVVKTRMGDSLLKIMNLDEKNFSKKFTLTGKLIDPDEVADTVLYLIRNESMTGQVITIDSG

SEQ ID NO: 10928 - protein, 484 aa, Ferroplasma acidarmanus
EYILSIDAGTTNCKAVIFDRSGEITGKSSIRMVSYYPREGWVEQNPYFIISAVKKVISQAIKIAGIDPGDIESAGITNQRETTVIWNRKTGVPIYNAIVWQDRRTENVMRKMENYITVIEEKTGLRPDPYFSAGKIQWLLDNVEGAREKASKGELAFGTVDSWLLFNMAGSGPHATDYTNASRTMLYNIRKLEWDSEMLELFNIPDSLLPDVEPSLNDFGSISISPGKEIPVYAIIGDQQSALFGHAAISKGMAKNTYGTGSFMLANTGNNIPATGSLIGTIAYGLEYKKVSYAVEGSIFSAGSSIDWMKNILNVKSYDKLEEMALKAHSSNAYLVPAFTGLGSPYWDPTARGTIVGLTHSTGRNEMARMAYESVAYQTEDVLQEVKKVTPVKELKVDGGLTRSQFLMQLQSNLSGLNIIKTNTTEITATGSAYIAGLASGFWKLDQLGAMSSTERKFSPDNSSGGAHSGYFGWKQAVAISFGW

SEQ ID NO: 10929 - protein, 622 aa, Ferroplasma acidarmanus
IDRSKNPAKDFYGYCNGKWLEETTIPEDRSRYGAFDMLYEKNMYILKSILEDLKKSSHNSMEKQLGDFYTSAMDTERIEKLKFGPIKGEMDNINNVTKEKLPELFAELTMKSVQIPFDIGSAEDAKNAEIYSLYIGQGGLSLPDRDYYLNEQMKPILDAYKKHIARMFTLYGYTQNDAENTAERVVSLETELAKFSRSKTDLRDVERAYNKYSMEELFQKFPELGFDRYFKIIGSGNMNYAIMDAPEFFEQAGALLKNTAIENIVSYLKWKVLAGSAMFLHKEAVDENFNFFKKTLLGQEKIAPRWRTVVNVVDASIGDSLGQVYVDKHFGKEAVEKITVLVNDIKAIFKERLENNPWMSKETREKALLKFSKFNAKIGYTEKFKDYSSIEINPDDYIGNVERAASFELNRQLKRIGTKVDKTEWYMTPPTVNAYFNPMGNEIVFPAGIMQPPFFDPEMDDAVNYGGIGGVISHEITHGYDDQGSHFDENGNMVNWWTDEDKKRFDEMAEKVVKLYSSVEILPGLNVNGKLTLGENIADLGAVLIAYEALQKRLKAEPAKNIKIDGLTPEQRFFISWGQVWRTKIRDNEARRLATIDPHSPGSVRSELPPWNHPDFCKTFGL

SEQ ID NO: 10930 - protein, 439 aa, Ferroplasma acidarmanus
LDRLPVSKFHTKFLLYVTGGEFIITFLVLLVGSLLAIISEVFHLSTDVSTYIMPTAFYSGMVVGTFAFGRLADIYGRKKIYFVNLLVFAIGAIIAGLMSNYILIGVFMFIAGIGTGAEIPLGDTYISETMTKRNRGRRLALVYTIGVISAPLGAFWLLEMSNINLADSWRIFLIVLGVAALVFQVIRFRMKESPRWLESVGRYKDANNLMNSIEEEVMKEKDISSLPPVENHTEVLKEKPKWIDLFDKKLRKNTIMVIIFQYAQSGVFFGFTALVPTLLIAKGYSLASTFLFSIIIYMGFLVGSLVNLLYIDKLERKIGVCLFVGLAGIFGIIFSIANNSAEIVLFGFIVAFMLWNMSNFFHQYQAEIFPTKLRGSGTGMGQGINAIASASVPTLIVVFVLSHGSLAVFSVLGILVVITIVDIMLFGPKTSQRELESIS

SEQ ID NO: 10931 - protein, 444 aa, Ferroplasma acidarmanus
  unsure (1)..(444): unsure at all Xaa locations
DELPVSPILLKITLLSSMGIFMDGYVLSIYSIAILYMRDYFHLVSGTPFYVYYIAFMGSSLFIGMFFGSIILGNLSDKYGRKKIYEYDLIITMVFLIMSGISTNILEFIIFEILAGVGIGADYPISSSIQAEFSPKNKRGKFLVFNIFSWTIGGIVLLLVAIPVILYIPAAINWRILYLTGAIIPFFVILSRRNLPESPFWLTGKGRDSEALKSSNYLGKSAGMEVDELPVVESGNSKIRDLFSKKYLYYTIFVSVAWFSYDVSSYGVWEYTPSAFAYSNSNIVMVVLATLLEELPVFIGFLICMYYVEKTGRKSLELIGFGGAAVSLIIFAAVSNFIALGILLTFFSFATMHLFHNMGPTNLTYDYPVEIFPTRIRGTAMGFATSVSRIGAIVGTIAFPIILFTLPFTFVLIFLVVFEVIGFSITFLLAPETKGKSLNXPFPG

SEQ ID NO: 10932 - protein, 458 aa, Ferroplasma acidarmanus
NTLNKYNPSTGEVLDTFPAATKDDIDAAMDSAESAFPSWSDMGTQERAKILYKAVELISQKRGELENLLTLEVGKIKREAIDEVDGVIDQIQYYAEFERKLTGDIVEGSSSKRKIFQYKVPYGIVVAITPWNFPAAMVVRKLAPALLTGNTVILKPSSDTPLTANWIVNKFIEAGIPKGVLNFVTGRGSEIGDYIVNHKKVGLVTMTGSTSTGQKIMQNASSNMAKLILELGGKAPFIVWKDADMIRALKSLIWAKYLNVGQSCIAAERLYIHEDIYDKFMSKFVAITKKLTTGDPDTSDVGPLINKNALAGMVQTVNNAKDSGYKILTGGNTPDLQGKYKNGYFFAPTIIENVPQDSGLFQDEIFGPIIGTEKISGVDEMYRKANDSKFGLASYLFTEDPELMLEASEKIRFGELYINMPGPEASQGYHTGFRMTGQAGEGSKYGINEYLKLKNVYV

SEQ ID NO: 10933 - protein, 462 aa, Ferroplasma acidarmanus
KTKIVATLGPASFDESIITKMADKGLATIRINTAHISEGYITDVSRLVYKINEKYNKKLGIMVDLKGPELRTGEFPGGILNITAGNTYGISDNPGVKSDISINYKISDYVDKDTLIAINDGRVRFNVESISNGVITTRAMDTGTIHDRSRVNIPGKYIDLGVLTDRDKMFLEEGLKNNINFYALSFVQSRENVYELQDYIYDRKGQGDIISKIETKSGYDNLESIVKASDFIMVARGDLGVELPLKEVAMAQKRIIDISHKYAVPTIVATQMLESMVNSDSPTRAEVSDVTNAILDDTDAVMLSEETAIGKYPVEAVTYLYEISKYVESQSTSFPEPENFMVDPIAFSVAKGVKIMSNTIDVSSIIAMTRTGHTAKILSAIRPVNDIYAIVQTEWLARSINLMRGVIPVVLPEAQAKEENIYDIINKIAPLGLLNPGEKAIVVSGSPSLYLGGTNNIRVISI

SEQ ID NO: 10934 - protein, 319 aa, Ferroplasma acidarmanus
MYIGSGLENKINSFMEDYGKNISFVSYALKQLYKSKINAISSYKSFLKDGESSKSQKYVNIVIKKLINMEIERDNSVSYIGGGTIGDLIGYSASVYKRGVHLIGIPTTLLAQVDSSIGGKNAINFENLKNAMGTFYNPDVIFADVDFLLGSDPALLRDGIAEAMKMALVKDRRFFNYFTSKNLNSIYNRKSLEYVISKSAKIKLDVVSEDFFDSRKIRYLLNFGHSIGHAIESYTENRVSHGTAVANGMILESYLAYKAGFSEPFYETVRDAVSAYGIPLLDFNTIETDKLVSFIKNDKKVENGKLNMVMLKGPGQAEI

SEQ ID NO: 10935 - protein, 221 aa, Ferroplasma acidarmanus
IYNSLFMDYGIDSMYIAIDLHRKNLPRFFDLSRGNIEGFNITAPYKEESIQFIDYADKIVSDTGSVNLVKNQGGKLYGYNSDYAGFMMLARKNNIDFSGKNVIIMGTGGAARTVAYSIMQNYNSNISIVSRNPGEKKIYGIATTGYNDIKEYDIIINCTPLGTFPDTGMPIPENMIHNGITGIDLVYNPSRTPFLKIVEKNGGIPVNGEDMFIGQGIETLK

SEQ ID NO: 10936 - protein, 398 aa, Ferroplasma acidarmanus
ISGTIYAPSSKSYTQRYVLYSAFSNKPVKIKNVSFSEDEMVSLKIAESCNATINYNRKDIEIKPDFKCPDSIYVGESGTSYRLSIGLLVARKCKTTIKGEQQLAGRPVEPLIKALSDAGTNFKKHKDGFYMVDGRNSASTGVSIDGGTSSQFVSAMLYYYSILGEGNFTVSNMVSANYVNITINCLRNFGITVHNNGNNYSIENGDYAVKEIGIEGDYSSASYFIVLGIFTGNIKIKNLGIDSLQPDRQIIELLNNATECIKIGGNELTVDKANFIKGIIVDASATPDIAPVISVIGIFSTEGVKIYNYQRLKTKESDRWKGIIEMCRAFGATVSVCENFIEIKKGILKDPESIKFTDHRMIMSAIIAGVIAGSHTEFKNAEKINKSYPEFLVDLKRL

SEQ ID NO: 10937 - protein, 144 aa, Ferroplasma acidarmanus
LKIGEQAPDFETIDQDGKNVKLSDFKDSVVVLYFYPKDNTPGCTMEAKNFRDNIDMFTEKGVKVFGVSVDSSESHKKFQEKYNLNFTLLSDKQKDIVKKYGVLGLATAKRVTYIIKDGKIVYVYPKVSPGEHAKEVYEKLQELK

SEQ ID NO: 10938 - protein, 381 aa, Ferroplasma acidarmanus
IGAISIFVASYNIAIISVALKPIENAFQTGTGIVYLLGALIFVGAMIGAIISGVFSDRFGRVSILTIDIVTFIGAGIGSALSTNIAMLMFFRTLVGVGVGIDYVVIFTYISEILATKNSTRNLALIMFFANFGILFSYLIGGTLLTLGSTGWRYALLSGAILAIVPLIMRSRLKESTLWKFKRIKSIKTILKDVTSRENRKYLYRFSIPWFLYQIGDQSLTMFLPFILISALGISVVSGAFSAVLVKAFTIPASIVAFLIIQRLGTRKLQATGFIIRSVFLGILGFGLYFALRFTGIEIIILLGFAFFFGSMGPDKTTVIMPVEKYDESIRGSGQGFNEMAGRFGGLIGILAFALFGMAGIDIGLIFLSITCILGFIITVI

SEQ ID NO: 10939 - protein, 389 aa, Ferroplasma acidarmanus
FRLNVKKSFDYALKDAGMSVKDIDGSVSAYFSDHLQGQLIAGAMSNDFIGLAGKPSKRIEGGGATGGLAFQTAYEEIASGNMDTCLAYGFENMSHVGTWRGNDIIALGSDANFDYPLGGFYTAYYALMATRHMYEFGTTEEQMAMVSVKNHRNAINNPFAQAPMNITVDDVLKSPVVSTPLRMLDICLMSDGAACAILASEEVAKSFSGKPVLISAIGSSSDTMRLADRPFGDVPLLPNENSAMYRGLKYPGVHSFRAGRLAAKMAYDRIGIKNPEKEIDFAELYDAYTSAEIQAYEDMGFCPYGKGGKFIEEGNPELDGSLPVNMEGGLQASGHAIGATGIMQAVYAFWQLQGSMQKHMGNGKLQVKPPSRGLIHSHAGTGAYEAVTI

SEQ ID NO: 10940 - protein, 368 aa, Ferroplasma acidarmanus
LKDEYIMIQQSAKEFAEKEIIPVAAKMDRENFFPRELFRKMGKEGYLGVTIPEQYGGSGSDYVSQAIIEEEISYASGSLGLSYGAHSNLCLDNLYRNGSEYLREKYLEKLCSGEHVGSLGMTEPSSGSDALSMKTSATMDKGNFILNGSKTFITNAPYADIFLVYARTGENITPFVVESSDRGFSRGQEFDKTGMRGSPTGTIFFNDIILPENRIVGKLNGGRNVLLSGLNLERAVLAFNSIGIARRALDLAIGYASERKQFGRPISDFELVQEKLAYMYTKFESSRLFAMEALKRVQEDRMDSLDAASAILYASESSEYIAREALQIFGGYGYIKDFEIERVFRDSILLTIGAGTNEIRKKVISEAL

SEQ ID NO: 10941 - protein, 418 aa, Ferroplasma acidarmanus
ELPHMNLVIIGHVDHGKSTFVGRLLFEHGEIPQHIIDEYKKESEEKGKATFEFAWVMDRFKEERERGVTIDLTHRKFQTDKYYFTIIDAPGHRDFVKNMITGTSQADAAVLVVSAREGDGVMAQTREHAFLARTLGVSQLIVAVNKMDATQPAYSEKRYNEVKEQVTKLLTPIGFKDVPIIPMSGYKGDNIMKNSANLSWWKGPTIMEALNNLKVPAKPTDKPLRIPVEDVYSITGIGTVPVGRVETGVIKINDKVIFLPANKSGEVKSIEEHHTAMQSAEPGDNIGFNVRGIAKNDLKRGDVCGPVSAPPTVVKSFTAQIVVLQHPSVIAAGYKPVFHVHTAQIACRFEEIIKTINPKDGTTLKEKPDFIKAGDIAVVKVIPDKPLVIEKVSEFPQLGRFAIRDMGMTVAAGQCIDL

SEQ ID NO: 10942 - protein, 723 aa, Ferroplasma acidarmanus
VNYNIKLDVDFSGKKYSGIEKIKITDAEKKITLDLNKIDIHKIKVNGADVKFEAGEDGVTFPTNGGDIVAEVQFSSDNDRGLKGFYVAGTEKEYILSTQFEESDARRAFPCIDNPNYKATFDITMAIDKDLQAISNMPVKFETLENNKKVVQFEQTPVMATYLVYLGVGHFDEMEDKYRGKRLALTAMKGHLTESRYPIECAKKSLEYLENYTGIDYMLPKLNLISVPEFAAGAMENWGAITFREILLNIDKSTTSRSYKRTAEVITHELVHMWFGDLVTMKWWNDLWLNESFATFFAFKTVDSTNPDWKFFGDFLLDQTDGAYTMDALKNSHPINADVTDPRSISQLSYEIRYGKGSNVLRMIEAYVGKDVFMKAMRNYLKEFSYSNASGSDLWNAIEKESGMGISTIMEQWISQKGYPYLETAKDGDSLKISQKQFYFLEGDKNSTWKIPLFINRFSSEEKLLMEGNEMKVDGDILSLNFNHNGFYRVLYDDSMFENISRNLSQITAEEKWGLANDLYAFLLSGKINMTTYVRRLEKLYGINENIVIDEISKELFNLYTITDNNYFKDLANFYIKDKMEYVEANRKDDFNFKITLSGLYTKLAYINNDFCKSLLKKYSSYENVDPDFRLAYLVAEAKINQDFSYFADIITNTKNDEDKTKAITASGALEGDKNHSAIMEFVKSGKAKKQDMDSFFVAMASNTPSRQFIIDNLKDIVDMLYK

SEQ ID NO: 10943 - protein, 276 aa, Ferroplasma acidarmanus
MEITFNKVTKKYHKFMALDDVSFNYRDHGAIGYLGPNGAGKTTTLKVMTNLLRPSEGHAELNGIDVNKYPKKALANVGSMIETPTPYPFLTVKESMQFVGELRGIDKKTINSKIDEFYDALKLPPLTSKMGQLSKGQRQRAVFASVLISDPDVVILDEPTSGLDPFERKIFRDFILELKKTKLVFFSSHILSEVSETCDDVIFINHGKILKQGKIDEIAQEFNTNAVSIEFLKPLDNNMIKNIQSLGSGVLKTDGKYAVIKFSGKEDERAQILENA

SEQ ID NO: 10944 - protein, 450 aa, Ferroplasma acidarmanus
KFPDNFMFGTATSPFQVEMGRSDNSISSESDWYKWSHDSNIIQKTYVSGDFPDDGPDFWNNYKRFIDASIDMGNNSIRIGIDWARIFKTSTESVDAVASKNEKGDVYAMSFPDNVIQRMDSIADNDAVKHYVEIMEYIKAKNLKLILTAYHWPLPLWLHDPVKCNQDFANCREKGWGDKATVEEFGKYIYYIYNKFHRYVDIWNTLNEPNIIAINGYVYGNLEGFPPGLSNFSIAVSVMRNLAYAHNIAYKIIKALDHSSQVGINVAVPYFQPEMDTPENRFIVNYVKHIFYDLYLNSALYGNFDNSLSGIFNESRPSEFAGTDFIGIDYYSRIRVRYVDNDNVDLRYRFAFLPCSKCSDNYWDIFPEGIRNVSRSVFNHYRKPVMILENGVADAEGSLRKEFIEKHLIELHKAIKEDYIPVKGYFHWSIVDNYEWARGYKDKFGLYKIN

SEQ ID NO: 10945 - protein, 315 aa, Ferroplasma acidarmanus
FPVERMRRYRLNSNLRDIFSETTINSDKLIMPVFVDETEKSKTAIKSMPGIYRYALNEYEKYIGHLEDIGVKNIIIFGIPKHKDSSGTASYDHDGIVQKAIRSAKSNTKLNVIADLCLCEYTDTGHCGVISNGYVDNDKTLDIYGKEAISYAEAGVDIVAPSGMMDGQVGAIRKAMDSNGYVNTLIMAYSSKFASNLYGPFRDAADSTPQFGDRKSYQMDYRNGDEAMREIDLDVKEGADIIMVKPALFYLDMIYRAKQLYKMPLATYMVSGEYSMVKNAVLSGALAPDTVNEALISLFRAGSDLAITYFAEDYI

SEQ ID NO: 10946 - protein, 279 aa, Ferroplasma acidarmanus
ERIVIALGGNALDNGKSSIDEQIEKASETFLRLSEIINNNEVVITYGNGPQVGEIYDKTGYPLDISGSMSQGLLLHILAMAYGSLKISGKLKKNIVPILTNTVIDENKYTLKPIGPFFDHKIDDTYAMEMNKGYRKMVKSPEPASILEIDSIINLVSNGYLPLAVGGGGVPVEILNKKYMGFQGVIDKDLSSSLLATLLNAKKFIIITDVNNVYLDFKNKSDPINKISYKQMLEYYNKIKFEEGTIKPKILAALRFIEHGGEKVYITSISNIENMESGT

SEQ ID NO: 10947 - protein, 315 aa, Ferroplasma acidarmanus
RIWWGTLHDSCNREKVIEMVRSLLTLKDIEPEEFTEMVNRAVYYKSMIGNKKMVVPVLKGKYAGLLFEKPSTRTRTSFEVASERMGGHALYLSSDQLHLSGGEPVKDVARMLGGWLDIMVARVFAQSTLEELKKYSGIPVINALSDSEHPTQMVSDFLTIMEKKKKFKGLKMTFVGDGTNNMANSLMLACSMTGIDLTIATPDAYQPDASYKAFAEKLGKKAGSAITVTDNVHDSAIGADILYTDVWVSMGEEAERQKRLEDFKGFQINSGLLKLARPDAIVMHCLPAERGLEITDEVIEGKQSVAWQQGVNKIY

SEQ ID NO: 10948 - protein, 740 aa, Ferroplasma acidarmanus
LIIAEKMDAGRRISYILSDKTSKQKKTKNISYIEFERNNEQNIMVSLSGHILGADFPEEFKDWVKSDLDKLIDSNIIYKVTNQRAYSALKSFSGIDNIIIATDYDREGELIGVEALKFIEPGYTNIRRAKFSALTSQEVKDAFDNLLDVNYGLADSAKAREEIDLLWGAVLTRFFSVTSNRLWKDFISVGRVQTPTLALIVEREEEIKSFVPEKYFVINVTFNKGIDFQGVYEKNIKDEDEANKIFNAINGNDGIVKSYKNEKKEVYKPPPFSTTDFLREASRIGVTPSNAMKIAEKLYMSGLISYPRTDNTVYQRSIPLKSIAQKFEGTEFDTEAKMVLGQEKIYPSRGKVETTDHPPIYPVSYPKKALTGAYKNIYELIVRRFLATLYKNAVIEKSDADIDIKGYNFKVSGEKIIDNGWFDIYKYRKLRESKLPELVIGETVKGKKWDMEEKYTEPPKRYDVASLLKLMESLNLGTKSTRHDIIQKLNDRNFATGNPLRPTPLGIGFIKSITTIDSDIAKPDMTAELEKEMDKIAENQKKLDDVVNDSRNMLHSALKGFRGNKEEIKETITSYANKGDSIGTCPLDGGEISLVKFRNFSKIKCSTEGCKINFNLNATGLVQMTDKRCDVCSLPIIKIIRKGQSPEYRCVDPNCEYNRKKLSVGKCPSDDGDLIIRQSRYGKRFLGCSNYPKCTVTYPLPQKGVIMPTGEICRYCGAPLLIMVNGKRKWKFCPNMKCEY

SEQ ID NO: 10949 - protein, 390 aa, Ferroplasma acidarmanus
KITFENGKWKVPDNPTILYTDGDGIGPEIMDVTRKVVDAAVKKAYKNKKIEWKEILVGDKALKEKNDRFPEESQEAIKQYRVLLKSPLGTPIGTGFKSINVRIRVMLDLYSNIRPVSFMKGLESPLKHPENVNLTIFRENTDDLYTGIEYKYDSKEAAEIRKFFKDKLHVEISDDSGIGIKPMSKYKTQRITRAAAKFAIENNKKKITIMHKGNVMKYTEGAFREWAYETLKNEFGNYTSTDDSSKILVNDMIADNMFQQIITRPENYEVILAPNIDGDYISDAAGALIGNIGTLGGANVGDDAGMFEAVHGTAPKYAGQNVADPLGLIRGAQLMIKYLNWHEAFDVIEKAIGEAIETKKVTKDLAKFFDVPAMGTKEFGDSLVKIIDGL

SEQ ID NO: 10950 - protein, 326 aa, Ferroplasma acidarmanus
NEDLITIYSTMIKIRKYEEKLRDIYLSDKKPLFNIAAGKIPGEMHLSAGQEPSAAWMSVLLRNDDFVYSTHRPHHTAIAKGVDLNRMTAEIMGKHGGLSKGKGGHMHIFDKKVNFACAGIVGSSFPSALGAALASKLDGKDSIAVAFGGDGSLNQGMFLESLNLASLWKLPVIFVIENNDWAISVETKDSTPLKNDAIRADGFGMPGVYIENNDPVKMYKAAEKAVKRARSGEGPTLIAIDTYRYYGHFEGDPEVYRPKDQVKELLAKDPIKIMESDLLKKGIISKDEDDRINNSAMEEISQAFAFAEDSPLPVGSDSMDDVYAPV

SEQ ID NO: 10951 - protein, 330 aa, Ferroplasma acidarmanus
KLPVYMAISEAISQEMEGNKDVLYMGEDVGKYGGIFGATTGLFKKFGAERIRDTPISESAFIGSAAGLAAAGKRPIVELMFSDFVGVTLDPIMNQIAKNHYMSGGTVNMPVVITTAVGGGYGDAAQHSQTLYSLFGHLPGLKVVVPSNSYDAKGLMVSAIKDNNPVVYMFHKGLLGLPWMPYPQSTVTEVPEEEYTVPIGKARIAREGKDITIIGIGATVHMAMEAAMELEENGINAEVIDLRSIKPLDTDTVIRSVGKTGSLLVADEDYAAFGLASEITSAVSHALFGKLDKAPESIVSPDVPVPYSQPMEKYWLPDTQKIVNRVMEMF

SEQ ID NO: 10952 - protein, 544 aa, Ferroplasma acidarmanus
MEKKKWFDIWPYYLPFTIDYPEMDIWEMLESPSGLYGNKNALVYYGNRIKYRELWQNVKNLSTYIKMMGFGKGDRIGIMMQNSPQFIISFFAISRSGATIVLMSPALDMETAEYIARDTNLKMVITTAELLKVPWDLHEKFNIPVICGLLKDYIKEPDIPVPEFVLADLDIKGVPWSEAVENRPDAGHIESGADAEALIAYTSGTTGIPKGCVHTNRSVISNAIGASIWRRLTSSAIELGAAPFFHVTGLSFSMLSPVYSGATIAILTRWNSEAAIEAIEKYRVTHFVSVAPMIVDLLNQKNLENRDFSSMRFIGGGGAAMPEILAENMEDLFHIPFVEGYGMTETMGQTHINPPEHRKLQCIGIPQFGYDAKIISTETGTPVEEGTGEIVVTGPSLFTGYLNKPLDTMQAFVDIDGQKYLRTGDIGYMDNEGSFFVVDRLKRMINRAGFKVWPAQVDSLMLKHSDILEACVVGTPDPRNGEEVKAYVVLREPGRNKKISEMEIVEWAKKEIGGYKYPRIVEFIESLPKTATGKVDWRKLQERE

SEQ ID NO: 10953 - protein, 376 aa, Ferroplasma acidarmanus
GFNSRCVHSGDMEIEGVGNVVTPIFENSTFEFPESGVAGKYIYSRWGNPTVESFEKKYADLEKTEHAFAFSTGMAAITSSIMPYLKSGDSVLALNELYGQTFGFFSKVLPQYKINVDFTSVNDLNRLDFKNKNYKLLYLESITNPLLEVPDIVNLSRICKEEGIKLMVDATFATPYNQNPVSLGADMALHSGTKYISGHSDLLIGLAGFNDNYDNLDFYRKTFGGTPDAFQAFLAYRGLKTLGLRMERHNKNAMELAKVLNESSRIEEVYYPGLKNSEYFDVAEKNLKGYGGMVSFKVKGGIENSHKLIKNLNIPKYAVSLGGVESLISIPVEGTHKALSPEERKASGITDNLVRLSVGIEDSEDLLQDFENALEK

SEQ ID NO: 10954 - protein, 681 aa, Ferroplasma acidarmanus
DFFDRYDYNDQINKLRSDYPDIKSLYISYNDLSGYSTDFIEGLMKDPYYYLTIGEFYIKETLGITYNKVRRINIRLVNVPEIIGIKYDIRNVRSSNVNSYISINGIIRKNTEVLPRLQNAAFKCPACGELTIVPEDIQKLFEPTACQACGWNKGKLKLIPEESEFVDTQKLEIQENPDTIDSTSQPQRITLIIEDDITGKIYPGDRVTVYGILKADEKHIGNTMLTEYNIYLNVNNFKKETRDFEEIKINDEDEKKIKELAREPNIIDRLAKSIAPSIYGLDVIKKSLVLQLFGGVRKVMKDGTHIRGDIHILMIGDPGTAKSQLLRYMTFISPRSVFAFGKGSSAAGLTAAAVRDDFGEGRWTLEAGALVLADNGFAAIDELDKMDKNDTASMHEAMEQQSVTISKAGIMATLKSRCSILAAANPRFGRYDPMKTIAEQTEFPPPLLSRFDIIFKLIDTPNREIDDKLAEHVLKTNRLGEIYRSLENNNLEIDIPDEENFIAELDKDLIRKYVSYAKNRVFPRLSDEAISILKEEYVKTRASGIDSVPITARQLESTIRLAEAAAKARLSPIITVEDALLAKGVVDYYLKEVSAMNGQVDIDILNTGISTKQRTELEVILSVIKEAKENSGDQKKAPEIETVIEMLKQKGISRERAETDLARLKSDGFIYEPSNKRVDVI

SEQ ID NO: 10955 - protein, 335 aa, Ferroplasma acidarmanus
MMESRSIKNYVILVTCNRIEIYFRPEEILMGSIEGSLYLEYPESVKHLFMVASGLESMAIGENDILRQIKSSFDIASKRGKLDKFLSYTFRKALSVGKDVRTLTDISHGKTSLSSISLDIIESQYGLAGKKLCIIGTGKMSTALLNYLAGSKTIVTVAGRTIDHARDLAIKYGANYSDIGNIQSLIKSNEIIIAATSSKNYIIRAEDYSTINENKIMIDLSNPPNIEQAMNEYIAFYDLDRIYSISKETREHRKLEIKKAEEIVENELTLYTSKINEMKSDDIIAAFYKFANQIKQDELEELARKTDIKEAQMEIIDIMMNSFTKKLLAPYTDSI

SEQ ID NO: 10956 - protein, 450 aa, Ferroplasma acidarmanus
RTERDVIGEVQIDDSIYYGINTLRAKNNFNISGIKSKDRDHIKAMAIVKKGAAYANYTAGKLQKELYESISKACDRLISGDFDEQFVVDVFQAGAGTSFNMNTNEILANLVLESLNHKKGEYKYAHPNDVINMSQSTNDIYPTMMRVSIMLKSPKLIENAEALIKSLKAKHKEFEKVYKTGRTHLQDAVRVTLGDEFNAWAFAIGRDLKEFKSALDYILELNIGGTAVGNGANTPDGYKEYAVKKISEETGFNFRPGENLMGIMQFMTDFSRVINSLSNMALDLSKISDDLRLLYSGPGAGLHEIVLPAVQQGSSIMPGKINPSIAEAMNMICHSITGSQQAVNLSVKAGQLELNVMMPHIDYEISKSIERLANGIKMLDEEAIQGIKPDLNKIKENIERSFGSAALLNPYLGYDTMAKIVEESLETGKSIKDLVLATGKIDEKKYKEIF

SEQ ID NO: 10957 - protein, 367 aa, Ferroplasma acidarmanus
IEFTDSGMVVPDILTIGYIDGDGIGPEITGAMIGVVNSAIELAYQGSRSIEWHKILIGTEAYEKFGTYVPEDSIKEIQKMYIAMKSTLNFMPDKRDLNTILRKRLGLYSNIRILKYIEGMDIPVNTFNRLNLTIIRDSTPNSHIFYHSSESTDDLIRFISDNYGLNITPDSGIYMMPQSKFRTRKIAKQAVRYSRRNGKKKITILESQQNHEFANWCIEEASAQEDVGYEVLKTREFMKRLISSPEDFEVILVDNVLSQTLVDYLAGTINIEYGSSIGDECAVFEAVQSSLPSEAGYDAADPLSFILSGCEMLMHIGWVEAAQIIENAISAAFRDNKIPKDINTRPDISPIKCSEFSSEIIKRMNGV

SEQ ID NO: 10958 - protein, 349 aa, Ferroplasma acidarmanus
SLGNEIKLTVFGSSHGPYIGGTVDGLPAGLAIDQEFIQKWLDRRKPGQSLITTPRNEDDKIEIIGGSRKGFTDGSPLAFIFKNKDYIDKHYDDLRDNPRPGHADLTMFYKYGEYRNYEGGGFFSGRMTMPLVAAGAFAMGVLKRYNIKIVTYIKSAGGISIDNEPQEDEDYVYGFSTRMPDREKDSLLYNKILESIKNGDSMGSVISTHIYNVPPGIGEPFFNSVESEISRAMFSIPGLKAIEFGSGFKLGNMYGSEANDEFYAENGKILSRTNNSGGILGGITNGMPVVFNIAMKPTSSIRISQKTVNLKSMEPSEVQVKGRHDPFISFRAVPVIQAMAAFVMLDLIM

SEQ ID NO: 10959 - protein, 541 aa, Ferroplasma acidarmanus
MMSGQTPILILKEGTERQQGKNAQKNNIEAAKAIADAVRTTLGPKGMDKMMVDSIGDIIISNDGATILKEMDVDHPTAKMIVEASKSQDTAVGDGTTTVVVFAGELLKQAEALLDQGVHSTIIADGYHLAAEEARKQLLAMSVSAKDDAMLRKIAITALSGKNTGVAPEFLADLVVNAINSVTETDGDKIIVDTANIKVDKKSGGSAADTKFINGLIIDKEKVHSKMPSVVKNAKIALINSALEIKKTEIDAKVQITDPSKIQEFLDQESDTLKEMAEKIKKSGANVVLCQKGIDDTVQYYLAKYGIYGVRRVKQSDMEKLAKATGAKMITDLDDITEETMGKAETVEERKIGDDRMTFVTGCKNPKAVNILIRGGTEHVVDEIDRSLNDAIRVVAITKEDGRYLPGGGATEAELAMKLRSYSNSVGGREQLSIEAFAKALEIIPRTLAENAGMDPINTLISLKSEHEKGNKNFGVDMEANKITDMIKAGVFDTFRVKTHAISSAVEVATMILRIDDVIASKKSSAPQGGAGGMGGGMPPG

SEQ ID NO: 10960 - protein, 301 aa, Ferroplasma acidarmanus
  unsure (1)..(301): unsure at all Xaa locations
RDILSVADMENDFDQIIDTSIKLKKDKTIKFSDKKLLGMIFEKPSTRTRISLEAAMEQLNGHAIYLSPHEMHLGDGETIADTARVMSRFLDIISYRAYDYRNVRELAKYADVPVLNALDNMEHPLQIVADFMTIMEKKHRLENLKLAYVGDGNNVSNSLLLGAALTGMDISVACPEHREPDRDILYRAKDLALKTGSRIEILRDARTAVDSADIIYTDVWVSMGEEKEKDQKEKLFKGYQVNEELADFADKNYIFMHCLPARRGLEVTDEIIEGIHSVVFDEAENRLYSEKGVIYTVLSXI

SEQ ID NO: 10961 - protein, 311 aa, Ferroplasma acidarmanus
DKINEVNSRLLQAIKTDQPYLFEMSKYTIDAGGKRFRPLLTILSYEISCNEPYDSILDLASGYELIHTASLIHDDIIDKSKYRRGRETLASRYGIDNAIVVGDYLFAKAYELGSRYGKVVSKVMADGSSHLAEGQIIEALNIGNLSLDIETYNKIIMNKTAYFFSACAEGATIAAMAPDNVRDKLSKFAYNMGMAFQITDDILDIVGNEKEMGKPTMVDLNHDVITLPIIHALSHVTGENKRTLVNILTGKYTDSDYKSKFRDILFKSGSLEYTFKIAKDYILKSVENLNGIGRSDDLGLLMDLALIVVDR

SEQ ID NO: 10962 - protein, 246 aa, Ferroplasma acidarmanus
KLDNKIVLITGSSRGLGKAIAMKFASEGARIAINYNRDQKSAMELKNMLAGSEIFQADVSDHAAVRNMVNEIHRKMGTIDILVNNAGILSAITWDEFDDARVKKIFDVNLMGPVYTTRECIEDLKKQHGIIINLASNAGVGTAAKGTTFYSMTKAAITMLTKRLAFDLMDWHVRVNAIAPGWIESDMTIGGKSEEEVNNLRQSFKSKTELGMTGKPENIADAAIFLASNESEYMDGQVLVVDGGRI

SEQ ID NO: 10963 - protein, 199 aa, Ferroplasma acidarmanus
GIDEAGRGPLIGPMVMAILCGDRESLEIIGVADSKKLSPGRRESLFARLQSYKYNFVIISPSEIDRYVEHQKLNVLEETYASKLASWAPASSTVYVDSFDVNELRLQSLLMENTKRQIVCRHKADEIYPCVSAASIIAKVIRDREIDKLHKDYGDFGSGYPSDPRTINFVKNALKNGINIDSIVRHQWKTYKSMLNKKL

SEQ ID NO: 10964 - protein, 605 aa, Ferroplasma acidarmanus
REWQDALISTVSKNLEEKNKIAIEAPTGSGKTSFILYLAFITGKKLIYLTRTHNEFTRLYEDNQKYFNIPALYLYGKSKLCPLKERWYDSEDDGQKNVCKGCPLKDKTIKLDLKNIRSPESFLEDIEADSTELIRQDVESKALGRDTKGNLVTIKKENVKSYCPYYSVRSNMADAQIIAMTYNYLLNPSIRFNVFHGTEGEEMIDLNECYIVFDEAHNLDSVIENFGRTLQIKTVEKAIDMLVKDFPIETYNSYDRIEANLMLENLLSNMSSTRGTDSLKLFKFSNDFASRIANLESLRTFSDEFEEKNENRPLNKRSRNYLENVYNFLYDYQRMENGSVYSTINNPEKKDLKLKLMYYDTSGYLSFLRDNSVIFMSGTMPSVDHISKVWNMENVLYLKVDSIFKNAGGLKQYHIVNGYTTLGRYRENLDDWAEMLRKYMQFAIDVYSKSDKSVLVAVPSYRILFGDTYTKTPGIGNYLPESMRANCVFENKKISYSYIEKKAKERKIIIFSVHGGKLLEGIQLVNRGKSLISDVIIAGLPLIPLDDYRKDKIKYLEKVLKKNAYNLLYYEFALIKVKQAAGRSTRSPEDTSSIWLCDDRFDEPF

SEQ ID NO: 10965 - protein, 587 aa, Ferroplasma acidarmanus
  unsure (1)..(587): unsure at all Xaa locations
MLFSEASKKFMEMESTTKRLELTSILGSLLENAGDDLKELVYLIQGKLAPDYEGIEFGVSGKLIVKSLAAISGMDEEEVNKLFYKNGDLGITASEIREKMEQKPLFREDLTVHYVYTRLMELAKSAGHGSVKGKTDIYADLMVNSYPEDIKYITRIIMGKLRLGVADSTILDSLVHAFSSKDNADMVETAYNFHPDIGLIATLLQKGDIKAISNIGPEPLIPFKVMLAERLRSIDDIREKMNHHVSFEYKYDGLRTELHKKGDKIKIFSRGLEETTENFPDIIENFKKSYSFESIIIDGESVPFNPDTGELFPFQMVSKRRGRKYQITEKSTEIPLVMFIFDILELNGRTLVNLPYEERRKILEENFVDNEHFRLATRLSSDDSEEINKFFEQSIEDGCEGIVAKDTSDESVYRAGARGWLWIKFKRDYQKELADSMDLVIIGAFNGRGRRAGAYGALLMASYNEETHAFESVTKLGTGFSDEVLFSLPKMLSDLVRDHKPAMVESKMVPDIWIYPQIVMEIQGAEITVSPIHTCAFGKIEKDSGLALRFPRLIKIRDDKNAEDATTTNEIIELYKMQKKTKXIKKS

SEQ ID NO: 10966 - protein, 315 aa, Ferroplasma acidarmanus
IEKIGIIGAGAMGSSIAEVFAFNGYSVYLKDQNMEYVNRGISHVRKVLDDYQSYMDSMPDKEIKRIERNGIELTETQKNTIKKNLGKQLDIDGIISNIHPVESYKELSQCGLVIEAVFEKQEIKNDLFRELSSYFGENTILASNTSSLSITEMAANYKYPENNIIIHFFNPPYTMPLVEIVPALQTGSKTVETAYSLISGLRNHRDAMVPVKAKERSGFIVNRILIQLINEAIKIVEEGIADEKSVDIGMKKGAGFPMGPFELGDYVGLDIVYDVLKSFNKAYGDAYIPPERLKNMVIAGYLGRKTGKGFYEYTK

SEQ ID NO: 10967 - protein, 305 aa, Ferroplasma acidarmanus
KISIIGAGAVGASVAQVLAIKNIADISIFDIVEGVAEGKALDIQEGAPHFGFDCKLQGFCTQDPKEYANLKGSDVIVVTAGLARRPGMSRDDLLVKNIGIMKDVGEQIKKYSPDSIIVAVTNPADIMAYALQKASGISPERIIGLGGSLDSSRFRTFLAEALNVSVRDVNAFVIGGHGDDMVPFIHYSSVSGIPISDLLSEEKIQEIIKRTRFGGGEILNLYKTGTAFYAPSISISVMVESVVNDQHRVIPCAAYLTGKHAENYKVSNAFIGVPIKIGKNGVEEIYDLKFSEADAKEWMKSVESV

SEQ ID NO: 10968 - protein, 564 aa, Ferroplasma acidarmanus
MEKKEYDAVILGGGLAGLMAANMVAAGGFTVAVVSKVFPTRSHSSAAEGGIAAYIMGNSDPNDDPDFMSYDEVKGGDYLVDQDAAELLSKKSGEIVNLLDAWGAPFNRQPDGRIALRYFGGQTYPRTRFIADKTGMALLHTLFEHSTGFKNIDFYNEYYVLDIAREGDSVNGLVAMEMKTLDPIYLKSRALLIASGGIGMMYKHSTNSYINTGDGHGIALRSGVALKDPEFVQFHPTGLYPSDILISEAARAEGAILKNNKGERFMARYAPHKFDLAPRDIVSRSMAIEIREGRGFEGGYLGLDLRHLGKKYILERLTLAYDAAKNFSGVDAAEEMIPVRPAQHYFMGGIDVDITGTNHDLKGVFAAGEAACVSVHGANRLGSNSLLETLVYGRETGNAMVEYLKSHKKIESNSDVDKLVDNAYAYIKRESGEHFGVLTEELRDIMWDNVGIFRDNDKLAQAISKIKDLRTRSRSMYVTDKSTNYNTELFNALETRNMIDVAYAMATGALNRTETRGAHFRDDFPERNDKDWMKHTITYLAGDEIKISYKPVTYTRWKPEPRVY

SEQ ID NO: 10969 - protein, 309 aa, Ferroplasma acidarmanus
EEKEITVNVKKYNEKDGAFWKSYKLSVDKYTQMTEVLRRIKSEQDPSLAYRASCHMAVCGSCSMKINGVPSLACRTIALQATDEKNEINLESMDYYPGVRDLITDIDVFYDKMYKVMPRLVADNSVLSGENEQRMTPEDQTEVWKFEECIYCGLCVSACPSVKEDEKFLGPAAHAKGFRFVDDERDTKRQERLDILMDSAYRCTSCYMCYEVCPQDVQPVIAIKKTKNYLDEYKGNTAITVAARKHDDAIENLIASTGKIKESTLFLKSFGYGEAMRDAVDMLKAGKFKYAFEKDSKVKNMDEIKKLMG

SEQ ID NO: 10970 - protein, 288 aa, Ferroplasma acidarmanus
  unsure (1)..(288): unsure at all Xaa locations
NKMVIISKETKVIVQGMTGHQGAFHSGEMIKFGTNVVAGVSPGKAGTKVNGVDVYNNVADTLDLKPDASMISVPAPFVKDAALEAIENGIKLIYILTEHVPVHDTMELYHEARRKGVFMIGPNSPGITVAGQAKIGIMPNNIFRVGNVAVASRSGTLTYEIVKAVTDAGFGESTVIGLGGDPIIGTTFSDIIKIFNEDPQTKQIVLVGEIGGSEEEKAAEYIKKYVKKPVTGYITGISAPPGKKMGHAGAIIEKGTGTADSKIKAFKDAGIKVANYPDDIPSLLQKXL

SEQ ID NO: 10971 - protein, 362 aa, Ferroplasma acidarmanus
MNLYEYMGKEIFKKYGIPVPDGYVIENVGELRKFEYPVAIKSQILSGKRGKAGGIKFARNSNELSEFSDKLLNSTINNLTVKKLLIERMLNIKKEIYLSITLDRATKEPVIILSADGGMEIESVPEENIHKIHIDPMVGYSDYIAREALSYIPVENKKQFSNLLSSLYKAFVGEDALLTEINPLVIDAENNIIAGDSKVIIDDNALYRHKDYMITDPDKTALENEAASKSFTFIEMDGDIGVIANGAGLTMATMDSLTLHKLKPRNFLDLGGTDNIEIVEDAFSFVMRARPKLIFVNIFGGVTKADTVANGIVSSKKKFDIKQPIVVRLSGVHEEEGQKILLESGIKAFTNMTDAVKELSRI

SEQ ID NO: 10972 - protein, 259 aa, Ferroplasma acidarmanus
KTSTIGMGTYYDMRWIFKTYLGIYSGRDQKIDAYRAGIDNGINLIDTAELYRTEKLVGTAIKSYKRDELFLASKVFPTHLSPKSLEKALNRSLKNLDTDYIDLYQIHFPNPTVDIKKTLRTMEKMVDKGKIRHIGVSNFTLNLLKRAQGILSKYEITSIQINYNVFHRNSQKGMIDYCNKNHIAVMAYFPLGHGKVTQPQFNKYFDHVRKTIGDVPNANIALAYLISRNQNVFPIPRASNRAHVLQNAKNSDILLNEDD

SEQ ID NO: 10973 - protein, 364 aa, Ferroplasma acidarmanus
SFENMDISENLKKSLGLMKFTEPTEIQEKAIPVVLTGKDVIIRSKTGSGKTAAYLLPVLNSVEKLKGKSVKAIIILPTRELALQTHRVASRLGKISGIKSTIVYGGASIIRQVEELPGSDIVIGTPGRILDLYNQKYLKLDHVKYLVLDEADLMLDMGFIDDIKKIISFTPEGRQTILLSATLPAEVKTIANHFMNNPEFVDAGGDEAIPSSIKHLYTVSEKFDKFSTLMSYIHSYNSRKAIVFVKTQRSGDLLNLILSRSGFNNVLIHGGMKQHARERSIADFRHIDSGILVATNVAARGLDIPNITDIINFDAPDSTETYAHRVGRSGRMGKDGRAMTIFDPSQKSLIQSIQRRNRIKMEKI

SEQ ID NO: 10974 - protein, 831 aa, Ferroplasma acidarmanus
KNMNINGRNLKYFPLAQLAGKYDIENLPYSLKILLENVLRNYDGVDIDERSIENIANMKSGSEMAFKPSRVVFQDYTGVPILVDLAAMREYYKENKLNADDVNPATKSDLVIDHSIIVDSFRGEEPIILNMKDEFERNVERYDFLKWSQQSFKNVRIVPPGHGIVHQINLEYLSSVAVIEKDEIFPESLIGADSHTTMIGGIGVLGWGVGGLEAEASMLNEPYFMNVPDVVGVNIKGTMPTGVTPTDVVLYITKTLRSKNVVGKFVEFYGNISELTAQDRATISNMAPEYGATIGYFPVDSETLKYLKGTNRSTESVEKYFKEQGLFYNGPKKYTETVEIDLSKIKSAVAGPKNPDELINIEDLKGKIEDLLKEGNDGKLVKNGAVVLSAITSCTNTSDPFVLLGAGLIAKKAIEHNLTVANTIKVSLAPGSKVVTEYLEKAGLMKYLNRLGFELVGYGCTTCIGNAGPLIPEVQDDMLKNNVKTFAVLSGNRNFEGRINPYIAGAFLASPMLVVAFAIAGKMNIDLINEPIGNDNGKPVYLKDLWPTNDEIKEYFHLAMDPEVYKKEYGDVFKGDNNWESMKSSKGLLFDFKEDSSYIKMPPWMYMEPVTDIKNGRILAVFGDKITTDHISPAGPIAKDSVAGKYLASMGITEMNTFGARRGNHEVMLRGGFSNTKIRNLMVSHAGGSTIYYPDGQEMSIYDAAMKYMKNKTPLVIFAGKQYGSGSSRDWAAKVTALLGVKAVVAESFERIHRSNLVDMGIVPVQVDKLPDLKGDEVVNIDGINNISIGKELNISINGKTLKGKALINTNAELNYVKTGNILKYIALSAK

SEQ ID NO: 10975 - protein, 273 aa, Ferroplasma acidarmanus
ITPVITPFTDNKVDKDKAVKHGEDVIKGGMKYLFPGGTTGLGPSMASGEKLQLLDAYAHIPEHVILQVGSLNLEESINLAREAKKYKIHAVAALPPYYFTGIKREWLIKYYTKISSEYPTIIYNYPETTGYNITYDMVNDIKKAGGDVIGIKETTFNMNDILNTKMYVPDFKVYTGPDQYILSAYRLGLDGFVSGASNYGYKVINKIIENHDNKDGDRYQFLLNELADLSRKYGTISSIYDMVEIMTGIDAGNPREPFFKLSKEERSSLEKEM

SEQ ID NO: 10976 - protein, 499 aa, Ferroplasma acidarmanus
SKRSDPFITYFKNIMTYGEFEGYSNAVAVEFSMYCDPGDIIAIIAENIPQFPIVQYASWKNSCIFVPLSPLDSENEITGKIKFIDARVVVISSEFREKFSSLMEIQSLHVLYTDPQTFGKLPDNMAEKYITGIMKEELNLRLKKEFKGYYPEPGSIAMLVFTSGTSGRQKAAEITHSNIYSASYIYREWYSVQPHDKNLCIAPFFHITGLIFGISLTMLSHSSMALTYRFNPENALETVESENTTITMFVATAYRAMINAWSNVDKIKTRLSSMRMWSAGGMPMPYKTEIEWKAMSGKWVYMAYGLTESTSPVALWEYPYTDNIPLYNGIVTAGKPANYTRIVRARGGELVVSGPQVIRRYYKNPEDTEKAFGKYGLKTGDICYIDRKGYIYIIDRKKDLIDVSGYKVVPAEVENAIRSCDHVEDVVVVGENDEYKGEVPVAYVKLSSVPDNYEEMKKSIYSVCKKELARYKVPARIIFVRDMPLNASGKIKRSGIHSV

SEQ ID NO: 10977 - protein, 237 aa, Ferroplasma acidarmanus
MSGKIVITGSNRGIGRSIAEKMASEKYGIIMVDYDNAVLDSAKSLNSRYGNVEGIKCDVSSYDACVEAFSTIDKKEIYGIVNNAGINRDALFKNMSFDQWDAVIKTDLYSMFNVTKQFVDSMIENLSGRIVNISSASWNGNVGQANYSSAKAGVIGFTKTLSRELGRYNITSNAIVPGFIKTPMTDQMPEKIKEKFIEKIPLKRMGSGDDVANAVSFLMKEDSNYVNGILLEVGGGM

SEQ ID NO: 10978 - protein, 262 aa, Ferroplasma acidarmanus
  unsure (1)..(262): unsure at all Xaa locations
LRLXIMKAAIIGAGTVGRSIGEGIKNDFEVSFSSGSFEKLEKWSKGEFKIFDNNVENAKYGDVILLAIKPGISDSVMEEIRSAAKGKLVISFMAGITLSHMQEMLKDSMVARGMPSIPMLVQKSVTAYSYKNLDKEHKDVLEKVLKGFGSAVHIDESYMDAVTGLSGSGPAFVAIMADSMINAGILAGIPKIQARELVIDTFINTMSLMREKGFSASDLRDEVMTPGGTTVAGIYEMEKANARTAIANAVLGSYRRAKEISK

SEQ ID NO: 10979 - protein, 327 aa, Ferroplasma acidarmanus
IMDVSLVGLGHIGKAVVGILNENHEYFKTRFGSDIHVISVSDSKTTVYDKNGLNLDKVLMYKERGELDEVADVMKMEDIYSLNSDVIVDMSPATKDGLAGMRMYKNAFDSGKQVVTCNKAPLALHWKEIMESSRKQKKNILYESAVGGGVPLFNLNRYSLKSSKLLEFKGQVSSTINFVLNHLMGNVDFHEAIKTAQSMGIAETDYHDDTNGLDGARKTVIIANALLGLDYTLKDVEYDGIENLDNIEYMRNSGEVYRVLSHITAGTNPIIESKIFSIKPGDSMAAMDSLSMGYLEKTDNNDDLMVFEKHDGPLETAAQVVNDILLL

SEQ ID NO: 10980 - protein, 541 aa, Ferroplasma acidarmanus
MQQEIRKQVIKNAYMHGGKADISSVVGKLISINPDAKKDMKTLMGTIRKYVDEVNAMGADQLEEIVNTEYPDILIKEKKEERHELPDLPGVNGSVVMRMAPSPSGPLHIGHSRMAILNDEYVKRYGGKLILRIEDTNPGNIDPDAYTMIPEDLKWLGVDVTETVIQSSRMEFYYSEAKRMISEGYMYVIEENQQEFHDLKLKKVPVKERDADPSVNLEKFDKMISGHYSEGEAALVMKTDINHPNPSIRDWIAFRINTTEHPLTGSKYSVYPTMNFSVSVDDHYLGLTHVIRGIDHLVNTEKQKYVFMYNNWKIPEYFHYGFITIPDTILKTTIIKEGIKSGKYSGWDDIRLGTLKALKKRGYNPETFRKYWVRSGMNKSNATFSWEIFDSMDREIIDYNTERYSFVPHPELISLQNAEPLKSHALLHPQRPDSGFREYSIPAQASVYFPGDEIDKINEGEVIRLKDLCVAVKKGNKLVYSNIEPEGRVKIIQWAPENSGDLQIFYPDGNIDKGKLEPLATEKRGVVQLERYGYVNLDGKN

SEQ ID NO: 10981 - protein, 286 aa, Ferroplasma acidarmanus
MKFLAFFGHLNIDVTLSVPSLPSPGQATGVKALREKFAGTAGNFAYVANALGLKFDLYSAVGEISHEKYLANLKKVGINTEHVDIMKEENGPICYLPSDGREQIAYMFQGPMNNWEASKHFEYGNYTFLNIGTGPVKEYMKILDREKKAKVVFDPGQEIWYTYNKESAEYMVNHSNMIIMNRKEFYHLLELLNTDSAAVYKTVNNIIITEGEKGATLIENGESTLMPGIKPDRIADTIGAGDSFRAGLFTALSNGYTLKDSVSIGNITASKAIENNINEFNLNFQD

SEQ ID NO: 10982 - protein, 400 aa, Ferroplasma acidarmanus
VESIEITDSRITKIFDSRGNPAIEATIILNYATGTSSAPAGASTGKTEVIAYPKNNIDNSVDFYNKHVRNALKGFNALNQSGFDTLLHELDGTDNFSEMGGNLATALSIANAKAVSNYLEIPLYRYVGGLHPQIPRPMGNIIGGGKHSKNGTTIQEFLVSSQGKTFYDSVYYNILVHRRVGEKLSEKLKGQSVGLGDEKAWTADVSDEEAIEIMKEAAGEISSENKVKIYLGVDFAADSFYNNGKYDYKTSKKTQDEQIDYAVSLNKEHGFYFIEDPLYDNDFEGFAEITKKIGEDSLIVGDDLYTTNSARIQKGIDMKSTNAVLIKVNQIGTLSDTVKSVKLATKNSMDTVVSHRSGETTDDFIAHLAVAFNSKFIKTGTIGGERLAKLNEVIRLEEDL

SEQ ID NO: 10983 - protein, 574 aa, Ferroplasma acidarmanus
  unsure (1)..(574): unsure at all Xaa locations
LNATAREIRKEIIKMVYSAKSGHPGGSLSIADVITALYFKEMNIDPEKPDKPDRDILIMSKGHASPAEYAALALRGYFPVELLEGFRKVNSKLEGHVHRGIPGVESSTGSLGQGLGVAIGFALSSKLDSKTNKIYAILGDGEMEEGNIWESLMAASKYHLGNLTAILDRNMIQLDGFTEDIMPLGNVAEKVAPFGWEVITINGNNMDEVVNALEYAKKPRDRPLFIVANTIKGKGVSYMENNPKYHGSPPANEEEYVQALKEIEGSQXMEKMDRMESLRDAYGKELASLGEKNKDIVVLDADLSSSTKTGVFGKKFPERFFNMGISEQSMVSAAAGLSLAGKTVFASTFAVFLSNTYNVIRQSICYNEAPVNFVVTHSGISLGEDGPTHQILEDVGIMSGLPNMKVIVPVDSIETVSVIDYLAARKTSPYYVRLTREKFPVLNDENYEFKEGKSVTFRDGSDVTIMGYGIMVSFALKAAEQLKNRGIDARVINMSSIKPLDRPAIIKAARETGKIVTAEEHSIYNGLGSRVAEVTSEEYPVPVMRIGMPDIFGKSGKGMELFDYFHIGVNDIVE

SEQ ID NO: 10984 - protein, 215 aa, Ferroplasma acidarmanus
MKIFIDTANIEEIKEANEFGLIDGVTTNPSLIMKASKGGKSFKAIATEILREVNGPVSLEVVAEKAEDMVEQALKLHALGSNAVIKIPMTLQGLKAMKILKEKEIKVNTTLIFNAIQALLAAKNGAAFVSPFVGRLDDIGEDGMAIIDQIKTEYTNYGYKTEVLVASIRNPVHVLRAALMGADAVTIPYDVIKKLAMHPKTDEGLNRFLDDWKKV

SEQ ID NO: 10985 - protein, 209 aa, Ferroplasma acidarmanus
EVLKTGTTTLGITAGDYVIMGTDSRATMGNFISNKNAQKLYKIDTYAGMTIAGLVGDAQVLVRYMRAEMELYRVQRKINMPIEAAATLLSNMLNQSKYYPYMVQLLVGGFDKKPHIFSIDAAGGSVEDEYASTGSGSPFVYGVLEAEYQPNMKLDDAINLAIKAISVAKQRDSASGNMLQIGVIDPEKGFNYLSEDDILSRMKKLKLTL

SEQ ID NO: 10986 - protein, 656 aa, Ferroplasma acidarmanus
  unsure (1)..(656): unsure at all Xaa locations
MKSICPFCGVGCGLELMAVNNIVVGVKPVPEHVVSRGHLCGKGSVAHEALTAWDRLYYPLKKVKGELERTSWEDSIKYTIESIKNIQKKYGKDSVAFYGGCQNSLEEVYLLQKLARALGTNNVDSCARVCHDPSAKALKEIVGVGAGSNSATEIPKAKVVVVAGESVTDSHPVLIQYFLEAKEKGTKIILIDPRNTRFASFADLHLKIKPRSDIFLFNAVANYLIQNNMIKPDFIAARTEGYEKYKENVSKYTLELAVEQTGLAEKDIIEFAKYISEDKVIFSWGLGLTESTGTKGIKSYLSLPLLTGNMGKEGAGVIVYRGQTNVQGSGDLIKPDVFPNGEMNEANSEALSRIWGFKPPVNKGSSIIDTFYGSKNIKALFIMGYNPVRSLPNRKKVKEFLGSLELLVVQDIFMTDTARYADIVLPAAAWAEKEGSVASLDRLVKWRFKAVDPPGMARPDYEILSDLAKAAGYNFNSNPKELFEELKTAAPLYSHLNIDDVMDYSKDSRYPNGELHLYGEKFSTKSGKAQFIPVDSEKHNDGLILVTGRTVTRYNSDEVINRVPGMQEYNPTLWVNPSDAKNLGIENEDMVKLASKSGELDIIAKITDDVIPGVVFTYMHNPKINDIVSPEFDDETKTPKYKYTPVTVTKXKNSXY

SEQ ID NO: 10987 - protein, 534 aa, Ferroplasma acidarmanus
GQPIFILKEGTKRESGKDAMFENIDAAKAIATSIRSTLGPRGMDKMLVDSLGDIVITNDGVTILKEMDVEHPAAKMMVEVSKTQDSYVGDGTTTAVIIAGALLDQAQSLVKQNVHPTVITEGYKTAAAQASRVLEEISRPVTLKDKEILIKMAKTSLNSKSASVEKELLGTISYNAIKTIAEERDGKYLVDFDNLQVVKKNGGEINQTELIDGIILDKEKVHPNMPKLVKNAKIALLDLALEIKKPEFDTNLQINDPSMIQKFLGQEEDVLKEMVDKIKATGANVVITQKGIDDMAQHYLSKAGIYAVRRVKKSDVDKIAKATGATIVSSLEEIVASDLGAADAVEERKIGDDYMTFVTGSKNPKAISLLIRAGTEHVADEIERSITDSLHVVAAAVEDGAYTTGGGSAAEEIAFNLRSYATKVGGRQQLAIEKFADALEEIPRALAENAGLDPIDILIKIRSEHANGHKTFGVNVFSGNVEDMEKAGVIEPIRIGKQAVEASTEAAVMILRIDDVIATKSSKGGSPGGAGGMP

SEQ ID NO: 10988 - protein, 374 aa, Ferroplasma acidarmanus
MEIEEYVKNILNDIKSGGIDAVSEYSKKFDGYGMPFKVPESEFAEANELIPEYQKDIINRTYKRIYENHAIQYNNDKVRFSRGSIYGIRYTPIERIGMYIPGKKPLPSTVMMIGIPAKIAGVRDIVIVSAPESNGRVNPYTLYIAGLLGIHEVYRIGGVQAIGSMAYGIGMKKVDKIFGPGNSYVNEAKRQVYGFTGIDGLYGPSEVMVISDGTAKDEYILADLNSQLEHGITSKAWLLTTGKAISTAGNERIGVMVFENMDELISKANEIAPEHMEIQAKDPMEIFTRIKNAGAIYIGEYAPVPAGDYFLGVNHLLPTGGTSRFSSALTVDDFMKKTSFASVSREDFMADRELGLELAKIEGMPLHYKSMEAR

SEQ ID NO: 10989 - protein, 174 aa, Ferroplasma acidarmanus
IRETKETVIEVDIGSESTVIETGDKILDHMMRTLFFYMGRNAKIKCSYDLRHHLWEDLGITIAMELTALKGEKPVKRFGSATMPMDESLIMVSLDISRAYINFQVDFRDAEGFELNLLYEFLWALARTMPMTLHVIKFSGINSHHITENVFKALGAALGNALEGTEYTRSTKGI

SEQ ID NO: 10990 - protein, 250 aa, Ferroplasma acidarmanus
MLAKRIIGALDIAGDRVVKGVNFENVKDSGDPIQLAKRYESEGIDELVFLDIRATREKRNIMNMLVERVASEIYIPFTVGGGLTDIETMVKIIRNGADRIFINTYAVEHPEIIGKISDRIGSANTVIAIDSGRHNGNYYVYTHGGTLNAGIDAISWAQKAESLGAGELLVTSINTDGTKKGFDTDLIRKITGSVNIPVIASGGAGSPEDFLGVFQAGADGALAASIFHEGKYTANEIKKYLKGNGVNVRL

SEQ ID NO: 10991 - protein, 196 aa, Ferroplasma acidarmanus
DLKFEGLMPVVVQDSETKEVLTLAYMDGEAYRKSMETGLMHYYSRSKQRVRMKGEASGNIQEIKDVKIDCDNDSLLFMVKQKGAACHLGTKSCFREIATPAVAGNINYSLEVLLELESLIAKTKNTPRKNSYTTELFESGEENIKKKVGEEAVESILAQGKDRIVYETADLLYHLLVFLSYENIKLSDIMDELSKR

SEQ ID NO: 10992 - protein, 431 aa, Ferroplasma acidarmanus
LSAMGYFLDGYDLSVISVFTLVLVTFKPFHYDPFTESFVTGAALLGAFVGAVIFGHFADNIGRRYLYIFDLIFFAVFAILSALSTNIYEMIIFRFFVGWGVGADYALSPVYTTEMYPDKKRGAGYGWVWTFWSIGAGAAFAIGYVFYMINPLVGWRYTLAIGAIPAIVTVVLRTRMPESVRWDILEPGKSKLSAKDLDSIAERVGITKEDIKAIIAEREKEENIAAGSFTALFKGEYGKRTAIIWFQWILYDIAGYGIGLYSPIILTTLGISHSSSLLFSLIFNMPVGFLGAFGAVMLNDRLGRRPLQALGFGGMAIAMAMFFIASSAIASIGIIIGIAAFVIDYGIGNLGPGDTMGLYAIELLPTKLRSSSMGGATGITRIASFLAAFMFPLISASLGKSSFFFILLGLMVLAFVFTIFFTPETKGLTLE

SEQ ID NO: 10993 - protein, 447 aa, Ferroplasma acidarmanus
MIVSPLDYRYGRDNVKNIFSEETRLNIMLNVEAAIAQAESYYGIIPEEAYADIRKVVDNNEVKIGRVKEIEAIINHDVMSIVEGLTEKCTTGKNYVHFGVTSNDINDSASAVQMKRAISIIISDLEDLGKALVSRIKENEETIMVGRTHGQHASPITLGLKFAVYLSEIGRHLERIQEARKRIIAGKILGPVGTGAALGKNALKIQEKTCEILGITHETASTQIVGRDRYIEYLSIINNISVSMEKFATEIRNLQRPEIYELSEYFDSDKQVGSSSMPSKRNPIVSENIVSLARLTRSFIIPEYEAGVQWHERDLTNSALERFTIPYVSILADDIITKMTGVFSHLFINREEMKKRAYGDEFIMSESVTTTLTENGMPRQDAHEFVREASMHAYKQKKTLKETLVDMGILNHISEKILDRAMEPENFLGVSKEICEDAIKNFDNLQK

SEQ ID NO: 10994 - protein, 369 aa, Ferroplasma acidarmanus
EEISPGLENVYIKYTELTFIDGQKGIMRYRGYDINELAEKSSFEKVSYLMLFGKFPDDSELKNFQNKINSHLALDDYLKDILRAMPETSDSLGILQTLLSAKASKESNYKYTKENDGEKIPEILGSVLSMVANIYRLKSGNNIIDPEPGESYAETFLKACSGSADKNKISAMDSALILYMDHEIPASTTAALVTASTLSDMYSSLASAIAALRGPLHGGAAEGAYRQFLEIGEPENVNAWFENNILNGKRRLVGFGHRVYRTYDPRLKTFKKYADILSTTEEQKKILAIAKRLEEAGVKAFGSKGIYTNTDFYAGMVFNAIGFPVDMFTTLFGLSRISGILAHITEYVETQERLIRPRAIYRGSGERKY

SEQ ID NO: 10995 - protein, 226 aa, Ferroplasma acidarmanus
MKSNIVIAGVGKGMGSSLAYYLKGGDYNVFLISRGSNVREVAGKTECEFYNADLNSYPQCVEAIKAADRSMGGIDAVINVAGNYYSNKSIEETEPEMFMEAILNNARTFYNIARAAIPLLKRQKHGSIIGFSASENVYYNSNPGYAAGKGAVYYMVKSLARELIKYNIKVNGVAPGFIGKDDDEMKSNIELGITRRYPPDDINRTIEFLINSEMVTGEIIPVAGGH

SEQ ID NO: 10996 - protein, 100 aa, Ferroplasma acidarmanus
FCSKCGALMTPSRDKYICNSCGNEIPKAGTADQKIISKSSDKEIIMVAKEVNAEPLDSDAVCPVCHHTGAYYLLKQTRSADEPETKFYTCESCGHRWREY

SEQ ID NO: 10997 - protein, 558 aa, Ferroplasma acidarmanus
  unsure (1)..(558): unsure at all Xaa locations
TVADVIIKTLVNFGVKRIYAIPGDSLNPIIDAIRRNKDIKYVQVRHEEGGALSASYESKYTGNLAACMGTSGPGSIHLLNGLYDAKTQHVPVIALTGQVETELLHHDYFQEVNLVKLFDDVSVFNARIITPDNAHYLIWKACREAITKKGVGHIDMPVDILMESCKEEDLSYYINPVNYNPGGLDEAVNLINNRNKPVIMIGGGSRNYRGEIDEFAEKIGAPIIYSLNGKGVFNDTDKKVMGGIGLLGTKPSIKAIEKSDLIIFLGTIFPYTQFLKNVDNIQVNTNIDDLNKIMKANYSYLCDIKYFLDNINVNEKDKKFYQEMQDEKAKWSEDMVRLASNHKNPIRAELLTDKISKKIEDDAIIITDTGNVTLWSNRFLNAGNNNKFYFSSWLGTMGSGIPGSVGLAFASGKKICGLIGDGSFAMTVMELITIKKYNLPVKLIVYDNSILGMIKLEEEVMGYPEYGVDLYNPDFAKLAESIGITGIRVDTVEALDAGIDKFFKCDGPAVLDVVTETNETPMPPKLNFKVAEKYVTSILKEKLETKDXFKSGLPAVKQ

SEQ ID NO: 10998 - protein, 487 aa, Ferroplasma acidarmanus
MFIGGEWVESSENQVLKVLNPSTGLPVASVQSASRDDVGKAIDAARNSFDSGIWSRATPGDRSNVLLKVADLIEKNQDKFIKVETENSGKSIKQISGYDIPYTVDNIRFLAGACRTLEGKAMNEYVADGTSAIRREPIGAIGIITPWNYPLMMVVWRAFPALAMGNSVVVKPASYTPLTTLMLADILKEAGVPDGVFNVITGPGSSVGEEMAKSEKLDMIAFTGSTEVGKRLSVLAASNLKKVSLELGGKAPFIVFKDANIDAAVESAIVGGLVNNGQDCANSTRYYIQEEVFDKFVSLLKKRIQKLRIGDPMDPSTDMGPLISETQRERVEGYIEKGIKEGGKLLSGGERPEIPGHKKGYYINPALIYTENEDSAIVKEEIFGPVFTILKFKDYNDAIRRSNDVTYGLGSSVWTSDITTAMRATRDLRFGTVWVNEHVVVPSEMPWAGYKESGHGASLSPYSLEEFTYIKHVYFDLTGKVRKDWYD

SEQ ID NO: 10999 - protein, 392 aa, Ferroplasma acidarmanus
RILFGEWQSMRVGEQLKEIEKKNTLIVTDPNVYKFGLLNDIETSLSKFQIKYEVYDKISNEPTMENIVNAVEFARSNGKFDSVVAVGGGSVLDTSKMVASMVTNKGEPAEYLTPVEDKFKNPGLPKILIPTTGGTGSEVSNMSVVINRESMYKTWAASSNLLADTAIVDPVLNVSAPPRTTAASGMDALAHNIEGLISKEANPISDGMATKAASLIFRNLRTAYNDPSNMEARSAMSMSAMLGGMVITFPWVAGPAVLGHCLGEAFGPKYGAIHGVAVGMALPYILDFNISAAYNKIGSLARIFNIRYKGESARAVASKIPPAIIQLLEDLEMPTTLKDINFPASDIEKFGDYIFSSRQKLYDLPRFNPRRLTKENSIRLIQNMYDGTLENQ

SEQ ID NO: 11000 - protein, 638 aa, Ferroplasma acidarmanus
KTLWEPGNEYKEKSTMNQFLNYVNTNNHTNMNSYKELWEWSVKNPEIFWISLADFSGLDLGEYNSILSENNVNARWFEGARVNYADRVYRMRNIEKAAIISYNEEGKEQVITYHSLWQKVSSLAAYFQSNGIAASDTVCAYIGNIPEAVITLLATASIGAIWSSCSPDFGIKGVIERFSQISPKVLIVSPEYSYNGKLYDRTENAIKILKALPEVRIAITTGNKEIHDFTKMNSIPDSRSEFVPIKVEFSHPLWILYSSGTTGKPKAIVHGHGGILLEHLKVIMLHMNIKENSVFTWATTTGWMMWNVLVGGLLAGSTILLYDGSLSYPDTGILWKLSEKYGITHLGVSAAYIGSLMDSRIKIKDHYQLDKLEFIGSTGSPLSPDAFEFVYENIKGNVWLSSLSGGTDLCSAICLGSPTLPVYSGMLQCRGLGAHVEALDPDGKPVINEKGELAIMDPMPDMPVFFWNDPDKTRYYESYYNFYPGIWRHGDYISIDDEGRVIIYGRSDAILNRNGIRIGTGEIYSSLNGIEMVDDSIVIGYTDSRKIYRITLFVVLRGNAKLDDNLIGTIKSKIRDDLSPRHVPDYILQAPSVPYTLNGKKMEVPVRRILEGALPGDILNRDSVKNPDSLDYYVAVGK

SEQ ID NO: 11001 - protein, 352 aa, Ferroplasma acidarmanus
FKKINHIEFYVSSAKTWSYFMERGLGLDLKAYSGLETGNRGKSSYVLNKGDINLVFSSSMEKHSEINDSISLHGDGVRDISLEVDDIEFTKKHLESRNIKVSSIKEEKDDNGKIRRAVMQTYGDTIHTMIEKGDYKGFLPGYREEDTHTADTGIYKVDHVVGNVYEGEMDQWVNYYIKNMNFSQLVTFDDKMIRTDYSALRSKVVKYNDNIVFPINEPAQGLKKSQIQEYLDYYNSQGVQHIALKTDNIIETVSKMKQNGIQFLQTPASYYDTLTERVGNVDEDIEELKKLNILVDRDDDGYLLQIFTKPLTDRPTVFFEVIERKGAKSFGAGNFKALFESIERDQAMRGNL

SEQ ID NO: 11002 - protein, 463 aa, Ferroplasma acidarmanus
FKFGFSECGFQSEMGLSGTDNNSDWFIWSNDKRNIEKHYVSGDLPQNGVAYWDLYKQDHDNADKLNINAARLGIEWSRIFTESTENIEVDIKYDNDDIINISINDETIRKLDEISNKDAIKRYMDIFKDFKSRNKFLIINLYHWTIPKWLNDPSKFSDNDKQRAIGGCFNNHIIIEFTKYCAYIASKFDNIVDRWSTMNEPNMVYQGCSVDSSYNGISARKKKFAEAHARAYDAIKLYSQKPVGIIFANGDIQSIDGDNDIVDKAKFFNRYSFFDSIINGDLSWYHELTNDGKPIKTRSDMKNKVDWLGLNYYSRDVIKRNDSGWEILKGYGHYCGDIKNSLDNRSVSDTGWEIYPEGIYNIIMDYHNRYKIPITITENGLADDMDRYRSNYILSHFYNIERAISDGAIVEGYYHWSLTDNYEWASGFSKKFGLFKVNMETKERYMRPSALIYKEIIDSHGVP

SEQ ID NO: 11003 - protein, 508 aa, Ferroplasma acidarmanus
FNWVSEIFEKLFAGNDKDAIIYINEGTGEERRISYRKLYESYNQFINFLRAEGINKGSSVYIMAGSIPEQWVVMMGALKAGFIVIPTAANLTEYELNYRFSQDSPDVIISDEASAEKLEHVLNTEALKLVIGNREGWISFDEIYKMEINAEPAELGKDDLFIKYFTSGTTGMPKAVRHSSILYPIGQLSTVTAIGIRPEYIHNNLSSPGWAKFAWSSFFAPLCAGATVLSIDYRGRLNSSRYLELIDRYKVNTFCAPPTAWRQFISLKNLNIELKHLKETVSAGEPLNGEVINKWKERYGTVIRDFYGQSESTAMVANLAGEEPVPGSMGKPLKSYNLVLVDDDMNLITHPLNIGNIAVGDYSGTYGLFLGYSDREKDASVFVNGYYLTGDKAYFDDNGYFYFISRTDDVIKTSDYRVGPFEVESAIIKNEAVLESAVIGIPDSMKYEKIKAFVILKDGYVKSEETAKSIHSTVKTLLPAYKCPRVIEFTDELPKTISGKIKRKELKQ

SEQ ID NO: 11004 - protein, 576 aa, Ferroplasma acidarmanus
KLKKSLSSVDIFLISFSGMVGSGWLLGVLAGPAYAGPASILTWVVAGVFFIILALVFSELGTLFPYSGSLVRFNEFSHGPVSNFYLGWAYMIGAIATPPVEAAALTGFISSYVPGIYNSSVALLTPLGVIVALALLGLFIIVQYAGVNVFGKSNAVMTWFKMAAIILTIIFVFAFIFHARNFFALSHGFLPYGPSSVFAAMVPAGVIFSYEGFRQGLDYAGETKNPKRSVPLGMISAMLAAMATYIMLQIVFIGAVNWKAAGVPVGDWSGLLSSTWSANPFFYAFHSTDETLLIGFSIFLIIVAVVSSASTLGVYVGSSARSLYGMAKMNYIPAFFGKIHPRFRTPWISLVVTFIIGAMFLLPFPSWYALVGINSSFTVFAYLAAGITNTSLRKTAPEMERPFKTPFLTVMAPLAFVIASMLVYFSGWSTVALLLLIVDGGLPIFLLSRYGRETFHINMRSASLFSAIYWVIFIFIGIIYALSLLPFEEYFALFSATILVTPYLLYRMSGRTASIHIRASIWIVVYSIILGIMSYYGSLGINAIPFPYDYIIMAIMSLTIYFIAINTGYHTDKLKE

SEQ ID NO: 11005 - protein, 398 aa, Ferroplasma acidarmanus
GKSIKNISDAYGTPVIVYNMARVRENIRRIRDAFNGINIKVHFAVKSNYNPYIVSQIIKEGTGIDAANYNEVKLAIMCGLGSRDIIATPNNLSGTELRTIKEEGVAINFDHEGQMGLLKGSLPETVSFRINPGIGKGEFPGITTGGKNVKFGISVDDAISAYSAAIKAGVKHFGIHMMTGSNVLEPEFFNESSGLFFKIAETISDRTGIDFDFIDIGGGFGVPYTSDEHALDIGKTAGYISDNFRASNNRGYFKDSRLIIEPGRYIVADSAILLSKVTSIKHSDRELIGIDASMNTLIRIPLYGARHGILLSGHGENTSSSRFDIVGQVCENTDYIAKDISIPEPAVGDIVVIADAGAYVASMASNYNLLSRPAELVLEGDREILTKGHDGLESMLAG

SEQ ID NO: 11006 - protein, 391 aa, Ferroplasma acidarmanus
MELVKASDREFIVAVAQRLLAIKSISPQSGGEGELKKSLELKKILNELGYDSYNEYNTTDNTGTIRPNIVLKLGSSSKTLWVICHMDTVPVGDISLWKHEPFKATIEGDRIYGRGSEDNGQSIFTMLLLLKHIKREQMKMNLNVAFVSDEETGNDYGIKYLISKGIFAKDDLIIVPDAGTEGGFIIETAEKSTMQLKFEINGIQGHASMPENSLNAFRVACKFIDLMDFNLHDQFGKTNKLFVPPYSTFEPTKHEQNIDNINTIPGRDVFYWDFRILPQYPADEILKSIDGLIEKFSKTSGAKIKYTVIDRVDAPDPTPDGAEIVVLLKKAIKSVIGKDAFTVGIGGETFASFLRGKGFSVAVWSTTVIESAHMPDEYCLIPHILQDIEVY

SEQ ID NO: 11007 - protein, 509 aa, Ferroplasma acidarmanus
IGIDLGTSNTSAAVALVTGGEYKTIAIPLSGKKTGSSLKSSITFGGSDIMFTGADADRMLKKYPGGNVSGFKTRMGSEYLYRTGEKFHSPVELSAIILARVKNIAEEYMHDRVKDAVIAVPAYFNNNQRNATREAAAIAGIKVKQFVSEPAAVAISYWNRASKAEAKNILVFDMGSGTTDVSIVRAQGKDFRVIATSGNTGLGGTDMDRRIEEMMKSFLRINGISPYPPDLRKDAEKLKIYLSNHETGDSLLGSTKIKYTMDSKQLDSIVSDMLPEIYRCIDTAILNSGIKRNELDTVIITGGPTKIPFLFHSIENYLSTRAVKQGKFDTAVSTGAAILASGFIHMGTGEISKIKVSDVVPISLGSVTRNDIVVTMIPANTPVPCKATRPFTTIRDYQSEIEVKVVQGERPLGTDNIVLGHFTLSGIKPAPRGEVAIDVTYSVDKNGILTVSARDNDTAAIKEIKISETMQHSQEEIKEMKEAVKKYFKVDSERKKMAEIMNRSEQLLH

SEQ ID NO: 11008 - protein, 286 aa, Ferroplasma acidarmanus
KKVAVIGSGIMGQGIAQVFMRNGMDTLLIDINDRILENAKNSIADGKFGLSRLVDRGTITEGQKAEYMKNLSVSTDYGMLNDREFAIEAVPEIMPLKLKVMESIEKNIPERSVIASNTSGIMISEIGMNIKDKSRLIGMHWFNPAPVMKLIEVVKTRFTSGDTVNMVLDMARSMGKEPVVVNDYPGFFTTNFVHSWLVESLRLYEKGIAGKEDIDKMVKLGFGFPMGPFELMDTIGLDTMKEIGDYLYSETGDMRILPPPILKEMVYAGYKGSKKVKMDSKGGWYD

SEQ ID NO: 11009 - protein, 380 aa, Ferroplasma acidarmanus
LTSVGWSEENGVNRLALNEYDIQARKNLEDEMRAVKADIKQDDAGLIFGTLGSGNDNTAIGSHMDSVPNGGRFDGFYGVMSGMQLLKDLGSTLKNRKITAIDFTNEEGARFQPSLLGSGMSTGVFTKEFAYSRKDSDGITFEEALEKSGYMGEEQNRVKNQDITRYLELHIEQGPVLELENYQVGIPKGIVTMVVDNVSFTGESNQAGPTPMKVRKDALVAASRFTVAVRDMAKSSGKELTMTVGKINNFPNAYNVIPGKVTMNLDTRSPDKKTAEEYSKMAKEISEKIASEEGVPVDFKNQWTTETTIFDEDMRKEIIKSCKSLNLKYKELYSWPGHDAQYMNRVVPTAMIFIPSHNGRSHTREEYSSDQDLINGYSVL

SEQ ID NO: 11010 - protein, 298 aa, Ferroplasma acidarmanus
LCLGGMSFGSSKWMADPETSGKIIKKAIDYGINFIDTANIYSSGESEKIIGEAITGYRPQLVLSTKGGGKVNDFTQGFSRAILFNEMKNSLKNLRTDYIDIYFLHTIFDNVDFRDTVHTLSSFISSGKAGYIGLSNFMGYQLAEFSTIMEMQENIKPAILQNHYNAVYREDERDAIPFCEKHGIAYSPFSPIAAGFLSGKYKRGLENETVRTKTYPVMKERYFSDSDFDILESVEDIAKKKGVKVPQLALAYVLNKGFIPVIGATKPEYLEDDIAALDVKLDREEMEAIDRNYKPHKI

SEQ ID NO: 11011 - protein, 169 aa, Ferroplasma acidarmanus
VIGTGCFWCSEAIFKLIKGVNNVVPGYAGGHTENPTYREVCTDKTGHAEVVKVSYEPDVISLEKLLELFMATHDPTSLNKQGNDIGTQYRSIILYNDDAEEKMIKDFLKEHQKNYSKPIVTEVQKLDRFYEAEDYHHNYFANNQSNPYCAMVIKPEVNDFIMKHGNILK

SEQ ID NO: 11012 - protein, 256 aa, Ferroplasma acidarmanus
DLTGKVAIVTGASGGIGKAIAIGLASAGASVAVHFGRNKNAADEVVNKIVAARGKAIAVSADMADPVAVEEMFRKVDSSLGPVDILVNSAGIDGVRAMLGDDDIENWKKVISINLYGPYFCSRMAIQRMKKKNRGVIINITSDHVNIPWQGYSAYCSSKAGLDMMAKTLAQETATMGIRVISIAPGAIKTAINKSVWENPDTLKDLDDKIAMGFPGDAEDVADAVLFAASDMAKYITGTTIVVDGGMLIYPDFRHG

SEQ ID NO: 11013 - protein, 351 aa, Ferroplasma acidarmanus
SLLLSRTLIGLAVGADSAIATAYIAEYAPKNRRGHLSLMQQWMITWGILGAYFVGMGVFFIAPQLAYTIDWRVLLGVAAIPSLIGLVFRFYMPESPRWLILHEKYDKAIASLKRFNVTAKLSEIKNTHDYLVAKETKQKATPGIKRAFVIVGLFMMFQQITGINIPFYYGPVVIAKLHIFGSTGGTAISSAVFGIEASSILAIINVLATLIGFRLIDSYGRRSLALLGYSGMAFFDVLGAVLYLSHIDIGLLIGFAGFIIFFAFGVGGTGWIIQGEYFPTQYRGLFASLIAVVDWISNFAIIELFPVMDLKIGLGYTMAVFAVLSIMAVVIFFYIMPKTKGKSVEEINDIF

SEQ ID NO: 11014 - protein, 256 aa, Ferroplasma acidarmanus
KLGESPIWRDGLLYYVDILNGKIYSYGENITQLHTDSIIPFIVPCDDGLIFATKDSIKHLILKSGKVETIFKMKFDEIVRFNDGKCDMNGVLFAGTMDMNEKDPLGSLYRFDNKESKVLDRITISNGTIWNYDKKIMYYIDSPTRKIRVFNYDNRNSAILDEMESIDVSVFPGVPDGMTIDSMGNLYVAFHGGSSVIVFDSNGKVIKKIYVSAKNVDSCVFGGDDLKTLYITTAMDENGDGGNLYKIKNEISGIPS

SEQ ID NO: 11015 - protein, 164 aa, Ferroplasma acidarmanus
FITIEGIDGSGKTTLVNSLRKIFDNIHFTREPTDKFQLANLKTLSTPFNSFYNFFLFTYDRLEHQDEINGFKNVICDRYLASSIAYEGPMIEELFGDKKETVLWMLEVSKMLKLPDMIIYLDAHLDVALERIRNSRKNLNFRGKQLSILEEKEGLKAIQDYYEY

SEQ ID NO: 11016 - protein, 248 aa, Ferroplasma acidarmanus
MKILSWNVNGIRAAVKNGIIKTLENENPDIILLQEAKADKMDIPEELHHTGYKIYVNPADKKGYSGTMAMAKQEPLSYTTGTGENNKDVEGRIQTLEYDNFYLINSYFPNSQHGLTRLDYKIQFNREILEYMDKLKAKKPVIITGDFNVAHEEIDIARPKGNEKNAGFTIEERDSMTEILSHGYVDTYRYFHKEPGHYSWWSYRFNAREKNIGWRIDYFLVSDNFIGKVEDSLILENVTGSDHAPLEL

SEQ ID NO: 11017 - protein, 346 aa, Ferroplasma acidarmanus
MSGIVSYGSYVPIYRIKPEEIARIWGDDPEKMKNNLFILSKSVPSPDEDVASISVEAARNALKRININPGDIGAIYVGSESHPYAVKPTATIVAAAIGMPLEYFAADYEFACKAGTAGMQNVKAMVDSGYIKYGIAIGSDTSQGAPGDALEYSASAGGTAMIIGKDNVIAEINDTLSVSTDTPDFWRREGEPYPRHGERFTGDPGYFKHVLAASKAMMERMGTKSSDYDYVVFHQPNGKFPTRAAKMLNFTEEQYKTGLLTPYIGNTYSGSTMTGLSAILDEAKPGDRILAVSFGSGAGSDAFDITITENMKNYHRENAPGVRKMIENVKFIDYAIYTKFRKILVM

SEQ ID NO: 11018 - protein, 382 aa, Ferroplasma acidarmanus
EVYIIGAGETKFGELWDKSLRNLAVEAGLKAVEDAGIYSKDIDAIYGANSLAGIINMQENIGALIADFSGLSAEGIPSLRVESSTASGGAALRDAYLSIKSGEYDVVVVGGVEKMTDIHGSDILEKSSSILDREWEAFFGATPAAMAALIARKYMHDFGVEKEALSMFSVNDHLNGSKNPDAQFRNKLTIQQAMNSTAVADPLNMMDCSPMSDGAAAVVLASESFIKKNKREGVRILSSAVAEDYLSVGSRKSIYTLNSTKLAVEKALRKSGIKRNDISFMEVHDSFSIFGLLELEDLGFAEKGKAKDLVYDEIKLNGSIPVNPSGGLKAKGDPYGAVGVGQAVDAYRQLKGKAGDNQIKDAKYALLHNMAGTGTSSIIHIL

SEQ ID NO: 11019 - protein, 433 aa, Ferroplasma acidarmanus
ELPGPNAKKIMAEDEKYLATSTKSLPVVAYRGQGCYIEDVDDNVFLDFSSGISTTNIGYGNEYVISKVQEQLHKLWHFAGTDFYYSEQVEAAKALIGVSPGSHDKKVFYANSGAESNEASLKLARSYTKRPQFIGFIGGFHGRTMGALSFTASQPVHHEGFFPEMAGVTHIPFPDPYRNPFNIDGYEEPEDLTNAAIDYLEDYVFGKFLPSNDVAAILVEPIQGEGGYIVPPMDFHKKLMELAHDNEILYIMDEVQTGFGRTGYFFASEYFGVDPDIMSVAKSIASGIPMGASVVKSKYNFEKSGLHSNTFGGNLLASVSSRATIEEIKNKNMVENARKVGDYLNKRLHELQEKYDNIGDVRGLGLMQAIDFVKNRKTKAHFRGLRDKTIENAYKNGLILLGAGESAIRFIPPLIVNEKQIDEAIDILDNSIK

SEQ ID NO: 11020 - protein, 253 aa, Ferroplasma acidarmanus
IEVTNLYKRYGTTTALNGISLSIAGGQIYGILGPNGSGKTTLLKILAGILPPSSGEVVIDGMNLTGNSDNIKSITGYIPETPALYESLTPIEYFNFLASVFKIEDSVLKERINAFSNALEIGKYLNEFIGSLSFGTKQKVAIIGSLIHDPKIIVMDEGMNGLDPKSSKIIKELLKDMTAKGKTVIFSTHIMEIAETVCDTISILYNGNIAGTGNLDQLKSEAGSNNSDLEGVFLKLTGDEDLDNLLDSLRESI

SEQ ID NO: 11021 - protein, 341 aa, Ferroplasma acidarmanus
FMSIKAVVMAGGKGTRLRPITYSIPKPVVPIAGKPCMLYLLDSYYNAGIKDVIITTGYKFSSLITSIIENRHNDQAILFSVEKEPAGTAGSVKMVSNFIDDTLIVGSGDILSDFNISDIINFHKKNKAMVTIVLTEVEDPRQFGIVEMENNRIVRFLEKPDRDQTFSHIASTGIYVIEPEILDYITTMPYDFAKDLFPELMKRNIDIYGYMGKGVWLDTGRPNDLITANQIMVEKYGKPSNVDFIKGKNIILDMAGIHNTGIDKCYIGRNIKAGDNVYIKYSALYDNEVIGNNVEITNSLLMDNVTVRENTKIRNSVIMKNCVIGENSEIVDSIIAPDMDL

SEQ ID NO: 11022 - protein, 248 aa, Ferroplasma acidarmanus
IKINDEIRLTDDKFLMIAGPCSVESEEQIIRVATQLRKIGVNVLRGGAFKPRTCPDSFQGLGEEGLKLLAKARDATGMAIITEVMDMDELPLVAEYADILQVGSRNSQNFSLLKKISRYDKPVLLKRGFGNTVDELISSSKYLSMNGNKRIMFSERGIRTFEQSTRFTLDISAIPVLHEKTEYPVIIDPSHPAGVNRYVEPLALGGTAAGADGLMIEVHPDPPKALSDSAQQLTVPQFQNLYTKVKNI

SEQ ID NO: 11023 - protein, 112 aa, Ferroplasma acidarmanus
ENLKYTKSHEWFKIDGDVATVGITDFAQHQLTDIVYVDMPKKGTVKKAGDTLLTIESVKSAEDVFFPVSGEVIETNEELDKKPELVNSDCYENWLVKIKLTDNKYDSMTAAE

SEQ ID NO: 11024 - protein, 263 aa, Ferroplasma acidarmanus
YEDADYVIFGAPFDNTSSYRRGSRLAPNSIRAAYDNLESYEVNYGINLLDAKICDLGDLPVYEDVDYILSEIETATATIFHDKKIPVMLGGEHSLTVGALRNLKDITMVIIDAHSDFRDSYMGNKNNHACVTRRALELLGKNKIISIGTRSTSYEEIASGEYENVRFISANEVRASGIDEVISEVMEKTSDRVYFSIDMDGFDPAYAPGVGTPEPYGLTSYDVRSILTSISDRIIGFDINEMTPLYDNGNTSMLAAKLIQDFI

SEQ ID NO: 11025 - protein, 220 aa, Ferroplasma acidarmanus
LQDLNPVEMLGKIGKYYGKGAVFTSSLGLEDMVITDMIARNNINVEIATIDTGRLPDETYQLMETVRSEMGIDLKIYFPEREDVEDMINSRGINLFYHSLDNRHFCCNVRKVKPLKNILRKRSVWITGIRAEQTVARKNARKVEYVRDHNVWKVNPLLDWSRDEIWSYVSIHKVPYNILFDQNYKSIGCQPCTKAVGKDDDERSGRWWWENGVKECGLHL

SEQ ID NO: 11026 - protein, 368 aa, Ferroplasma acidarmanus
HGGKLVNIPDVSDREAHHTIEVSYGTAIRIMNMKMGILSPLKGFMGESDFHSVVENQRLENGLPWSIPYTLDIGEKEFRCVRAGDTVRLSQNSGVIAIMDVTDIYRYDRIEYCRKVFGTTSTDHPGVRNIRESTGICMAGEIKSANLPEIPFLKETLFPVDTRQIFLERGWKTVTGFQTRNVPHRGHEEMQRTALRVTDGIFINPVIGKKKPGDYRDEIIMKSYDTLINNYYPSNRVLFSPLHYEMSYGGPREAMIHAIMRKNFGCTHFVVGRDHAGIGNFYGPYDAQKNLQAFELGIEIMNMDEVFYCKKCEQLATSRDCSHVDGDRVHFSGTMVRDTLKNGLSPETYLFRKDVYETINRHDNKFVE

SEQ ID NO: 11027 - protein, 421 aa, Ferroplasma acidarmanus
VLSSMGVMMDGYTLTVFSYALLYLINVMSLKSYEISIMGISSIGGVLIGSFISGYIADIYGRRFIYIYDLFLVSIFIFLTGLATNYINFSILELIVGIGIGADYPVSSSIQAEFSPTKSRGKFMFFNIFSFSIGSLIFLGFAVPLVLFTGVNAWRYMYMIGAVFPILVLYSRKKIPESPYWVQHKYGKVAGEEAKDKFEASTGYSIENLPEISPGKTRLRDVFKGKYAAYIIFISIAWFSYDIVSYGIWTYSPLIFSTEITSYYADLYVVFTGMAESIPVVIGFLIAIYYVDRIGRRFLLIIGFLGSFAVLILFFFVNQYMVVGLLMTFSAFGFVHFFHNVGPSPITYTYPVEIFPTRIRGTAMGFATSVSRIGSIVAVFSFPIIDALYGLKAIIIFFAIFEFIGLALTLKYAPETKGKAL

SEQ ID NO: 11028 - protein, 1195 aa, Ferroplasma acidarmanus
MNPILDAFFKSESVVNYQIDSMNYFYASKNNPDNIMQQIVDETKISDDATPGVIDLDPSKTKGKDIKIYFGRERQNGKATGDPTIWVDKPEIKEASGATNQITPQEARLRDLNYMAPIMLRLRIVEDGIERDANTIKIGEIPVMVRSKICTLSEQNLDLYIEKNNGPIDETRENKLRYVDEDPTDPGGYFIIGGSERVIVSLEDLAPNKILVEYEEKYDSRVEVAKIFSQKSGFRALISMEKGSDGIINVSIPTVAGTIPLVILMKALGIDKDVDIHEAIYTDPRMDPLIYANIEDSRNLKILPPNGINNNEDALSYLEKRFAAGQAKEFRDKKITQMLDRALLPHLGDDVSDRLKKAIYLGRMARSLLELNLGMRHVDDKDHYANKRIKLSGDLLDELFRNAFQSVMKDLKYQLEKTYNKKRGIRLRPAVRQDLLTQKVLHSMATGNWIGGRTGVSQLLDRTSNMSTLSHLRRIISPLTRSQPHFEARDLHPTQWGRICPNETPEGQNCGLVKNASLIINVTQGIDPDIVMEELQNMDIHEVTKEEASGRIYLNGDFIGYHNDPAILTDTIRNLRRSGKLSNEVNVKYDSNTNEVIINCDRGRLRRPLFVVNEGKTVMNEEMLEKLRMGEYTVNDLISSGAIEWLDAEEEENAYISVFPFEFPDNCPDCGKVLYRDNVTWINPGNSDVTLECDECHAHFKGTNNLSMDHTHCEIDASMILGVVASLIPYPEHNSSPRITIASAMIKQSIGLPQANYRIRTDTRGHLLHYPQIPLVTTKVMDFIKYRRKPAGQNFVVAIVSYHGYNMQDAIIMNKASIERGLGRSSFFRTYTAEERRYPGGQEDKFEIPSHDVLGARAEEYYKNLDENGIIFPESKVEGSDVLVGKTSPPRFLEEENADKLGPLRRRESSVTVRPTESGYVDNVFLTVSESNSRIIKVKVRSDRIPQPGDKFASRHGQKGVIGYVAAQEDMPFTEDGIIPDLLFNPHSVPSRMTLGHVLEMMGAKVSTMSGENIDSTIFDGEPERSLREQLKKYGFRESGNEVMYDGITGKKFEVDIFMGVIYYQKLHHMVASKFHARSRGPVQILTRQPTEGRSRQGGLRFGEMERDTLIAHGASMVIKDRLLDQSDGTILYVCGNPTCGHIAIYDFRKGTLRCPACGNTGNIYPIETSYAFKLMRDELSSMGIVMRLELGDMK

SEQ ID NO: 11029 - protein, 273 aa, Ferroplasma acidarmanus
IGTRNSKLALIQANSVKDALESRGYEVNIKSYTSAGDSNKNIPLYRMSSTGVFVDELNERVLKGEIDLAVHSAKDIPSNIQKGLEITAVTGRDDFRDVLISRTPLEEMTAGSVIGTSSMRRIRQAMTVNPEITVSDIRGNIDTRISKYTEKKYTGIIIAMAAYKRMKLDIEHFILSEEQFLPAPNQGIIAIVGKSNSPASIISGEINDRETYRDMKNERFIATSLNLGCSMPVGILSKDGKIKTRFYSLDSDEHRDMVFSAENLDSVVEHIKE

SEQ ID NO: 11030 - protein, 433 aa, Ferroplasma acidarmanus
  unsure (1)..(433): unsure at all Xaa locations
LRKKINPXXECRYMRSSELFKEALELFPLGVNSPVRYYSPEPVMFAQGHGSKILDVNGKEYIDYSLGFGPMILGHANPDVSNHIKSQVDKGILFGSISENEIKLGKTIKNAVGSIERLRFTNSGTEATMHAIRLARGFTGKKYIVKMEGGYHGAHDYALIKSGSGTMTFGVPSSAGVPEEVSRTVLVGRYNDAESIEKLFKEHRNEIAAVITEPVLGNIGVINPENDFLNSLREITEKYSSLLIFDEVITGFRFGFKGYQDIAGIKPDLTTMGKIIGGGAPVGMFGGREDIMAHVAPQGDVYEAGTFSGNPLTMAAGIATLDQLKSKDYSAITNYAARLEEKLNSLISEYNIDATINRCHSMFQIFFNKNKVTDYKGATASDTEKFNKMFHTLLEKGIFFPPSQFETEFVSFAHSETDLESTVDAFSSVLKCL

SEQ ID NO: 11031 - protein, 167 aa, Ferroplasma acidarmanus
MIITISGESGSGKTTVGKLLASSLNYKFFSGGYFFRKKAEEYNMDLIDFSNYAEHHPEIDKEEDRMIVEFMQHNDDIILESRLSGYMAYKNNINAIKIYLNTDIATRVDRLASRDKGVDRAGIMTRARSEFLRYMIFYGIDYRVFTNYDYIIDTDHISPENIVNDIV

SEQ ID NO: 11032 - protein, 233 aa, Ferroplasma acidarmanus
MQQGQMAYDRAITVFSPDGRLFQVEYAREAVKKGSTALGIKFKDGVLLLSEKKARSRLVEKNSLEKIQLVDDNVATVTSGLVADARVLIDFARVGAQQEKVTYGSLTNIENLVKKVADQMQQYTQFGGVRPYGVSIIFAGTDTIGPRLFDCDPAGTINEYKSVAIGAGKDAVTDYIEKEYKDDMSLEDTIKLGVAALKSALADASSMKEPEIASIKVGETFHVYTNEEVSKYL

SEQ ID NO: 11033 - protein, 417 aa, Ferroplasma acidarmanus
VILGLQFGDEGKGKITDFVSRDYDEVVRFNGGSNAGHTVVIKGEKFKFHLVPSGAMQSNKVILGNGMVIDPEELVSELDLLKKSKKDIEIKISAGAHIVTKMHKCLDKKEEEIRSKLNIGTTSQGIGPTYEDKYARTGIRFIDLSNPEIIKDKIETIYNMKKQLLKGSIFENPEERAKMVKDLCGFGNSIMQYMDYTENVINNDYRLGKNILFEGAQGGMLDIDFGIYPFVTSSNTLAGALSTGSGFSFRKVDRVIGVFKAYTSKVGSGPFPSEIIGDSTLRDLGSEYGTTTGRPRRVGWLDLPLLKYTIMMNDVDSLAITKVDILGKMKTIEIATKYTIDGKEIDYFPRRLDDFEKLHVDYVELPGWGDIENPDDIIANGYQALPENMKKYIEFIEEKTGKTIDIISLGEDRRMTI

SEQ ID NO: 11034 - protein, 432 aa, Ferroplasma acidarmanus
  unsure (1)..(432): unsure at all Xaa locations
MYIGDXMDFDAAIIGSGAGGYYSALRLLKHGKKVLIIEKEKFGGECLNYGCIPSKALIELSENIGYLHDMPGVTMNYKIDMKEWQEWKESMVKRITGGAEKLCISLGAKVVYGVGSVKDRNTVTVNGTDYTAKNIIINTGSVPVKIKGIDDVYYNREMLAVETIPAKLVIIGGGYIGVEMGTAFRKLGSEVYIVEMKDRILPEIEEDLAREVDKRLRKLGVNIMTGMKVLSVKKDKNYKVSIEGSDTIEADTVLMSVGRIPNTEGSGIEKLGIEMDGRFIKTDSHKRTNIPNIYAIGDVSGVPMLAHKAFYDGYVAAENILGNDTVVDYRAMPFVVYTDPEIAFTGKAGTKSNKVPVLANPRSLTMNQKDGFFKLYYDDDGTITGAGVAAPRSSESITEISLAVESGLSIDDLFLTIHPHPTVSEGLKDAAE

SEQ ID NO: 11035 - protein, 377 aa, Ferroplasma acidarmanus
YTVSLPPIGEGIQEGEIVKWTVKPGDSIKKDDELVEVMTDKITVKIPSPVAGKVSKILIKEGETAMIGDAMVEIDSPDESNSPEKPVEKPATTAHQEVSVSTDEKIPSVKATPAVRAYARSKNVDILKVKPAAQDGRITKEDVDAYMKQPAEPIAQKAPSGEDEVFTPTGIRKLIFDKMTKSKQIIPHFTITDFIDTENIEKAINQYSKKKYVSFTAFFVKAVTVAFRDFPKFNAVYNENDRTYTIKKKYNIGVAVDSPAGLTVVVVKDVASKNIFQISEEIKDMAERARNGKLGLQDVQGSTFSVTNIGSIGGIMATPIINYPEVAILEINTRTSGFVNGELKHGLYLTLACDHRLIDGAEAARYLEKLKEVLEYP

SEQ ID NO: 11036 - protein, 319 aa, Ferroplasma acidarmanus
TQMTMVKALNSGLNNAMEKDDSIILLGEDVGTDGGVFRVTDGLLAKYGKERVMDTPLAELGIVGFGIGMSMAGLKSIPEIQFQDFIYTAMDQIINQMAKLRYRTNGDYTLPMVLRTPYGGGVHGGPYHSQSGEAYFTHTQGLTVVTPSNPYDAKGLLLSSIELNDPVIFLEPKRLYYAGKMDVPDDYYKVDLRKASVIREGDDLTIITYGPAVPVVKSTVEKNNVNAQIIDLRTLSPFDLDTILAGVKKTGKVLIVHESPKMFGVGAELSATISEKAVDYLAAPILRVTGLDIPIPFALEEYYVPNERRIMAAIDKLLK

SEQ ID NO: 11037 - protein, 338 aa, Ferroplasma acidarmanus
ISKEGLLAAYKNIVMERLFDKKMLNASRQGFLPFYIPLMGHEAIHIGMGMAIRDEDFFYPYYRDFGVLIQMGIPIDTILSQVFATATDNEIGRDMPDHFSLKKYNIGAVITPVAGHLTSATGIAYAKKYRKESGSVITTFGDGATSTPDFHVAMNFAGVYKLPMVFFCENNQFAISVPTYPTDDKAFNQTYEETRGAIYKKAESYGFSGIRIDGTNFIEVYRATRKALENASEDPILIEAMTYRMGPHSTADDPNKYRTDRVPEGSEKDPLIVSQKLLKDMKVITDLDIKQINDEMEETTSKLIDTYEKAPKPDKETMMGNLYEEEPWYISEERGDIQ

SEQ ID NO: 11038 - protein, 464 aa, Ferroplasma acidarmanus
TSDSMSSAIDRSMDEAKTSKFHYKVLFISGLGFFTDAYDLFIIGVVILLLPYAGWHNISIFYKGLVTSTALLAAVIGSVVFGRLLDYSGRKAIYGFELVALIAGSLGSAFLTPVNNIFMLLFWRFLLGVGIGGDYATSSTIMTEYSSTMNRGKFVGMIFSMQSFGLIAGPLISIAFLSNYVSPYITWRLLLAIGAIPAIIVIYFRRTMPEPPRYTADVRGDYKLAAKNLKTFAGLDSTGSKGKTINAPWYVLFRDRKFLLTLIGTAGAWFLMDWAFYGNSIMSNSILSFLVPSTVSGIHSIIMTNEYSAIIFGVAAFPGYWIAAFTIDRIGRKPVQITGFAMMAISFGIISAFSFLTTYRFLDYFLLLYGISYFFIMFGPNVTTFVYPPEVFPISTRGLGTGISAAGGKTGAFIGTLADTIILSITGLHFLMGMLAIIAAIGLILTIVLLPETKRRDLGETSGE

SEQ ID NO: 11039 - protein, 588 aa, Ferroplasma acidarmanus
MHIAILDRERCHPKKCNHECRYYCPPVRSGAKTIEFPGQSDDFPVITESLCIGCGICVNRCPFGAIKIVSVPDELNKDIVHQYGIDSFRLYSLPELGTGRVNAILGQNALGKTTTMNILSGVLIPNFGNISKKNDKDYVIERFSKSIMGQYFRDLYNGTKKAVLKNQYVDLIPRVASGTVRDIMKDNDHGNMDIIVDDLSMKTFLGRDVKELSGGELQKLAIGITLMKDADIYLFDEASSYLDINERIRVSDIIRKLSQSKIVMVVEHDLAILDKMADQVNLVYGSPGAYGVITKEKSTNKAINAFLSGYLREENVRVRPTSIDFTVKSSKRTSVTTKVTSWTAMEKSYGSFNLNIGEGYINREEIIGVLGQNALGKTTFVKILSGVIKPDSGSVENELKIAYKPQYISTDYEGTVYELLSTALKEKMEDVFIKNEILSPMNVSELYDNYIGDLSGGELQRTSIALTLATDADLYLIDEPSAHLDSSYRMNVARIIRRVIENNKKSAIVVDHDIYLIDLISDALIVFKGEQGVYGNSRGPMEMRDGMNMFLKDLGITFRRDETTRRPRINKLNSALDRQQKASGEYYY

SEQ ID NO: 11040 - protein, 332 aa, Ferroplasma acidarmanus
MKAYVLKEPGVLELINTEARKPDTGEVQIKTRACGICGTDFHAYNGKHLAVKYPVIPGHEFSGVITSIGEGVKSFMPGDRVVVDPNITCGQCEYCKGGKENFCENIKTVGINYPGGYGEYVTVPEKVVYKIPDTMSFEAAAIVEPVACIIHAFDNTHVPLGGSAIISGTGFIGLAFLQILKGMGYYPVYTMDTNPTRNLLAKKYGSDKIYTGIDDLMESDIIGKANVVVEATGSNSILSKTIDMASPSGKIFAFSVYPPGEKIEIESNKIYSKEISIFGDFVNPYTMRKAINMISSGLIDYSGMEDPVIKINDIGNLFQSGKRNFIKPLISY

SEQ ID NO: 11041 - protein, 451 aa, Ferroplasma acidarmanus
ALDNATGKFHFRTFLTAGMGFFTDAYDLFIIGTVLAILPMIGWHLTKTEIALIGSVSLIAAVLGALAFGRLLDYLGRKAIYGLELVLLVIGALGSAFLSFKNPYALMAWRFLLGVGIGGDYATSSVIMAEYSNMKTRGKYVGMVFSMQSIGLVVSSLLALTFLLSTKIIPLADAWKIMLSVGAIPAAIVIYYRRKMPEPPRYTVAKGRAAEASKNLKSYTGIDVAVSKNKEEVNAPWYTLFKDRKFLITLIGTAGAWFLMDWAFYGNSIMASRIFATIITQTGLSGLIRSTEYSAIVFIGFALPGYWLATFTLDKLGRKPIQITGFIMLAVTYGILALFPILDTPSFVVEFIAVYGISYFFMMFGPNVTTFVFPSEVFPVTTRGFGTGISAAGGKTGAFIGTFVDVFIIAAGLSSLMTVLAIFSVLGVIVTILCLPEPKGRAMEEISREKE

SEQ ID NO: 11042 - protein, 211 aa, Ferroplasma acidarmanus
ENRMPLIGEKFPEMDVVTTQGSKKLPDDYKGKWFVLFSHPGDFTPVCTTEFFSFAQRNDEFTKLNTELIGLSVDSKISHMEWINWIHDNLKIDVKFPIIADPMGNVAKSLGMIHAESATSTVRAVFIVDDKAVVRAILYYPLEIGRNISEILRMIKALQMVDKYKIATPANWPDNELMKGRFIIPPPATMNDIPERLKKYKGYAWWLTYRD

SEQ ID NO: 11043 - protein, 315 aa, Ferroplasma acidarmanus
LNIWTEKYRPSKLSDVIGEKGNINRLNAYVKDKNIPHLIFAGPQGTGKTSTAIALAISLFGDSWKENFMELNASNDRGIDIIRDNIKNFAKIRPSNDLGFKIIFLDEADHLTGDAQAALRRTMEMFYNTTRFIFSCNYSSKIIPPIQSRCVVLRFKPIDRESMKNRLKDIAKKENFEIDDDSLDAIYEISDGDMRKAVNVLQAVKLSGKVSATAIYEISGEINRDEYKNLINMAIEGNFNDARNYLDKMLIDYGLSGIDIIKGMHSSIRGEQIAYKQKLEIIMALAEAEFRIVEGGTDNIQMDALLAKLSYIGSE

SEQ ID NO: 11044 - protein, 178 aa, Ferroplasma acidarmanus
KITIENIVASTSLAEHLDLSRIALALEGSEYEPEQFPGLIYRLKDPKTAVLIFRSGKVNCTGAKNLENVKKTIDIIIDKLKKAKIEVYDNPDIIVQNIVAVYDLESDLNLTDIAMSLGLENVEYEPEQFPGLVYRVEEPKVVLLLFGSGKVVCTGAKEESEIEQAVIKVKKELQKVGL

SEQ ID NO: 11045 - protein, 478 aa, Ferroplasma acidarmanus
FREKFQNITEGYTFDDVLLKPLHSSIEPKNANVSSKFSRHISIGIPIVSSPMDTVTEESMAIAMARYGAIGVIHRNMSANEQVEMVKKVKKEESIIIRDVFSIASDTPVNVARTLMKTKNIAGLPVVASGKLIGILTKRDLEFSESEGTVKDIMTKDVITADENVSIEDAKFILYKNRVEKLPLVDSKGRLVGLITAKDIKTREKFPNASRDEQGQLMVGAAIGAYDIDRAINLENAGSDFLVIDTAHAHNKNVLSSLKKIRNAIHIDIIAGNIATAEAAEDLISLGVDGLRVGIGPGSICTTRIVAGVGIPQLTAISDVADVASEHGIPVIADGGIRYSGDMIKALAAGASTVMLGSLLAGTEESPGTEMIINGRKYKAYRGMGSIGAIKAGKSDRYEKLGTNEFIAEGVEGSVPYRGKVSENLFQFVGGIKTGMGYLGAENLEELKKKAVFIKITNSGLRESHPHDIRIVSEPPNY

SEQ ID NO: 11046 - protein, 307 aa, Ferroplasma acidarmanus
DYSIEIDKLTKIFNGKVTAVDNVSLKIGSGQIYGLLGQNGAGKSTLIKMLTGSLTPTSGTAKIAGLDLTKDSMKIRKITGVVPQDLTTDGDLSGRENLKLIADLYGIPKKEALERIDVLLHMVDLYDVRDRHAENYSGGMRKRLELACGLMNTPEVLFLDEPTLGLDVTTRENLWKYIRSVQKEFHITIILTSHYLDEVDALANELSIIDHGKIIISGTSDELKKSLKGDIITLKVKNDDEYSKLEKFPESLEIKRMETGDVRMKVNNSDEVLPKLMKFLGENEISPEAISIRKPSLDEVFIEYTGR

SEQ ID NO: 11047 - protein, 734 aa, Ferroplasma acidarmanus
DGILLRIAEANATDPGMARVRLDEISRLDLDVEIGDVVAIEKVRSTVGRVFRSRPEDENKGIVRIDSVMRNNCGASIGDKVKVKKVEVEEAKKVVLAPIIRKDQKLRFGEGIDDFVQKALIRRPLIEQDSISVPGLTLAGHTGLLFKVIKTIPSKIPVEVSEETRVEIREDPASEVLEEVTKVSYEDIGGLSDQLGKIREIIELPLKHPELFERLGITPPKGVLLNGPPGTGKTLIAKAVANESGANFFAINGPEIMSKYYGQSEQKLREIFQKADESEPSIIFIDEIDSIAPKREDVQGEVERRVVAQLLTLMDGLKDRGHVIVIGATNRLDAVDPALRRPGRFDREIVIGVPDKKGRMEILTIHTRGMPLGMDDEKESEFFSRIADITYGFVGADLAALTRESAMNALRRYLPEIDLDKPIPTEVLEKMIVTEDDFMEALKTIEPSSLREVTVEVPNIKWNDIGGLEALKSELREAVELPLLNPDVFSRLGIRAPKGFLLYGPPGTGKTLLAKAVANESNANFISVKGPEVLSKWVGDSEKAVREIFKKAKQVSPAIIFMDEIDSIAPRRGTSMDSGVTERIVNQLLTSMDGIEVLKGVVVIAATNRPDIIDPALLRAGRFDKIIYIPPPEEEGRLKILEVHTRKMPLAKDVDLKDIARKTDGYVGADLENLCREAGMMAYRNNPEATEVNQDAFIKAMKTIRPSIDKNVTKFYSDLAATMGRDISEKKKTE

SEQ ID NO: 11048 - protein, 355 aa, Ferroplasma acidarmanus
AYAAPLTYPIYQTSSYIVPEGQKYRYSREYNPTVENLGIKIKEMEGAEDYNVFSSGMGAITTTLLSLSKPGDRILTHLDTFARSYHFIRDFMGKWGIKPDIANPGTENIINGIKKGTGIVFIESVTNPILRVNDISTISEKCHDVGAILVVDSTVPTPYNVKSLKLGADIVVHSSSKFIAGHNNVISGLAAGRNDLMEKIDAMRRTLGTSLDPNSAFLTENGMKTLEIRMEKINSNAMEIAAELQKNPEISRVIYPGLPEHPDHEIAKKYMKGYSGIVCFKVKTDPEKFIGKLEKIVPANTMGGTETVISTPASMSHRSLTSEELNVLGVDSTFMRLSVGIEDPDEIVRDINRAL

SEQ ID NO: 11049 - protein, 198 aa, Ferroplasma acidarmanus
VRLTRIELINTKKRIKVASRGLELLKMKRQSLVMEFFKISNEVRGLRENIKNDIEKGLNAIKVAEIIDGTLEIERISYMFSSPEIKIGGKNIMGVTIPEMSAQAGKKIIDDSYLANSVPVSIYDAITLFNKIFKELLEVSQKESSMRKLLNEIDKTNRRSNAIENIMIPRFNNNYKIIREHLDELERDSFATLKFVKS

SEQ ID NO: 11050 - protein, 448 aa, Ferroplasma acidarmanus
YRSISQINGPLLFVDDVKNASYNEIVSIILDNGERVKGQVLETRNGVAVVQVFGSTTSMSPKSTGVSFTGSTFKLPVSDDMLGRIFNGFGEPVDNGPKIYSKDKVDITGAAINPYSREEPSEFIETGISTIDGMNTLVMGQKLPIFSGAGLSHNRLATQIAKQAKTLKGGEKFGVVFGAIGITSEEANYFMKQFESSGALSESVIFLNLASDPSMDRIILPRVALTTAEYLAYEKDMNMLVILTDMTNYCEALREISSSREEIPGRRGYPGYMYTDLSTIYERAGKIKGRNGSITQIPILTMPGDDITNPVPDLTGYITEGQITLSRDLSRKDIYPEVDVLLSLSRLMNQGIGSDHTREDHRGLADQLYSSYAKGKDARALSEIVGEEALSVSDKKYLQFAEDFESKYVNQGDTDRSIEETLNLGWDLLSILPKEEMKKVKSAYIPKY

SEQ ID NO: 11051 - protein, 580 aa, Ferroplasma acidarmanus
  unsure (1)..(580): unsure at all Xaa locations
DXMENKGSIYSISGPVVIATDLDGKMFDVVRVGEMGLVGEVIKIVGDKFTIQVYEDTSGLKPGEPVYSTGKPLSVELGPGLLKSIYDGIQRPLDIIQSETGDFIVRGATAPPLDEKKEWDFVPLLKEGDEVEQGYILGTVQETNIITHKIMVPYGIRGIIKSISKGKFKVSDTVCMIDTGTSKYDIKLKQIWPVRQARKVFLKFAPEIPLITGQRVIDSFFPVAKGGTVAVPGPFGSGKTVIQHQLSKWSDADITVYVGCGERGNEMTEILSTFPELQDPKSGKPLMEKTILIANTSNMPVAAREASIYTGVTIAEYYRDMGYDVALMADSTSRWAEALREISGRLEEMPGEEGYPAYLGRRISEFYERSGNAQIIAQDERTGSITLIGAVSPPGGDLSDPVVQNTLRVTRAFWALDASLASRRHFPSINWLNSYSLYLDSLSGWFKSNVNPEWPQMHSLMMGILQKESELQEIVQLVGYDSLPENQKNVLDIAKIIREDFLQQNAFDDTDTYCSIKKQYEMLTIIKTLNEMQEKSIASGLKLTQTATLPVRMKISRMKEIPENDFEKFYNDVIKEINNE

SEQ ID NO: 11052 - protein, 299 aa, Ferroplasma acidarmanus
  unsure (1)..(299): unsure at all Xaa locations
IEILHLSKSFKNFKAVSDLNLEINNGQIMGLAGLNGAGKTTTIRAACGIIFPTSGTITVNNFDIVKEKIKASRNIGWVPELPNFEPDARPVPLLKYYAGFYGIKPDEAEKNAIEMMKQFDIYNYRNRKLKYYSQGMKKRFALIAAMIGNPDNYLFDETLNGLDPNGVKEVRDLIINLKKQGKSILLSSHILELQNVADKIAIVKNGSVVKTLSRDDLMHLGTTGTKIHIKNPDAGMEKILSEFGEFTSDGTYYYIKNNGEVDVSELNRQLVIKNYRVDYISMENETLEDYFLNMVKXDE

SEQ ID NO: 11053 - protein, 413 aa, Ferroplasma acidarmanus
MSKTAVEKIFSEKSGTDSKSGDYIVANVDYVMANDITAPIAIDAFNELGMKPKSDKIIIIPDHFVPPKDINSAKQYKKSKDFALENGTWFYDIGHGGVCHQVMMEKGFAAPGRLIAGADSHTNTYGALSAISTGIGSTEAGVIFATGKMWFKIPETIKINLTGKPGKGVEGKDIILHVLSKIKNGGAAYKCMEFSGNIKYIDINERMTMANMTTEAGAKCSFFDTDEKTIEYLNQRNTGSYKIVKSDENADFSQTFNIDMNNIEPSIAIPNSPDNVRIASAIHEKIDQAYIGSCTNGRIEDIRKAAAILKGRKVNRNVRLMVVPASQEVYNQALREGLINTIVEAGGYFSGTTCGACLGGYMGVLGPDEVCISSTNRNFIGRMGDKTSKVYLANPSIVASSAILGRIGTPEEI

SEQ ID NO: 11054 - protein, 351 aa, Ferroplasma acidarmanus
IAVIPGDGIGKEIIPQVCDLVTSIDPSVNFTFYNISSERYINKGITIKDSEIDELKSYNSIFFGAIGDFRVKPGIMEQGVILRLRKELDLYMNIRPAISFSRITGNNIHMTILRENKEDFYSDISGSLNEHKLFRQKGNFYNYNIDINSESDDTIYYTMGFLSRKNLKRFFNMAYKIADTETVTITDKANAVDMYSLWREIAIEESEPAGKKINFEYADSLAYNMINNPLKYRYIIAPNLYGDILSDMSSAMVGGLGYAPSGNIGDYSSMFEPVHGSAPDIAGKNIANPVASILSCIMMLKHLNQTETAGIMEKSVENVIRNGTIPIESGGNAGTHEFINKVKNYCTMTKN

SEQ ID NO: 11055 - protein, 386 aa, Ferroplasma acidarmanus
KVLLLYSGGLDTSVMAKWIQKEMKKEVVTLTLNIGNSNLQKIKEKALGLGVSDAIVLDVKNEFSEKYIAKEIYADGMYEGYPLSTAIARPLMAEKAVLYAEEYGCNTIAHGSTGKGNDQVRFEVTMKALNEDINVIAPVRDWNMNRPDEIKYAKANGIDIPMGGKYSVDENIWGRSVEGSSIETVSNPLEYDVYEWVKPLEETGNGDIIDIEFKNGVPVSLNGKQYALKELVEKLNVIAGNNGIGLINHMEDRVTGIKSHEVYEVPGAMAIIQAHKMMESLTLNKSELDIKNYMDNQWSNFVYNGLWYDPVMEHINQFESSINKYVNGNIKLKLYKGNIVMQSIESENSIYNYDKISYDNSNFNQDSAKGFIDIYKNNTVYASNAR

SEQ ID NO: 11056 - protein, 207 aa, Ferroplasma acidarmanus
  unsure (1)..(207): unsure at all Xaa locations
LGQKAPGFLVNTTKGPLSLEDYKGNWVILFSHPADFTPVCTTEFMAFARRYDEFKKINTELIGLSVDSIYSHIEWMKNIKEKFGIEIPFPVIADINKDVAREYNMMDEKTGSTVRGVFIIDPNMIVRLMIYYPAETGRNIDEIMRTLKALQMNWDRKLAAPVNWQPGNDGIVSAPGTLDEAINREKNGSKTWYLTYRRXDKWTQGKK

SEQ ID NO: 11057 - protein, 291 aa, Ferroplasma acidarmanus
VVGSINMDIIMSSARLPETGETIKADKYYMYPGGKGANQAVSVARTGVKPQLIGKIGNDYFAEMITNYLRKENLDLCLTYGDKTGIAMINVESSGKNMITVYPGSNGNMSYDDFHNIELKNSIVMFQQEIPLKTIRDFISSNRENGNLFITDPSPFSEDNYILENSGILTPNETEAQLIAGCAINSIEDAEKASTLISGKYKNNVIIKLGSRGSISNFEGEIKYHKPYNVKTVDTTGAGDCFNGAFASEFLRTGDVDKSMEFANIAAALSTTGYGAFPSFPYRNQIISIME

SEQ ID NO: 11058 - protein, 321 aa, Ferroplasma acidarmanus
LEDYEPPEPGDNEVTIEQKYTGVCFRDILTQQGFFPRVSLPVIPGHEIGGTIIKKGKNVKDFNIGDRVSSLIYVPCGKCEFCLSGNENLCPNKVAYGEGRNGGYSRYVNADERSLVKVPPEVPEETVPIAACVIAMLYHAIGRVGKIKKGDYVLITGAGGGVGVHAVQMVKALGGHPIAETGSKWKEEELYKLGAEYVVSPEREYNKDVKEITGQGADIVLEDVGIATFSKSLRSLKTGGRLVVIGNLKPEPVELPLGLIILKGNSIKGSISSTRDDLKKALELSKSQISPVIGNKIELQDINDGYANMLDRKVLGRLLIK

SEQ ID NO: 11059 - protein, 252 aa, Ferroplasma acidarmanus
KRFPDNEMYLKIIDDVKGEDVLLVGNTRSDQDIIEYLLLLDAIKEEEPKSITAVVPFFGYARQHMRYNNGEPVSSKVFTQAINQYADRIITVELHDEQTLNYSKVPFTDIKIINPIYKYFMDKNIDFVISPDDGGYERVKLMGSKLGIPAYYIDKKRIDSTTVKMTLPEEDYKDKNILILDDIISTGGTIIKASGMLKDKGARNIYACAIHGVFANNSNEKIERYVNELTVTDTIETKYSNITISGEIAESL

SEQ ID NO: 11060 - protein, 486 aa, Ferroplasma acidarmanus
FPEKKVISGSRSITYRDLFEKVLSLSTSMNKMGISKGTVIAVADYNSIEFMELLFASSLTGSIIYPVNIKLPWNMAMETVKESGAEYVFASKEFMNAGIYKGFRDDHIVSLSENGDYIKFHDMLTSDLHREEKTTGNDNYSILFTSGTTGKPKEVLYTNEKSVNGALSILYQLGLFNTPAKLTSSDTILSLIPFYHIWSWGSAFHAAYLGADYIITGKYNPENVLNAIKENKATWINAVPTMVYDLLSHDRENRLNGIKMLIGGSPISKNLAEKLNAKGIKFSTIYGGTDMLATSISLGRPDQHESLRSVTYPVPMVSATVRDNNGNILENGTIGELWINAPWLPEKYLNRPENHDYENGWFKTGDVGEMTPDGGIKILDRVKDVVKSGGEWIPTSIIESLISEFPGIEIAAVTGIADEKWGERPVAWVKASEDIEIKEIRQFMETHASNGNINKWWIPVEFIIIEEMPMTSVGKIDKAKLREMKK

SEQ ID NO: 11061 - protein, 393 aa, Ferroplasma acidarmanus
MKDVYIAYYKRTPFSRAKPDNPSKDVYNGVSMDVLLSKLIKDSLSTGINPEDIGDVITGCAIQAGENWTYGGRHQTLLSELPVSVPSMAIDRACSSSLNATAIGAMEIQTGNSDVVLAGGMEHMTHVPLYNDPYVKYNTELMEKPEYRKYDMDVTYHVGLTAEKLAAINNISREEMDKFSFESQKLTAHAIEEGFYNNEILPVKVTHDGSAKTINADQTPRPESTLEQMSQLKPAFIENGRVTAGNSPPLSSGASLLMLMSGEKIKEYGLKPLARVIDYAAAGVDPTIMGHGPVPATNKLLKKNKLSPDNIDYWEINEAFAVVALNAIKHLNLDRNRVNIHGGSIAIGHPLGATGARIAGTLARTLQEKKGNLGVATLCVGGGQGYSLLIEKV

SEQ ID NO: 11062 - protein, 398 aa, Ferroplasma acidarmanus
  unsure (1)..(398): unsure at all Xaa locations
MIKXIKPWHIWKNMKDVYIVSAKRTPIGKFGKSLAKIKATELGAAAIKGVIQDSGIDKDLIEEVIMGNVIQANVGQNPAGQAAFSAGLKPEVTKNTVNVVCASGMLATENAAREIMLEEHDIIVSGGFENMSNSPLIMPSEFRWGPKQLLYKNLKIEDSMLVDGLVDAMYGEHMGVSAERSAKKYGITRDQTDGFSVESQNRAIRATESGEFAREIVKLDNLQKDEGMRKTSMEDLAKLNPAFDRNGILTAGSSSQLSDGASALILASEKALNEYGLKPIAKITGFSSASLDTRDFVEAPIPATRKLLEKQHKNIDYYDLVEHNEAFSVASIIVRDQLGVAQERFNVNGGAIAIGHPLGNSGSRIIVTLINALQSRHMKTGLATICHGGGGGHTLTLE

SEQ ID NO: 11063 - protein, 302 aa, Ferroplasma acidarmanus
IKNKEILVTGGAGFIGSNLVNTLSKDNHVYALDDLQTGSMHNLKDSMDRIEFIKDRVKNINDYEINPDYIFHIGIYSSSPMYKNNPHLIANAIDDLITVLEYAKKNKSKIVYASTSSIYNGIEEQKEDVIPKVSDYYTEARIAMERIANLYCNLYGMDVSGMRFFSVYGYNERSKKIYANLVSQFLWAMHDNIAPVLYGDGEQKRDFVFVEDLVKALMLAAENNKKFNVYNVGTGKNYTLNELVKILNKHLGKDIKPEYIENPMKDTYVYYTLADIKKTEQKIGFKASISLDEGIDKLIKYY

SEQ ID NO: 11064 - protein, 764 aa, Ferroplasma acidarmanus
ILWFSEISKEDLPLVGGKSANLGEMVKMKTVPVPNGFSTTSYAYKEFIIENDLDDKIINIIKHTDIENSRKLKEASEEIRQLFLNAHFNASLGKEIREYYRKLIEKEKNVYVAVRSSATSEDLPDASFAGEQDTYLNIHGEDDVVQNIKACYASLFSPRAIYYREKKNFGHFNIYLAVAVQKQLFSEVSGVMFTVDVSTGDNSKIIIESSYGLGEYIVGGVVTPDTYYVDKSTMKITNKIITNKNKMLKCLETGGTEELVVEKEMANKQSLSDEEVIHLANYGLQLEKHYGNSMDVEWAKDSFDHKIYILQARFETVWNGNRVGEDKMQQEKEANENEVILKGLPASPGKVAGVAKVLLSVEEMDKFKEGDILVTKMTAPDWVPIMGKAKAIVTDEGGLTCHAAIISRELGVPCIVGTSSYGKKATEVLKDGETITIDAKNGLIYLGGITTGTEEKTPEQNVSYESDIITGTKVLVNMGEPQLSEKVSKLPSDGIGLMREEFIWAEIGEHPLSLIKNGRGEYFVDRLSSELAKVCRDFAPRPVVLRFSDFKSDEYKSLKGGKEFEPEEDNPLLGWRGASRYYDDRYKEAFKLELQGIKKARDDYLLKNLWVMIPFTRTVEELKRVVKIMEDNGLERTKDFKLFLMAEIPSNILLADKFNQYVDGYSIGSNDLTMLLLGSDRNNGKMSSMFDERDLAIKRAIRYLIKIAHRDGKIVSICGQAPSQYDEIVDFLVRSGIDDISVNPDAVTHVRKMVASVEKRIQLE

SEQ ID NO: 11065 - protein, 332 aa, Ferroplasma acidarmanus
ALTTSPPGGGISYSRITMADHMDGKAKIRPVYTGICGTDRAEIAGHLPFAYNPTGQNYMVIGHEAVCQVIDIGENNSRIRPGDYVIPIVRRRGTCINCRIGRQDNCSDADNDITEAGIRGADGFNSEYFFDSPENLIKVNDSSMVMLSTLTEPAKNVMKAFEIFNKLSARSIFESEDSTYTSKNCLIIGTGSEAFLYAFMAREYGMTVYLTNRHRLLEEKMRIIEGIHCLFYNYLEENGPDKIDLLIDTSGDPAAVMKFVGKLNYNGIAILFGTNGAAPDSQLTGNDLNYIIEHNIAVSGSVDGSKKHYMDAIGYLEKWKYSSSGIINKLIT

SEQ ID NO: 11066 - protein, 278 aa, Ferroplasma acidarmanus
MLLDGKVVASEKMERLKSEIKGIIEKYGIEPELKLIQVGNDPASTIYANSKIKRGTKLGINVTLEKFDNITMGKLVDYIKDANANSRINGIMVESPLPPSLNFQEVVDNISFYKDTDGMTSFNQGNLYTKNEMIAPATARAVVDILEYYKIQPGNACIINRSAVVGRPLAMLLLNRDYTVTLCHSKTVDIKRIARENNVLVVAIGKPDYIDESYVTSESTVIDVGINYSGNKISGDVNFDSVSNKAKNITPVPGGVGIVTATDIFENFLNGLKYQIKE

SEQ ID NO: 11067 - protein, 409 aa, Ferroplasma acidarmanus
MDSLIHGFHKMTVDERRQIIREFSGLSSEDMEAMDYRMDISTAGNMIENVYTIMDYPVGIATNFKINDKEYLIPMSLEEPSVIAACSNAARYARPGGFTAYSTNSYMRGEIELYNVPDPDYAAINILKNKENILKMANTRSKTLSGMNAGAKSIDLHFVNNELIINIIIDVADAMGANIINTMLEYVSGYIEELTGGQANLRIMSNLTTERITYAYAKFDGKMLGEETVDRIIRANEFAKNDIYRATTHNKGIMNGIDAVLLATMNDFRAQEANSHAYASMGGYGPLTEYRKDIDGNLIGSIKIPIAVGTVGGATKTSRKAMLAMKIMGIHGSGEFSNILGSVGLAQNFAALRALAAEGIQSGHMKLHARNIAIAAGATGEMVEKVAGEMISTGSISYTAAVDIIKKFR

SEQ ID NO: 11068 - protein, 298 aa, Ferroplasma acidarmanus
RSIISISDLDGEDINEVFSRADKMLENIESGKKINVMSSKILATLFYEPSTRTRLSFESAMERLGGSVISMADSKTSSTSKGETLADTIRIVESYSDLIVIRHPLEGAAFLASRFSSKPIINAGDGSGEHPTQTLIDLYTIRKEFGSIDGKTITIIGDLKYGRTVHSLLSALSRYNVTVNLVSPENLAIPKHVYNDVKGRLNMNISTDITKYLGETDILYVTRIQKERFTDKNEYARLIGSYKITVSDVNKLKKGAIIMHPLPRVDEISSEVDNTPAARYFKQAYYGVPVRMAIISMI

SEQ ID NO: 11069 - protein, 147 aa, Ferroplasma acidarmanus
LKISKIKDGTVIDHIAAGKALKVLAILGIDESNSISIGIRVTSEKLAYKDVIKIENKFLEKLELDKIALIANEATISIIKNYEIIEKFKLDMPQVFKGIVKCANQNCITNAGEPVKSEFMTVNADPLTIKCVYCKKEMSGEEIINNI

SEQ ID NO: 11070 - protein, 216 aa, Ferroplasma acidarmanus
MEIYLDSLTKNYRKIKALDSINLKIEGHGCTGLLGPNGAGKTTMLKLCTNIIKPSHGKVELNNVNVAIYPEKALEPVGALIEQPEFYSYLTGYEILEFTSKIKGIGKDEFKSEMKRLGELTGIDAYADRKTGTYSRGMKQRLALSVAMLGNPEIIILDEPTFGLDPKGMVDVRNIIKDIAKEHLVLLSTHLISEARELCDRTIIINGGKIEYDSAM

SEQ ID NO: 11071 - protein, 542 aa, Ferroplasma acidarmanus
IKSYPPGIKRHIQIPEIGIYQQFCRSASKYASHVAIDFMGNRISYSRLKQEIESAASFLKGLNLHKGDKLTIMLPNIPQYVIFFFASMKLGISVVQMNPMYMLPEIEYELNDSGSRNIVVMHDMLSKVLPLKEKMLDNIIDVRVEDYLPPVKALLYKAVKKGKSEKLAAPAGIIPYSGKSRNPAADDESIDPYNDAALLQYTGGTTGVPKAATLTHRNLLANVNQLIEWFPEDFKESISYLSSIPFFHVYGMMTAMLTPLMQGSTIIPVPDPRDLKMTLNIIKKKKPTAFPGIPTMYHSIINYPDLEKYDISNIKLCISGAMPLPLELQKKFEGKTGGTLVEGYGLSECSPVTNISPLLPEWKNRRKPGSIGLPLPETYEKIVDIDDGITEVPQGVEGELLIKGPQVMKGYWNRPEENKQILVDGWLHTGDIAKMDSEGYFYIVDRKKDMIIAGGYNIYPEEVEKVLYEHPGVSQCAVVGVPDAHRGETVKAIIVLSDKSVTEDEIKKYCQEKLAKYKVPKIIQFTDSLPLTPVGKIDKKAL

SEQ ID NO: 11072 - protein, 371 aa, Ferroplasma acidarmanus
VSLGLEDVFIKYTGLTFIDGNAGVLRYRGYDINDLVQNTGFEEVCYLMTNGELPNSQQLAEFKKSVKEHYKLPDHVMELISDLPREADTLTMMETAFASLSSGDYQWNKENDRKQVPKILGENLGIISNIYRHKMGMGLQNPDPKYDYAEAFLRNCFGNADEKKISAMNAALVIYVDHEVPASTTAALVASSTLSDMYSCITAATAALKGPLHGGAAEAAYKQLLDIGNVDNVENWFKTNILDGKRRLMGFGHRVYRTYDPRMKIFKKLATTLEQTDEQKKLFEIAVKLEELGVKEFGGKGIYPNTDYYSGIVFNEIGFPIYMFTTLFGFSRVLGWLSHITEYVEEEERLIRPRAVYTGPDKRDFVKIQDR

SEQ ID NO: 11073 - protein, 1390 aa, Ferroplasma acidarmanus
  unsure (1)..(1390): unsure at all Xaa locations
IRFFKIYMKRYLLLEDGTTYEGTGYGYEGETNGEIVFTTSMSGYLETITDPSYAGEILIFAFPEIANYPLNLEHMESSKVQVAGIITKDAHSIYSGGESGTGFNEFLKQNMVPAIDGIDTRSLVEKIRESGAIKGYIKNKNEFPDKFEDTMDLDLVSMVSIKKYKYYNSGHKKQILFIDVGTKNSLIKRLSETASLHIVPYNYDFFNIKFHYDAIFLPNGPGNPGHSSLEPLRAFIREKSSSMPVMGVCLGNQLIALSMGGKTEKMKYGHRGINHAVLIGNRVYITSHNHGYAVNGDSLKGTGMEICGTDINDGTVEMIKHRELPVFSVQFHPEAYPGPYDSTWFFNXYXNNSRXKNMNSDIKCTLVIGSGPIVIGQAAEFDYSGSQACLALKEEGIKTVLLNSNPATIQTDREIADRVYIEPVDPESVLAIIKKEKIDSILPSTGGQVGLNLVILLERLGILSSYNIKVLGTPVTSIEIAEDRKKFFNLMKKIGEPVIESYTLTKNDYRDLMPGIKKYPLILRTGFSLGGSGGVIIKNVKELSDYCDDYFSVHDDMVELDESLLGLKEIEYEMMRDNNGNCISICNMENLDPMGVHTGESIVTTPSLTLSNDSYQKLRTSAIHVVNEIGVIGSCNIQFALDQEKDEYYIVEVNPRTSRSSALASKASGYPIARVSTKIAVGYNLNEIKNPVTKNTYAAFEPSMDYITVKIPRWPFDKFSVKREIGIEMKSIGEAMGIGRIFEEALMKAISSLDIKQSIPMRLFTSPEKTIELMKVPNDLRLFAIFDGLFQGIGVDKISELSGYDKFFIVKIKNIVDAMETIKRGVIPENMENLKMLGISDETISYYTGIPQTEIIKYRIEKKIVPVYKNIDTCSGEFNADTTYLYSAYDTHNDNRISNKKKVIVIGSGPNRISQGVEFDYGAVKSILSLRSMGYEAIMVNSNPETVSTDFDISDKLYFEPVTLEHISNIASAEKPEGIIIQFSGQTGQNMASGISEIFNNIILGTKPEDIYRIEERTIFSKTLRSLGIKQPDFIEASNINELEEKIKGISLPVIIRSSFIIGGRAMDIIYDYDILVSRVRELFIERPGSPVLVSSYLKNATEIDVDFISSAEKSIIAGISVHIEEAGTHSGDATMVLGPGVVDSDTLEQLKEIVEKMRQNFNLSGLSNLQLAIKDSEIYVIELNARSSRSVPFVSKATGINWIDSGVKAMLGIEPDLKYSEPASFFIKVPVFPFKRFRDMDVILGPEMKSTGEAMCCGKTFQEAMSKVIRIMKRDFKLNSVIITVNDADKNEAIKIGRKLAAKNVKIYATPGTYNAMKDAGVKSNVVYRVKDLRSPGISEIIKNEDISMIINTPSESYGSIRDGFSIRNLGIKKDIPLITNIRFASELV

SEQ ID NO: 11074 - protein, 230 aa, Ferroplasma acidarmanus
MIQIRELEKEYGKHQRALDHITQDLDSGIVSIIGKNGAGKTTLLRILSTQLKSSSGDAFIDGLSINKDIKEIRNKIVSIPQEASPIGILTAYEQVFLYLTGKGFSFHSARQESRMALKVVGLGDKMDVPTDILSGGMKRKMFVAMALGCNAETVFLDEPTTGLDPLSRMETWGAIKELTGNVVLTTHYMEEATELSRKIYMMDSGKFIGSGTADELLYDLRGKVRIESKE

SEQ ID NO: 11075 - protein, 433 aa, Ferroplasma acidarmanus
ELFGTNGIRGVPNEDLTTDLAMGIGKAIGTFFNGGKIAIAKDTRISGDMFMLAVASAIMSTGSDVIYVGELPTPGLQYYCKSKGIPGVMITASHNPPQYNGIKAIDKDGTEIDEESEIKIEDIYNGKLFKQASWEKIGTYNYDSTAIGLYMDSIVSMVDEKAIKERRLNVVIDTGNGASYYTSPTILTKLNCHVVSLNANPDGKFSSRNSEPKPENLVDLISVMKTGKFDLGIAHDGDADRCVFIDEKGNYIDGDKSLALIVKHTIQKGDIVVTPVSSSDALENICREKGAKLISTRVGAPIVARAMIDNNASIGGEENGGIIYGKHQFCRDGAMTMALMLNLLTHENKTVSSLLEEIPDYTMAKSSVARKKSWEEIKKLLMENFSGKKMDFTDGVKIFDEDGWTLIRPSGTEKIIRIFSESPSKSLAEEYNK

SEQ ID NO: 11076 - protein, 139 aa, Ferroplasma acidarmanus
MERTLVLIKPDGVKRHLIGNIIERFENKGLKIVSLKLMKVSDDKARQHYSVHSMKPFFEGLVSYLTSGPIVALILEGDNAIISCRNLAGATDGSAAAAGTIRGDFSLNIEENIVHASDSPESFNHEYKIFFNENEIMDY

SEQ ID NO: 11077 - protein, 595 aa, Ferroplasma acidarmanus
FPFSAIVDNEDIKLGLIVNAIDSNIGGLLITGPKGIAKSTMVRALSSILPEVKAVKGCRFHCDPDGDLCDECLEARKKGELKTENMKIRIINLPNSTTLDRVVGSLDISHAIKGESVLREGLIGEANRGILYIDEVNLLDDSIVDSILDSAASGINIVEREGVSYTHPARFILVGTMNPEEGELRPQLLDRFGISVEGKMPESPEKLLDIADRVEEFDSDRESFIEKFRAPDREIQLKIVNARKLLPYVKIKREYRVFVADLVIKNSLSNRAMISTVKTAKAIAAYYGRTEVNEDDLKKALQFALNHRMKEKGKSRPDYNFNDPGNNGDNTGDNQEQDSASNQPTPQDQKNHETGKNGKEKQEKQQKQKENRESTVHNLEVDTGKKIETKKSGRSGRAKQFRHRGRKSGTYMDIRHSLLNTWSSGFRMINEKTIVMKDSYSKGSIPFIIAIDSSRSMNFSSRIEIAREFSDMLLKKLYIMRSRVALIKFAGERSEVLMNFSRNFTALKNIIDNISSGGKTPLYDALENIYKLSSYEKLKTVSLLVTDGRGNVFPGNARENLMEISKKIKPLSSMYIIDKNDNKFLPTYNGIISSY

SEQ ID NO: 11078 - protein, 1129 aa, Ferroplasma acidarmanus
  unsure (1)..(1129): unsure at all Xaa locations
SVIQSFLHAGEETGNEIKIKYPRLDPVDKEFIDFVRDADAVFIHHFSGENIYSNILEDIESVIKGKKNVIAIDPILSNYSTVSKFVEEKVSNYYFYGGYENIKNMVLFIENTITPRHYEEPVEMPFSGIYEYGNTEFPKKVGILFYRTAWVDRDTKIIQYIIDNLNNNKISAIPVFTNGFGDRSRGIMSAEECINTYFYSDGKPVVDAVINLLSFSLIKKEDKSTLMNLGVPVFQGLIYYYKEEKEWLDSSGLDVVSTIMSAMLPEMDGTIEPVLIGVIKKIYDRGAIYRELVPVKEQAQYMINRIRKWVNLRYMKNSEKKIAIILHSGSSFKDLEANIGTATGLDTLNSVSSIMSLLRENGYNIDYLPENGESLIKTIMEKKAIPEGKWTPVEEIINKGGSVYGMPVKEYMKFFRELPEDSQDMIIKRWGELNTERDYMLLNGTMHIPGIISGNIFIGIQPKRITFADNDNSIRSIHDSLTPVTHYWLAFYKWIQEIFRADAIIHVGTHGTLEFTPGKGLGLSPSDFPEISIGEIPNLYLYSTNVPGEGIIAKRRSYAVLLDYITPPTAYDDVPDDIKELEDLIDDYEETEKAENTSRETMILEKIQKISDKIGLSIDFKDAHKATHEIEHRLNLFKDSIISKGLYIYGKDIDKDDLKDYVTTATRFDESLSKKYGKEEAENQIMAYLNEGTPIPELETGIIEKLKFSPENEKNNLLMALNGKFIEPGVSGSLTRGRYDVLPSGRNFYAVDPFKIPSHSAWQVGVILANKLIENEYKKNNKFPETIGFVLWSTDAYRSDGELISQILYTIGVEPVWQEGTKKVKDVKPIPMDVLKRPRIDVVVESSGIVRDNLFNIIELIDLAIKKVSELDEDDDVNFIVKHHKKYGHLDRIFSSKPGSYGSGVNNAIESSKWENENDLADVFTEWMGYSYGKNNFGRESKDELLSISKDIETIIHKREIDEIDINDDSCNYSYAGGFYLMAKKSGSKPSLMFEDTFNPNKPQVRTMKEEIERTAIGKLLNEKWIEAQKNFGYRGATEMLKKIEHLYGWGATTGMVNDNIFNNIADKFVLDREMKEWFKKENPWALSEITSRMIEAYKRDIWHASDSMKEQLEEEYMEIEGENEXGHT

SEQ ID NO: 11079 - protein, 530 aa, Ferroplasma acidarmanus
  unsure (1)..(530): unsure at all Xaa locations
KTVELKVYGMTCDDCVRHVSGGLKQAEGVTDVSVSLKDGMAVVKAMDTVDPENLLKWMFSKASIKHSXKVLKMSEYDLAIIGWGAAGFAAAIKASELTSNQMKIALIGTGPIGGTCVNVGCVPSKFLIEASKNYKEATKPSYRGITANANINFSEFMESLNDFVSTERNTKYADVIKNFENIDMYEGMAKFIDNNTVAVNNKDIKALNFIISTGSRTLIPEIKGLTDYYTSDTIWNMRELPGKIAVLGSGEVALELAYAFSNFGTEVHIFNRSNRILKGFDEDINNHLINALKTNGIIFHLGQNFQEIINKNGKKSIVTEAGTFDNFDSLLVATGRVPQIDKLNLKAAGISTDNGIVVDDSLKTTNPIIYAAGDCIRQSLKLETLAGKEGVIAVENMLGGSRTINMHEVPWVVFTEPNVASVGYTEAELKSKNIEYDVRTVELKNVVKANILNSYDGIAKVISGKDKKILGVHVVAPMAAEFIIEGVYLIQNGLTYDNLINAMHVFPTVAESIKIGGQAFIRDISKMSCC

SEQ ID NO: 11080 - protein, 341 aa, Ferroplasma acidarmanus
  unsure (1)..(341): unsure at all Xaa locations
MGVDISGILVKHQTSIRENGGITVSIDAFNIIYQFLSSIRGEDGEPLKDEHGNITSHLSGIFYRTATLLENNIKPVYSFDGKPYRLKDETLKERKAIKEKNIAELNLAMENKDAEKIKTLSSRINYITADIVSESKKLLDMMGVPWVQAPSEGEAQASYMSKVGAVDSVISQDYDCLLLGARRVLRNFTMYGRRRISGTGKFINITPEIIDLKENLDNLGITQDQLIGIGILVGTDFNPGIRGIGAKTGLSLIKKYGDIESVLKQKNKTIDNLDEIKEFFLNPPVEDTGELKFAPPYREKIIEYLCAEHSFSENRINSILDRIEKNYSGANQSSLDKYFXR

SEQ ID NO: 11081 - protein, 1143 aa, Ferroplasma acidarmanus
VDSIEMENFKSYGDKQSIKINKGFTVIIGPNGSGKSNIGDSMLFVLGIRANKTVRVDKLEDFIHKTDPPKKHCYVVLNVISNENNRYSIKRELVYNHGEYKSNYYINDKRASRTDVLKLIDSFHIYLDAYSFVLQGDINNLVKMTGTEKRKLFESIAGIESYKERIESAQNDINGLNENLNSMDAVLLEIKSMLDTLEVDRENALKYNKLNKEVNELKFFLKVKDRDRINQELAMYNGNIEKSQSDIDNLENENKNLSIQRDEAINRIKEIEDKLDAMGGQEVKGIRKRIEELNIGIAELKTKIGSTGESKTNSEARLKTSREAYNFNREQLENKLKEKKNYESYLKGTENSIAKINRELEKFRQENYENSKLTREINDRLAAIDVEMQQANDQIINDYDIRTIEQELSGFSRENTMNEEKIKEESIKVKDLKWKIDNLKKNIKEYSEEINEVNKKFLTVRNKLNELVTMKSNNDVEIRNKEKELRGLNYRGTASPALREINSMMETESGIHGPLGKLIEYEDKYANAVIVAAGGRLNSIVVDNDSVAQMCIQAIKAKKLGRLTFIPLNKIATSPDRQKAAELINSGNAIDFVRNLITCDPAFEKAIKYAFGDTVLMDTLENARKHMTGVRIVTLDGDVLDPSGAMTGGSIKNDEILANRITKAIAELEEQNEILKSEISFKEKENSEISSKLADLTRKRDISTSNINNYETQLQESENSIEAAKTRIEEIKLKIKDAEDRKSNFEFKKNEVKMQLFTLDKERKELFKKLKELAPENVEIEKQMEEELGNEMKSRENYSSKLAQIETEFKHFTEKSQELEEKITGLENEITKFTGMVAEFKNKVEAMEKELEENRAKENEIDSRSRELYTEKNQVSTARDKLFENIRKNDDLISNKKAIIAGLKTKIENLAFQLETINYEIENTGMEYIEFNMSISEVKQKIDENSREIEKLGAVNMKAIEQYDMELNKYNSTEEKYKTLLSEKNDLIDLQNQIIEDEKRIFLELFDTINSQFQKIYARLSEGGEANLEITSRDDPLNSEVYIKVKPRGKHMIKIDALSGGEKSVAVLALILSFQIKNPSPIYYLDEVDMFLDGHNAEHVGELFMENSKTSQVVMVSLKGAVTKFADNLIAVTTDKHGNTKII

SEQ ID NO: 11082 - protein, 318 aa, Ferroplasma acidarmanus
DSELENKKLTIEDLPGVGEATAEKLRENGYDDIMAIAVASPKDLADISGIAEGAAVKIINAARKYADVGNFETGEEILKRRKEVRKLSTGAQGLDNLIGGGLETQSITEFFGEFGSGKTQIMLQLAVNATMPEEQGGLNSDVLIIDTENTFRPERVIQMAKAKNLDPDETLKRIHVARAYNAHHQILLAEKASDIAKEFPIKLLIVDSLTSHFRSEYVGRGSLAERQQLLNKHMHDLLKFGTIFNAVIAVTNQVSANPAVFFGDPMTPIGGNIVGHTATFRLYLRKAKAGKRIARLIDSPYLPEGEAVITLTEDGIID

SEQ ID NO: 11083 - protein, 375 aa, Ferroplasma acidarmanus
  unsure (1)..(375): unsure at all Xaa locations
DXSYNVTGTGLMQYFREYYYKNHLGIPDMLFQREIGFIPFNGTMIRHKKFDSQNEIENFVRRAIPRHLYYSSSYYRFPDQHKMLEKEWLGAELIFDLDADHIEGADKMTYMEILAEVKKHTLRLLEMLMDDFGFEEKNIRLYFSGGRGYHVHVESDRIYTMDSDSRREIGDYIKIEGLNMEDLKLLDDSYFEYGILKKFNIYISNFYRNLDENYIKKVFPKSWWNYLEYLEKYYNGEKIRDFLSNEKGNKFKLLIKQNKSNENASIDYDRIILGKILEDFKSNALAEIDEPVTTDIHRLIRFPYSLHGKTGLMVKPVAIGELKTFNPLDEAIPDVFQGRDVKINLKIDKFSIEMNRQNYNIARGENSVPLYLAIF

SEQ ID NO: 11084 - protein, 474 aa, Ferroplasma acidarmanus
LDPVFGNPGTTEIPMLRGIRNYYLTLHDSIALGMADGYAQYNNTASIVNLHTLPGLGNTMSFVNTAKWNRSPVVITAGQQDTRHIVFDPLLSGDLLNTVSGLVKYSYEIKNPSDIPTAFRRAKAIAMTPPMGPVFISVPMDMMDYTAENLYFNDVRTNVSSYDPEAVFEIVERINKAKHPALVFGYEIDVYNAYAEAEAFADRLGVEVYSEPLASRGTFNTANEHYAGDLLPASTLMNLKFVNNDLIVFIGGDITFYPYLPSLPFPGKDVIFIGTDISHKTGDGYTMNPKLFLSEAVKLIKAKGDYKRGTDYLYANRVARQRLSMGVDYVLFKAKKLFSDYTIVDEAISASENVRSTFGYGYRKYYTAKSGQLGWATAAALGIGMNNKKTLVIIGDGAFMYTVQGLWTAKHYNIPVKFLVLNNSGYNILKSFSKSYYPDMEKKDYFQLNLDIESVAKGFGVETHTADENLSDLE

SEQ ID NO: 11085 - protein, 469 aa, Ferroplasma acidarmanus
NIINGIEETGGERIELKSPVDGSLIGYIIDTDKDTVERAIQSSREAFNKFYLESTIKSRQELIGKLTDIVQEKATIYADLESKNTGKTIRQSTFMDIPLAISHIRYFAETDEFKFQRKITHPEYPGTEGIVQNAPMGVVASIAPWNVPFLMAVWKIIPPVLAGNAVVIKPSHYTPLTAIELVKDMKAAGFPDGLVNLVNGTGRTTGNLLVNSDHVDMVSFTGSTPTGSRIMEQAAKNIKKVSLELGGKSPNIVFADADLDHAVKGVIFGIFLNAGQLCESASRLIIEESIMDKFLQKVKTYLDSMKSGNPMDFETDISAITTKEQKEKIESLISQTVKSGGNIFYSKNMQGTPDKGTYFPPTLLTGLTPGQQISDEEIFGPVLTVYPFKSEKEAIDLANSTKYGLAAGIWTKDIEKAGRVASMIEAGTVWVNEYHLLSAAAPRGGFKKSGIGRELGLEGILEYTQTRHI

SEQ ID NO: 11086 - protein, 424 aa, Ferroplasma acidarmanus
KIITDVPGPESTLLLQRQREMESSTVIYLDSFPIAIKRAENSLIEDLDGNIFIDWVSGISVMNLGFNDKIRDAVKAQLDDIWHALEIPTEVRINFLEALRNSFPPEMRNYKTIFGISGADACETAINIAHAIRKKNAPTIAFEGAYHGVSGGIIAATAGRKYREAVYSDGFKIIRVPYPYELWYDYDVSDIISIMKKIMDDGEAGYDRPDSVIVEPIQGEGGYIVPPDGFLKAIREFCTEYDLTMIVDEVQSGVGRTGKMWAFEYENITPDIVCVSKSIGGGLPVSLVYYRDDYDKKLPKPFHLGTYRANPLAMAAGITVINEVPKYFDKVKSSGKEMLNKFNKIDSNLIGEVRGKGYMIGIELVDNGKPMNSKRMMELKHELLQNGLLMHTCGHYGNVFRFMGALNMPDELINTGINIFGKVL

SEQ ID NO: 11087 - protein, 354 aa, Ferroplasma acidarmanus
YYQILGVDKTASQEEIRSKFRELAKKYHPDVNSGSKEAEQKFKEIAEAYEVLSDPQKRQQYDATGSTTFGDAGAGGGAGFNWDNFSHFDDINDIFNTIFGGGFGRGNFNGSYGSSSPQPDLDIYVKLNVTMEDAYYGASKPIKFKRNAMCEVCNGTGAEGGVLVTCPTCHGTGQERISRGQGFFNFVQVIVCRTCMGKGKIPKTPCKACAGKGYIPKMENISITIPKGVDTNTRLRTQKLGNSFGGVTGDLYAVVYVQPNPNIKRTGDNLYVKEAIDFPTAALGGSVEIPLFKEKFTLNIPAGSQPEDVLRIKGAGMPKLTSRGSGDLLVVLKLQVPKHLTSREKELIEELKGE

SEQ ID NO: 11088 - protein, 625 aa, Ferroplasma acidarmanus
MSKIIGIDLGTSNSAAAVVISGKPETIPAAEGVSLGGKSFPSYVAFTKDGQLLVGEPARRQALLNPEGTIYGAKRKMGTDFKYKIFGKEYTPQQISAFILQKIKKDAEAFLGEPVNDAVITVPAYFNDNQRQATKDAGAIAGLNVKRIINEPTAACMAYGIDKLNETLKILIYDFGGGTLDVTVMDFGQGVFEVMSTSGDTKLGGSDMDEAIVNFLADDFKSKEGIDLRKDKSAYIRLRDAAEKAKIELSTVLESDINLPYITATQDGPKHLEFKLTRAKLEELIAPIVGKSAASLDKALEGAKLSKGDINKIILIGGPTRMPYVKKYVEDYFGKKSEGGVDPMQAVATGAAIQGGVLMGDIKDIVLLDVTPLTLGIETVGGVMTPLINANATIPTKKTQVFSTAADMQTSVEIHIVQGERPLVKDDVSLGNFVLTGIAPAPRGVPQIEVTFDIDANGILNVSAKDKGTGKSQSISISASNKLSKDEIEKMKKEAEQYAEEDKKEKETIETLNNGESLAYTVEKTINEAGDKLDNETKDKIKGIIKDLKDAVEKKDVDKVKEITENLTKEMTEVYTKMAQAQQPDQGAGQQSEQQSEQQGEEGSSQEQNNNEQQSDDSTVNTDYK

SEQ ID NO: 11089 - protein, 313 aa, Ferroplasma acidarmanus
ENNILKETVAEFCEKNLDEKKIENEGISKATTELLASQGFLGATIPAKYSGSELDNTSYEIILEEISKYSPSVAMKIFILNSLYYPSVKGTSAESTLTDAASGKLDVAVDVIGNGSDLKENSGKLSGTLKSILGTDAENIILFNGKTSMVSGKFKSAARDFMGFRGMKFGDVTLDNSITILDQKSRKDKIIEESYGPLSAIALGMISGALQKAIDYTSVRKAFGNYLKDFEPISFRLSRFRSIESVLRSALYGGVDPYYAFNLAMESMVEIARYSVNTHGGYGYFQDFGVEKFYRDSIVMKSIFYGNQELKKL

SEQ ID NO: 11090 - protein, 354 aa, Ferroplasma acidarmanus
EEYDEYRNKIREFALKEFTEDVAADYDRKEAYPDELRKKSLSLGIVDMQNPAKVMIGIEELCRVDAGLGIALTTPYFGSEVIMLFGNDAQKAILEDVYKGKYILGLGVTEPSGGSDVAGLKTTAKKQGNKYILNGSKMFITNGSIADYLVVLARTSEDSNPHHGLSTFLVNTKLKGFKANKLVDKLGVRATNTAELQFNNIELSEDDLIGEEGKGFYYIMMFFNISRIYVAAQSLGIARGAFDKIKSYIKENNIKDEESMFRLSDVGTRIEATRQMTYNAATYLFEFKPKPELTSMAKAYGSETAVYAAESAMEILGDHSAYEDVQRIFRNAKIMEIWEGTSEIEKLVIARYIL

SEQ ID NO: 11091 - protein, 391 aa, Ferroplasma acidarmanus
MEDVYIVDYRRIPFSRARPRDPEKDVYNDLRMDKMLSELIRHSVSETKINPAEIEDVITGCAFQAGENWTYGGRHPVLLADLPVSVPAMSLDRACSSSLNATGIGALEIMAGKAGIIISGGMEHMTHVPLGVDNQFIKPNMELMANPKYSKFNMNVSYNMGLTAEKLAKLRNISRDEMDEYSYNSHKRAAKAYEDGFMKGEIMPVTVNGNTITSDLGIRKDTTLEQIKSLKPAYSEDGIITAANSSSLNDGASMVMLMSGKKLKEYGLKPMARIVDFAAAGVDPTIMGEGPVPATKKVLERNNLKPEDIDYWEINEAFAVVVLNAVHAFNLDLNRVNIHGGGLSIGHPLGATGARIAGTLARTLEDKKGDLGIATLCVGGGQGYSMLLERV

SEQ ID NO: 11092 - protein, 520 aa, Ferroplasma acidarmanus
DFKLTINNLLDSAVRANGDQKIIYKNLQLTYNSFYKNVKNFAANLVKIGVKPGDRIAVIDYDTINYMYCYYSIPMIGAVIHMVNIRYPPEILYYTIKNSEDTYIVVNSDFMPLLMQFKNMFEFIKGFIVYSEHGHENYQLDNVYYADDLLKDTDYNITPPDENDMATLFYTSGTTGLPKGVYYNHRQLVLHSMATAEGLSDDPILLNKTSILLPLVPMFHVHAWGMPYFAIMKGLKYVLPGKYEWDRIVETMEKEHVTNSAMVPSILYLLLQAKRGPEVLGKLKLKSVIGGAALNEGLARSAESIGMSLVTGYGMSETCPILTLASYTNDILPLSEEIKEKYRRKTGVPVPMVNLRVVYQGKDVAKDDTEIGEIIVQAPWLTAGYLKDPEKTAKLWIDGWLHTGDLATMDKYGYIKIVDRESDAVKSGGEFIPSMVLEDLISTVPGVGEVAVTKKSDEKWGERPVAFIKGTATVEAIKEHMQQFVDTGRIAKFWLPDDYIFVDDFEKTGTGKINKVVLRK

SEQ ID NO: 11093 - protein, 645 aa, Ferroplasma acidarmanus
IYISMIKQVAVIGAGVMGHSIAEVFALNGYKVNLEDFYPEVIEKAKVGINGSLDKLIASGKINDAAKKAALDNIKFFNNIGEAVKNVDLSIEVVPEIYNIKVKVLKEIAENTDKIIASNTSNIRITEMGEEIKNPERLVGMHFFNPPILMKLVEVIKGDKTSMEYVEEIYELAGKIGKKPIKVLKDEAGFVVNRISAPEMLLLCNAYGNKIDRPEAIDKYFKSQGLPMGPYQLFDYVGLDTVVDSLQYYGKELSPDYGKCHAFDSFIEAKHLGLKTGSGIYKWENGKAIIPDANESEKISLMDMFALEINEATKLIEDGVAVPDDIEIGVKYGLNRPFGPITVANGLSNDEVLETLNNLYKQYKIEVFKPSKTIESHKMKESFNKKPVEVKKEEKSGILDYSKDGKVGVITIKNGKNNLMSFELLKALDKQLDAIEEANDVNVVVIKGNERAFSAGADLSQFISNPYMFMKISNTGESIFDRITRMNKIFIAQLRGYVLGGGFELSLACDIRTSLPDSVIGFPETSLGLIPGYGGSQRLPNLIGISRAMDMILTCERISGEKAYEYGIITRLFKEELEENTMKLAKDLSEKISPASVYVAKRLIYNTATINLDEEALSMGMLYAGNDMKEGVKAFLEKRKPDYKG

SEQ ID NO: 11094 - protein, 380 aa, Ferroplasma acidarmanus
MNYENEHIANTYQRLPVNVLNGNGAILHDINGKRYIDMMGGYGVAILGYGNKKIKEAVCRQFDTIPIAHASEYTAAREEFIKNLTGIVPAGLDKFYLGNTGAEAIEAAIKVVIKSSKNHKIIAMTNSYHGKTAGALSITYSEKYRQSFGDLLIKNVEFIRYNNMEDLDKIRKDNDISAVFFEPVQGEGGINIPDRDYVRELRQITEEKGIILVADEIQSGLGRTGKMWAHEHFGIKPDIITIGKGIGGGIPLSVTAGKPEFMDNLAKGEQSSTTGGNPIAMASGSAVIEQLTDDLINEVAVKGELFRNTLKEYLADSRIVKEIRGLGLMDAIELRVKFLPVFMDIINRGVLPLYSGINILRMLPPYVISDAEITEAAKIM

SEQ ID NO: 11095 - protein, 238 aa, Ferroplasma acidarmanus
VLKIGGSVLDNFLENDNLYSIIQQFDCPLAIVHGGGNYLDTHADSFNYTKKFVTSPEGIRSRYTDKNTLEIFTMVMNLINQKLVLNLKEHGIKAVTLNGIINARRKEKLIIMNEKNRKMIIDGGYTGRVESADSIPIRAVIDEGYIPVISPVAYGNGNYLNVDADRAAAYVAGSMGSDSLVFLTNVSGLYYKDRVIEKADVAYIKSILNEIGTGMDKKLMASIEALEMGVRQVTISNP

SEQ ID NO: 11096 - protein, 347 aa, Ferroplasma acidarmanus
VMKVGIVGASGYVGGELMRLLVRHPEIEITSVSSTRHSGEKVSRIHPDLYGLTDLKFEDITPLDMAGKVDLIFLALPHGTSIKYVPGLVETGVKIIDMSADFRLKNPELYKPWYGYEHGYPDLIKKFVYGMPELHREQIKNATYIATPGCIASSSIYSIAPFLSLELSSDIINVDAKVGSSGSGSGLDESKVFSERFDSIRAYKPVNHRHTPEIEQELEYASGKKVKIALSAHSVNMVRGILTTSSIYSEGDEITLWSLLRKFYGNEKFIRLIMDRKSNYKYPDPKTVIGSNFADIGFAIDKYVKRVVSFGAIDNLIKGAAGNAVQSMNIMNGFNEYEGLMMPSLFP

SEQ ID NO: 11097 - protein, 259 aa, Ferroplasma acidarmanus
DLKNKNAIVCAGSTGIGKGVISVLAKYGANITTFSRTKENVESLKEEIRKETGVTVNAMCADLSKKDDLMRVVDSAHEQYGKIDFLVMNYGDPRVDPFMQLNESDWDYNIDMIFKSTIRMVDMCATDMIKSNSGRIIFITSMTTKNPLENFAISNSLRSGVVALGKTLSIELGKYNINVNSISQGYFYTRRLENIIKKNSVSSGKPVEEVESQLMKEIPLGRFGKPEEVGNLVAFLCSGMSSYITGINIPIDGGVIKSI

SEQ ID NO: 11098 - protein, 777 aa, Ferroplasma acidarmanus
SLEDLFKKLNTSKAGLSGNEASSRLHTYGYNEVSEKKESSILKFLKKFWTPISWMLELTIIITFILGKYDDSLIILFLLIFNGVISFTQESKADNAVELLKKKLSAQARVLRDGKWNVIETKFLVPGDIVHLRLGDVVPADIKIIDDELEIDQSALTGESLSVTRKKGDTIYSSSVVKRGECNGLVTETGSKTYFGKTTELVEIAKTKSHIEELIMKIIKDLIAIDTILVIALILFSIYRGVDITEVIPFALVILIASIPVALPATFTIAMSLGALHMSKRGEIVTRLSAIEDAASMDTLCMDKTGTITENKLTIKTPKVYTGDELSLIKYASYASQRKSEDPIDDAILDYADLKSVKIDYANRSKFTPFDPSIKRTEAIINEAGKSVKIVKGAPQVISELTGNVPETYENDIKYFSSQGFRIISVAAGTDKLEILGVIPLYDPPRKDSRDLITELKQLSVSPVMITGDNSLIAEEVAGEIGLEKKLCNAENIKGNYAGASDCSVFAEVFPEDKYYIVKALQKSGHIVGMTGDGVNDSPALKQAEFGVAVASATDVAKASASVVLTHSGLTDIVDGIKSGRRIYQRMLTYTLNKIIKVIQIVFFLTLSFFVVGFFVTTAFDVILLIFANDFVTMAIATDNVGYSIKPERWNVNSLISSSVILAAFLVVESFIFLYIGLYAGLRISQIHTFIFDMLVFSGQFTVYMVRERKRFSNSMPSKILLLSSIVDIIIISFISYYGILVTAIPLKFILISIGLTFIWMVFMDTIKNVVFRHYKL
